United States Patent
Naudet et al.

(10) Patent No.: US 12,102,091 B2
(45) Date of Patent: Oct. 1, 2024

(54) CONTROL OF PLANT PESTS USING RNA MOLECULES

(71) Applicant: SYNGENTA CROP PROTECTION AG, Basel (CH)

(72) Inventors: Yann Naudet, Gent-Zwijnaarde (BE); Kaat Cappelle, Gent-Zwijnaarde (BE); Jennifer Diaz Gonzalez, Gent-Zwijnaarde (BE); Lies Degrave, Gent-Zwijnaarde (BE); Myriam Beghyn, Gent-Zwijnaarde (BE); Lien De Schrijver, Gent-Zwijnaarde (BE)

(73) Assignee: SYNGENTA CROP PROTECTION AG, Basel (CH)

( * ) Notice: Subject to any disclaimer, the term of this patent is extended or adjusted under 35 U.S.C. 154(b) by 551 days.

(21) Appl. No.: 17/275,460

(22) PCT Filed: Sep. 12, 2019

(86) PCT No.: PCT/US2019/050716
§ 371 (c)(1),
(2) Date: Mar. 11, 2021

(87) PCT Pub. No.: WO2020/056070
PCT Pub. Date: Mar. 19, 2020

(65) Prior Publication Data
US 2022/0408732 A1    Dec. 29, 2022

Related U.S. Application Data

(60) Provisional application No. 62/730,712, filed on Sep. 13, 2018.

(51) Int. Cl.
*A01N 63/60* (2020.01)
*C12N 15/113* (2010.01)
*A01P 7/04* (2006.01)

(52) U.S. Cl.
CPC ............ *A01N 63/60* (2020.01); *C12N 15/113* (2013.01); *A01P 7/04* (2021.08); *C12N 2310/14* (2013.01)

(58) Field of Classification Search
None
See application file for complete search history.

(56) References Cited

U.S. PATENT DOCUMENTS

| | | |
|---|---|---|
| 8,906,876 B2 | 12/2014 | Raemaekers et al. |
| 2012/0240288 A1 | 9/2012 | Ye et al. |
| 2015/0128303 A1 | 5/2015 | Raemaekers et al. |
| 2016/0230185 A1 | 8/2016 | Baum et al. |
| 2017/0121732 A1 | 5/2017 | Nibblet |

FOREIGN PATENT DOCUMENTS

| | | | |
|---|---|---|---|
| WO | 2007083193 A2 | 7/2007 | |
| WO | 2011153418 A2 | 12/2011 | |
| WO | 2016018887 A1 | 2/2016 | |
| WO | WO-2016105696 A1 * | 6/2016 | ............ A01N 57/16 |
| WO | 2017132330 A1 | 8/2017 | |

OTHER PUBLICATIONS

Fourgoux-Nicol et al. Plant Molecular Biology (1999), 40: 857-872.*
Thomas et al. Plant J. (2001), 25:417-425.*
Written Opinion of the International Authority and International Search Report for PCT Application No. PCT/US2019/050716 mailed Jan. 27, 2020.
Jason Lancaster et al., "De novo formation of an aggregation pheromone precursor by an isoprenyl diphosphate synthase-related terpene synthase in the harlequin bug", Proceedings of the National Academy of Sciences, Aug. 23, 2018, pp. 1-8, vol. 115, No. 37.
Kanakachari Mogilicherla et al: "Improving RNAi in the Brown Marmorated Stink Bug: Identification of target genes and reference genes for RT-qPCR", Scientific Reports, Feb. 27, 2018, pp. 1-9, vol. 8, No. 1.
Courtney Davis-Vogel et al: "Identification and comparison of key RNA interference machinery from western corn rootworm, fall armyworm, and southern green stink bug", PLOS One, Sep. 5, 2018, pp. 1-26, vol. 13, No. 9.
EPO; App. No. EP 19859213.1; Extended European Search Report mailed Sep. 23, 2022; pp. 1-21.
Bingsohn, L et al., Knockdown of genes in the Toll pathway reveals new lethal RNA interference targets for insect pest control, Insect Molecular Biology, vol. 26, No. 1, Nov. 15, 2016, pp. 92-102.
Fishilevich, Elaine et al., Use of chromatin remodeling ATPases as RNAi corn rootworm (*Diabrotica virgifera virgifera*) and Neotropical brown stink bug (*Euschistus heros*), Insects Biochemistry and Molecular Biology, vol. 71, Feb. 10, 2016, pp. 58-71.
Vallier, Agnes et al., RNAi in the cereal weevil *Sitophilus* spp: Systemic gene knockdown in the bacteriome tissue, BMV Biotechnology, vol. 9, No. 1, May 15, 2009, p. 44.
Zhao, Y.Y. et al., PsOr1, a potential target for RNA interference-based pest management, Insect Molecular Biology, vol. 20, No. 1, Sep. 21, 2010, pp. 97-104.
Partial Supplementary European Search Report for EP Application No. 19859213.1 dated May 25, 2022.

* cited by examiner

*Primary Examiner* — Medina A Ibrahim
(74) *Attorney, Agent, or Firm* — BakerHostetler; Toni-Junell Herbert

(57) ABSTRACT

Disclosed are double stranded RNA (dsRNA) molecules that are toxic to coleopteran and/or hemipteran insect pests. In particular, interfering RNA molecules capable of interfering with pest insect target genes and that are toxic to the target insect pest are provided. Further, methods of making and using the interfering RNA, for example in transgenic plants or as the active ingredient in an insecticidal composition, to confer protection from insect damage are disclosed.

10 Claims, No Drawings
Specification includes a Sequence Listing.

CONTROL OF PLANT PESTS USING RNA MOLECULES

CROSS-REFERENCE TO RELATED APPLICATIONS

This application is a 371 National Stage application of International Application No. PCT/US2019/050716 filed Sep. 12, 2019, which claims priority to U.S. Provisional Application Ser. No. 62/730,712 filed on Sep. 13, 2018, the contents of these applications are incorporated by reference herein in their entirety.

SEQUENCE LISTING

A Sequence Listing in ASCII text format, submitted under 37 C.F.R. § 1.821, entitled "81661-WO-REG-ORG-P-1_5 T25.txt," 21,222,639 bytes in size, generated on Aug. 5, 2019 and filed via EFS-Web is provided in lieu of a paper copy. This Sequence Listing is hereby incorporated by reference into the specification for its disclosures in its entirety.

FIELD OF THE INVENTION

The invention relates generally to the control of pests that cause damage to crop plants by their feeding activities, and more particularly to the control of coleopteran and hemipteran pests by compositions comprising interfering RNA molecules. The invention further relates to the compositions and to methods of using such compositions comprising the interfering RNA molecules.

BACKGROUND

Commercial crops are often attacked by invertebrate pests such as insects. Compositions for controlling insect infestations in plants have typically been in the form of chemical insecticides. Good insect control can thus be reached, but these chemicals can sometimes also affect other, beneficial insects. Additional problems occur in areas of high insecticide use where populations of pest insects have become resistant to certain insecticides. This has been partially alleviated by various resistance management practices, but there is an increasing need for alternative pest control agents.

Insecticidal compositions that include the bacteria *Bacillus thuringiensis* ("Bt") have been commercially available and used as environmentally safe and acceptable bio-insecticides for more than thirty years. The effectiveness of these compositions is due to insecticidal proteins (called "Cry proteins") that are produced during the sporulation phase of the bacteria's growth cycle. Cry proteins are primarily active against the larval stages of pest insects and not active against the adult stage. Several native Cry proteins from Bt, for example, Cry1Ab, Cry1F, Cry2Aa and Cry34/Cry35, or engineered Cry proteins, for example modified Cry3A (mCry3A) or eCry3.1Ab, have also been expressed in transgenic crop plants, for example corn, and exploited commercially to control certain lepidopteran and coleopteran insect pests.

With the increased use of transgenic plants expressing Cry proteins, there have now been some reports that populations of pest insects in certain geographies have become tolerant or resistant to certain Cry proteins. Therefore, identifying alternative insect control agents with new modes of action, i.e. different from existing chemical insecticides and Cry proteins, would be beneficial. In addition, new biological insect control agents that may be toxic to multiple life stages of the target insect pest would be useful. Such insect control agents may include those that target genetic elements, such as genes that are essential to the growth and/or survival of a target insect pest.

RNA interference (RNAi) is a well-established technique to regulate gene expression, for example to down regulate gene expression, by using double-stranded RNA (dsRNA) or small interfering RNA (siRNA) to trigger degradation of mRNA of a gene of interest, thus preventing translation of a protein. RNAi has not only provided a means of functionally analyzing genes, but has been used for the effective control of pests, in particular plant insect pests. RNAi occurs when an organism recognizes double-stranded RNA (dsRNA) molecules and hydrolyzes them. The resulting hydrolysis products are siRNA fragments of about 19-24 nucleotides in length. The siRNAs then diffuse or are carried throughout the organism, including across cellular membranes, where they hybridize to mRNAs (or other RNAs) and cause hydrolysis of the RNA. Interfering RNAs are recognized by the RNA interference silencing complex (RISC) into which an effector strand (or "guide strand") of the RNA is loaded. This guide strand acts as a template for the recognition and destruction of the duplex sequences. This process is repeated each time the siRNA hybridizes to its complementary-RNA target, effectively preventing those mRNAs from being translated, and thus "silencing" the expression of specific genes from which the mRNAs were transcribed. Most plant microRNAs (miRNAs) show extensive base pairing to, and guide cleavage of, their target mRNAs (Jones-Rhoades et al. (2006) *Annu. Rev. Plant Biol.* 57, 19-53; Llave et al. (2002) *Proc. Natl. Acad. Sci. USA* 97, 13401-13406). In other instances, interfering RNAs may bind to target RNA molecules having imperfect complementarity, causing translational repression without mRNA degradation. The majority of the animal miRNAs studied so far appear to function in this manner.

RNAi has been found to be useful for control of certain insect pests. RNAi strategies typically employ a synthesized, non-naturally occurring "interfering RNA", or "interfering RNA molecule" which typically comprises at least a RNA fragment against a target gene, a spacer sequence, and a second RNA fragment which is complementary to the first, so that a double-stranded RNA structure can be formed. This non-naturally occurring double-stranded RNA (dsRNA) takes advantage of the native RNAi pathways in the insect to trigger down-regulation of target genes that may lead to the cessation of feeding and/or growth and may result in the death of the insect pest.

Although it is known in the literature that RNAi strategies focused on certain target genes can lead to an insecticidal effect, for example in *Diabrotica* (corn rootworm) species, it is also known that not every target sequence is successful, and that an insecticidal effect cannot be predicted. For example, the overwhelming majority of sequences complementary to corn rootworm DNAs are not lethal in species of corn rootworm when used as dsRNA or siRNA. For example, Baum et al. ((2007) Nature Biotechnology 25:1322-1326), describe the effects of inhibiting several western corn rootworm (WCR) gene targets by RNAi. These authors reported that 8 of 26 target genes they tested were not able to provide experimentally significant WCR mortality, even at a very high iRNA (e.g., dsRNA) concentration of more than 520 ng/cm$^2$. Additionally, target genes against which a dsRNA molecule is known to give a strong RNAi effect in one insect species may not be a good target for different insect species. Whyard et al. ((2009) *Insect Biochemistry and Molecular Biology* 39: 824-832) report nearly 100-fold differences in efficacy when testing conspecific dsRNA molecules against a V-ATPase gene in four different insect species.

There is an ongoing need for compositions containing insecticidal active ingredients, and for methods of using such compositions, for instance for use in crop protection or insect-mediated disease control. Novel compositions are required to overcome the problem of resistance to existing insecticides and/or to help mitigate the development of resistance to existing transgenic plant approaches. Ideally such compositions have a high toxicity and are effective when ingested orally by the target pest and have applicability for use against the larval and/or adult stages of the pest insect. Thus any invention which provided compositions in which any of these properties was enhanced would represent a step forward in the art.

SUMMARY

The needs outlined above are met by the present invention which, in various embodiments, provides new compositions and methods of controlling economically important insect pests. More particularly, the invention provides compositions and methods of inhibiting expression of one or more target genes and proteins in coleopteran and/or hemipteran pests. More particularly, the invention encompasses compositions and methods of modulating expression of one or more target genes in coleopteran insect pests, such as *Sitophilus oryzae* (So; rice weevil), *Diabrotica virgifera virgifera* (Dv; western corn rootworm), *Diabrotica undecimpunctata howardi* (Du; southern corn rootworm), *Diabrotica barberi* (db; northern corn rootworm), *Phyllotreta armoraciae* (Pa; horseradish flea beetle), *Phyllotreta nemorum* (Pn; turnip flea beetle), *Phyllotreta cruciferae* (Pu; crucifer flea beetle), *Phyllotreta striolata* (Ps; striped flea beetle), *Phyllotreta atra* (Pt), *Psylliodes chrysocephala* (Pc; cabbage-stem flea beetle), *Meligethes aeneus* (Ma; pollen beetle), *Ceutorhynchus assimilis* (Ca; cabbage seedpod weevil), *Leptinotarsa decemlineata* (Ld; Colorado potato beetle), and/or in hemipteran insect pests, such as, *Nezara viridula* (Nv; green stink bug), *Euschistus heros* (Eh; brown stink bug), and *Piezodorus guildinii* (Pg; red-banded stink bug), and related species, that causes cessation of feeding, growth, development and reproduction, and eventually results in the death of the insect. A method of the invention comprises introduction of an interfering RNA molecule comprising a double-stranded RNA (dsRNA) or its modified forms such as small interfering RNA (siRNA) sequences, into cells or into the extracellular environment, such as the midgut, within a pest insect body wherein the dsRNA or siRNA enters the cells and inhibits expression of at least one or more target genes and wherein inhibition of the one or more target genes exerts a deleterious effect upon the pest insect. The interfering RNA molecule is non-naturally occurring. It is specifically contemplated that the methods and compositions of the invention will be useful in limiting or eliminating pest insect infestation in or on any plant by providing one or more compositions comprising interfering RNA molecules comprising dsRNA or siRNA molecules in the diet of the pest. The invention also provides interfering RNA molecules that, when delivered to a pest insect, inhibits through a toxic effect the ability of the pest insect to survive, grow, feed and/or reproduce, or to limit pest related feeding damage or loss to crop plants. Such delivery may be through production of the interfering RNA in a transgenic plant, for example corn, soybean, canola, rice, wheat and the like, or by topically applying a composition comprising the interfering RNA to a plant or plant seed, such as a corn plant or seed, or a soybean plant or seed, or a canola plant or seed, or a rice plant or seed, or a wheat plant or seed, and so forth. Delivery may further be through contacting the insect with the interfering RNA, such as when the insect feeds on plant material comprising the interfering RNA, either because the plant material is expressing the interfering RNA through a transgenic approach, or because the plant material is coated with a composition comprising the interfering RNA. The interfering RNA may also be provided in an artificial insect diet which the insect then contacts by feeding. The interfering RNA molecule comprises a nucleotide sequence that is complementary to a nucleotide sequence of a mRNA transcribable from a target gene or a portion of a nucleotide sequence of a mRNA transcribable from a target gene of the pest insect and therefore inhibits expression of the target gene, which causes cessation of feeding, growth, development, reproduction and eventually results in death of the pest insect. The invention is further drawn to nucleic acid constructs, nucleic acid molecules and recombinant vectors that comprise or encode at least a fragment of one strand of an interfering RNA molecule of the invention. The invention also provides chimeric nucleic acid molecules comprising an antisense strand of a dsRNA of the interfering RNA operably associated with a plant microRNA precursor molecule. The invention also provides artificial plant microRNA precursors comprising an antisense strand of a dsRNA of an interfering RNA of the invention.

In one aspect of the invention, an interfering ribonucleic acid (RNAi) molecule is provided wherein the RNAi molecule is encoded by a sequence comprising (a) any one of SEQ ID NOs:1-1814; (b) the complement of any one of SEQ ID NOs:1-1814; (c) at least 19 consecutive nucleotides of any one of SEQ ID NOs:1-1814; (d) the complement of at least 19 consecutive nucleotides of any one of SEQ ID NOs:1-1814; or (e) a sequence that hybridizes under stringent conditions with any of the aforementioned sequences, wherein said RNAi molecule post-transcriptionally silences an essential gene in a coleopteran and/or hemipteran pest insect.

In another aspect, the invention provides a double-stranded RNA (dsRNA) comprising annealed complementary strands, one strand of which comprises a sequence of at least 19 consecutive nucleotides which is wholly or partially complementary to a portion of a mRNA polynucleotide transcribable from a pest insect target gene, wherein the pest insect target gene comprises a coding sequence having from at least 90% to at least 99% identity to any one of SEQ ID NOs:1-1814, and wherein the strand of RNA having complementarity to said target gene is toxic to a coleopteran and/or hemipteran insect pest.

In another aspect of the invention, the RNAi or dsRNA is complementary to a portion of a target gene comprising any one of SEQ ID NOs:1815-3628.

In still another aspect of the invention, the RNAi or dsRNA comprises a nucleotide fragment that has at least 85% identity (e.g., at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, at least 100% identity) to any one of SEQ ID NOs:3629-5442. In one embodiment of this aspect the RNAi or dsRNA comprises any one of SEQ ID NOs:3629-5442.

In other aspect of the invention, the interfering RNA molecule has insecticidal activity on a coleopteran and/or a hemipteran plant pest. In some embodiments, the interfering molecule may comprise at least two dsRNAs, wherein each dsRNA comprises a sequence of nucleotides which is at least partially complementary to a target nucleotide sequence within the target gene. In further embodiments, each of the dsRNAs may comprise a different sequence of nucleotides which is complementary to a different target nucleotide sequence within the target gene.

The invention further provides compositions comprising one or more interfering RNA molecules comprising two or more of dsRNA molecules, wherein the two or more RNA molecules each comprise a different antisense strand, or comprising two or more nucleic acid constructs or nucleic acid molecules or artificial plant microRNA precursors of the invention.

The invention further provides insecticidal compositions for inhibiting the expression of a coleopteran and/or a hemipteran pest insect gene that comprises a dsRNA of the invention and an agriculturally acceptable carrier. In some embodiments, the coleopteran insect pest is selected from the group consisting of *Sitophilus oryzae* (So; rice weevil), *Diabrotica virgifera virgifera* (Dv; western corn rootworm), *Diabrotica undecimpunctata howardi* (Du; southern corn rootworm), *Diabrotica barberi* (db; northern corn rootworm), *Phyllotreta armoraciae* (Pa; horseradish flea beetle), *Phyllotreta nemorum* (Pn; turnip flea beetle), *Phyllotreta cruciferae* (Pu; crucifer flea beetle), *Phyllotreta striolata* (Ps; striped flea beetle), *Phyllotreta atra* (Pt), *Psylliodes chrysocephala* (Pc; cabbage-stem flea beetle), *Meligethes aeneus* (Ma; pollen beetle), *Ceutorhynchus assimilis* (Ca; cabbage seedpod weevil), *Leptinotarsa decemlineata* (Ld; Colorado potato beetle), and/or the hemipteran insect pest is selected from the group consisting of *Nezara viridula* (Nv; green stink bug), *Euschistus heros* (Eh; brown stink bug), and *Piezodorus guildinii* (Pg; red-banded stink bug). In some embodiments, inhibition of the expression of a target gene in a target insect pest of the invention leads to cessation of feeding and growth and ultimately results in the death of the target insect pest of the invention.

The invention is further drawn to transgenic plants which produce one or more interfering RNA molecules of the invention that are self-protected from insect feeding damage and to methods of using the plants alone or in combination with other insect control strategies to confer maximal insect control capabilities. Plants and/or plant parts producing one or more interfering RNA molecules of the invention or treated with a composition comprising one or more interfering RNA molecules of the invention are highly resistant to insect pest infestation. For example, economically important coleopteran pests can be controlled by a plant that produces an interfering RNA molecule of the invention or by a plant or plant seed that is treated with a composition comprising an interfering RNA molecule of the invention.

The invention also provides a method of controlling a coleopteran and/or hemipteran insect plant pest comprising contacting the coleopteran and/or hemipteran insect pest with a nucleic acid molecule that is or is capable of producing an interfering RNA of the invention for inhibiting expression of a gene in the coleopteran and/or hemipteran insect pest thereby controlling the coleopteran and/or hemipteran insect pest. In some aspects, the coleopteran insect pest is selected from the group consisting of the coleopteran insect pest is selected from the group consisting of *Sitophilus oryzae* (So; rice weevil), *Diabrotica virgifera virgifera* (Dv; western corn rootworm), *Diabrotica undecimpunctata howardi* (Du; southern corn rootworm), *Diabrotica barberi* (db; northern corn rootworm), *Phyllotreta armoraciae* (Pa; horseradish flea beetle), *Phyllotreta nemorum* (Pn; turnip flea beetle), *Phyllotreta cruciferae* (Pu; crucifer flea beetle), *Phyllotreta striolata* (Ps; striped flea beetle), *Phyllotreta atra* (Pt), *Psylliodes chrysocephala* (Pc; cabbage-stem flea beetle), *Meligethes aeneus* (Ma; pollen beetle), *Ceutorhynchus assimilis* (Ca; cabbage seedpod weevil), *Leptinotarsa decemlineata* (Ld; Colorado potato beetle), and/or the hemipteran insect pest is selected from the group consisting of *Nezara viridula* (Nv; green stink bug), *Euschistus heros* (Eh; brown stink bug), and *Piezodorus guildinii* (Pg; red-banded stink bug).

In other aspects, the invention provides a method of reducing an insect pest population on a transgenic plant expressing a second insecticidal agent, for example an insecticidal protein, in addition to an interfering RNA of the invention capable of inhibiting expression of an target gene in an insect pest, thereby reducing the pest insect population. The second insecticidal agent may be an insecticidal protein derived from *Bacillus thuringiensis*. A *B. thuringiensis* insecticidal protein can be any of a number of insecticidal proteins including but not limited to a Cry1 protein, a Cry3 protein, a Cry7 protein, a Cry8 protein, a Cry11 protein, a Cry22 protein, a Cry 23 protein, a Cry 36 protein, a Cry37 protein, a Cry34 protein together with a Cry35 protein, a binary insecticidal protein CryET33 and CryET34, a binary insecticidal protein TIC100 and TIC101, a binary insecticidal protein PS149B1, a VIP, a TIC900 or related protein, a TIC901, TIC1201, TIC407, TIC417, a modified Cry3A protein, or hybrid proteins or chimeras made from any of the preceding insecticidal proteins. In other embodiments, the *B. thuringiensis* insecticidal protein is selected from the group consisting of Cry3Bb1, Cry34Ab1 together with Cry35Ab1, mCry3A and eCry3.1Ab.

In other embodiments, the second insecticidal agent may be derived from sources other than *B. thuringiensis*. The second insecticidal agent can be an agent selected from the group comprising a patatin, a protease, a protease inhibitor, a urease, an alpha-amylase inhibitor, a pore-forming protein, a chitinase, a lectin, an engineered antibody or antibody fragment, a *Bacillus cereus* insecticidal protein, a *Xenorhabdus* spp. (such as *X. nematophila* or *X. bovienii*) insecticidal protein, a *Photorhabdus* spp. (such as *P. luminescens* or *P. asymobiotica*) insecticidal protein, a *Brevibacillus laterosporous* insecticidal protein, a *Lysinibacillus sphearicus* insecticidal protein, a *Chromobacterium* spp. insecticidal protein, a *Yersinia entomophaga* insecticidal protein, a *Paenibacillus popiliae* insecticidal protein, a *Clostridium* spp. (such as *C. bifermentans*) insecticidal protein, and a lignin. In other embodiments, the second agent may be at least one insecticidal protein derived from an insecticidal toxin complex (Tc) from *Photorhabdus, Xenorhabus, Serratia*, or *Yersinia*. In other embodiments, the insecticidal protein may be an ADP-ribosyltransferase derived from an insecticidal bacteria, such as *Photorhabdus* spp. In other embodiments, the insecticidal protein may be a VIP protein, such as VIP1 or VIP2 from *B. cereus*. In still other embodiments, the insecticidal protein may be a binary toxin derived from an insecticidal bacteria, such as ISP1A and ISP2A from *B. laterosporous* or BinA and BinB from *L sphaericus*. In still other embodiments, the insecticidal protein may be engineered or may be a hybrid or chimera of any of the preceding insecticidal proteins.

In other aspects, the invention provides a method of reducing resistance development in a pest insect population to an interfering RNA of the invention, the method comprising expressing in a transgenic plant fed upon by the pest insect population an interfering RNA of the invention that is capable of inhibiting expression of a target gene in a larval and adult insect pest, thereby reducing resistance development in the pest insect population compared to a pest insect population exposed to an interfering RNA capable of inhibiting expression of a pest insect gene described herein in only the larval stage or adult stage of an insect pest.

In other aspects, the invention provides a method of reducing the level of a target RNA transcribable from a pest insect target gene described herein in an insect comprising contacting the pest insect with a composition comprising an interfering RNA molecule of the invention, wherein the interfering RNA molecule reduces the level of the target RNA in a cell of the pest insect.

In still other aspects, the invention provides a method of conferring pest insect, particularly coleopteran and/or hemipteran pest insect, tolerance to a plant, or part thereof, comprising introducing into the plant, or part thereof, an interfering RNA molecule, a dsRNA molecule, a nucleic acid construct, a chimeric nucleic acid molecule, an artificial plant microRNA precursor molecule and/or a composition of the invention, thereby conferring to the plant or part thereof tolerance to the coleopteran and/or hemipteran pest insect.

In further aspects, the invention provides a method of reducing root damage to a plant fed upon by a *Diabrotica* insect, comprising introducing into cells of the plant an interfering RNA molecule, a dsRNA, a nucleic acid molecule, a nucleic acid construct, a chimeric nucleic acid molecule, an artificial plant microRNA precursor molecule and/or a composition of the invention, thereby reducing root damage to the plant fed upon by a *Diabrotica* insect.

In other aspects, the invention provides a method of producing a transgenic plant cell having toxicity to a coleopteran and/or hemipteran pest insect, comprising introducing into a plant cell an interfering RNA molecule, a dsRNA, a nucleic acid molecule, a nucleic acid construct, a chimeric nucleic acid molecule, an artificial plant microRNA precursor molecule and/or a composition of the invention, thereby producing the transgenic plant cell having toxicity to the coleopteran and/or hemipteran insect compared to a control plant cell (e.g., a plant cell not comprising the interfering RNA molecule, the dsRNA, the nucleic acid molecule, the nucleic acid construct, the chimeric nucleic acid molecule, the artificial plant microRNA precursor molecule and/or the composition of the invention).

In further aspects, the invention provides a method of producing a transgenic plant having enhanced tolerance to coleopteran and/or hemipteran pest insect feeding damage, comprising introducing into a plant an interfering RNA molecule, a dsRNA, a nucleic acid molecule, a nucleic acid construct, a chimeric nucleic acid molecule, an artificial plant microRNA precursor molecule and/or a composition of the invention, thereby producing a transgenic plant having enhanced tolerance to coleopteran and/or hemipteran pest insect feeding damage compared to a control plant (e.g., a plant not comprising the interfering RNA molecule, the dsRNA, the nucleic acid molecule, the nucleic acid construct, the chimeric nucleic acid molecule, the artificial plant microRNA precursor molecule and/or the composition of the invention).

In other aspects, the invention provides a method of enhancing control of a coleopteran and/or hemipteran insect population comprising providing a transgenic plant or transgenic seed of the invention and applying to the transgenic plant or the transgenic seed a chemical pesticide that is insecticidal to a coleopteran and/or hemipteran insect, thereby enhancing control of the coleopteran and/or hemipteran insect population.

In other aspects, the invention provides a method of providing a corn grower with a means of controlling a coleopteran and/or hemipteran insect pest population below an economic threshold in a corn crop comprising (a) selling or providing to the grower transgenic corn seed comprising a dsRNA, a nucleic acid molecule, a nucleic acid construct, a chimeric nucleic acid molecule, an artificial plant microRNA precursor molecule and/or a composition of the invention; and (b) advertising to the grower that the transgenic corn seed produces transgenic corn plants capable of controlling a coleopteran and/or hemipteran insect pest population.

In another aspect, the invention provides a method of identifying an orthologous target gene for using as a RNAi strategy for the control of a plant pest, said method comprising the steps of: a) producing a primer pair that will amplify a target selected from the group comprising or consisting of SEQ ID NOs:7257-10884, or a complement thereof; b) amplifying an orthologous target gene from a nucleic acid sample of the plant pest; c) identifying a sequence of an orthologous target gene; d) producing an interfering RNA molecule, wherein the RNA comprises at least one dsRNA, wherein the dsRNA is a region of double-stranded RNA comprising annealed complementary strands, one strand of which comprises a sequence of at least 19 consecutive nucleotides which is at least partially complementary to the orthologous target nucleotide sequence within the target gene; and e) determining if the interfering RNA molecule of step (d) has insecticidal activity on the plant pest. If the interfering RNA has insecticidal activity on the plant pest target gene, an orthologous target gene for using in the control of a plant pest has been identified.

These and other aspects of the invention are set forth in more detail in the description of the invention below.

BRIEF DESCRIPTION OF THE SEQUENCES IN THE SEQUENCE LISTING

SEQ ID NOs:1-1814 are coding sequences of target genes from pest insects of the invention.

SEQ ID NOs:1815-3628 are fragments of DNA coding sequences from target genes (SEQ ID Nos:1-1814, respectively) used to synthesize interfering RNA molecules to test for insecticidal activity.

SEQ ID NOs:3629-5442 are RNA sequences of the fragments of the DNA coding sequences (SEQ ID NOs:1815-3628, respectively) used to synthesize interfering RNA molecules to test for insecticidal activity.

SEQ ID NO:5443-7256 are RNA sequences of the complete DNA coding sequences of the 112 target genes of SEQ ID NOs:1-1814, respectively.

SEQ ID NOs:7257-10884 are nucleotide sequences of forward and reverse primer pairs used to identify target genes (SEQ ID NOs:1-1814, respectively) from pest insects of the invention.

SEQ ID NOs:10885-12698 are amino acid sequences encoded by the target gene coding sequences (SEQ ID NOs:1-1814, respectively) from pest insects of the invention.

DETAILED DESCRIPTION

The following is a detailed description of the invention provided to aid those skilled in the art in practicing the invention. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. In addition, numerous variations and additions to the various embodiments of the invention will be apparent to those skilled in the art in light of the instant disclosure, which do not depart from the invention. Hence, the following descriptions are intended to illustrate some particular embodiments of the invention, and not to exhaustively specify all permutations, combinations and variations thereof. Those of ordinary skill in the art will recognize that modifications and variations in the embodiments described herein may be made without departing from the spirit or scope of the invention.

Definitions

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention. All publications, patent applications, patents, and other references mentioned herein are incorporated by reference in their entirety.

For clarity, certain terms used in the specification are defined and presented as follows:

As used herein, "a," "an" or "the" can mean one or more than one. For example, "a cell" can mean a single cell or a multiplicity of cells.

As used herein, "and/or" refers to and encompasses any and all possible combinations of one or more of the associated listed items, as well as the lack of combinations when interpreted in the alternative, "or."

Further, the term "about," as used herein when referring to a measurable value such as an amount of a compound or agent, dose, time, temperature, and the like, is meant to encompass variations of ±20%, ±10%, ±5%, ±1%, ±0.5%, or even ±0.1% of the specified amount.

The term "chimeric construct" or "chimeric gene" or "chimeric polynucleotide" or "chimeric nucleic acid" (or similar terms) as used herein refers to a construct or molecule comprising two or more polynucleotides of different origin assembled into a single nucleic acid molecule. The term "chimeric construct", "chimeric gene", "chimeric polynucleotide" or "chimeric nucleic acid" refers to any construct or molecule that contains, without limitation, (1) polynucleotides (e.g., DNA), including regulatory and coding polynucleotides that are not found together in nature (i.e., at least one of the polynucleotides in the construct is heterologous with respect to at least one of its other polynucleotides), or (2) polynucleotides encoding parts of proteins not naturally adjoined, or (3) parts of promoters that are not naturally adjoined. Further, a chimeric construct, chimeric gene, chimeric polynucleotide or chimeric nucleic acid may comprise regulatory polynucleotides and coding polynucleotides that are derived from different sources, or comprise regulatory polynucleotides and coding polynucleotides derived from the same source, but arranged in a manner different from that found in nature. In some embodiments of the invention, the chimeric construct, chimeric gene, chimeric polynucleotide or chimeric nucleic acid comprises an expression cassette comprising a polynucleotide of the invention under the control of regulatory polynucleotides, particularly under the control of regulatory polynucleotides functional in plants or bacteria.

A "coding sequence" is a nucleic acid sequence that is transcribed into RNA such as mRNA, rRNA, tRNA, snRNA, sense RNA or antisense RNA. Preferably the RNA is then translated in an organism to produce a protein.

As used herein, a "codon optimized" sequence means a nucleotide sequence wherein the codons are chosen to reflect the particular codon bias that a host cell or organism may have. This is typically done in such a way so as to preserve the amino acid sequence of the polypeptide encoded by the nucleotide sequence to be optimized. In certain embodiments, the DNA sequence of the recombinant DNA construct includes sequence that has been codon optimized for the cell (e.g., an animal, plant, or fungal cell) in which the construct is to be expressed. For example, a construct to be expressed in a plant cell can have all or parts of its sequence (e.g., the first gene suppression element or the gene expression element) codon optimized for expression in a plant. See, for example, U.S. Pat. No. 6,121,014, incorporated herein by reference.

The terms "complementary" or "complementarity," refer to the natural binding of polynucleotides under permissive salt and temperature conditions by base-pairing. Complementarity between two single-stranded molecules may be "partial," in which only some of the nucleotides bind, or it may be complete when total complementarity exists between the single stranded molecules. The degree of complementarity between nucleic acid strands has significant effects on the efficiency and strength of hybridization between nucleic acid strands. Complementary polynucleotides are those that are capable of base pairing according to the standard Watson-Crick complementarity rules. Specifically, purines will base pair with pyrimidines to form a combination of guanine paired with cytosine (G:C) and adenine paired with either thymine (A:T) in the case of DNA, or adenine paired with uracil (A:U) in the case of RNA. For example, the sequence "A-G-T" binds to the complementary sequence "T-C-A." It is understood that two polynucleotides may hybridize to each other even if they are not completely complementary to each other, provided that each has at least one region that is substantially complementary to the other.

As used herein, the terms "substantially complementary" or "partially complementary" mean that two nucleic acid sequences are complementary at least about 50%, 60%, 70%, 80% or 90% of their nucleotides. In some embodiments, the two nucleic acid sequences can be complementary at least at 85%, 90%, 95%, 96%, 97%, 98%, 99% or more of their nucleotides. The terms "substantially complementary" and "partially complementary" can also mean that two nucleic acid sequences can hybridize under high stringency conditions and such conditions are well known in the art.

To "control" insects means to inhibit, through a toxic effect, the ability of insect pests to survive, grow, feed, or reproduce, or to limit insect-related damage or loss in crop plants or to protect the yield potential of a crop when grown in the presence of insect pests. To "control" insects may or may not mean killing the insects, although it preferably means killing the insects.

The terms "comprises" or "comprising," when used in this specification, specify the presence of stated features, integers, steps, operations, elements, or components, but do not preclude the presence or addition of one or more other features, integers, steps, operations, elements, components, or groups thereof.

As used herein, the transitional phrase "consisting essentially of" (and grammatical variants) means that the scope of a claim is to be interpreted to encompass the specified materials or steps recited in the claim and those that do not materially alter the basic and novel characteristic(s) of the claimed invention. Thus, the term "consisting essentially of" when used in a claim of this invention is not intended to be interpreted to be equivalent to "comprising."

To "deliver" a composition or toxic protein means that the composition or toxic protein comes in contact with an insect, which facilitates the oral ingestion of the composition or toxic protein, resulting in a toxic effect and control of the insect. The composition or toxic protein can be delivered in many recognized ways, including but not limited to, transgenic plant expression, formulated protein composition(s), sprayable protein composition(s), a bait matrix, or any other art-recognized protein delivery system.

"Effective insect-controlling amount" means that concentration of a toxic protein that inhibits, through a toxic effect, the ability of insects to survive, grow, feed or reproduce, or limits insect-related damage or loss in crop plants or protects the yield potential of a crop when grown in the presence of insect pests. "Effective insect-controlling amount" may or may not mean killing the insects, although it preferably means killing the insects.

"Expression cassette" as used herein means a nucleic acid molecule capable of directing expression of at least one polynucleotide of interest, such as a polynucleotide that encodes an interfering RNA molecule and/or a Cry protein of the invention, in an appropriate host cell, comprising a promoter operably linked to the polynucleotide of interest which is operably linked to a termination signal. An "expression cassette" also typically comprises additional polynucleotides required for proper translation of the polynucleotide of interest. The expression cassette may also comprise other polynucleotides not necessary in the direct expression of a polynucleotide of interest but which are present due to convenient restriction sites for removal of the cassette from an expression vector. The expression cassette comprising the polynucleotide(s) of interest may be chimeric, meaning that at least one of its components is heterologous with respect to at least one of its other components. The expression cassette may also be one that is naturally occurring but has been obtained in a recombinant form useful for heterologous expression. Typically, however, the expression cassette is heterologous with respect to the host, i.e. the polynucleotide of interest in the expression cassette does not occur naturally in the host cell and must have been introduced into the host cell or an ancestor of the host cell by a transformation process or a breeding process. The expression of the polynucleotide(s) of interest in the expression cassette is generally under the control of a promoter. In the case of a multicellular organism, such as a plant, the promoter can also be specific or preferential to a particular tissue, or organ, or stage of development. An expression cassette, or fragment thereof, can also be referred to as "inserted polynucleotide" or "insertion polynucleotide" when transformed into a plant.

A "gene" is a defined region that is located within a genome and that, besides the aforementioned coding sequence, comprises other, primarily regulatory nucleic acid sequences responsible for the control of the expression, that is to say the transcription and translation, of the coding portion. A gene may also comprise other 5' and 3' untranslated sequences and termination sequences. Further elements that may be present are, for example, introns.

The term "heterologous" when used in reference to a gene or a polynucleotide or a polypeptide refers to a gene or a polynucleotide or a polypeptide that is or contains a part thereof not in its natural environment (i.e., has been altered by the hand of man) For example, a heterologous gene may include a polynucleotide from one species introduced into another species. A heterologous gene may also include a polynucleotide native to an organism that has been altered in some way (e.g., mutated, added in multiple copies, linked to a non-native promoter or enhancer polynucleotide, etc.). Heterologous genes further may comprise plant gene polynucleotides that comprise cDNA forms of a plant gene; the cDNAs may be expressed in either a sense (to produce mRNA) or anti-sense orientation (to produce an anti-sense RNA transcript that is complementary to the mRNA transcript). In one aspect of the invention, heterologous genes are distinguished from endogenous plant genes in that the heterologous gene polynucleotide are typically joined to polynucleotides comprising regulatory elements such as promoters that are not found naturally associated with the gene for the protein encoded by the heterologous gene or with plant gene polynucleotide in the chromosome, or are associated with portions of the chromosome not found in nature (e.g., genes expressed in loci where the gene is not normally expressed). Further, a "heterologous" polynucleotide refers to a polynucleotide not naturally associated with a host cell into which it is introduced, including non-naturally occurring multiple copies of a naturally occurring polynucleotide.

"Insecticidal" is defined as a toxic biological activity capable of controlling insects, preferably by killing them.

The term "isolated" nucleic acid molecule, polynucleotide or protein is a nucleic acid molecule, polynucleotide or protein that no longer exists in its natural environment. An isolated nucleic acid molecule, polynucleotide or protein of the invention may exist in a purified form or may exist in a recombinant host such as in a transgenic bacteria or a transgenic plant. Therefore, a claim to an "isolated" nucleic acid molecule, as enumerated herein, encompasses a nucleic acid molecule when the nucleic acid molecule is comprised within a transgenic plant genome.

The term "homology" in the context of the invention refers to the level of similarity between nucleic acid or amino acid sequences in terms of nucleotide or amino acid identity or similarity, respectively, i.e., sequence similarity or identity. Homology, homologue, and homologous also refers to the concept of similar functional properties among different nucleic acids or proteins. Homologues include genes that are orthologous and paralogous. Homologues can be determined by using the coding sequence for a gene, disclosed herein or found in appropriate database (such as that at NCBI or others) in one or more of the following ways. For an amino acid sequence, the sequences should be compared using algorithms (for instance see section on "identity" and "substantial identity"). For nucleotide sequences the sequence of one DNA molecule can be compared to the sequence of a known or putative homologue in much the same way. Homologues are at least 20% identical, or at least 30% identical, or at least 40% identical, or at least 50% identical, or at least 60% identical, or at least 70% identical, or at least 80% identical, or at least 88% identical, or at least 90% identical, or at least 92% identical, or at least 95% identical, across any substantial region of the molecule (DNA, RNA, or protein molecule).

The terms "sequence similarity" or "sequence identity" of nucleotide or amino acid sequences mean a degree of identity or similarity of two or more sequences and may be determined conventionally by using known software or computer programs such as the Best-Fit or Gap pairwise comparison programs (GCG Wisconsin Package, Genetics Computer Group, 575 Science Drive, Madison, Wis. 53711). BestFit uses the local homology algorithm of Smith and Waterman, Advances in Applied Mathematics 2:482-489 (1981), to find the best segment of identity or similarity between two sequences. Sequence comparison between two or more polynucleotides or polypeptides is generally performed by comparing portions of the two sequences over a comparison window to identify and compare local regions of sequence similarity. The comparison window is generally from about 20 to 200 consecutive nucleotides. Gap performs global alignments: all of one sequence with all of another similar sequence using the method of Needleman and Wunsch, J. Mol. Biol. 48:443-453 (1970). When using a sequence alignment program such as BestFit to determine the degree of DNA sequence homology, similarity or identity, the default setting may be used, or an appropriate scoring matrix may be selected to optimize identity, similarity or homology scores. Similarly, when using a program such as BestFit to determine sequence identity, similarity or homology between two different amino acid sequences, the default settings may be used, or an appropriate scoring matrix, such as blosum45 or blosum80, may be selected to optimize identity, similarity or homology scores.

The phrase "substantially identical," in the context of two nucleic acids or two amino acid sequences, refers to two or more sequences or subsequences that have at least about 50% nucleotide or amino acid residue identity when compared and aligned for maximum correspondence as measured using one of the following sequence comparison algorithms or by visual inspection. In certain embodiments, substantially identical sequences have at least about 60%, or at least about 70%, or at least about 80%, or even at least about 90% or 95% nucleotide or amino acid residue identity. In certain embodiments, substantial identity exists over a region of the sequences that is at least about 50 residues in length, or over a region of at least about 100 residues, or the sequences are substantially identical over at least about 150 residues. In further embodiments, the sequences are substantially identical when they are identical over the entire length of the coding regions.

Optimal alignment of sequences for comparison can be conducted, e.g., by the local homology algorithm of Smith & Waterman, *Adv. Appl. Math.* 2: 482 (1981), by the homology alignment algorithm of Needleman & Wunsch, *J. Mol. Biol.* 48: 443 (1970), by the search for similarity method of Pearson & Lipman, *Proc. Nat'l. Acad. Sci. USA* 85: 2444 (1988), by computerized implementations of these algorithms (GAP, BESTFIT, FASTA, and TFASTA in the Wisconsin Genetics Software Package, Genetics Computer Group, 575 Science Dr., Madison, WI), or by visual inspection (see generally, Ausubel et al., infra).

One example of an algorithm that is suitable for determining percent sequence identity and sequence similarity is the BLAST algorithm, which is described in Altschul et al., *J. Mol. Biol.* 215: 403-410 (1990). Software for performing BLAST analyses is publicly available through the National Center for Biotechnology Information (http://www.ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., 1990). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=-4, and a comparison of both strands. For amino acid sequences, the BLASTP program uses as defaults a wordlength (W) of 3, an expectation (E) of 10, and the BLOSUM62 scoring matrix (see Henikoff & Henikoff, *Proc. Natl. Acad. Sci. USA* 89: 10915 (1989)).

In addition to calculating percent sequence identity, the BLAST algorithm also performs a statistical analysis of the similarity between two sequences (see, e.g., Karlin & Altschul, *Proc. Nat'l. Acad. Sci. USA* 90: 5873-5787 (1993)). One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleic acid sequence to the reference nucleic acid sequence is less than about 0.1, more preferably less than about 0.01, and most preferably less than about 0.001.

Another widely used and accepted computer program for performing sequence alignments is CLUSTALW v1.6 (Thompson, et al. Nuc. Acids Res., 22: 4673-4680, 1994). The number of matching bases or amino acids is divided by the total number of bases or amino acids, and multiplied by 100 to obtain a percent identity. For example, if two 580 base pair sequences had 145 matched bases, they would be 25 percent identical. If the two compared sequences are of different lengths, the number of matches is divided by the shorter of the two lengths. For example, if there were 100 matched amino acids between a 200 and a 400 amino acid proteins, they are 50 percent identical with respect to the shorter sequence. If the shorter sequence is less than 150 bases or 50 amino acids in length, the number of matches are divided by 150 (for nucleic acid bases) or 50 (for amino acids), and multiplied by 100 to obtain a percent identity.

Two nucleotide sequences can also be considered to be substantially identical when the two sequences hybridize to each other under stringent conditions. In representative embodiments, two nucleotide sequences considered to be substantially identical hybridize to each other under highly stringent conditions.

The terms "stringent conditions" or "stringent hybridization conditions" include reference to conditions under which a polynucleotide will hybridize to its target sequence to a detectably greater degree than other sequences (e.g., at least 2-fold over background). Stringent conditions are sequencedependent and will be different in different circumstances. By controlling the stringency of the hybridization and/or washing conditions, target polynucleotides can be identified which are 100% complementary to the probe (homologous probing). Alternatively, stringency conditions can be adjusted to allow some mismatching in sequences so that lower degrees of similarity are detected (heterologous probing). Typically, stringent conditions will be those in which the salt concentration is less than approximately 1.5 M Na ion, typically about 0.01 to 1.0 M Na ion (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions also may be achieved with the addition of destabilizing agents such as formamide. Exemplary low stringency conditions include hybridization with a buffer solution of 30 to 35% formamide, 1 M NaCl, 1% SDS (w/v; sodium dodecyl sulphate) at 37° C., and a wash in 1× to 2×SSC (20×SSC=3.0 M NaCl/0.3 M trisodium citrate) at 50 to 55° C. Moderate stringency conditions detect sequences that share at least 80% sequence identity. Exemplary moderate stringency conditions include hybridization in 40 to 45% formamide, 1 M NaCl, 1% SDS at 37° C., and a wash in 0.5× to 1×SSC at 55 to 60° C. High stringency conditions detect sequences that share at least 90% sequence identity. Exemplary high stringency conditions include hybridization in 50% formamide, 1 M NaCl, 1% SDS at 37° C., and a wash in 0.1×SSC at 60 to 65° C. Specificity is typically the function of post-hybridization washes, the critical factors being the ionic strength and temperature of the final wash solution. For DNA-DNA hybrids, the Tm can be approximated from the equation of Meinkoth and Wahl (Anal. Biochem., 138:267-284, 1984): Tm=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The Tm is the temperature (under defined ionic strength and pH) at which 50% of a complementary target sequence hybridizes to a perfectly matched probe. Tm is reduced by about 1° C. for each 1% of mismatching; thus, Tm, hybridization and/or wash conditions can be adjusted to hybridize to sequences of the desired identity. For example, if sequences with approximately 90% identity are sought, the Tm can be decreased 10° C. Generally, stringent conditions are selected to be about 5° C. lower than the thermal melting point (Tm) for the specific sequence and its complement at a defined ionic strength and pH. However, severely stringent conditions can utilize hybridization and/or wash at 1, 2, 3, or 4° C. lower than the thermal melting point (Tm); moderately stringent conditions can utilize a hybridization and/or wash at 6, 7, 8, 9, or 10° C. lower than the thermal melting point (Tm); low stringency conditions can utilize a hybridization and/or wash at 11, 12, 13, 14, 15, or 20° C. lower than the thermal melting point (Tm). Using the equation, hybridization and wash compositions, and desired Tm, those of ordinary skill will understand that variations in the stringency of hybridization and/or wash solutions are inherently described. If the desired degree of mismatching results in a Tm of less than 45° C. (aqueous solution) or 32° C. (formamide solution), it is preferred to increase the SSC concentration so that a higher temperature can be used. An extensive guide to the hybridization of nucleic acids is found in Tijssen, Laboratory Techniques in Biochemistry and Molecular Biology—Hybridization with Nucleic Acid Probes, Part I, Chapter 2 "Overview of principles of hybridization and the strategy of nucleic acid probe assays", Elsevier, N.Y. (1993); and Current Protocols in Molecular Biology, Chapter 2, Ausubel, et al., eds., Greene Publishing and Wiley-Interscience, New York (1995). Methods of stringent hybridization are known in the art which conditions can be calculated by means known in the art. This is disclosed in Sambrook et al., Molecular Cloning: A Laboratory Manual, 2nd Ed., Cold Spring Harbor Laboratory Press, 1989, Cold Spring Harbor, N.Y. and Current Protocols in Molecular Biology, Ausebel et al, eds., John Wiley and Sons, Inc., 2000. Methods of determining percent sequence identity are known in the art, an example of which is the GCG computer sequence analysis software (GCG, Inc, Madison Wis.).

Nucleic acids that do not hybridize to each other under stringent conditions are still substantially identical if the proteins that they encode are substantially identical (e.g., due to the degeneracy of the genetic code).

A further indication that two nucleic acids or proteins are substantially identical is that the protein encoded by the first nucleic acid is immunologically cross reactive with the protein encoded by the second nucleic acid. Thus, a protein is typically substantially identical to a second protein, for example, where the two proteins differ only by conservative substitutions.

A nucleic acid sequence is "isocoding with" a reference nucleic acid sequence when the nucleic acid sequence encodes a polypeptide having the same amino acid sequence as the polypeptide encoded by the reference nucleic acid sequence.

As used herein, "dsRNA" or "RNAi" refers to a polyribonucleotide structure formed either by a single self-complementary RNA strand or at least by two complementary RNA strands. The degree of complementary, in other words the % identity, need not necessarily be 100%. Rather, it must be sufficient to allow the formation of a double-stranded structure under the conditions employed. As used herein, the term "fully complementary" means that all the bases of the nucleotide sequence of the dsRNA are complementary to or 'match' the bases of the target nucleotide sequence. The term "at least partially complementary" means that there is less than a 100% match between the bases of the dsRNA and the bases of the target nucleotide sequence. The skilled person will understand that the dsRNA need only be at least partially complementary to the target nucleotide sequence in order to mediate down-regulation of expression of the target gene. It is known in the art that RNA sequences with insertions, deletions and mismatches relative to the target sequence can still be effective at RNAi. According to the current invention, it is preferred that the dsRNA and the target nucleotide sequence of the target gene share at least 80% or 85% sequence identity, preferably at least 90% or 95% sequence identity, or more preferably at least 97% or 98% sequence identity and still more preferably at least 99% sequence identity. Alternatively, the dsRNA may comprise 1, 2 or 3 mismatches as compared with the target nucleotide sequence over every length of 24 partially complementary nucleotides. It will be appreciated by the person skilled in the art that the degree of complementarity shared between the dsRNA and the target nucleotide sequence may vary depending on the target gene to be down-regulated or depending on the insect pest species in which gene expression is to be controlled.

It will be appreciated that the dsRNA may comprise or consist of a region of double-stranded RNA comprising annealed complementary strands, one strand of which, the sense strand, comprises a sequence of nucleotides at least partially complementary to a target nucleotide sequence within a target gene.

The target nucleotide sequence may be selected from any suitable region or nucleotide sequence of the target gene or RNA transcript thereof. For example, the target nucleotide sequence may be located within the 5'UTR or 3'UTR of the target gene or RNA transcript or within exonic or intronic regions of the gene. The skilled person will be aware of methods of identifying the most suitable target nucleotide sequences within the context of the full-length target gene. For example, multiple dsRNAs targeting different regions of the target gene can be synthesised and tested. Alternatively, digestion of the RNA transcript with enzymes such as RNAse H can be used to determine sites on the RNA that are in a conformation susceptible to gene silencing. Target sites may also be identified using in silico approaches, for example, the use of computer algorithms designed to predict the efficacy of gene silencing based on targeting different sites within the full-length gene.

Preferably, the % identity of a polyribonucleotide is determined by GAP (Needleman and Wunsch, 1970) analysis (GCG program) using the default settings, wherein the query sequence is at least about 21 to about 23 nucleotides in length, and the GAP analysis aligns the two sequences over a region of at least about 21 nucleotides. In another embodiment, the query sequence is at least 150 nucleotides in length, and the GAP analysis aligns the two sequences over a region of at least 150 nucleotides. In a further embodiment, the query sequence is at least 300 nucleotides in length and the GAP analysis aligns the two sequences over a region of at least 300 nucleotides. In yet another embodiment, the query sequence corresponds to the full length of the target RNA, for example mRNA, and the GAP analysis aligns the two sequences over the full length of the target RNA.

Conveniently, the dsRNA can be produced from a single open reading frame in a recombinant host cell, wherein the sense and anti-sense sequences are flanked by an unrelated sequence which enables the sense and anti-sense sequences to hybridize to form the dsRNA molecule with the unrelated sequence forming a loop structure. Alternatively, the sense strand and antisense strand can be made without an open reading frame to ensure that no protein will be made in the transgenic host cell. The two strands can also be expressed separately as two transcripts, one encoding the sense strand and one encoding the antisense strand.

RNA duplex formation can be initiated either inside or outside the cell. The dsRNA can be partially or fully double-stranded. The RNA can be enzymatically or chemically synthesized, either in vitro or in vivo.

The dsRNA need not be full length relative to either the primary transcription product or fully processed RNA. It is well-known in the art that small dsRNA of about 19-23 bp in length can be used to trigger gene silencing of a target gene. Generally, higher identity can be used to compensate for the use of a shorter sequence. Furthermore, the dsRNA can comprise single stranded regions as well, e.g., the dsRNA can be partially or fully double stranded. The double stranded region of the dsRNA can have a length of at least about 19 to about 23 base pairs, optionally a sequence of about 19 to about 50 base pairs, optionally a sequence of about 50 to about 100 base pairs, optionally a sequence of about 100 to about 200 base pairs, optionally a sequence of about 200 to about 500, and optionally a sequence of about 500 to about 1000 or more base pairs, up to a molecule that is double stranded for its full length, corresponding in size to a full length target RNA molecule. Bolognesi et al (2012, PLOS One, 7(10): e47534, herein incorporated by reference) teach that dsRNAs greater than or equal to about 60 bp are required for biological activity in artificial diet bioassays with Southern Corn Rootworm (SCR; *Diabrotica undecimpunctata howardii*).

Mao et al (2007, *Nature Biotechnology*, 35(11): 1307-1313) teach a transgenic plant expressing a dsRNA construct against a target gene (CYP6AE14) of an insect pest (cotton bollworm, *Helicoverpa armigera*). Insects feeding on the transgenic plant have small RNAs of about 19-23 bp in size of the target gene in their midgut, with a corresponding reduction in CYP6AE14 transcripts and protein. This suggests that the small RNAs were efficacious in reducing expression of the target gene in the insect pest. Therefore, small RNAs of about 19 bp, about 20 bp, about 21 bp, about 22 bp, about 23 bp, about 24 bp, about 25 bp, about 26 bp, about 27 bp, about 28 bp, about 29 bp, or about 30 bp may be efficacious in reducing expression of the target gene in an insect pest.

Alternatively, the dsRNA may comprise a target dsRNA of at least 19 base pairs, and the target dsRNA may be within a dsRNA "carrier" or "filler" sequence. For example, Bolognesi et al (2012) show that a 240 bp dsRNA encompassing a target dsRNA, which comprised a 21 bp consecutive sequence with 100% identity to the target sequence, had biological activity in bioassays with Southern Corn Rootworm. The present application exemplifies a similar approach in bioassays with Western Corn Rootworm. The target dsRNA may have a length of at least 19 to about 25 base pairs, optionally a sequence of about 19 to about 50 base pairs, optionally a sequence of about 50 to about 100 base pairs, optionally a sequence of about 100 to about 200 base pairs, optionally a sequence of about 200 to about 500, and optionally a sequence of about 500 to about 1000 or more base pairs. Combined with the carrier dsRNA sequence, the dsRNA of the target sequence and the carrier dsRNA may have a total length of at least about 50 to about 100 base pairs, optionally a sequence of about 100 to about 200 base pairs, optionally a sequence of about 200 to about 500, and optionally a sequence of about 500 to about 1000 or more base pairs.

The dsRNA can contain known nucleotide analogs or modified backbone residues or linkages, which are synthetic, naturally occurring, and non-naturally occurring. Examples of such analogs include, without limitation, phosphorothioates, phosphoramidates, methyl phosphonates, chiralmethyl phosphonates and 2-O-methyl ribonucleotides.

As used herein, the term "specifically reduce the level of a target RNA and/or the production of a target protein encoded by the RNA", and variations thereof, refers to the sequence of a portion of one strand of the dsRNA being sufficiently identical to the target RNA such that the presence of the dsRNA in a cell reduces the steady state level and/or the production of said RNA. In many instances, the target RNA will be mRNA, and the presence of the dsRNA in a cell producing the mRNA will result in a reduction in the production of said protein. Preferably, this accumulation or production is reduced at least 10%, more preferably at least 50%, even more preferably at least 75%, yet even more preferably at least 95% and most preferably 100%, when compared to a wild-type cell.

The consequences of inhibition can be confirmed by examination of the outward properties of the cell or organism or by biochemical techniques such as, but not limited to, Northern hybridization, reverse transcription, gene expression monitoring with a microarray, antibody binding, enzyme linked immunosorbent assay (ELISA), Western blotting, radioimmunoassay (RIA), and other immunoassays.

The interfering RNAs of the current invention may comprise one dsRNA or multiple dsRNAs, wherein each dsRNA comprises or consists of a sequence of nucleotides which is at least partially complementary to a target nucleotide sequence within the target gene and that functions upon uptake by an insect pest species to down-regulate expression of said target gene. Concatemeric RNA constructs of this type are described in WO2006/046148 as incorporated herein by reference. In the context of the present invention, the term 'multiple' means at least two, at least three, at least four, etc and up to at least 10, 15, 20 or at least 30. In one embodiment, the interfering RNA comprises multiple copies of a single dsRNA i.e. repeats of a dsRNA that binds to a particular target nucleotide sequence within a specific target gene. In another embodiment, the dsRNAs within the interfering RNA comprise or consist of different sequences of nucleotides complementary to different target nucleotide sequences. It should be clear that combinations of multiple copies of the same dsRNA combined with dsRNAs binding to different target nucleotide sequences are within the scope of the current invention.

The dsRNAs may be arranged as one contiguous region of the interfering RNA or may be separated by the presence of linker sequences. The linker sequence may comprise a short random nucleotide sequence that is not complementary to any target nucleotide sequences or target genes. In one embodiment, the linker is a conditionally self-cleaving RNA sequence, preferably a pH-sensitive linker or a hydrophobic-sensitive linker. In one embodiment, the linker comprises a sequence of nucleotides equivalent to an intronic sequence. Linker sequences of the current invention may range in length from about 1 base pair to about 10000 base pairs, provided that the linker does not impair the ability of the interfering RNA to down-regulate the expression of target gene(s).

In addition to the dsRNA(s) and any linker sequences, the interfering RNA of the invention may comprise at least one additional polynucleotide sequence. In different embodiments of the invention, the additional sequence is chosen from (i) a sequence capable of protecting the interfering RNA against RNA processing, (ii) a sequence affecting the stability of the interfering RNA, (iii) a sequence allowing protein binding, for example to facilitate uptake of the interfering RNA by cells of the insect pest species, (iv) a sequence facilitating large-scale production of the interfering RNA, (v) a sequence which is an aptamer that binds to a receptor or to a molecule on the surface of the insect pest cells to facilitate uptake, or (v) a sequence that catalyses processing of the interfering RNA within the insect pest cells and thereby enhances the efficacy of the interfering RNA. Structures for enhancing the stability of RNA molecules are well known in the art and are described further in WO2006/046148 as incorporated herein by reference.

The interfering RNA may contain DNA bases, non-natural bases or non-natural backbone linkages or modifications of the sugar-phosphate backbone, for example to enhance stability during storage or enhance resistance to degradation by nucleases. Furthermore, the interfering RNA may be produced chemically or enzymatically by one skilled in the art through manual or automated reactions. Alternatively, the interfering RNA may be transcribed from a polynucleotide encoding the same. Thus, provided herein is an isolated polynucleotide encoding any of the interfering RNAs of the current invention.

MicroRNAs (miRNAs) are non-protein coding RNAs, generally of between about 18 to about 25 nucleotides in length (commonly about 20-24 nucleotides in length in plants). These miRNAs direct cleavage in trans of target transcripts, negatively regulating the expression of genes involved in various regulation and development pathways (Bartel, Cell, 116:281-297 (2004); Zhang et al. Dev. Biol. 289:3-16 (2006)). As such, miRNAs have been shown to be involved in different aspects of plant growth and development as well as in signal transduction and protein degradation. In addition, small endogenous mRNAs including miRNAs may also be involved in biotic stress responses such as pathogen attack. Since the first miRNAs were discovered in plants (Reinhart et al. Genes Dev. 16:1616-1626 (2002), Park et al. Curr. Biol. 12:1484-1495 (2002)) many hundreds have been identified. Furthermore, many plant miRNAs have been shown to be highly conserved across very divergent taxa. (Floyd et al. Nature 428:485-486 (2004); Zhang et al. Plant J. 46:243-259 (2006)). Many microRNA genes (MIR genes) have been identified and made publicly available in a database (miRBase, available via the World Wide Web). miRNAs are also described in U.S. Patent Publications 2005/0120415 and 2005/144669A1, the entire contents of which are incorporated by reference herein.

Genes encoding miRNAs yield primary miRNAs (termed a "pri-miRNA") of 70 to 300 bp in length that can form imperfect stem-loop structures. A single pri-miRNA may contain from one to several miRNA precursors. In animals, pri-miRNAs are processed in the nucleus into shorter hairpin RNAs of about 65 nt (pre-miRNAs) by the RNaseIII enzyme Drosha and its cofactor DGCR8/Pasha. The pre-miRNA is then exported to the cytoplasm, where it is further processed by another RNaseIII enzyme, Dicer, releasing a miRNA/miRNA* duplex of about 22 nt in size. In contrast to animals, in plants, the processing of pri-miRNAs into mature miRNAs occurs entirely in the nucleus using a single RNaseIII enzyme, DCL1 (Dicer-like 1). (Zhu. Proc. Natl. Acad. Sci. 105:9851-9852 (2008)). Many reviews on microRNA biogenesis and function are available, for example, see, Bartel Cell 116:281-297 (2004), Murchison et al. Curr. Opin. Cell Biol. 16:223-229 (2004), Dugas et al. Curr. Opin. Plant Biol. 7:512-520 (2004) and Kim Nature Rev. Mol. Cell Biol. 6:376-385 (2005).

The term "plant microRNA precursor molecule" as used herein describes a small (~70-300 nt) non-coding RNA sequence that is processed by plant enzymes to yield a ~19-24 nucleotide product known as a mature microRNA sequence. The mature sequences have regulatory roles through complementarity to messenger RNA (mRNA). The term "artificial plant microRNA precursor molecule" describes the non-coding miRNA precursor sequence prior to processing that is employed as a backbone sequence for the delivery of a siRNA molecule via substitution of the endogenous native miRNA/miRNA* duplex of the miRNA precursor molecule with that of a non-native, heterologous miRNA (amiRNA/amiRNA*; e.g. siRNA/siRNA*) that is then processed into the mature miRNA sequence with the siRNA sequence.

In the context of the invention, the term "toxic" used to describe a dsRNA of the invention means that the dsRNA molecules of the invention and combinations of such dsRNA molecules function as orally active insect control agents that have a negative effect on an insect. When a composition of the invention is delivered to the insect, the result is typically death of the insect, or the insect does not feed upon the source that makes the composition available to the insect. Such a composition may be a transgenic plant expressing the dsRNA of the invention.

As used herein, a "coleopteran insect" refers to any member of the Order Coleoptera, including coleopteran plant pests. Non-limiting examples of coleopteran pest insects according to the invention include corn rootworm species in the Genus *Diabrotica*, such as *Diabrotica barberi* (northern corn rootworm; NCR), *D. virgifera virgifera* (western corn rootworm; WCR), *D. undecimpunctata howardii* (southern corn rootworm; SCR), *D. virgifera zeae* (Mexican corn rootworm; MCR) and *D. speciose; Leptinotarsa* spp. such as *L. decemlineata* (Colorado potato beetle); *Chrysomela* spp. such as *C. scripta* (cottonwood leaf beetle; CLB); *Hypothenemus* spp. such as *H. hampei* (coffee berry borer); *Sitophilus* spp. such as *S. zeamais* (maize weevil); *Epitrix* spp. such as *E. hirtipennis* (tobacco flea beetle) and *E. cucumeris* (potato flea beetle); *Phyllotreta* spp. such as *P. cruciferae* (crucifer flea beetle) and *P. pusilla* (western black flea beetle); *Anthonomus* spp. such as *A. eugenii* (pepper weevil; PW); *Hemicrepidus* spp. such as *H. memnonius* (wireworms); *Melanotus* spp. such as *M. communis* (wireworm); *Ceutorhychus* spp. such as *C. assimilis* (cabbage seedpod weevil); *Aeolus* spp. such as *A. mellillus* (wireworm); *Aeolus* spp. such as *A. mancus* (wheat wireworm); *Horistonotus* spp. such as *H. uhlerii* (sand wireworm); *Sphenophorus* spp. such as *S. maidis* (maize billbug), *S. zeae* (timothy billbug), *S. parvulus* (bluegrass billbug), and *S. callosus* (southern corn billbug); *Phyllophaga* spp. (white grubs); *Chaetocnema* spp. such as *C. pulicaria* (corn flea beetle); *Popillia* spp. such as *P. japonica* (Japanese beetle); *Epilachna* spp. such as *E. varivestis* (Mexican bean beetle); *Cerotoma* spp. such as *C. trifurcate* (bean leaf beetle); *Epicauta* spp. such as *E. pestifera* and *E. lemniscata* (blister beetles); and any combination of the foregoing.

As used herein, a "hemipteran insect" refers to any member of the Order Hemiptera, including hemipteran plant pests. Non-limiting examples of hemipteran pest insects according to the invention include *Euschistus heros* (brown stinkbug), *Nezara viridula* (green stinkbug) and *Piezodorus guildinii* (red banded stinkbug).

The term "agrochemically active ingredient" refers to chemicals and/or biological compositions, such as those described herein, which are effective in killing, preventing, or controlling the growth of undesirable pests, such as, plants, insects, mice, microorganism, algae, fungi, bacteria, and the like (such as pesticidally active ingredients). An interfering RNA molecule of the invention is an agrochemically active ingredient.

An "agriculturally acceptable carrier" includes adjuvants, mixers, enhancers, etc. beneficial for application of an active ingredient, such as an interfering RNA molecule of the invention. Suitable carriers should not be phytotoxic to valuable crops, particularly at the concentrations employed in applying the compositions in the presence of crops, and should not react chemically with the compounds of the active ingredient herein, namely an interfering RNA of the invention, or other composition ingredients. Such mixtures can be designed for application directly to crops, or can be concentrates or formulations which are normally diluted with additional carriers and adjuvants before application. They may include inert or active components and can be solids, such as, for example, dusts, granules, water dispersible granules, or wettable powders, or liquids, such as, for example, emulsifiable concentrates, solutions, emulsions or suspensions. Suitable agricultural carriers may include liquid carriers, for example water, toluene, xylene, petroleum naphtha, crop oil, acetone, methyl ethyl ketone, cyclohexanone, trichloroethylene, perchloroethylene, ethyl acetate, amyl acetate, butyl acetate, propylene glycol monomethyl ether and diethylene glycol monomethyl ether, methanol, ethanol, isopropanol, amyl alcohol, ethylene glycol, propylene glycol, glycerine, and the like. Water is generally the carrier of choice for the dilution of concentrates. Suitable solid carriers may include talc, pyrophyllite clay, silica, attapulgus clay, kieselguhr, chalk, diatomaceous earth, lime, calcium carbonate, bentonire clay, Fuller's earth, cotton seed hulls, wheat flour, soybean flour, pumice, wood flour, walnut shell flour, lignin, and the like.

For the present invention, an agriculturally acceptable carrier may also include non-pathogenic, attenuated strains of microorganisms, which carry the insect control agent, namely an interfering RNA molecule of the invention. In this case, the microorganisms carrying the interfering RNA may also be referred to as insect control agents. The microorganisms may be engineered to express a nucleotide sequence of a target gene to produce interfering RNA molecules comprising RNA sequences homologous or complementary to RNA sequences typically found within the cells of an insect. Exposure of the insects to the microorganisms result in ingestion of the microorganisms and down-regulation of expression of target genes mediated directly or indirectly by the interfering RNA molecules or fragments or derivatives thereof.

In another embodiment, the interfering RNA molecules may be encapsulated in a synthetic matrix such as a polymer and applied to the surface of a host such as a plant. Ingestion of the host cells by an insect permits delivery of the insect control agents to the insect and results in down-regulation of a target gene in the host.

A composition of the invention, for example a composition comprising an interfering RNA molecule of the invention and an agriculturally acceptable carrier, may be used in conventional agricultural methods. For example, the compositions of the invention may be mixed with water and/or fertilizers and may be applied preemergence and/or postemergence to a desired locus by any means, such as airplane spray tanks, irrigation equipment, direct injection spray equipment, knapsack spray tanks, cattle dipping vats, farm equipment used in ground spraying (e.g., boom sprayers, hand sprayers), and the like. The desired locus may be soil, plants, and the like.

A composition of the invention may be applied to a seed or plant propagule in any physiological state, at any time between harvest of the seed and sowing of the seed; during or after sowing; and/or after sprouting. It is preferred that the seed or plant propagule be in a sufficiently durable state that it incurs no or minimal damage, including physical damage or biological damage, during the treatment process. A formulation may be applied to the seeds or plant propagules using conventional coating techniques and machines, such as fluidized bed techniques, the roller mill method, rotostatic seed treaters, and drum coaters.

In the context of the invention, a number in front of the suffix "mer" indicates a specified number of subunits. When applied to RNA or DNA, this specifies the number of bases in the molecule. For example, a 19 nucleotide subsequence of an mRNA having the sequence ACUGGUCGCGUUG-CAUGCU is a "19-mer."

A "plant" is any plant at any stage of development, particularly a seed plant.

A "plant cell" is a structural and physiological unit of a plant, comprising a protoplast and a cell wall. The plant cell may be in the form of an isolated single cell or a cultured cell, or as a part of a higher organized unit such as, for example, plant tissue, a plant organ, or a whole plant.

"Plant cell culture" means cultures of plant units such as, for example, protoplasts, cell culture cells, cells in plant tissues, pollen, pollen tubes, ovules, embryo sacs, zygotes and embryos at various stages of development.

"Plant material" refers to leaves, stems, roots, flowers or flower parts, fruits, pollen, egg cells, zygotes, seeds, cuttings, cell or tissue cultures, or any other part or product of a plant.

A "plant organ" is a distinct and visibly structured and differentiated part of a plant such as a root, stem, leaf, flower bud, or embryo.

"Plant tissue" as used herein means a group of plant cells organized into a structural and functional unit. Any tissue of a plant in planta or in culture is included. This term includes, but is not limited to, whole plants, plant organs, plant seeds, tissue culture and any groups of plant cells organized into structural and/or functional units. The use of this term in conjunction with, or in the absence of, any specific type of plant tissue as listed above or otherwise embraced by this definition is not intended to be exclusive of any other type of plant tissue.

A corn rootworm "transcriptome" is a collection of all or nearly all the ribonucleic acid (RNA) transcripts in a corn rootworm cell.

"Transformation" is a process for introducing heterologous nucleic acid into a host cell or organism. In particular, "transformation" means the stable integration of a DNA molecule into the genome of an organism of interest.

"Transformed/transgenic/recombinant" refer to a host organism such as a bacterium or a plant into which a heterologous nucleic acid molecule has been introduced. The nucleic acid molecule can be stably integrated into the genome of the host or the nucleic acid molecule can also be present as an extrachromosomal molecule. Such an extrachromosomal molecule can be auto-replicating. Transformed cells, tissues, or plants are understood to encompass not only the end product of a transformation process, but also transgenic progeny thereof. A "non-transformed", "non-transgenic", or "non-recombinant" host refers to a wild-type organism, e.g., a bacterium or plant, which does not contain the heterologous nucleic acid molecule.

Nucleotides are indicated herein by their bases by the following standard abbreviations: adenine (A), cytosine (C), thymine (T), and guanine (G) Amino acids are likewise indicated by the following standard abbreviations: alanine (Ala; A), arginine (Arg; R), asparagine (Asn; N), aspartic acid (Asp; D), cysteine (Cys; C), glutamine (Gln; Q), glutamic acid (Glu; E), glycine (Gly; G), histidine (His; H), isoleucine (Ile; 1), leucine (Leu; L), lysine (Lys; K), methionine (Met; M), phenylalanine (Phe; F), proline (Pro; P), serine (Ser; S), threonine (Thr; T), tryptophan (Trp; W), tyrosine (Tyr; Y), and valine (Val; V).

The invention is based on the unexpected result that double stranded RNA (dsRNA) or small interfering RNAs (siRNA) designed to target a mRNA transcribable from a pest insect essential gene described herein are toxic to the pest insect and can be used to control pest insect infestation of a plant and impart to a transgenic plant tolerance to a pest insect infestation, particularly a coleopteran and/or hemipteran pest insect infestation. Thus, in one embodiment, the invention provides a double stranded RNA (dsRNA) molecule comprising a sense strand and an antisense strand, wherein a nucleotide sequence of the antisense strand is complementary to a portion of a mRNA polynucleotide transcribable from a pest insect gene described herein, wherein the dsRNA molecule is toxic to a pest insect, particularly to a coleopteran and/or a hemipteran pest insect.

The present invention relates to an RNA encoded by the sequence comprising any one of SEQ ID NOs:1-1814, any at least 19 nucleotide fragment of any one of SEQ ID NOs:1-1814, the complement of any at least 19 nucleotide fragment of any one of SEQ ID NOs:1-1814, or a sequence that hybridizes under stringent conditions with any of the aforementioned sequences, wherein said RNA post transcriptionally silences an essential gene in a plant pest organism.

It is known in the art that dsRNA molecules that are not perfectly complementary to a target sequence (for example, having only 95% identity to the target gene) are effective to control coleopteran pests (see, for example, Narva et al., U.S. Pat. No. 9,012,722). The invention provides an interfering RNA molecule comprising at least one dsRNA, where the dsRNA is a region of double-stranded RNA comprising annealed at least partially complementary strands. One strand of the dsRNA comprises a sequence of at least 19, at least 20, at least 21, at least 22, at least 23, at least 24, at least 25, at least 26, at least 27, at least 28, at least 29, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 consecutive nucleotides which is at least partially complementary to a target nucleotide sequence within an insect pest target gene. The interfering RNA molecule (i) has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, or 100% identity, to at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of SEQ ID NO:3629-7256, or the complement thereof; (ii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of SEQ ID NO:3629-7256, or the complement thereof; (iii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of a nucleotide sequence encoding an amino acid sequence encoded by SEQ ID NO:3629-7256, or the complement thereof, or (iv) can hybridize under stringent conditions to a polynucleotide selected from the group consisting of SEQ ID NO:3629-7256, and the complements thereof, wherein the interfering RNA molecule has insecticidal activity on a coleopteran and/or hemipteran plant pest. In some embodiments, the interfering RNA molecule comprises a nucleotide fragment that has at least 85% identity (e.g., at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, or 100% identity) to any one of SEQ ID Nos:3629-7256, or a complement thereof.

In some embodiments, the interfering RNA molecule comprises at least two dsRNAs, wherein each dsRNA comprises a sequence of nucleotides which is at least partially complementary to a target nucleotide sequence within the target gene. In some embodiments the target gene comprises any one of SEQ ID NOs:1-1814. In some embodiments, each of the dsRNAs comprise a different sequence of nucleotides which is complementary to a different target nucleotide sequence within the target gene. In other embodiments, each of the dsRNAs comprise a different sequence of nucleotides which is complementary to a target nucleotide sequence within two different target genes.

In some embodiments, the interfering RNA molecule comprises a dsRNA that can comprise, consist essentially of or consist of from at least 18 to about 25 consecutive nucleotides (e.g. 18, 19, 20, 21, 22, 23, 24, 25, 26, 27, 28, or 29) to at least about 300 consecutive nucleotides. Additional nucleotides can be added at the 3' end, the 5' end or both the 3' and 5' ends to facilitate manipulation of the dsRNA molecule but that do not materially affect the basic characteristics or function of the dsRNA molecule in RNA interference (RNAi).

In some embodiments, the interfering RNA molecule comprises a dsRNA which comprises an antisense strand that is complementary to at least 19, at least 20, at least 21, at least 22, at least 23, at least 24, at least 25, at least 26, at least 27, at least 28, at least 29, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 consecutive nucleotides of SEQ ID NO:3629-7256, or the complement thereof. In other embodiments, the portion of dsRNA comprises, consists essentially of or consists of at least from 19, 20 or 21 consecutive nucleotides to at least 19, at least 20, at least 21, at least 22, at least 23, at least 24, at least 25, at least 26, at least 27, at least 28, at least 29, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 consecutive nucleotides of SEQ ID NO:3629-7256, or the complement thereof. In some embodiments, the portion of the dsRNA comprises a nucleotide fragment that has at least 85% identity (e.g., at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, or 100% identity) to any one of SEQ ID Nos:3629-7256, or a complement thereof.

In other embodiments, an interfering RNA molecule of the invention comprises a dsRNA which comprises, consists essentially of or consists of any 21-mer subsequence of any one of SEQ ID NOs:5443-7256 consisting of N to N+20 nucleotides, or any complement thereof. For example, an interfering RNA molecule of the invention comprises a dsRNA which comprises, consist essentially of or consists of any 21-mer subsequence of SEQ ID NO:5443, wherein N is nucleotide 1 to nucleotide 201 of SEQ ID NO:5443, or any complement thereof. In other words, the portion of the mRNA that is targeted comprises any of the 2020 21 consecutive nucleotide subsequences i.e. 21-mers, of SEQ ID NO:5443, or any of their complementing sequences.

In still other embodiments, the interfering RNA molecule of the invention comprises a dsRNA which comprises, consists essentially of or consists of SEQ ID NO:3629-7256, or the complement thereof.

In other embodiments, the interfering RNA molecule comprises the antisense strand of a dsRNA of the invention which comprises, consists essentially of or consists of the antisense of any one of nucleotide sequences SEQ ID NOs:3629-7256. The nucleotide sequence of the antisense strand of a dsRNA of the invention can have one nucleotide at either the 3' or 5' end deleted or can have up to six nucleotides added at the 3' end, the 5' end or both, in any combination to achieve an antisense strand consisting essentially of any 19-mer, any 20-mer, or any 21-mer nucleotide sequence, as it would be understood that the deletion of the one nucleotide or the addition of up to the six nucleotides do not materially affect the basic characteristics or function of the double stranded RNA molecule of the invention. Such additional nucleotides can be nucleotides that extend the complementarity of the antisense strand along the target sequence and/or such nucleotides can be nucleotides that facilitate manipulation of the RNA molecule or a nucleic acid molecule encoding the RNA molecule, as would be known to one of ordinary skill in the art. For example, a TT overhang at the 3' end may be present, which is used to stabilize the siRNA duplex and does not affect the specificity of the siRNA.

In some embodiments of the invention, the antisense strand of the double stranded RNA of the interfering RNA molecule can be fully complementary to the target RNA polynucleotide or the antisense strand can be substantially complementary or partially complementary to the target RNA polynucleotide. The dsRNA of the interfering RNA molecule may comprise a dsRNA which is a region of double-stranded RNA comprising substantially complementary annealed strands, or which is a region of double-stranded RNA comprising fully complementary annealed strands. By substantially or partially complementary is meant that the antisense strand and the target RNA polynucleotide can be mismatched at about 1, 2, 3, 4, 5, 6, 7, 8, 9, or 10 nucleotide pairings. Such mismatches can be introduced into the antisense strand sequence, e.g., near the 3' end, to enhance processing of the double stranded RNA molecule by Dicer, to duplicate a pattern of mismatches in a siRNA molecule inserted into a chimeric nucleic acid molecule or artificial microRNA precursor molecule of this invention, and the like, as would be known to one of skill in the art. Such modification will weaken the base pairing at one end of the duplex and generate strand asymmetry, therefore enhancing the chance of the antisense strand, instead of the sense strand, being processed and silencing the intended gene (Geng and Ding "Double-mismatched siR-NAs enhance selective gene silencing of a mutant ALS-causing Allele1" *Acta Pharmacol. Sin.* 29:211-216 (2008); Schwarz et al. "Asymmetry in the assembly of the RNAi enzyme complex" *Cell* 115:199-208 (2003)).

In some embodiments of the invention, the interfering RNA comprises a dsRNA which comprises a short hairpin RNA (shRNA) molecule. Expression of shRNA in cells is typically accomplished by delivery of plasmids or recombinant vectors, for example in transgenic plants such as transgenic corn.

The invention encompasses a nucleic acid construct comprising an interfering RNA of the invention. The invention further encompasses a nucleic acid molecule encoding at least one interfering molecule of the invention. The invention further encompasses a nucleic acid construct comprising at least one interfering molecule of the invention or comprising a nucleic acid molecule encoding the at least one interfering molecule of the invention. The invention further encompasses a nucleic acid construct wherein the nucleic acid construct is an expression vector. The invention further encompasses a recombinant vector comprising a regulatory sequence operably linked to a nucleotide sequence that encodes an interfering RNA molecule of the invention. A regulatory sequence may refer to a promoter, enhancer, transcription factor binding site, insulator, silencer, or any other DNA element involved in the expression of a gene.

The invention further encompasses chimeric nucleic acid molecules comprising an interfering RNA molecule with an antisense strand of a dsRNA operably linked with a plant microRNA precursor molecule. In some embodiments, the chimeric nucleic acid molecule comprises an antisense strand having the nucleotide sequence of any of the 21-mer subsequences of any one of SEQ ID NOs:5443-7256, or any complement thereof, operably linked with a plant microRNA precursor molecule. In some embodiments, the plant microRNA precursor molecule is a maize microRNA precursor.

In some embodiments, the invention encompasses an artificial plant microRNA precursor molecule comprising an antisense strand of a dsRNA of an interfering RNA molecule of the invention. In other embodiments, the artificial plant microRNA precursor molecule comprises an antisense strand having the nucleotide sequence of any of the 19-mer, 20-mer, or 21-mer subsequences of the antisense of any one of SEQ ID NOs:5443-7256. The use of artificial plant microRNAs to deliver a nucleotide sequence of interest (e.g., an artificial miRNA; siRNA/siRNA*) into a plant is known in the art (see, e.g., Schwab et al. 2006. The Plant Cell 18:1121-1133). In the invention, the artificial microR-NAs are chimeric or hybrid molecules, having a plant microRNA precursor backbone and an insect siRNA sequence inserted therein. As would be understood by one of ordinary skill in the art, it is typically desirable to maintain mismatches that normally occur in the plant microRNA precursor sequence in any nucleotide sequence that is substituted into the plant microRNA precursor backbone. In still other embodiments, the artificial plant microRNA precursor comprises portions of a corn microRNA precursor molecule. Any corn microRNA (miRNA) precursor is suitable for the compositions and methods of the invention. Non-limiting examples include miR156, miR159, miR160, miR162, miR164, miR166, miR167, miR168, miR169, miR171, miR172, miR319, miR390, miR393, miR394, miR395, miR396, miR397, miR398, miR399, miR408, miR482, miR528, miR529, miR827, miR1432, as well as any other plant miRNA precursors now known or later identified.

In some embodiments, the invention encompasses interfering RNA molecules, nucleic acid constructs, nucleic acid molecules or recombinant vectors comprising at least one strand of a dsRNA of an interfering RNA molecule of the invention, or comprising a chimeric nucleic acid molecule of the invention, or comprising an artificial plant microRNA of the invention. In some embodiments the nucleic acid construct comprises a nucleic acid molecule of the invention. In other embodiments, the nucleic acid construct is a recombinant expression vector.

Plant pest insects that are targets of the present invention include those insects in the Orders Coleoptera (beetles), Lepidoptera (moths, butterflies), Diptera (flies), Protura, Collembola (springtails), Diplura, Microcoryphia (jumping bristletails), Thysanura (bristletails, silverfish), Ephemeroptera (mayflies), Odonata (dragonflies, damselflies), Orthoptera (grasshoppers, crickets, katydids), Phasmatodea (walkingsticks), Grylloblattodea (rock crawlers), Mantophasmatodea, Dermaptera (earwigs), Plecoptera (stoneflies), Embioptera (web spinners), Zoraptera, Isoptera (termites), Mantodea (mantids), Blattodea (cockroaches), Hemiptera (true bugs, cicadas, leafhoppers, aphids, scales), Thysanoptera (thrips), Psocoptera (book and bark lice), Phthiraptera (lice; including but not limited to suborders Amblycera, Ischnocera and Anoplura), Neuroptera (lacewings, owlflies, mantispids, antlions), Hymenoptera (bees, ants, wasps), Trichoptera (caddisflies), Siphonaptera (fleas), Mecoptera (scorpion flies), Strepsiptera (twisted-winged parasites), and preferably in the Orders Coleoptera and/or Hemiptera.

More preferably, target insect pests of the invention are selected from the group consisting of the coleopteran insect pests *Sitophilus oryzae* (So; rice weevil), *Diabrotica virgifera virgifera* (Dv; western corn rootworm), *Diabrotica undecimpunctata howardi* (Du; southern corn rootworm), *Diabrotica barberi* (db; northern corn rootworm), *Phyllotreta armoraciae* (Pa; horseradish flea beetle), *Phyllotreta nemorum* (Pn; turnip flea beetle), *Phyllotreta cruciferae* (Pu; crucifer flea beetle), *Phyllotreta striolata* (Ps; striped flea beetle), *Phyllotreta atra* (Pt; flea beetle), *Psylliodes chrysocephala* (Pc; cabbage-stem flea beetle), *Meligethes aeneus* (Ma; pollen beetle), *Ceutorhynchus assimilis* (Ca; cabbage seedpod weevil), *Leptinotarsa decemlineata* (Ld; Colorado potato beetle), and/or the hemipteran insect pest is selected from the group consisting of *Nezara viridula* (Nv; green stink bug), *Euschistus heros* (Eh; brown stink bug), and *Piezodorus guildinii* (Pg; red-banded stink bug).

In some embodiments, the insect pest is a *Sitophilus* species, preferably *Sitophilus oryzae*, and a gene that is targeted by a dsRNA of the invention comprises, consists essentially of or consists of any one of SEQ ID NOs:1-116, the complement of any one of SEQ ID NOs:1-116, any at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1-116, the complement of any at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1-116 or a sequence that can hybridize under stringent conditions with any of the aforementioned sequences; wherein said RNA is effective in inhibiting expression of a target sequence in a *Sitophilus* species. Preferably, the sequence is or comprises any one of SEQ ID NOs:3629-3744, the complement of any one of SEQ ID NOs:3629-3744, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with SEQ ID NOs:3629-3744 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:3629-3744.

In some embodiments, the insect pest is a *Diabrotica* species, preferably a *Diabrotica* species selected from the group consisting of *D. virgifera virgifera* (Dv; western corn rootworm), *D. undecimpunctata howardi* (Du; southern corn rootworm) and *Diabrotica barberi* (db; northern corn rootworm). In some embodiments, the pest is *Diabrotica virgifera* (Dv) and a gene that is targeted by a dsRNA of the invention comprises, consists essentially of or consists of any one of SEQ ID NOs:117-228, the complement of any one of SEQ ID NOs:117-228, any at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:117-228, the complement of any at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:117-228 or a sequence that can hybridize under stringent conditions with any of the aforementioned sequences; wherein said RNA is effective in inhibiting expression of a target sequence in a Dv pest. Preferably, the sequence is or comprises any one of SEQ ID NOs:3745-3856, the complement of any one of SEQ ID NOs:3745-3856, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:3745-3856 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:3745-3856.

In some embodiments, the pest is *Diabrotica undecimpunctata* (Du) and a gene that is targeted by a dsRNA of the invention comprises, consists essentially of or consists of any one of SEQ ID NOs:229-340, the complement of any one of SEQ ID NOs:229-340, any at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:229-340, the complement of any at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:229-340 or a sequence that can hybridize under stringent conditions with any of the aforementioned sequences; wherein said RNA is effective in inhibiting expression of a target sequence in a Du pest. Preferably, the sequence is or comprises any one of SEQ ID NOs:3857-3968, the complement of any one of SEQ ID NOs:3857-3968, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:3857-3968 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:3857-3968.

In some embodiments, the pest is *Diabrotica barberi* (db) and a gene that is targeted by a dsRNA of the invention comprises, consists essentially of or consists of any one of SEQ ID NOs:341-451, the complement of any one of SEQ ID NOs:341-451, any at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:341-451, the complement of any at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:341-451 or a sequence that can hybridize under stringent conditions with any of the aforementioned sequences; wherein said RNA is effective in inhibiting expression of a target sequence in a db pest. Preferably, the sequence is or comprises any one of SEQ ID NOs:3969-4079, the complement of any one of SEQ ID NOs:3969-4079, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:3969-4079 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:3969-4079.

In some embodiments, the insect pest is a flea beetle pest species, preferably the flea beetle pest species selected from the group consisting of *Phyllotreta armoraciae* (Pa; horseradish flea beetle), *Phyllotreta nemorum* (Pn; turnip flea beetle), *Phyllotreta cruciferae* (Pu; crucifer flea beetle), *Phyllotreta striolata* (Ps; striped flea beetle), *Phyllotreta atra* (Pt; flea beetle) and *Psylliodes chrysocephala* (Pc; cabbage-stem flea beetle). In some embodiments the pest is *Phyllotreta armoraciae* (Pa) and a gene that is targeted by a dsRNA of the invention comprises, consists essentially of or consists of any one of SEQ ID NOs:452-564, the complement of any one of SEQ ID NOs:452-564, any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:452-564, the complement of any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:452-564 or a sequence that hybridizes under stringent conditions with any of the aforementioned sequences; wherein said RNA is effective in inhibiting expression of a target sequence in the Pa pest. Preferably, the sequence is or comprises any one of SEQ ID NOs:4080-4192, the complement of SEQ ID NOs: 4080-4192, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:4080-4192 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:4080-4192.

In some embodiments the pest is *Phyllotreta nemorum* (Pn) and a gene that is targeted by a dsRNA of the invention comprises, consists essentially of or consists of any one of SEQ ID NOs:565-679, the complement of any one of SEQ ID NOs:565-679, any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:565-679, the complement of any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:565-679 or a sequence that hybridizes under stringent conditions with any of the aforementioned sequences; wherein said RNA is effective in inhibiting expression of a target sequence in the Pn pest. Preferably, the sequence is or comprises any one of SEQ ID NOs:4193-4307, the complement of SEQ ID NOs:4193-4307, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:4193-4307 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:4193-4307.

In some embodiments the pest is *Phyllotreta cruciferae* (Pu) and a gene that is targeted by a dsRNA of the invention comprises, consists essentially of or consists of any one of SEQ ID NOs:680-789, the complement of any one of SEQ ID NOs:680-789, any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:680-789, the complement of any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:680-789 or a sequence that hybridizes under stringent conditions with any of the aforementioned sequences; wherein said RNA is effective in inhibiting expression of a target sequence in the Pu pest. Preferably, the sequence is or comprises any one of SEQ ID NOs:4308-4417, the complement of SEQ ID NOs:4308-4417, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:4308-4417 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:4308-4417.

In some embodiments the pest is *Phyllotreta striolata* (Ps) and a gene that is targeted by a dsRNA of the invention comprises, consists essentially of or consists of any one of SEQ ID NOs:790-905, the complement of any one of SEQ ID NOs:790-905, any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:790-905, the complement of any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:790-905 or a sequence that hybridizes under stringent conditions with any of the aforementioned sequences; wherein said RNA is effective in inhibiting expression of a target sequence in the Ps pest. Preferably, the sequence is or comprises any one of SEQ ID NOs:4418-4533, the complement of SEQ ID Nos:4418-4533, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:4418-4533 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:4418-4533.

In some embodiments the pest is *Phyllotreta atra* (Pt) and a gene that is targeted by a dsRNA of the invention comprises, consists essentially of or consists of any one of SEQ ID NOs:906-1020, the complement of any one of SEQ ID NOs:906-1020, any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:906-1020, the complement of any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:906-1020 or a sequence that hybridizes under stringent conditions with any of the aforementioned sequences; wherein said RNA is effective in inhibiting expression of a target sequence in the Pt pest. Preferably, the sequence is or comprises any one of SEQ ID NOs:4534-4648, the complement of SEQ ID NOs:4534-4648, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:4534-4648 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:4534-4648.

In some embodiments the pest is *Psylliodes chrysocephala* (Pc) and a gene that is targeted by a dsRNA of the invention comprises, consists essentially of or consists of any one of SEQ ID NOs:1021-1133, the complement of any one of SEQ ID NOs:1021-1133, any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1021-1133, the complement of any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1021-1133 or a sequence that hybridizes under stringent conditions with any of the aforementioned sequences; wherein said RNA is effective in inhibiting expression of a target sequence in the Pc pest. Preferably, the sequence is or comprises any one of SEQ ID NOs:4649-4761, the complement of SEQ ID NOs:4649-4761, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:4649-4761 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:4649-4761.

In some embodiments the pest is *Meligethes aeneus* (Ma) and a gene that is targeted by a dsRNA of the invention comprises, consists essentially of or consists of any one of SEQ ID NOs:1134-1248, the complement of any one of SEQ ID NOs:1134-1248, any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1134-1248, the complement of any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1134-1248 or a sequence that hybridizes under stringent conditions with any of the aforementioned sequences; wherein said RNA is effective in inhibiting expression of a target sequence in the Ma pest. Preferably, the sequence is or comprises any one of SEQ ID NOs:4762-4876, the complement of any one of SEQ ID NOs:4762-4876, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:4762-4876 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:4762-4876.

In some embodiments the pest is *Ceutorhynchus assimilis* (Ca) and a gene that is targeted by a dsRNA of the invention comprises, consists essentially of or consists of any one of SEQ ID NOs:1249-1360, the complement of any one of SEQ ID NOs:1249-1360, any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1249-1360, the complement of any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1249-1360 or a sequence that hybridizes under stringent conditions with any of the aforementioned sequences; wherein said RNA is effective in inhibiting expression of a target sequence in the Ca pest. Preferably, the sequence is or comprises any one of SEQ ID NOs:4877-4988, the complement of any one of SEQ ID NOs:4877-4988, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:4877-4988 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:4877-4988.

In some embodiments, the insect pest is a hemipteran insect pest, preferably a hemipteran insect pest selected from the group consisting of *Nezara viridula* (Nv), *Euschistus heros* (Eh) and *Piezodorus guildinii* (Pg). In some embodiments the insect pest is *Nezara viridula* (Nv), and a gene that is targeted by a dsRNA of the invention comprises, consists essentially of or consists of any one of SEQ ID NOs:1361-1473, the complement of any one of SEQ ID NOs:1361-1473, any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1361-1473, the complement of any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1361-1473 or a sequence that hybridizes under stringent conditions with any of the aforementioned sequences; wherein said RNA is effective in inhibiting expression of a target sequence in the Nv pest. Preferably, the sequence is or comprises any one of SEQ ID NOs:4989-5101, the complement of any one of SEQ ID NOs:4989-5101, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:4989-5101 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:4989-5101.

In some embodiments, the insect pest is *Euschistus heros* (Eh) and a gene that is targeted by a dsRNA of the invention comprises, consists essentially of or consists of any one of SEQ ID NOs:1474-1586, the complement of any one of SEQ ID NOs:1474-1586, any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1474-1586, the complement of any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1474-1586 or a sequence that hybridizes under stringent conditions with any of the aforementioned sequences; wherein said RNA is effective in inhibiting expression of a target sequence in the Eh pest. Preferably, the sequence is or comprises any one of SEQ ID NOs:5102-5214, the complement of any one of SEQ ID NOs:5102-5214, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:5102-5214 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:5102-5214.

In some embodiments, the insect pest is *Piezodorus guildinii* (Pg) and a gene that is targeted by a dsRNA of the invention comprises, consists essentially of or consists of any one of SEQ ID NOs:1587-1699, the complement of any one of SEQ ID NOs:1587-1699, any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1587-1699, the complement of any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1587-1699 or a sequence that hybridizes under stringent conditions with any of the aforementioned sequences; wherein said RNA is effective in inhibiting expression of a target sequence in the Pg pest. Preferably, the sequence is or comprises any one of SEQ ID NOs:5215-5327, the complement of any one of SEQ ID NOs:5215-5327, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:5215-5327 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:5215-5327.

In some embodiments, the insect pest is *Leptinotarsa decimlineata* (Ld) and a gene that is targeted by a dsRNA of the invention comprises, consists essentially of or consists of any one of SEQ ID NOs:1700-1814, the complement of any one of SEQ ID NOs:1700-1814, any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1700-1814, the complement of any at least 15, at least 16, at least 17, at least 18, at least 19, at least 20, at least 21, at least 22, at least 23, at least 24, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 or more nucleotide fragment of any one of SEQ ID NOs:1700-1814 or a sequence that hybridizes under stringent conditions with any of the aforementioned sequences; wherein said RNA is effective in inhibiting expression of a target sequence in the Ld pest. Preferably, the sequence is or comprises any one of SEQ ID NOs:5328-5442, the complement of any one of SEQ ID NOs:5328-5442, any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with any one of SEQ ID NOs:5328-5442 or any sequence that has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity with the complement of any one of SEQ ID NOs:5328-5442.

In some embodiments, the invention encompasses a composition comprising one or more or two or more of the interfering RNA molecules of the invention. In some embodiments, the interfering RNA molecules are present on the same nucleic acid construct, on different nucleic acid constructs, or any combination thereof. For example, one interfering RNA molecule of the invention may be present on a nucleic acid construct, and a second interfering RNA molecule of the invention may be present on the same nucleic acid construct or on a separate, second nucleic acid construct. The second interfering RNA molecule of the invention may be to the same target gene or to a different target gene.

In some embodiments, the invention encompasses a composition comprising an interfering RNA molecule which comprises at least one dsRNA wherein the dsRNA is a region of double-stranded RNA comprising annealed complementary strands. One strand of the dsRNA comprises a sequence of at least 19, at least 20, at least 21, at least 22, at least 23, at least 24, at least 25, at least 26, at least 27, at least 28, at least 29, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, or at least 300 consecutive nucleotides which is at least partially complementary to a target nucleotide sequence within a target gene comprising, consisting essentially of or consisting of any one of SEQ ID NOs:1-1814. In some embodiments, the interfering RNA molecule (i) has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, or 100% identity, to at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of any one of SEQ ID NOs:3629-7256, or the complement thereof; (ii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of any one of SEQ ID NOs:3629-7256 or the complement thereof; (iii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of a nucleotide sequence encoding an amino acid sequence encoded by any one of SEQ ID NOs:3629-7256, or the complement thereof, or (iv) can hybridize under stringent conditions to a polynucleotide selected from the group consisting of any one of SEQ ID NOs:3629-7256, and the complements thereof.

In some embodiments, the invention encompasses compositions comprising an interfering RNA molecule comprising two or more dsRNAs, wherein the two or more dsRNAs each comprise a different antisense strand. In some embodiments the invention encompasses compositions comprising at least two or more interfering RNA molecules, wherein the two or more interfering RNA molecules each comprise a dsRNA comprising a different antisense strand. The two or more interfering RNAs may be present on the same nucleic acid construct, on different nucleic acid constructs or any combination thereof. In other embodiments, the composition comprises a RNA molecule comprising an antisense strand consisting essentially of a nucleotide sequence comprising at least a 19 consecutive nucleotide fragment of any one of SEQ ID NOs:5443-7256, and in some embodiments may further comprise an RNA molecule comprising an antisense strand consisting essentially of a second nucleotide sequence comprising at least a 19 consecutive nucleotide fragment of any one of SEQ ID NOs:5443-7256; and in some embodiments may further comprise an RNA molecule comprising an antisense strand consisting essentially of a third nucleotide sequence comprising at least a 19 consecutive nucleotide fragment of the antisense any one of SEQ ID NOs: 5443-7256, and in some embodiments may further comprise an RNA molecule comprising an antisense strand consisting essentially of a fourth nucleotide sequence comprising at least a 19 consecutive nucleotide fragment of the antisense any one of SEQ ID NOs:5443-7256, and in some embodiments may further comprise an RNA molecule comprising an antisense strand consisting essentially of a fifth nucleotide sequence comprising at least a 19 consecutive nucleotide fragment of the antisense of SEQ ID NOs:5443-7256, and in some embodiments may further comprise an RNA molecule comprising an antisense strand consisting essentially of a sixth nucleotide sequence comprising at least a 19 consecutive nucleotide fragment of the antisense of any one of SEQ ID NOs:5443-7256, and in some embodiments may further comprise an RNA molecule comprising an antisense strand consisting essentially of a seventh nucleotide sequence comprising at least a 19 consecutive nucleotide fragment of the antisense of any one of SEQ ID NOs:5443-7256. In other embodiments, the composition may comprise two or more of the nucleic acid molecules, wherein the two or more nucleic acid molecules each encode a different interfering RNA molecule. In other embodiments, the composition may comprise two or more of the nucleic acid constructs, wherein the two or more nucleic acid constructs each comprise a nucleic acid molecule encoding a different interfering RNA.

In other embodiments, the composition comprises two or more nucleic acid constructs, two or more nucleic acid molecules, two or more chimeric nucleic acid molecules, two or more artificial plant microRNA precursors of the invention, wherein the two or more nucleic acid constructs, two or more nucleic acid molecules, two or more chimeric nucleic acid molecules, or two or more artificial plant microRNA precursors, each comprise a different antisense strand.

In some embodiments, the invention encompasses an insecticidal composition for inhibiting the expression of an insect pest gene described herein, comprising at least one interfering RNA of the invention and/or the DNA encoding it and/or the expression construct of the invention and/or a cell (active or inactivated) expressing the RNA molecule of the invention and an agriculturally acceptable carrier. For example, the compositions of the invention may be mixed with water and/or fertilizers and may be applied preemergence and/or postemergence to a desired locus by any means, such as airplane spray tanks, irrigation equipment, direct injection spray equipment, knapsack spray tanks, cattle dipping vats, farm equipment used in ground spraying (e.g., boom sprayers, hand sprayers), and the like. The desired locus may be soil, plants, and the like.

In some embodiments, an acceptable agricultural carrier is a formulation useful for topically applying the insecticidal composition comprising the interfering RNA molecule to a plant or seed. In some embodiments, the formulation may be in any form suitable for application to a plant, a seed or directly to a target insect pest. In one aspect, the formulation may be in solid form (powder, pellet, or a bait), liquid form, or gel form. In some embodiments, the interfering RNA molecules are stabilized against degradation because of their double stranded nature and the introduction of Dnase/Rnase inhibitors. For example, dsRNA or siRNA can be stabilized by including thymidine or uridine nucleotide 3' overhangs. The dsRNA or siRNA contained in the compositions of the invention can be chemically synthesized at industrial scale in large amounts. Methods available would be through chemical synthesis or through the use of a biological agent.

In other embodiments the formulation comprises a transfection promoting agent. In other embodiments, the transfection promoting agent is a lipid-containing compound. In further embodiments, the lipid-containing compound is selected from the group consisting of; Lipofectamine, Cellfectin, DMRIE-C, DOTAP and Lipofectin. In another embodiment, the lipid-containing compound is a Tris cationic lipid.

In some embodiments, the formulation further comprises a nucleic acid condensing agent. The nucleic acid condensing agent can be any such compound known in the art. Examples of nucleic acid condensing agents include, but are not limited to, spermidine (N-[3-aminopropyl]-1,4-butanediamine), protamine sulphate, poly-lysine as well as other positively charged peptides. In some embodiments, the nucleic acid condensing agent is spermidine or protamine sulfate.

In still further embodiments, the formulation further comprises buffered sucrose or phosphate buffered saline.

A composition of the invention may be applied to a seed or plant propagule in any physiological state, at any time between harvest of the seed and sowing of the seed; during or after sowing; and/or after sprouting. It is preferred that the seed or plant propagule be in a sufficiently durable state that it incurs no or minimal damage, including physical damage or biological damage, during the treatment process. A formulation may be applied to the seeds or plant propagules using conventional coating techniques and machines, such as fluidized bed techniques, the roller mill method, rotostatic seed treaters, and drum coaters.

In order to apply an active ingredient to insects and/or crops of useful plants as required by the methods of the invention said active ingredient may be used in pure form or, more typically, formulated into a composition which includes, in addition to said active ingredient, a suitable inert diluent or carrier and optionally, a surface active agent (SFA). SFAs are chemicals which are able to modify the properties of an interface (for example, liquid/solid, liquid/air or liquid/liquid interfaces) by lowering the interfacial tension and thereby leading to changes in other properties (for example dispersion, emulsification and wetting). SFAs include non-ionic, cationic and/or anionic surfactants, as well as surfactant mixtures. Thus in further embodiments according to any aspect of the invention mentioned hereinbefore, the active ingredient will be in the form of a composition additionally comprising an agriculturally acceptable carrier or diluent.

The compositions can be chosen from a number of formulation types, including dustable powders (DP), soluble powders (SP), water soluble granules (SG), water dispersible granules (WG), wettable powders (WP), granules (GR) (slow or fast release), soluble concentrates (SL), oil miscible liquids (OL), ultra low volume liquids (UL), emulsifiable concentrates (EC), dispersible concentrates (DC), emulsions (both oil in water (EW) and water in oil (EO)), microemulsions (ME), suspension concentrates (SC), aerosols, fogging/smoke formulations, capsule suspensions (CS) and seed treatment formulations. The formulation type chosen in any instance will depend upon the particular purpose envisaged and the physical, chemical and biological properties of the active ingredient.

Dustable powders (DP) may be prepared by mixing the active ingredient with one or more solid diluents (for example natural clays, kaolin, pyrophyllite, bentonite, alumina, montmorillonite, kieselguhr, chalk, diatomaceous earths, calcium phosphates, calcium and magnesium carbonates, sulfur, lime, flours, talc and other organic and inorganic solid carriers) and mechanically grinding the mixture to a fine powder.

Soluble powders (SP) may be prepared by mixing the active ingredient with one or more water-soluble inorganic salts (such as sodium bicarbonate, sodium carbonate or magnesium sulfate) or one or more water-soluble organic solids (such as a polysaccharide) and, optionally, one or more wetting agents, one or more dispersing agents or a mixture of said agents to improve water dispersibility/solubility. The mixture is then ground to a fine powder. Similar compositions may also be granulated to form water soluble granules (SG).

Wettable powders (WP) may be prepared by mixing the active ingredient with one or more solid diluents or carriers, one or more wetting agents and, preferably, one or more dispersing agents and, optionally, one or more suspending agents to facilitate the dispersion in liquids. The mixture is then ground to a fine powder. Similar compositions may also be granulated to form water dispersible granules (WG).

Granules (GR) may be formed either by granulating a mixture of the active ingredient and one or more powdered solid diluents or carriers, or from pre-formed blank granules by absorbing the active ingredient (or a solution thereof, in a suitable agent) in a porous granular material (such as pumice, attapulgite clays, fuller's earth, kieselguhr, diatomaceous earths or ground corn cobs) or by adsorbing the active ingredient (or a solution thereof, in a suitable agent) on to a hardcore material (such as sands, silicates, mineral carbonates, sulfates or phosphates) and drying if necessary. Agents which are commonly used to aid absorption or adsorption include solvents (such as aliphatic and aromatic petroleum solvents, alcohols, ethers, ketones and esters) and sticking agents (such as polyvinyl acetates, polyvinyl alcohols, dextrins, sugars and vegetable oils). One or more other additives may also be included in granules (for example an emulsifying agent, wetting agent or dispersing agent).

Dispersible concentrates (DC) may be prepared by dissolving the active ingredient in water or an organic solvent, such as a ketone, alcohol or glycol ether. These solutions may contain a surface active agent (for example to improve water dilution or prevent crystallisation in a spray tank). Emulsifiable concentrates (EC) or oil-in-water emulsions (EW) may be prepared by dissolving the active ingredient in an organic solvent (optionally containing one or more wetting agents, one or more emulsifying agents or a mixture of said agents). Suitable organic solvents for use in ECs include aromatic hydrocarbons (such as alkylbenzenes or alkylnaphthalenes, exemplified by SOLVESSO 100, SOLVESSO 15060 and SOLVESSO 200; SOLVESSO is a Registered TradeMark), ketones (such as cyclohexanone or methylcyclohexanone) and alcohols (such as benzyl alcohol, furfuryl alcohol or butanol), N-alkylpyrrolidones (such as N-methylpyrrolidoneor N-octylpyrrolidone), dimethyl amides of fatty acids (such as C8-C10 fatty acid dimethylamide) and chlorinated hydrocarbons. An EC product may spontaneously emulsify on addition to water, to produce an emulsion with sufficient stability to allow spray application through appropriate equipment. Preparation of an EW involves obtaining the active ingredient either as a liquid (if it is not a liquid at room temperature, it may be melted at a reasonable temperature, typically below 70° C.) or in solution (by dissolving it in an appropriate solvent) and then emulsifying the resultant liquid or solution into water containing one or more SFAs, under high shear, to produce an emulsion. Suitable solvents for use in EWs include vegetable oils, chlorinated hydrocarbons (such as chlorobenzenes), aromatic solvents (such as alkylbenzenes or alkylnaphthalenes) and other appropriate organic solvents which have a low solubility in water.

Microemulsions (ME) may be prepared by mixing water with a blend of one or more solvents with one or more SFAs, to produce spontaneously a thermodynamically stable isotropic liquid formulation. The active ingredient is present initially in either the water or the solvent/SPA blend. Suitable solvents for use in MEs include those hereinbefore described for use in ECs or in EWs. A ME may be either an oil-in-water or a water-in-oil system (which system is present may be determined by conductivity measurements) and may be suitable for mixing water-soluble and oil-soluble pesticides in the same formulation. A ME is suitable for dilution into water, either remaining as a microemulsion or forming a conventional oil-in-water emulsion.

Suspension concentrates (SC) may comprise aqueous or non-aqueous suspensions of finely divided insoluble solid particles of the active ingredient. SCs may be prepared by ball or bead milling the solid active ingredient in a suitable medium, optionally with one or more dispersing agents, to produce a fine particle suspension of the compound. One or more wetting agents may be included in the composition and a suspending agent may be included to reduce the rate at which the particles settle. Alternatively, the active ingredient may be dry milled and added to water, containing agents hereinbefore described, to produce the desired end product.

Aerosol formulations comprise the active ingredient and a suitable propellant (for example n-butane). Active ingredients may also be dissolved or dispersed in a suitable medium (for example water or a water miscible liquid, such as n-propanol) to provide compositions for use in non-pressurized, hand-actuated spray pumps. The active ingredient may be mixed in the dry state with a pyrotechnic mixture to form a composition suitable for generating, in an enclosed space, a smoke containing the compound.

Capsule suspensions (CS) may be prepared in a manner similar to the preparation of EW formulations but with an additional polymerisation stage such that an aqueous dispersion of oil droplets is obtained, in which each oil droplet is encapsulated by a polymeric shell and contains the active ingredient and, optionally, a carrier or diluent therefor. The polymeric shell may be produced by either an interfacial polycondensation reaction or by a coacervation procedure. The compositions may provide for controlled release of the compound of the active ingredient. Active ingredients may also be formulated in a biodegradable polymeric matrix to provide a slow, controlled release of the compound.

A composition may include one or more additives to improve the biological performance of the composition (for example by improving wetting, retention or distribution on surfaces; resistance to rain on treated surfaces; or uptake or mobility of the active ingredient). Such additives include surface active agents, spray additives based on oils, for example certain mineral oils, natural plant oils (such as soy bean and rape seed oil) and/or modified plant oils (e.g. esterified plant oils), and blends of these with other bio-enhancing adjuvants (ingredients which may aid or modify the action of the active ingredient. Where the active ingredient described herein is employed in methods of protecting crops of useful plants, methods of enhancing/maintaining yield and/or methods of increasing/maintaining pollination in crops of useful plants, it is preferred that said active ingredient (or compositions containing such active ingredient) is applied to the crop of useful plants at the flower-bud stage. In particular for crops of useful plants wherein said plants have yellow flowers, (e.g. oilseed rape, mustard etc.) it is preferred that the application occurs at the green to yellow bud stage.

In some embodiments, the acceptable agricultural carrier is a transgenic organism expressing an interfering RNA of the invention. In some embodiments the transgenic organism may be a transgenic plant expressing the interfering RNA of the invention that when fed upon by a target coleopteran and/or hemipteran plant pest causes the target coleopteran and/or hemipteran plant pest to stop feeding, growing or reproducing or causing death of the target coleopteran and/or hemipteran plant pest. In some embodiments the plant pest is selected from the group consisting of *Sitophilus oryzae* (So; rice weevil), *Diabrotica virgifera virgifera* (Dv; western corn rootworm), *Diabrotica undecimpunctata howardi* (Du; southern corn rootworm), *Diabrotica barberi* (db; northern corn rootworm), *Phyllotreta armoraciae* (Pa; horseradish flea beetle), *Phyllotreta nemorum* (Pn; turnip flea beetle), *Phyllotreta cruciferae* (Pu; crucifer flea beetle), *Phyllotreta striolata* (Ps; striped flea beetle), *Phyllotreta atra* (Pt; flea beetle), *Psylliodes chrysocephala* (Pc; cabbage-stem flea beetle), *Meligethes aeneus* (Ma; pollen beetle), *Ceutorhynchus assimilis* (Ca; cabbage seedpod weevil), *Leptinotarsa decemlineata* (Ld; Colorado potato beetle), and/or the hemipteran insect pest is selected from the group consisting of *Nezara viridula* (Nv; green stink bug), *Euschistus heros* (Eh; brown stink bug), and *Piezodorus guildinii* (Pg; red-banded stink bug).

In other embodiments, the transgenic plant is a transgenic corn plant and the target pest is a *Diabrotica* insect pest. In still other embodiments, the *Diabrotica* insect pest is selected from the group consisting of *Diabrotica virgifera virgifera* (Dv; western corn rootworm), *Diabrotica undecimpunctata howardi* (Du; southern corn rootworm), and *Diabrotica barberi* (db; northern corn rootworm).

In other embodiments, the transgenic organism is selected from, but not limited to, the group consisting of: yeast, fungi, algae, bacteria, virus or an arthropod expressing the interfering RNA molecule of the invention. In some embodiments, the transgenic organism is a virus, for example an insect baculovirus that expresses an interfering RNA molecule of the invention upon infection of an insect host. Such a baculovirus is likely more virulent against the target insect than the wildtype untransformed baculovirus. In other embodiments the transgenic organism is a transgenic bacterium that is applied to an environment where a target pest occurs or is known to have occurred. In some embodiments, non-pathogenic symbiotic bacteria, which are able to live and replicate within plant tissues, so-called endophytes, or non-pathogenic symbiotic bacteria, which are capable of colonizing the phyllosphere or the rhizosphere, so-called epiphytes, are used. Such bacteria include bacteria of the genera *Agrobacterium, Alcaligenes, Azospirillum, Azotobacter, Bacillus, Clavibacter, Enterobacter, Erwinia, Flavobacter, Klebsiella, Pseudomonas, Rhizobium, Serratia, Streptomyces* and *Xanthomonas*. Symbiotic fungi, such as *Trichoderma* and *Gliocladium* are also possible hosts for expression of the inventive interfering RNA molecule for the same purpose.

In some embodiments, the invention encompasses transgenic plants, or parts thereof, comprising an interfering RNA molecule, a nucleic acid construct, a chimeric nucleic acid molecule, an artificial plant microRNA precursor molecule and/or a composition of the invention, wherein the transgenic plant has enhanced resistance to a coleopteran insect, hemipteran insect, or *Diabrotica* insect as compared to a control plant (e.g., a plant not comprising the interfering RNA molecule, the dsRNA, the nucleic acid molecule, the nucleic acid construct, the chimeric nucleic acid molecule, the artificial plant microRNA precursor molecule and/or the composition of the invention). In other embodiments, the transgenic plant, or part thereof, is a transgenic corn plant, or part thereof. The invention further encompasses transgenic seed of the transgenic plants of the invention, wherein the transgenic seed comprises an interfering RNA molecule, a nucleic acid construct, a chimeric nucleic acid molecule, an artificial plant microRNA precursor molecule and/or a composition of the invention. In some embodiments the transgenic seed is a transgenic corn seed.

Transgenic plants expressing an interfering RNA of the invention are tolerant or resistant to attack by target insect pests. When the insect starts feeding on such a transgenic plant, it also ingests the expressed dsRNA or siRNA. This may deter the insect from further biting into the plant tissue or may even harm or kill the insect. A nucleic acid sequence encoding a dsRNA or siRNA of the invention is inserted into an expression cassette, which is then preferably stably integrated in the genome of the plant. The nucleic acid sequences of the expression cassette introduced into the genome of the plant are heterologous to the plant and non-naturally occurring. Plants transformed in accordance with the present invention may be monocots or dicots and include, but are not limited to, corn, wheat, barley, rye, sweet potato, bean, pea, chicory, lettuce, cabbage, cauliflower, broccoli, turnip, radish, spinach, asparagus, onion, garlic, pepper, celery, squash, pumpkin, hemp, zucchini, apple, pear, quince, melon, plum, cherry, peach, nectarine, apricot, strawberry, grape, raspberry, blackberry, pineapple, avocado, *papaya*, mango, banana, soybean, tomato, sorghum, sugarcane, sugar beet, sunflower, rapeseed, clover, tobacco, carrot, cotton, alfalfa, rice, potato, eggplant, cucumber, *Arabidopsis*, and woody plants such as coniferous and deciduous trees. In further embodiments, the transgenic plant is a transgenic corn plant.

Expression of the interfering RNA molecule in transgenic plants is driven by regulatory sequences comprising promoters that function in plants. The choice of promoter will vary depending on the temporal and spatial requirements for expression, and also depending on the insect target species. Thus, expression of the interfering RNAs of this invention in leaves, in stalks or stems, in ears, in inflorescences (e.g. spikes, panicles, cobs, etc.), in roots, and/or seedlings is contemplated. In many cases, however, protection against more than one type of insect pest is sought, and thus expression in multiple tissues is desirable. Although many promoters from dicotyledons have been shown to be operational in monocotyledons and vice versa, ideally dicotyledonous promoters are selected for expression in dicotyledons, and monocotyledonous promoters for expression in monocotyledons. However, there is no restriction to the provenance of selected promoters; it is sufficient that they are operational in driving the expression of the dsRNA or siRNA in the desired cell.

Promoters useful with the invention include, but are not limited to, those that drive expression of a nucleotide sequence constitutively, those that drive expression when induced, and those that drive expression in a tissue- or developmentally-specific manner. These various types of promoters are known in the art.

In some embodiments, tissue-specific/tissue-preferred promoters can be used. Tissue-specific or tissue-preferred expression patterns include, but are not limited to, green tissue specific or preferred, root specific or preferred, stem specific or preferred, and flower specific or preferred. In addition, promoters functional in plastids can be used. In some embodiments of the invention, inducible promoters can be used. In further aspects, the nucleotide sequences of the invention can be operably associated with a promoter that is wound inducible or inducible by pest or pathogen infection (e.g., an insect or nematode plant pest)

In some embodiments of the present invention, a "minimal promoter" or "basal promoter" is used. A minimal promoter is capable of recruiting and binding RNA polymerase II complex and its accessory proteins to permit transcriptional initiation and elongation. In some embodiments, a minimal promoter is constructed to comprise only the nucleotides/nucleotide sequences from a selected promoter that are required for binding of the transcription factors and transcription of a nucleotide sequence of interest that is operably associated with the minimal promoter including but not limited to TATA box sequences. In other embodiments, the minimal promoter lacks cis sequences that recruit and bind transcription factors that modulate (e.g., enhance, repress, confer tissue specificity, confer inducibility or repressibility) transcription. A minimal promoter is generally placed upstream (i.e., 5') of a nucleotide sequence to be expressed. Thus, nucleotides/nucleotide sequences from any promoter useable with the present invention can be selected for use as a minimal promoter.

In some embodiments, a recombinant nucleic acid molecule of the invention can be an "expression cassette." As used herein, "expression cassette" means a recombinant nucleic acid molecule comprising a nucleotide sequence of interest (e.g., the nucleotide sequences of the invention), wherein the nucleotide sequence is operably associated with at least a control sequence (e.g., a promoter). Thus, some embodiments of the invention provide expression cassettes designed to express nucleotides sequences encoding the dsRNAs or siRNAs of the invention. In this manner, for example, one or more plant promoters operably associated with one or more nucleotide sequences of the invention are provided in expression cassettes for expression in a corn plant, plant part and/or plant cell.

An expression cassette comprising a nucleotide sequence of interest may be chimeric, meaning that at least one of its components is heterologous with respect to at least one of its other components. An expression cassette may also be one that comprises a native promoter driving its native gene, however it has been obtained in a recombinant form useful for heterologous expression. Such usage of an expression cassette makes it so it is not naturally occurring in the cell into which it has been introduced.

An expression cassette also can optionally include a transcriptional and/or translational termination region (i.e., termination region) that is functional in plants. A variety of transcriptional terminators are available for use in expression cassettes and are responsible for the termination of transcription beyond the heterologous nucleotide sequence of interest and correct mRNA polyadenylation. The termination region may be native to the transcriptional initiation region, may be native to the operably linked nucleotide sequence of interest, may be native to the plant host, or may be derived from another source (i.e., foreign or heterologous to the promoter, the nucleotide sequence of interest, the plant host, or any combination thereof). Appropriate transcriptional terminators include, but are not limited to, the CAMV 35S terminator, the tm1 terminator, the nopaline synthase terminator and/or the pea rbcs E9 terminator. These can be used in both monocotyledons and dicotyledons. In addition, a coding sequence's native transcription terminator can be used.

An expression cassette of the invention also can include a nucleotide sequence for a selectable marker, which can be used to select a transformed plant, plant part and/or plant cell. As used herein, "selectable marker" means a nucleotide sequence that when expressed imparts a distinct phenotype to the plant, plant part and/or plant cell expressing the marker and thus allows such transformed plants, plant parts and/or plant cells to be distinguished from those that do not have the marker. Such a nucleotide sequence may encode either a selectable or screenable marker, depending on whether the marker confers a trait that can be selected for by chemical means, such as by using a selective agent (e.g., an antibiotic, herbicide, or the like), or on whether the marker is simply a trait that one can identify through observation or testing, such as by screening (e.g., the R-locus trait). Of course, many examples of suitable selectable markers are known in the art and can be used in the expression cassettes described herein.

Examples of selectable markers include, but are not limited to, a nucleotide sequence encoding neo or nptII, which confers resistance to kanamycin, G418, and the like (Potrykus et al. (1985) *Mol. Gen. Genet.* 199:183-188); a nucleotide sequence encoding bar, which confers resistance to phosphinothricin; a nucleotide sequence encoding an altered 5-enolpyruvylshikimate-3-phosphate (EPSP) synthase, which confers resistance to glyphosate (Hinchee et al. (1988) *Biotech.* 6:915-922); a nucleotide sequence encoding a nitrilase such as bxn from *Klebsiella ozaenae* that confers resistance to bromoxynil (Stalker et al. (1988) *Science* 242:419-423); a nucleotide sequence encoding an altered acetolactate synthase (ALS) that confers resistance to imidazolinone, sulfonylurea or other ALS-inhibiting chemicals (EP Patent Application No. 154204); a nucleotide sequence encoding a methotrexate-resistant dihydrofolate reductase (DHFR) (Thillet et al. (1988) *J. Biol. Chem.* 263:12500-12508); a nucleotide sequence encoding a dalapon dehalogenase that confers resistance to dalapon; a nucleotide sequence encoding a mannose-6-phosphate isomerase (also referred to as phosphomannose isomerase (PMI)) that confers an ability to metabolize mannose (U.S. Pat. Nos. 5,767,378 and 5,994,629); a nucleotide sequence encoding an altered anthranilate synthase that confers resistance to 5-methyl tryptophan; and/or a nucleotide sequence encoding hph that confers resistance to hygromycin. One of skill in the art is capable of choosing a suitable selectable marker for use in an expression cassette of the invention.

An expression cassette of the invention also can include polynucleotides that encode other desired traits. Such desired traits can be other polynucleotides which confer insect resistance, or which confer nematode resistance, or other agriculturally desirable traits. Such polynucleotides can be stacked with any combination of nucleotide sequences to create plants, plant parts or plant cells having the desired phenotype. Stacked combinations can be created by any method including, but not limited to, cross breeding plants by any conventional methodology, or by genetic transformation. If stacked by genetically transforming the plants, nucleotide sequences encoding additional desired traits can be combined at any time and in any order. For example, a single transgene can comprise multiple expression cassettes, such that multiple expression cassettes are introduced into the genome of a transformed cell at a single genomic location. Alternatively, a transgenic plant comprising one or more desired traits can be used as the target to introduce further traits by subsequent transformation. The additional nucleotide sequences can be introduced simultaneously in a co-transformation protocol with a nucleotide sequence, nucleic acid molecule, nucleic acid construct, and/or other composition of the invention, provided by any combination of expression cassettes. For example, if two nucleotide sequences will be introduced, they can be incorporated in separate cassettes (trans) or can be incorporated on the same cassette (cis). Expression of the nucleotide sequences can be driven by the same promoter or by different promoters. It is further recognized that nucleotide sequences can be stacked at a desired genomic location using a site-specific recombination system. See, e.g., Int'l Patent Application Publication Nos. WO 99/25821; WO 99/25854; WO 99/25840; WO 99/25855 and WO 99/25853.

Thus, an expression cassette can include a coding sequence for one or more polypeptides for agronomic traits that primarily are of benefit to a seed company, grower or grain processor. A polypeptide of interest can be any polypeptide encoded by a polynucleotide sequence of interest. Non-limiting examples of polypeptides of interest that are suitable for production in plants include those resulting in agronomically important traits such as herbicide resistance (also sometimes referred to as "herbicide tolerance"), virus resistance, bacterial pathogen resistance, insect resistance, nematode resistance, and/or fungal resistance. See, e.g., U.S. Pat. Nos. 5,569,823; 5,304,730; 5,495,071; 6,329,504; and 6,337,431.

Vectors suitable for plant transformation are described elsewhere in this specification. For *Agrobacterium*-mediated transformation, binary vectors or vectors carrying at least one T-DNA border sequence are suitable, whereas for direct gene transfer any vector is suitable and linear DNA containing only the construct of interest may be preferred. In the case of direct gene transfer, transformation with a single DNA species or co-transformation can be used (Schocher et al. Biotechnology 4:1093-1096 (1986)). For both direct gene transfer and *Agrobacterium*-mediated transfer, transformation is usually (but not necessarily) undertaken with a selectable marker that may provide resistance to an antibiotic (kanamycin, hygromycin or methotrexate) or a herbicide (basta). Plant transformation vectors of the invention may also comprise other selectable marker genes, for example, phosphomannose isomerase (pmi), which provides for positive selection of the transgenic plants as disclosed in U.S. Pat. Nos. 5,767,378 and 5,994,629, herein incorporated by reference, or phosphinotricin acetyltransferase (pat), which provides tolerance to the herbicide phosphinotricin (glufosinate). The choice of selectable marker is not, however, critical to the invention.

In other embodiments, a nucleic acid sequence of the invention is directly transformed into the plastid genome. Plastid transformation technology is extensively described in U.S. Pat. Nos. 5,451,513, 5,545,817, and 5,545,818, in PCT application no. WO 95/16783, and in McBride et al. (1994) Proc. Natl. Acad. Sci. USA 91, 7301-7305. The basic technique for chloroplast transformation involves introducing regions of cloned plastid DNA flanking a selectable marker together with the gene of interest into a suitable target tissue, e.g., using biolistics or protoplast transformation (e.g., calcium chloride or PEG mediated transformation). The 1 to 1.5 kb flanking regions, termed targeting sequences, facilitate homologous recombination with the plastid genome and thus allow the replacement or modification of specific regions of the plastome. Initially, point mutations in the chloroplast 16S rRNA and rps12 genes conferring resistance to spectinomycin and/or streptomycin are utilized as selectable markers for transformation (Svab, Z., Hajdukiewicz, P., and Maliga, P. (1990) Proc. Nati. Acad. Sci. USA 87, 8526-8530; Staub, J. M., and Maliga, P. (1992) Plant Cell 4, 39-45). This resulted in stable homoplasmic transformants at a frequency of approximately one per 100 bombardments of target leaves. The presence of cloning sites between these markers allowed creation of a plastid targeting vector for introduction of foreign genes (Staub, J. M., and Maliga, P. (1993) EMBO J. 12, 601-606). Substantial increases in transformation frequency are obtained by replacement of the recessive rRNA or r-protein antibiotic resistance genes with a dominant selectable marker, the bacterial aadA gene encoding the spectinomycin-cletoxifying enzyme aminoglycoside-3'-adenyltransferase (Svab, Z., and Maliga, P. (1993) Proc. Natl. Acad. Sci. USA 90, 913-917). Previously, this marker had been used successfully for high-frequency transformation of the plastid genome of the green alga *Chlamydomonas reinhardtii* (Goldschmidt-Clermont, M. (1991) Nucl. Acids Res. 19:4083-4089). Other selectable markers useful for plastid transformation are known in the art and encompassed within the scope of the invention. Typically, approximately 15-20 cell division cycles following transformation are required to reach a homoplastidic state. Plastid expression, in which genes are inserted by homologous recombination into all of the several thousand copies of the circular plastid genome present in each plant cell, takes advantage of the enormous copy number advantage over nuclear-expressed genes to permit expression levels that can readily exceed 10% of the total soluble plant protein. In a preferred embodiment, a nucleic acid sequence of the present invention is inserted into a plastid-targeting vector and transformed into the plastid genome of a desired plant host. Plants homoplastic for plastid genomes containing a nucleic acid sequence of the present invention are obtained, and are preferentially capable of high expression of the nucleic acid sequence.

Transgenic plants or seed comprising an interfering RNA of the invention can also be treated with an insecticide or insecticidal seed coating as described in U.S. Pat. Nos. 5,849,320 and 5,876,739, herein incorporated by reference. Where both the insecticide or insecticidal seed coating and the transgenic plant or seed of the invention are active against the same target insect, for example a coleopteran pest, a hemipteran pest or a *Diabrotica* target pest, the combination is useful (i) in a method for further enhancing activity of the composition of the invention against the target insect, and (ii) in a method for preventing development of resistance to the composition of the invention by providing yet another mechanism of action against the target insect. Thus, the invention provides a method of enhancing control of a coleopteran insect population, a hemipteran insect population, or a *Diabrotica* insect population comprising providing a transgenic plant or seed of the invention and applying to the plant or the seed an insecticide or insecticidal seed coating to a transgenic plant or seed of the invention. Examples of such insecticides and/or insecticidal seed coatings include, without limitation, a carbamate, a pyrethroid, an organophosphate, a fiprole, a neonicotinoid, an organochloride, a nereistoxin, or a combination thereof. In another embodiment, the insecticide or insecticidal seed coating are selected from the group consisting of carbofuran, carbaryl, methomyl, bifenthrin, tefluthrin, permethrin, cyfluthrin, lambda-cyhalothrin, cypermethrin, deltamethrin, chlorpyrifos, chlorethoxyfos, dimethoate, ethoprophos, malathion, methyl-parathion, phorate, terbufos, tebupirimiphos, fipronil, acetamiprid, imidacloprid, thiacloprid, thiamethoxam, endosulfan, bensultap, and a combination thereof. Commercial products containing such insecticides and insecticidal seed coatings include, without limitation, FURADAN® (carbofuran), LANATE® (methomyl, metomil, mesomile), SEVIN® (carbaryl), TALSTAR® (bifenthrin), FORCE® (tefluthrin), AMMO® (cypermethrin), CYMBUSH® (cypermethrin), DELTA GOLD® (deltamethrin), KARATE® (lambda-cyhalothrin), AMBUSH® (permethrin), POUNCE® (permethrin), BRIGADE® (bifenthrin), CAPTURE® (bifenthrin), PROSHIELD® (tefluthrin), WARRIOR® (lambda-cyhalothrin), DURSBAN® (chlorphyrifos), FORTRESS® (chlorethoxyfos), MOCAP® (ethoprop), THIMET® (phorate), AASTAR® (phorate, flucythinate), RAMPART® (phorate), COUNTER® (terbufos), CYGON® (dimethoate), DICAPTHON, REGENT® (fipronil), CRUISER® (thiamethoxam), GAUCHO® (imidacloprid), PRESCRIBE® (imidacloprid), PONCHO® (clothianidin) and AZTEC® (cyfluthrin, tebupirimphos).

The compositions of the invention can also be combined with other biological control agents to enhance control of a coleopteran insect, a hemipteran insect, or a *Diabrotica* insect population. Thus, the invention provides a method of enhancing control of a coleopteran insect population, hemipteran insect population, or a *Diabrotica* insect population by providing a transgenic plant that produces an interfering RNA of the invention and further comprises a polynucleotide that encodes a second insecticidal agent. The second insecticidal agent may be an insecticidal protein derived from *Bacillus thuringiensis*. A *B. thuringiensis* insecticidal protein can be any of a number of insecticidal proteins including but not limited to a Cry1 protein, a Cry3 protein, a Cry7 protein, a Cry8 protein, a Cry11 protein, a Cry22 protein, a Cry 23 protein, a Cry 36 protein, a Cry37 protein, a Cry34 protein together with a Cry35 protein, a binary insecticidal protein CryET33 and CryET34, a binary insecticidal protein TIC100 and TIC101, a binary insecticidal protein PS149B1, a VIP, a TIC900 or related protein, a TIC901, TIC1201, TIC407, TIC417, a modified Cry3A protein, or hybrid proteins or chimeras made from any of the preceding insecticidal proteins. In other embodiments, the *B. thuringiensis* insecticidal protein is selected from the group consisting of Cry3Bb1, Cry34Ab1 together with Cry35Ab1, mCry3A and eCry3.1Ab.

In other embodiments, the transgenic plant may produce an interfering RNA of the invention and a second insecticidal agent which is derived from sources other than *B. thuringiensis*. The second insecticidal agent can be an agent selected from the group comprising a patatin, a protease, a protease inhibitor, a chitinase, a urease, an alpha-amylase inhibitor, a pore-forming protein, a lectin, an engineered antibody or antibody fragment, a *Bacillus cereus* insecticidal protein, a *Xenorhabdus* spp. (such as *X. nematophila* or *X. bovienii*) insecticidal protein, a *Photorhabdus* spp. (such as *P. luminescens* or *P. asymobiotica*) insecticidal protein, a *Brevibacillus laterosporous* insecticidal protein, a *Lysinibacillus sphearicus* insecticidal protein, a *Chromobacterium* spp. insecticidal protein, a *Yersinia entomophaga* insecticidal protein, a *Paenibacillus popiliae* insecticidal protein, a *Clostridium* spp. (such as *C. bifermentans*) insecticidal protein, and a lignin. In other embodiments, the second agent may be at least one insecticidal protein derived from an insecticidal toxin complex (Tc) from *Photorhabdus, Xenorhabus, Serratia*, or *Yersinia*. In other embodiments, the insecticidal protein may be an ADP-ribosyltransferase derived from an insecticidal bacteria, such as *Photorhabdus* spp. In other embodiments, the insecticidal protein may be a VIP protein, such as VIP1 or VIP2 from *B. cereus*. In still other embodiments, the insecticidal protein may be a binary toxin derived from an insecticidal bacteria, such as ISP1A and ISP2A from *B. laterosporous* or BinA and BinB from L *sphaericus*. In still other embodiments, the insecticidal protein may be engineered or may be a hybrid or chimera of any of the preceding insecticidal proteins.

In another embodiment, the transgenic plant and transgenic seed is a corn plant or corn seed. In another embodiment, the transgenic corn plant is provided by crossing a first transgenic corn plant comprising a dsRNA of the invention with a transgenic corn plant comprising a transgenic event selected from the group consisting of MIR604, Event 5307, DAS51922-7, MON863 and MON88017.

Even where the insecticide or insecticidal seed coating is active against a different insect, the insecticide or insecticidal seed coating is useful to expand the range of insect control, for example by adding an insecticide or insecticidal seed coating that has activity against lepidopteran insects to the transgenic plant or seed of the invention, which has activity against coleopteran insects, the treated plant or coated transgenic seed controls both lepidopteran and coleopteran insect pests.

In further embodiments, the invention encompasses a biological sample from a transgenic plant, seed, or parts thereof, of the invention, wherein the sample comprises a nucleic acid that is or encodes at least one strand of a dsRNA of the invention. In other embodiments, the invention encompasses a commodity product derived from a transgenic plant, seed, or parts thereof, of the invention. In some embodiments, the commodity product is selected from the group consisting of whole or processed seeds, beans, grains, kernels, hulls, meals, grits, flours, sugars, sugars, starches, protein concentrates, protein isolates, waxes, oils, extracts, juices, concentrates, liquids, syrups, feed, silage, fiber, paper or other food or product produced from plants. In other embodiments, the biological sample or commodity product is toxic to insects. In other embodiments, the transgenic plant is a transgenic corn plant.

The invention further encompasses a method of controlling a coleopteran and/or hemipteran pest insect comprising contacting the insect with a nucleic acid molecule that is or is capable of producing an interfering RNA molecule of the invention for inhibiting expression of a target gene in the insect thereby controlling the coleopteran and/or hemipteran insect. In some embodiments, the target gene comprises a coding sequence (i) having at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, or 100% identity, to at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of any one of SEQ ID NOs:1-1814, or a complement thereof; (ii) comprising at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of any one SEQ ID NOs:1-1814, or a complement thereof; (iii) comprising at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of a nucleotide sequence encoding an amino acid sequence encoded by any one of SEQ ID NOs:1-1814, or a complement thereof. In some embodiments the target gene coding sequence comprises any one of SEQ ID NOs:1-1814, or a complement thereof, or (iv) can hybridize under stringent conditions to a polynucleotide selected from the group consisting of any one of SEQ ID NOs:1-1814, and the complements thereof. In other embodiments, the interfering RNA molecule of the invention is complementary to a portion of a mRNA polynucleotide transcribable from the pest insect target genes described herein.

In some embodiments of the method of controlling a coleopteran and/or hemipteran insect pest, the interfering RNA molecule of the invention comprises at least one dsRNA, wherein the dsRNA is a region of double-stranded RNA comprising annealed complementary strands, one strand of which comprises a sequence of at least 19 consecutive nucleotides which (i) has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, or 100% identity, to at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of any one of SEQ ID NOs:3629-7256, or the complement thereof; or (ii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of any one of SEQ ID NOs:3629-7256, or the complement thereof; (iii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of a nucleotide sequence encoding an amino acid sequence encoded by any one of SEQ ID NOs:3629-7256, or the complement thereof, or (iv) can hybridize under stringent conditions to a polynucleotide selected from the group consisting of any one of SEQ ID NOs:3629-7256, and the complements thereof.

In some embodiments of the method of controlling a coleopteran and/or hemipteran pest insect, the pest insect is selected from the group consisting of *Sitophilus oryzae* (So; rice weevil), *Diabrotica virgifera virgifera* (Dv; western corn rootworm), *Diabrotica undecimpunctata howardi* (Du; southern corn rootworm), *Diabrotica barberi* (db; northern corn rootworm), *Phyllotreta armoraciae* (Pa; horseradish flea beetle), *Phyllotreta nemorum* (Pn; turnip flea beetle), *Phyllotreta cruciferae* (Pu; crucifer flea beetle), *Phyllotreta striolata* (Ps; striped flea beetle), *Phyllotreta atra* (Pt; flea beetle), *Psylliodes chrysocephala* (Pc; cabbage-stem flea beetle), *Meligethes aeneus* (Ma; pollen beetle), *Ceutorhynchus assimilis* (Ca; cabbage seedpod weevil), *Leptinotarsa decemlineata* (Ld; Colorado potato beetle), and/or the hemipteran insect pest is selected from the group consisting of *Nezara viridula* (Nv; green stink bug), *Euschistus heros* (Eh; brown stink bug), and *Piezodorus guildinii* (Pg; red-banded stink bug).

In other embodiments of the method of controlling a coleopteran and/or hemipteran pest insect, the contacting comprises (a) planting a transgenic seed capable of producing a transgenic plant that expresses the nucleic acid molecule, wherein the insect feeds on the transgenic plant, or part thereof; or (b) applying a composition comprising the nucleic acid molecule to a seed or plant, or part thereof, wherein the insect feeds on the seed, the plant, or a part thereof. In some embodiments, the transgenic seed and the transgenic plant is a corn seed or a corn plant. In other embodiments the seed or plant is a corn seed or a corn plant.

The invention also encompasses a method of controlling a *Diabrotica* insect comprising contacting the *Diabrotica* insect with a nucleic acid molecule that is or is capable of producing the interfering RNA molecule of the invention for inhibiting expression of a target gene in the *Diabrotica* insect, and also contacting the *Diabrotica* insect with at least a second insecticidal agent for controlling *Diabrotica*, wherein said second insecticidal agent comprises a *B. thuringiensis* insecticidal protein, thereby controlling the *Diabrotica* insect. The invention also encompasses a method for controlling *Diabrotica* insect pests on a plant, comprising topically applying to said plant a pesticide composition comprising an interfering RNA of the invention and at least a second insecticidal agent for controlling *Diabrotica*, wherein said second insecticidal agent does not comprise a *B. thuringiensis* insecticidal protein, and providing said plant in the diet of said *Diabrotica* insect. The invention also encompasses a method wherein the second insecticidal agent comprises a patatin, a protease, a protease inhibitor, a urease, an alpha-amylase inhibitor, a pore-forming protein, a lectin, an engineered antibody or antibody fragment, or a chitinase. The second insecticidal agent may also be a *Bacillus cereus* insecticidal protein, a *Xenorhabdus* spp. insecticidal protein, a *Photorhabdus* spp. insecticidal protein, a *Brevibacillus laterosporous* insecticidal protein, a *Lysinibacillus sphearicus* insecticidal protein, a *Chromobacterium* ssp. insecticidal protein, a *Yersinia entomophaga* insecticidal protein, a *Paenibacillus popiliae* insecticidal protein, or a *Clostridium* spp. insecticidal protein.

The invention also encompasses a method of reducing an adult coleopteran insect population or an adult *Diabrotica* insect population on a transgenic plant expressing a Cry protein, a hybrid Cry protein or modified Cry protein comprising expressing in the transgenic plant a nucleic acid molecule that is or is capable of producing an interfering RNA molecule of the invention capable of inhibiting expression of a target gene as described herein in an adult insect, thereby reducing the adult coleopteran insect population or adult *Diabrotica* insect population.

In some embodiments, the invention encompasses a method of reducing the level of a target mRNA transcribable from a target gene as described herein in a coleopteran insect, a hemipteran insect or a *Diabrotica* insect comprising contacting the insect with a composition comprising the interfering RNA molecule of the invention, wherein the interfering RNA molecule reduces the level of the target mRNA in a cell of the insect. In some embodiments, the interfering RNA of the method comprises at least one dsRNA, wherein the dsRNA is a region of double-stranded RNA comprising annealed complementary strands, one strand of which comprises a sequence of at least 19 consecutive nucleotides which (i) has at least 80% identity, at least 85% identity, at least 86% identity, at least 87% identity, at least 88% identity, at least 89% identity, at least 90% identity, at least 91% identity, at least 92% identity, at least 93% identity, at least 94% identity, at least 95% identity, at least 96% identity, at least 97% identity, at least 98% identity, at least 99% identity, or 100% identity, to at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of any one of SEQ ID NOs:3629-7256, or the complement thereof; (ii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of any one of SEQ ID NOs:3629-7256, or the complement thereof; (iii) comprises at least a 19, at least a 20, at least a 21, at least a 22, at least a 23, at least a 24, at least a 25, at least a 26, at least a 27, at least a 28, at least a 29, at least a 30, at least a 35, at least a 40, at least a 45, at least a 50, at least a 55, at least a 60, at least a a 65, at least a 70, at least a 75, at least a 80, at least a 85, at least a 90, at least a 95, at least a 100, at least a 110, at least a 120, at least a 130, at least a 140, at least a 150, at least a 160, at least a 170, at least a 180, at least a 190, at least a 200, at least a 210, at least a 220, at least a 230, at least a 240, at least a 250, at least a 260, at least a 270, at least a 280, at least a 290, or at least a 300 consecutive nucleotide fragment of a nucleotide sequence encoding an amino acid sequence encoded by any one of SEQ ID NOs:3629-7256, or the complement thereof, or (iv) can hybridize under stringent conditions to a polynucleotide selected from the group consisting of any one of SEQ ID NOs:3629-7256, and the complements thereof, wherein the interfering RNA molecule has insecticidal activity against the target coleopteran insect, the target hemipteran insect or the target *Diabrotica* insect. In another embodiment, the contacting is achieved by the target insect feeding on the composition. In other embodiments, production of the protein encoded by the target mRNA is reduced. In other embodiments, the target protein comprises an amino acid having at least about 80%, at least about 85%, at least about 90%, at least about 91%, at least about 92%, at least about 93%, at least about 94%, at least about 95%, at least about 96%, at least about 97%, at least about 98% or at least about 99% identity to any one SEQ ID NOs:10885-12698. In other embodiments the target protein comprises any one SEQ ID NOs:10885-12698. In other embodiments, the interfering RNA is contacted with a coleopteran and/or hemipteran insect or a *Diabrotica* insect through a transgenic organism expressing the interfering RNA. In other embodiments, the transgenic organism is a transgenic plant, a transgenic microorganism, a transgenic bacterium or a transgenic endophyte. In other embodiments, the interfering RNA is contacted with a coleopteran and/or hemipteran insect or a *Diabrotica* insect by topically applying an interfering RNA in an acceptable agricultural carrier to a plant or plant part on which the insect feeds. In some embodiments, the interfering RNA that reduces the level of a target mRNA transcribable from a target gene described herein is lethal to the coleopteran and/or hemipteran insect or *Diabrotica* insect. In some embodiments, the *Diabrotica* insect is selected from the group consisting of *D. barberi* (northern corn rootworm), *D. virgifera virgifera* (western corn rootworm), *D. undecimpunctata howardi* (southern corn rootworm), *D. balteata* (banded cucumber beetle), *D. undecimpunctata undecimpunctata* (western spotted cucumber beetle), *D. significata* (3-spotted leaf beetle), *D. speciosa* (chrysanthemum beetle) and *D. virgifera zeae* (Mexican corn rootworm).

In some embodiments, the invention encompasses a method of conferring coleopteran and/or hemipteran insect tolerance or *Diabrotica* insect tolerance to a plant, or part thereof, comprising introducing into the plant, or part thereof, an interfering RNA molecule, a dsRNA molecule, a nucleic acid construct, a chimeric nucleic acid molecule, an artificial plant microRNA precursor molecule and/or a composition of the invention, wherein the dsRNA molecule, nucleic acid construct, chimeric nucleic acid molecule, artificial plant microRNA precursor molecule and/or composition of the invention are toxic to the insect, thereby conferring tolerance of the plant or part thereof to the coleopteran insect and/or hemipteran insect or *Diabrotica* insect. In other embodiments, the introducing step is performed by transforming a plant cell and producing the transgenic plant from the transformed plant cell. In still other embodiments, the introducing step is performed by breeding two plants together.

In other embodiments, the invention encompasses a method of reducing root damage to a plant fed upon by a *Diabrotica* insect, comprising introducing into cells of the plant an interfering RNA molecule, a dsRNA, a nucleic acid molecule, a nucleic acid construct, a chimeric nucleic acid molecule, an artificial plant microRNA precursor molecule and/or a composition of the invention, wherein the dsRNA, nucleic acid molecule, nucleic acid construct, chimeric nucleic acid molecule, artificial plant microRNA precursor molecule and/or composition of the invention are toxic to the *Diabrotica* insect, thereby reducing root damage to the plant. In other embodiments, the introducing step is performed by transforming a plant cell and producing the transgenic plant from the transformed plant cell. In still other embodiments, the introducing step is performed by breeding two plants together.

In still other embodiments, the invention encompasses a method of producing a transgenic plant cell having toxicity to a coleopteran insect and/or hemipteran insect or *Diabrotica* insect, comprising introducing into a plant cell an interfering RNA molecule, a dsRNA, a nucleic acid molecule, a nucleic acid construct, a chimeric nucleic acid molecule, an artificial plant microRNA precursor molecule and/or a composition of the invention, thereby producing the transgenic plant cell having toxicity to the insect compared to a control plant cell (e.g., a plant cell not comprising the interfering RNA molecule, the dsRNA, the nucleic acid molecule, the nucleic acid construct, the chimeric nucleic acid molecule, the artificial plant microRNA precursor molecule and/or the composition of the invention). In some embodiments, the invention encompasses a plurality of transgenic plant cells produced by this method. In other embodiments, the plurality of transgenic plant cells is grown under conditions which include natural sunlight. In other embodiments, the introducing step is performed by transforming a plant cell and producing the transgenic plant from the transformed plant cell. In still other embodiments, the introducing step is performed by breeding two plants together.

In some embodiments, the invention encompasses a method of producing a transgenic plant having enhanced tolerance to coleopteran and/or hemipteran or *Diabrotica* insect feeding damage, comprising introducing into a plant an interfering RNA molecule, a dsRNA, a nucleic acid molecule, a nucleic acid construct, a chimeric nucleic acid molecule, an artificial plant microRNA precursor molecule and/or a composition of the invention, thereby producing a transgenic plant having enhanced tolerance to coleopteran or *Diabrotica* insect feeding damage compared to a control plant (e.g., a plant not comprising the interfering RNA molecule, the dsRNA, the nucleic acid molecule, the nucleic acid construct, the chimeric nucleic acid molecule, the artificial plant microRNA precursor molecule and/or the composition of the invention). In other embodiments, the introducing step is performed by transforming a plant cell and producing the transgenic plant from the transformed plant cell. In still other embodiments, the introducing step is performed by breeding two plants together.

In some embodiments, the invention encompasses a method of providing a corn grower with a means of controlling a coleopteran and/or hemipteran insect pest population or a *Diabrotica* insect pest population in a corn crop comprising (a) selling or providing to the grower transgenic corn seed that comprises an interfering RNA, a nucleic acid molecule, a nucleic acid construct, a chimeric nucleic acid molecule, an artificial plant microRNA precursor molecule and/or a composition of the invention; and (b) advertising to the grower that the transgenic corn seed produce transgenic corn plants that control a coleopteran or *Diabrotica* pest population.

In some embodiments, the invention encompasses a method of identifying a target gene for using as a RNAi strategy for the control of a plant pest for RNAi in a coleopteran and/or hemipteran plant pest, said method comprising the steps of a) producing a primer pair with sequences selected from the group comprising or consisting of SEQ ID NOs:7257-10884, or a complement thereof; b) amplifying an orthologous target from a nucleic acid sample of the plant pest; c) identifying a sequence of an orthologous target gene; d) producing an interfering RNA molecule, wherein the RNA comprises at least one dsRNA, wherein the dsRNA is a region of double-stranded RNA comprising annealed complementary strands, one strand of which comprises a sequence of at least 19 consecutive nucleotides which is at least partially complementary to a target nucleotide sequence within a coleopteran target gene, is obtained; and e) determining if the interfering RNA molecule has insecticidal activity on the plant pest. If the interfering RNA has insecticidal activity on the coleopteran and/or hemipteran pest, a target gene for using in the control of the plant pest has been identified. In some embodiments, the plant pest is a coleopteran and/or hemipteran plant pest.

EXAMPLES

The invention will be further described by reference to the following detailed examples. These examples are provided for the purposes of illustration only, and are not intended to be limiting unless otherwise specified.

Example 1. Identification of Potential RNAi Lethal Genes in Sitophilus oryzae

This example describes the RNA sequencing, the dsRNA synthesis and the testing of all protein coding genes for RNAi induced lethality in a grain pest insect, Sitophilus oryzae (rice weevil).

1.1. RNA Sequencing and Transcriptome Generation of Sitophilus oryzae.

Total RNA was extracted from several Sitophilus oryzae adults, which were species-confirmed by COI barcoding. A whole-body adult Sitophilus oryzae transcriptome was generated by pair-end sequencing on an Illuma HiSeq X (Illumina, Inc., San Diego, CA), essentially according to the manufacturer's instructions. The resulting raw reads (i.e., short fragments of nucleic acid sequence) were de novo assembled using a set of three transcriptome assemblers (Trinity, Velvet/OASES and SOAPdenovo-Trans) to maximize diversity and completeness of the transcriptome. Redundancy in the assembly was reduced using the Evidential Gene pipeline (Genome Informatics Lab, Indiana University), which includes a coding sequence prediction step on the resulting transcripts. From this analysis, 13,509 coding sequences were identified, of which 9,650 (71%) were mapped to a Drosophila ortholog and 11,286 (84%) have at least one form of functional annotation.

1.2. dsRNA Synthesis of all Protein Coding Genes from Sitophilus oryzae dsRNAs of the 13,509 gene targets were produced on an 96 well library synthesis platform. All the dsRNA samples were designed automatically using Primer3 (Untergasser, A., et al. Nucleic Acids Research 40(15):115), a primer design tool, to synthetize a dsRNA fragment of around 500-800 bp based on the coding sequence of each protein coding gene. Smaller fragments were designed if the size of the coding sequence did not allow a 500 bp fragment. Each 96-well plate also contained three negative controls (dsRNA against a Green Fluorescent Protein—GFP) and a positive control (dsRNA against a ubiquitin protein of Sitophilus oryzae).

1.3. Primary Screen of dsRNA Samples for Activity Against Sitophilus oryzae

The dsRNA molecules described above were tested for toxicity against S. oryzae in laboratory bioassays. Bioassays were performed using an RNA-treated artificial diet method. Briefly, 96-well plates of synthesized dsRNA molecules were diluted in a flour suspension. The suspension was divided over 7 replicate 96-well plates and allowed to dry overnight in an oven set at 60° C. One insect was added to each well to have 7 adults per treatment. The plates were maintained at approximately 25° C. and 16/8 light:dark photoperiod. Mortality was recorded at different days post-infestation, with the final survival percentage calculated at 14 or 15 days with Abbott's correction for natural mortality (See for example, Abbott, W. S. J. Am. Mosquito Control Assoc. 3(2):302-303). dsRNA designed to target green fluorescent protein (GFP) was used as a negative control and dsRNA designed to target an ubiquitin protein of S. oryzae was used as a positive control. Results, shown in Table 1, demonstrate that 116 genes (SEQ ID NOs:1-116) in Sitophilus oryzae, when targeted by dsRNA are insecticidal to *Sitophilus oryzae*.

For Tables 1-7, the target gene is named as well as the Target ID. The "SEQ ID NO:" in Tables 1-7 indicates the RNA sequence of the sense strand of the dsRNA tested. "Survival %" is the final survival percentage calculated, with Abbott correction, for each insect bioassay.

TABLE 1

Activity of dsRNA against rice weevil

| Target ID | SEQ ID NO for Target | Putative gene name | Putative Flybase ID | SEQ ID NO: (RNA fragment) | Primary screen Percent Mortality (Abbott corr.) | Confirmation assay Percent Mortality (Abbott corr.) |
|---|---|---|---|---|---|---|
| Gene00101 | 1 | cactin | CG1676 | 3629 | 79 | 26 |
| Gene00111 | 2 | CstF64 | CG7697 | 3630 | 74.8 | 100 |
| Gene00116 | 3 | Rpt4 | CG3455 | 3631 | 100 | 100 |
| Gene00120 | 4 | Prosalpha3 | CG9327 | 3632 | 100 | 100 |
| Gene00129 | 5 | Rpn1 | CG7762 | 3633 | 100 | 100 |
| Gene00132 | 6 | pnr | CG10278 | 3634 | 100 | 100 |
| Gene00134 | 7 | garz | CG8487 | 3635 | 100 | 100 |
| Gene00140 | 8 | Prosbeta3 | CG11981 | 3636 | 100 | 100 |
| Gene00143 | 9 | Trn-SR | CG2848 | 3637 | 74.8 | 0 |
| Gene00161 | 10 | Bap60 | CG4303 | 3638 | 79 | 47 |
| Gene00171 | 11 | l(1)10Bb | CG1639 | 3639 | 100 | 8 |
| Gene00180 | 12 | Pop2 | CG5684 | 3640 | 74.8 | 5 |
| Gene00183 | 13 | CG7483 | CG7483 | 3641 | 100 | 89 |
| Gene00187 | 14 | CCT4 | CG5525 | 3642 | 79 | 89 |
| Gene00190 | 15 | Rpt3 | CG16916 | 3643 | 100 | 100 |
| Gene00191 | 16 | SkpA | CG16983 | 3644 | 79 | 47 |
| Gene00196 | 17 | mts | CG7109 | 3645 | 100 | 100 |
| Gene00213 | 18 | Ubi-p63E | CG11624 | 3646 | 100 | 100 |
| Gene00220 | 19 | CCT7 | CG8351 | 3647 | 100 | 100 |
| Gene00228 | 20 | Dhc64C | CG7507 | 3648 | 82 | 37 |
| Gene00233 | 21 | l(2)37Cb | CG10689 | 3649 | 100 | 65 |
| Gene00236 | 22 | pont | CG4003 | 3650 | 82 | 100 |
| Gene00237 | 23 | Cpsf100 | CG1957 | 3651 | 100 | 100 |
| Gene00238 | 24 | Sf3a1 | CG16941 | 3652 | 100 | 100 |
| Gene00242 | 25 | Rpn8 | CG3416 | 3653 | 100 | 100 |
| Gene00245 | 26 | CCT3 | CG8977 | 3654 | 79 | 100 |
| Gene00266 | 27 | Prosbeta6 | CG4097 | 3655 | 100 | 100 |

TABLE 1-continued Activity of dsRNA against rice weevil

| Target ID | SEQ ID NO for Target | Putative gene name | Putative Flybase ID | SEQ ID NO: (RNA fragment) | Primary screen Percent Mortality (Abbott corr.) | Confirmation assay Percent Mortality (Abbott corr.) |
|---|---|---|---|---|---|---|
| Gene00268 | 28 | Ufd1-like | CG6233 | 3656 | 100 | 75 |
| Gene00269 | 29 | CCT5 | CG8439 | 3657 | 82 | 68 |
| Gene00276 | 30 | Roc1a | CG16982 | 3658 | 82 | 68 |
| Gene00277 | 31 | CCT2 | CG7033 | 3659 | 82 | 100 |
| Gene00281 | 32 | Prosalpha6 | CG4904 | 3660 | 100 | 100 |
| Gene00282 | 33 | fand | CG6197 | 3661 | 100 | 58 |
| Gene00283 | 34 | Spx | CG3780 | 3662 | 64 | 47 |
| Gene00284 | 35 | RpL8 | CG1263 | 3663 | 100 | 68 |
| Gene00286 | 36 | His3:CG31613 | CG31613 | 3664 | 100 | 68 |
| Gene00289 | 37 | CCT6 | CG8231 | 3665 | 100 | 79 |
| Gene00305 | 38 | Uba1 | CG1782 | 3666 | 100 | 68 |
| Gene00306 | 39 | Hel25E | CG7269 | 3667 | 100 | 100 |
| Gene00309 | 40 | Rpn3 | CG42641 | 3668 | 100 | 100 |
| Gene00313 | 41 | Slu7 | CG1420 | 3669 | 100 | 100 |
| Gene00323 | 42 | RpS8 | CG7808 | 3670 | 79 | 100 |
| Gene00325 | 43 | Rpn11 | CG18174 | 3671 | 100 | 100 |
| Gene00337 | 44 | Rpt6 | CG1489 | 3672 | 100 | 100 |
| Gene00340 | 45 | Ykt6 | CG1515 | 3673 | 100 | 100 |
| Gene00343 | 46 | Prosalpha5 | CG10938 | 3674 | 100 | 100 |
| Gene00356 | 47 | Vha44 | CG8048 | 3675 | 82 | 8 |
| Gene00367 | 48 | CCT1 | CG5374 | 3676 | 100 | 100 |
| Gene00368 | 49 | Prosbeta7 | CG12000 | 3677 | 100 | 88 |
| Gene00370 | 50 | Exo84 | CG6095 | 3678 | 100 | 68 |
| Gene00379 | 51 | pea | CG8241 | 3679 | 100 | 100 |
| Gene00384 | 52 | CG9175 | CG9175 | 3680 | 100 | 100 |
| Gene00416 | 53 | Rpn6 | CG10149 | 3681 | 100 | 100 |
| Gene00418 | 54 | Lam | CG6944 | 3682 | 100 | 100 |
| Gene00424 | 55 | TER94 | CG2331 | 3683 | 100 | 89 |
| Gene00428 | 56 | cpb | CG17158 | 3684 | 100 | 68 |
| Gene00429 | 57 | fs(1)h | CG2252 | 3685 | 82 | 42 |
| Gene00532 | 58 | RpL4 | CG5502 | 3686 | 82 | 88 |
| Gene00544 | 59 | Spt6 | CG12225 | 3687 | 100 | 100 |
| Gene00557 | 60 | ncm | CG12750 | 3688 | 100 | 100 |
| Gene00892 | 61 | Rop | CG15811 | 3689 | 100 | 100 |
| Gene00949 | 62 | Sec10 | CG6159 | 3690 | 82.9 | 100 |
| Gene01074 | 63 | Sf3a2 | CG10754 | 3691 | 65.8 | 90 |
| Gene01187 | 64 | SmD3 | CG8427 | 3692 | 81.1 | 100 |
| Gene01510 | 65 | UQCR-C2 | CG4169 | 3693 | 83.8 | 100 |
| Gene01576 | 66 | Bet1 | CG14084 | 3694 | 100 | 83 |
| Gene01649 | 67 | Vha55 | CG17369 | 3695 | 100 | 100 |
| Gene01735 | 68 | CG15862 | CG15862 | 3696 | 65.7 | 0 |
| Gene01896 | 69 | arm | CG11579 | 3697 | 82.8 | 100 |
| Gene02220 | 70 | CG9667 | CG9667 | 3698 | 65.7 | 100 |
| Gene02411 | 71 | Ran | CG1404 | 3699 | 100 | 100 |
| Gene02760 | 72 | Ssk | CG6981 | 3700 | 100 | 100 |
| Gene02775 | 73 | Cdc5 | CG6905 | 3701 | 100 | 75 |
| Gene03652 | 74 | AP-1sigma | CG5864 | 3702 | 100 | 100 |
| Gene03841 | 75 | CG11779 | CG11779 | 3703 | 67.6 | 83 |
| Gene04283 | 76 | CG1542 | CG1542 | 3704 | 63 | 0 |
| Gene04844 | 77 | pea | CG8241 | 3705 | 100 | 91 |
| Gene05081 | 78 | pAbp | CG5119 | 3706 | 100 | 100 |
| Gene05129 | 79 | AP-1-2beta | CG12532 | 3707 | 100 | 100 |
| Gene05740 | 80 | RpL12 | CG3195 | 3708 | 100 | 100 |
| Gene06225 | 81 | CG1129 | CG1129 | 3709 | 100 | 100 |
| Gene06978 | 82 | cpa | CG10540 | 3710 | 63.1 | 75 |
| Gene08627 | 83 | mesh | CG31004 | 3711 | 100 | 100 |
| Gene08840 | 84 | RpLP2 | CG4918 | 3712 | 100 | 90 |
| Gene08867 | 85 | alpha-Cat | CG17947 | 3713 | 100 | 100 |
| Gene08949 | 86 | Nup62 | CG6251 | 3714 | 80.6 | 90 |
| Gene09268 | 87 | Sar1 | CG7073 | 3715 | 100 | 100 |
| Gene09411 | 88 | DCTN3-p24 | CG9893 | 3716 | 80.6 | 31 |
| Gene09812 | 89 | Sac1 | CG9128 | 3717 | 80.6 | 90 |
| Gene09966 | 90 | atms | CG2503 | 3718 | 80.6 | 100 |
| Gene10001 | 91 | Rpn7 | CG5378 | 3719 | 100 | 100 |
| Gene10086 | 92 | Lpt | CG5591 | 3720 | 80.6 | 1 |
| Gene10142 | 93 | DNApol-alpha180 | CG6349 | 3721 | 68.4 | 70 |
| Gene10189 | 94 | rept | CG9750 | 3722 | 100 | 100 |
| Gene10549 | 95 | Snr1 | CG1064 | 3723 | 68.4 | 41 |
| Gene10649 | 96 | Rho1 | CG8416 | 3724 | 100 | 100 |
| Gene10683 | 97 | Nup154 | CG4579 | 3725 | 68.4 | 50 |
| Gene10692 | 98 | Nup160 | CG4738 | 3726 | 68.4 | 80 |

TABLE 1-continued

Activity of dsRNA against rice weevil

| Target ID | SEQ ID NO for Target | Putative gene name | Putative Flybase ID | SEQ ID NO: (RNA fragment) | Primary screen Percent Mortality (Abbott corr.) | Confirmation assay Percent Mortality (Abbott corr.) |
|---|---|---|---|---|---|---|
| Gene10724 | 99 | Cse1 | CG13281 | 3727 | 84.2 | 70 |
| Gene10755 | 100 | asf1 | CG9383 | 3728 | 100 | 100 |
| Gene11048 | 101 | Tbp | CG9874 | 3729 | 84.2 | 80 |
| Gene11055 | 102 | ATPsyndelta | CG2968 | 3730 | 100 | 100 |
| Gene11554 | 103 | nudC | CG9710 | 3731 | 84.2 | 70 |
| Gene11636 | 104 | Srp19 | CG4457 | 3732 | 64.3 | 100 |
| Gene11792 | 105 | crn | CG3193 | 3733 | 64.3 | 100 |
| Gene12327 | 106 | Sec61alpha | CG9539 | 3734 | 100 | 100 |
| Gene12548 | 107 | Cbp20 | CG12357 | 3735 | 100 | 100 |
| Gene12739 | 108 | Cyt-c1 | CG4769 | 3736 | 100 | 100 |
| Gene12888 | 109 | CG6015 | CG6015 | 3737 | 82.1 | 100 |
| Gene13224 | 110 | RpL7A | CG3314 | 3738 | 100 | 100 |
| Gene13823 | 111 | betaggt-II | CG18627 | 3739 | 68.2 | 100 |
| Gene13837 | 112 | Fs(2)Ket | CG2637 | 3740 | 100 | 100 |
| Gene13977 | 113 | noi | CG2925 | 3741 | 100 | 100 |
| Gene14143 | 114 | SmB | CG5352 | 3742 | 82.9 | 100 |
| Gene14302 | 115 | CG43088 | CG43088 | 3743 | 65.8 | 31 |
| Gene14726 | 116 | CG3848 | CG3848 | 3744 | 65.8 | 41 |

1.4. Confirmation Assay of Candidate RNAi Targets in *Sitophilus oryzae*

The dsRNA molecules that gave the highest mortality in the primary screen were re-arrayed in 96-well plates and tested with twelve replicates in the same *Sitophilus oryzae* laboratory bioassay as described above. Results of the confirmation assay can also be found in Table 1.

It has previously been suggested that certain genes of a given insect species can be predicted to confer an RNAi-mediated insecticidal effect based on the essential nature of the gene in insects. However, empirical evaluation of the target genes revealed that the insecticidal effect could not be predicted (See, for example, Baum et al., 2007, Nature Biotechnology 25: 1322-1326; also U.S. Patent Publication No. 2015/0322456). Additionally, it has been suggested that a gene which has been shown to be a useful target for RNAi-mediated insect control for one insect pest may be a useful target for RNAi-mediated insect control of a second insect pest of a different genus and/or family. However, empirical evaluation of the target gene in different insect pests of different families show that a given target with very high insecticidal activity in one insect pest may not produce significant mortality or growth inhibition in a second insect pest (Knorr et al, 2018, Scientific Reports 8: 2061, DOI: 10.1038/s41598-018-20416-y). Therefore, the insecticidal activity of a dsRNA molecule against a target gene of an insect pest can only be determined empirically.

Example 2. Identification of Potential RNAi Lethal Target Genes in Corn Rootworm This example describes the testing of dsRNA molecules against target genes in western corn rootworm, *Diabrotica virgifera virgifera* (Dv), southern corn rootworm, *Diabrotica undecimpunctata howardi* (Du), and northern corn rootworm, *Diabrotica barberi* (db), that are orthologues of the *Sitophilus oryzae* target genes described in Table 1.

2.1. RNA Sequencing and Transcriptome Generation of Corn Rootworms.

The corn rootworm transcriptomes were generated in a similar way as described for *Sitophilus oryzae* in Example 1. With BLAST most of the orthologous genes from the *Sitophilus oryzae* positives were identified in the transcriptomes of the different rootworm species; Dv (SEQ ID NOs:117-228), Du (SEQ ID NOs:229-340) and for db (SEQ ID NOs:341-451).

2.2. dsRNA Synthesis from the Candidate Target Genes of Corn Rootworm.

The same 96-well library synthesis platform was used to produce dsRNA samples for testing against corn rootworm. The negative control (dsRNA against a Green Fluorescent Protein—GFP) and the positive control (dsRNA against the species specific ubiquitin protein) were produced in the same manner.

2.3. Testing of dsRNA Samples Against Corn Rootworms.

Bioassays were performed using an RNA-treated artificial diet method. Briefly, molten artificial diet, modified from the diet of Marrone et al. 1985 (J. Econ. Entomol. 78:290-293), was poured into each well of 48-well plates and allowed to solidify. dsRNA molecules were diluted to the appropriate concentration such that 20 µl of solution was added to the surface of the diet in half of the wells of a 48-well plate, with a final overlay concentration of 0.1 µg dsRNA per well. One or two corn rootworm larvae were added to each well to have between 24 and 48 replicate larvae per dsRNA tested. Each 48-well plate was maintained at approximately 26° C. and 16:8 light:dark photoperiod. Mortality was recorded at 7 days after treatment. The results, shown in Table 2, demonstrate that 112 dsRNA molecules having complementarity to 112 target genes, which are orthologues to the initial 116 *Sitophilus* target genes described in Table 1, are highly toxic to *Diabrotica virgifera virgifera* (Dv; western corn rootworm).

TABLE 2

Results of Dv dsRNA primary screen

| Target ID | SEQ ID NO for Target | Putative Gene name | Putative Flybase ID | SEQ ID NO: (RNA fragment) | Percent Mortality (Abbott corr.) |
|---|---|---|---|---|---|
| Gene00101 | 117 | cactin | CG1676 | 3745 | 36.6 |
| Gene00111 | 118 | CstF64 | CG7697 | 3746 | 45.2 |
| Gene00116 | 119 | Rpt4 | CG3455 | 3747 | 60.6 |
| Gene00120 | 120 | Prosalpha3 | CG9327 | 3748 | 48.7 |

TABLE 2-continued

Results of Dv dsRNA primary screen

| Target ID | SEQ ID NO for Target | Putative Gene name | Putative Flybase ID | SEQ ID NO: (RNA fragment) | Percent Mortality (Abbott corr.) |
|---|---|---|---|---|---|
| Gene00129 | 121 | Rpn1 | CG7762 | 3749 | 74.6 |
| Gene00132 | 122 | pnr | CG10278 | 3750 | 86.5 |
| Gene00134 | 123 | garz | CG8487 | 3751 | 32.5 |
| Gene00140 | 124 | Prosbeta3 | CG11981 | 3752 | 68 |
| Gene00143 | 125 | Tm-SR | CG2848 | 3753 | 54.1 |
| Gene00161 | 126 | Bap60 | CG4303 | 3754 | 94.2 |
| Gene00171 | 127 | l(1)10Bb | CG1639 | 3755 | 43 |
| Gene00180 | 128 | Pop2 | CG5684 | 3756 | 79.3 |
| Gene00183 | 129 | CG7483 | CG7483 | 3757 | 44.6 |
| Gene00187 | 130 | CCT4 | CG5525 | 3758 | 50.3 |
| Gene00190 | 131 | Rpt3 | CG16916 | 3759 | 38 |
| Gene00191 | 132 | SkpA | CG16983 | 3760 | 49.8 |
| Gene00196 | 133 | mts | CG7109 | 3761 | 55.6 |
| Gene00213 | 134 | Ubi-p63E | CG11624 | 3762 | 100 |
| Gene00220 | 135 | CCT7 | CG8351 | 3763 | 57.5 |
| Gene00228 | 136 | Dhc64C | CG7507 | 3764 | 90.7 |
| Gene00233 | 137 | l(2)37Cb | CG10689 | 3765 | 30.6 |
| Gene00236 | 138 | pont | CG4003 | 3766 | 83.1 |
| Gene00237 | 139 | Cpsf100 | CG1957 | 3767 | 71.1 |
| Gene00238 | 140 | Sf3a1 | CG16941 | 3768 | 48.9 |
| Gene00242 | 141 | Rpn8 | CG3416 | 3769 | 53.7 |
| Gene00245 | 142 | CCT3 | CG8977 | 3770 | 75.7 |
| Gene00266 | 143 | Prosbeta6 | CG4097 | 3771 | 52.8 |
| Gene00268 | 144 | Ufd1-like | CG6233 | 3772 | 30.2 |
| Gene00269 | 145 | CCT5 | CG8439 | 3773 | 82.2 |
| Gene00276 | 146 | Roc1a | CG16982 | 3774 | 66 |
| Gene00277 | 147 | CCT2 | CG7033 | 3775 | 75.3 |
| Gene00281 | 148 | Prosalpha6 | CG4904 | 3776 | 67.8 |
| Gene00282 | 149 | fand | CG6197 | 3777 | 61.8 |
| Gene00283 | 150 | Spx | CG3780 | 3778 | 61.4 |
| Gene00284 | 151 | RpL8 | CG1263 | 3779 | 66.4 |
| Gene00286 | 152 | His3:CG31613 | CG31613 | 3780 | 82.7 |
| Gene00289 | 153 | CCT6 | CG8231 | 3781 | 82.7 |
| Gene00305 | 154 | Uba1 | CG1782 | 3782 | 45.8 |
| Gene00306 | 155 | Hel25E | CG7269 | 3783 | 75.3 |
| Gene00309 | 156 | Rpn3 | CG42641 | 3784 | 64.2 |
| Gene00313 | 157 | Slu7 | CG1420 | 3785 | 35.5 |
| Gene00323 | 158 | RpS8 | CG7808 | 3786 | 54.2 |
| Gene00325 | 159 | Rpn11 | CG18174 | 3787 | 70.7 |
| Gene00337 | 160 | Rpt6 | CG1489 | 3788 | 71.7 |
| Gene00340 | 161 | Ykt6 | CG1515 | 3789 | 78.5 |
| Gene00343 | 162 | Prosalpha5 | CG10938 | 3790 | 69.8 |
| Gene00367 | 163 | CCT1 | CG5374 | 3791 | 39.4 |
| Gene00368 | 164 | Prosbeta7 | CG12000 | 3792 | 49.4 |
| Gene00370 | 165 | Exo84 | CG6095 | 3793 | 30.3 |
| Gene00379 | 166 | pea | CG8241 | 3794 | 33.6 |
| Gene00384 | 167 | CG9175 | CG9175 | 3795 | 41.1 |
| Gene00416 | 168 | Rpn6 | CG10149 | 3796 | 62.6 |
| Gene00418 | 169 | Lam | CG6944 | 3797 | 39.9 |
| Gene00424 | 170 | TER94 | CG2331 | 3798 | 69.9 |
| Gene00428 | 171 | cpb | CG17158 | 3799 | 38.2 |
| Gene00429 | 172 | fs(1)h | CG2252 | 3800 | 33.4 |
| Gene00532 | 173 | RpL4 | CG5502 | 3801 | 61.9 |
| Gene00544 | 174 | Spt6 | CG12225 | 3802 | 65.8 |
| Gene00557 | 175 | ncm | CG12750 | 3803 | 55.5 |
| Gene00892 | 176 | Rop | CG15811 | 3804 | 70.1 |
| Gene00949 | 177 | Sec10 | CG6159 | 3805 | 57.7 |
| Gene01074 | 178 | Sf3a2 | CG10754 | 3806 | 39.7 |
| Gene01187 | 179 | SmD3 | CG8427 | 3807 | 34.8 |
| Gene01510 | 180 | UQCR-C2 | CG4169 | 3808 | 60.1 |
| Gene01576 | 181 | Bet1 | CG14084 | 3809 | 57.1 |
| Gene01649 | 182 | Vha55 | CG17369 | 3810 | 67.6 |
| Gene01735 | 183 | CG15862 | CG15862 | 3811 | 35.4 |
| Gene01896 | 184 | arm | CG11579 | 3812 | 88.7 |
| Gene02220 | 185 | CG9667 | CG9667 | 3813 | 58 |
| Gene02411 | 186 | Ran | CG1404 | 3814 | 36.7 |
| Gene02775 | 187 | Cdc5 | CG6905 | 3815 | 35.7 |
| Gene03652 | 188 | AP-1sigma | CG5864 | 3816 | 55.1 |
| Gene03841 | 189 | CG11779 | CG11779 | 3817 | 46.1 |
| Gene04283 | 190 | CG1542 | CG1542 | 3818 | 50.4 |
| Gene04844 | 191 | pea | CG8241 | 3819 | 54.3 |
| Gene05081 | 192 | pAbp | CG5119 | 3820 | 62.1 |
| Gene05129 | 193 | AP-1-2beta | CG12532 | 3821 | 75.8 |
| Gene05740 | 194 | RpL12 | CG3195 | 3822 | 67.4 |
| Gene06225 | 195 | CG1129 | CG1129 | 3823 | 91 |
| Gene06978 | 196 | cpa | CG10540 | 3824 | 52.4 |
| Gene08627 | 197 | mesh | CG31004 | 3825 | 100 |
| Gene08840 | 198 | RpLP2 | CG4918 | 3826 | 38.6 |
| Gene08867 | 199 | alpha-Cat | CG17947 | 3827 | 97.4 |
| Gene08949 | 200 | Nup62 | CG6251 | 3828 | 59.6 |
| Gene09268 | 201 | Sar1 | CG7073 | 3829 | 36.3 |
| Gene09411 | 202 | DCTN3-p24 | CG9893 | 3830 | 69.4 |
| Gene09812 | 203 | Sac1 | CG9128 | 3831 | 47.2 |
| Gene09966 | 204 | atms | CG2503 | 3832 | 62.2 |
| Gene10001 | 205 | Rpn7 | CG5378 | 3833 | 39.3 |
| Gene10086 | 206 | Lpt | CG5591 | 3834 | 49.3 |
| Gene10142 | 207 | DNApol-alpha180 | CG6349 | 3835 | 43.1 |
| Gene10549 | 208 | Snrl | CG1064 | 3836 | 35.9 |
| Gene10683 | 209 | Nup154 | CG4579 | 3837 | 36.7 |
| Gene10692 | 210 | Nup160 | CG4738 | 3838 | 36.7 |
| Gene10724 | 211 | Cse1 | CG13281 | 3839 | 43.4 |
| Gene10755 | 212 | asf1 | CG9383 | 3840 | 46.5 |
| Gene11048 | 213 | Tbp | CG9874 | 3841 | 34.3 |
| Gene11055 | 214 | ATPsyndelta | CG2968 | 3842 | 93.5 |
| Gene11554 | 215 | nudC | CG9710 | 3843 | 41.9 |
| Gene11636 | 216 | Srp19 | CG4457 | 3844 | 32.3 |
| Gene11792 | 217 | crn | CG3193 | 3845 | 55.9 |
| Gene12327 | 218 | Sec61alpha | CG9539 | 3846 | 78 |
| Gene12548 | 219 | Cbp20 | CG12357 | 3847 | 50.2 |
| Gene12739 | 220 | Cyt-c1 | CG4769 | 3848 | 57.7 |
| Gene12888 | 221 | CG6015 | CG6015 | 3849 | 40 |
| Gene13224 | 222 | RpL7A | CG3314 | 3850 | 71.7 |
| Gene13823 | 223 | betaggt-II | CG18627 | 3851 | 38.2 |
| Gene13837 | 224 | Fs(2)Ket | CG2637 | 3852 | 45.1 |
| Gene13977 | 225 | noi | CG2925 | 3853 | 38 |
| Gene14143 | 226 | SmB | CG5352 | 3854 | 45 |
| Gene14302 | 227 | CG43088 | CG43088 | 3855 | 30.2 |
| Gene14726 | 228 | CG3848 | CG3848 | 3856 | 50 |

In a similar assay, the orthologue genes were tested in *Diabrotica barberi*. dsRNA molecules were diluted to the appropriate concentration such that 20 µl of solution was added to the surface of the diet in a 48-well plate, with a final overlay concentration of 1 µg dsRNA per well. One corn rootworm larvae was added to each well to have approximately 48 replicate larvae per dsRNA tested. Each 48-well plate was maintained at approximately 26° C. and 16:8 light:dark photoperiod. Mortality was recorded at different days after treatment. The results, shown in Table 3, demonstrate that dsRNA having complementarity to target genes, which are orthologues to *Sitophilus* target genes described in Table 1, are highly toxic to *Diabrotica barberi* (db; northern corn rootworm).

TABLE 3

Results of Db dsRNA primary screen

| Target ID | SEQ ID NO for Target | Putative Gene Name | Putative Flybase ID | SEQ ID NO: (RNA fragment) | Percent Mortality (Abbott corr.) |
|---|---|---|---|---|---|
| Gene00892 | 400 | Rop | CG15811 | 4028 | 87 |
| Gene01896 | 408 | arm | CG11579 | 4036 | 77 |
| Gene05129 | 416 | AP-1-2beta | CG12532 | 4044 | 88 |
| Gene06225 | 418 | CG1129 | CG1129 | 4046 | 67 |

TABLE 3-continued

Results of Db dsRNA primary screen

| Target ID | SEQ ID NO for Target | Putative Gene Name | Putative Flybase ID | SEQ ID NO: (RNA fragment) | Percent Mortality (Abbott corr.) |
|---|---|---|---|---|---|
| Gene08627 | 420 | mesh | CG31004 | 4048 | 84 |
| Gene08867 | 422 | alpha-Cat | CG17947 | 4050 | 96 |
| Gene11055 | 437 | ATPsyndelta | CG2968 | 4065 | 61 |
| Gene12327 | 441 | Sec61alpha | CG9539 | 4069 | 70 |
| Gene13224 | 445 | RpL7A | CG3314 | 4073 | 79 |

2.4. Testing of dsRNA Samples Against WCR in a Dose Response Curve.

This example describes testing dsRNAs of the invention for biological activity against *Diabrotica virgifera virgifera* (Dv; western corn rootworm).

The dsRNA molecules described above were tested for toxicity against WCR in laboratory bioassays in a 10-fold dilution series starting from 0.1 µg dsRNA/well. Bioassays were performed using an RNA-treated artificial diet method as described above. Synthesized dsRNA molecules were diluted to the appropriate concentration such that 20 µl of solution was added to the surface of the diet in half of the wells of a 48-well plate, with a final overlay concentration of 0.1 µg, 0.01 µg, 0.001 µg and 0.0001 µg per well. One or two WCR larvae were added to each well to have between 24 and 48 replicate larvae per concentration of dsRNA tested. Each 48-well plate was maintained at approximately 26° C. and 16:8 light:dark photoperiod. Mortality was recorded at 1, 2, 3, 4, 6 and 7 d post-infestation. dsRNA designed to target GFP was used as a negative control and dsRNA designed to target an ubiquitin gene of WCR was used as a positive control.

The results confirm that the dsRNA molecules designed to target mRNA transcribable from Dv genes are highly toxic to Dv. See Table 4. After correction for the control mortality on the GFP dsRNA, the estimated $LT_{50}$ (time to obtain 50% mortality to pest insect population) and $LC_{50}$ (dsRNA concentration required to obtain 50% mortality in test insect population) were calculated by curve fitting analysis. The % mortality at day 7 is based on 0.1 µg dsRNA/well. The LT50 is based on using 0.1 µg dsRNA and is measured in days. The LC50 is measured in µg dsRNA/well.

Example 3. Expression of an RNAi Molecule Comprising Target dsRNA in Corn Plants This example describes introducing a construct that expresses an interfering RNA molecule into plant cells.

Vector Construction

Expression vectors designed to produce hairpin RNAs (hpRNA) consist of a cassette containing a promoter, a sense strand, an intron functioning as a loop sequence, an antisense strand, and terminator. A binary vector comprising an expression cassette comprising a DNA sequence designed to produce a hpRNA targeting a nucleotide fragment of a target gene described above is constructed. The binary vector also contains a second cassette between the left and right borders, designed to express phosphomannose isomerase (PMI) which confers unto the plant cell the ability to metabolize mannose (U.S. Pat. Nos. 5,767,378 and 5,994,629, which are incorporated by reference herein) as a selectable marker during plant transformation. The vectors also contain selectable markers for selection in bacteria.

*Agrobacterium* Mediated Transformation

Each resulting plasmid containing the hairpin cassette is transformed into *Agrobacterium tumefaciens* using standard molecular biology techniques known to those skilled in the art. The vectors described above are transformed into maize. *Agrobacterium* transformation of immature maize embryos is performed essentially as described in Negrotto et al., 2000, Plant Cell Reports 19: 798-803. For this example, all media constituents are essentially as described in Negrotto et al., supra. However, various media constituents known in the art may be substituted. Following transformation, selection, and regeneration, plants are tested for the presence of the pmi gene and the hairpin dsRNA interfering RNA molecule. Positive plants from the PCR assay are transferred to the greenhouse and tested for resistance to at least *Diabrotica virgifera* (Dv, western corn rootworm).

Transgenic Maize Dv Insecticidal Assay

F1 progeny of transgenic maize plants comprising the transgene a binary vector described above are germinated and allowed to grow. A PMI ELISA strip test (Romer Labs SeedChek® PMI (#7000052)) is used to identify plants positive for the transgene and null, non-transgenic segregating sister plants. Each plant is infested with 10 neonate western corn rootworms at its base. Seven days after infestation, the survival and size of the rootworms are evaluated.

TABLE 4

DRC results of dsRNA against Dv

| Target ID | SEQ ID NO for Target | Putative Gene Name | Putative Flybase ID | SEQ ID NO: (RNA fragment) | Percent Mortality (Abbott corr.) | LC50 (µg/well) | LT50 (days) |
|---|---|---|---|---|---|---|---|
| Gene00892 | 176 | Rop | CG15811 | 3804 | 97.7 | 0.0101 | 5.1 |
| Gene01896 | 184 | arm | CG11579 | 3812 | 95.7 | 0.0027 | 3.1 |
| Gene05129 | 193 | AP-1-2beta | CG12532 | 3821 | 90.3 | 0.0003 | 5.1 |
| Gene06225 | 195 | CG1129 | CG1129 | 3823 | 85.4 | 0.0040 | 4.4 |
| Gene08627 | 197 | mesh | CG31004 | 3825 | 100 | 0.0010 | 3.2 |
| Gene08867 | 199 | alpha-Cat | CG17947 | 3827 | 97.7 | 0.0004 | 3.2 |
| Gene11055 | 214 | ATPsyndelta | CG2968 | 3842 | 84.3 | 0.0036 | 4.3 |
| Gene12327 | 218 | Sec61alpha | CG9539 | 3846 | 75.6 | 0.0048 | 6.0 |
| Gene13224 | 222 | RpL7A | CG3314 | 3850 | 83.4 | 0.0034 | 6.0 |

Additionally, the corn roots from each of the plants are examined for feeding damage. This experiment is repeated at least eight times each for F1 progeny of transgenic maize plants comprising the transgene of the binary vector.

Results of the bioassays include the number of Dv larvae recovered 7 days after infestation. Recovered rootworm are graded by size (Dv size), as medium (m), medium/big (mb), big (b), or very big (vb). Roots of the corn plants are also analyzed for feeding damage. "Minor" root damage indicates roots appear strong and healthy. "Noticeable" root damage indicates the roots are slightly weaker compared to controls. "Significant" root damage indicates that the smaller roots are damaged or missing. "Severe" root damage indicates only the largest roots remain attached to the plant.

It is expected that results will confirm that the transgenic corn plants expressing dsRNAs that target Dv genes have less root damage compared to the non-transgenic, negative control sister plants. Therefore, transgenic plants comprising an interfering RNA molecule of the invention are expected to have enhanced resistance to an insect pest as compared to a non-transgenic control plant.

Transgenic Maize CRW Root Assay

Transgenic maize expressing the transgene from a binary vector described above are grown and brace roots or crown roots from the plant are removed. Root pieces are placed on a 2% agar plate and infested with 80 to 100 L1 Dv larvae. Following an incubation in the dark 26° C. for 24 to 48 hours, the L1 larvae are transferred to a 48-well Dv diet plate and incubated in the dark at 26° C. and scored daily for mortality of the Dv larvae, up to 7 days post-infestation. This experiment is performed on three different transgenic maize events, and on a non-transgenic control maize plant. The percent mortality is calculated.

It is expected that results of this test will confirm that the transgenic corn plants expressing dsRNAs that target one or more Dv genes have an insecticidal effect on Dv insect pests. It is expected that this will further show that a transgenic plant comprising an interfering RNA molecule of the invention has enhanced resistance to an insect pest as compared to a non-transgenic control plant.

Example 4. Interfering RNA Molecules with a Second Insecticidal Agent Bioassays

This example illustrates the toxicity of interfering RNA molecules of the invention in combination with a second insecticidal agent.

Double stranded RNA molecules are produced against the one or more of the Dv target genes identified above. Additionally, a second insecticidal agent, for example mCry3A or eCry3.1Ab, is prepared. Both the RNA and the second insecticidal agent are tested in combination for toxicity against Dv larvae in laboratory bioassays as described above.

Example 5. Producing Targeted dsRNA Molecules by Bacterial Expression

This example describes producing dsRNA molecules engineered against identified insect targets using a bacterial expression system.

Hairpin cassettes are engineered for selected insect target genes as described above. The hairpin cassette comprises a T7 promoter operably linked to an antisense sequence of the target, further linked at the 3' end to a nucleic acid sequence which is capable of forming a loop structure, further linked at the 3' end to the corresponding sense sequence of the target, operably linked at the 3' end to a T7 terminator sequence. The hairpin cassette is introduced into a bacterial expression vector, for example pGCP295, via appropriate restriction sites, for example BamHI and NotI. The vector is then introduced into an *Escherichia coli* strain, for example, HT115(DE3)GA01, via electroporation using standard methods, and transformants are selected using kanamycin selection.

The bacteria containing the targeted dsRNA expression vector plasmid are grown in defined medium to a specific optical density and induced by addition of IPTG for a specific time period following standard methods and routine optimization. After induction, the bacteria are harvested by centrifugation, and the produced dsRNA molecules are collected.

Example 6. Activity of Bacterially Produced dsRNA Molecules Against Dv Larvae

This example describes testing of a sub-set of the identified target dsRNAs of the invention for biological activity against Dv when applied as a spray. dsRNA molecules are bacterially produced as described above for testing as a spray application. A negative control GFP dsRNA molecule is also produced.

Bioassays are performed using an RNA-treated artificial diet method. Briefly, molten artificial diet, modified from the diet of Marrone et al. 1985 (J. Econ. Entomol. 78:290-293), is poured into each well of 48-well plates and allowed to solidify. Bacterially produced dsRNA molecules are diluted to appropriate concentration so that 20 μl of solution is added to the surface of the diet in half of the wells of a 48-well plate. One or two Dv larvae are added to each well to have between 24 and 48 replicate larvae per dsRNA tested. Each 48-well plate is maintained at approximately 26° C. and 16:8 light:dark photoperiod. Mortality is recorded at 7 days after treatment.

It is expected that spray-applied RNAi molecules of the invention are active against Dv.

Example 7. Identification of Potential RNAi Lethal Genes in Flea Beetle

This example describes the testing of dsRNA molecules against target genes in the flea beetles, *Phyllotreta armoraciae* (Pa) *Phyllotreta nemorum* (Pn), *Phyllotreta cruciferae* (Pu), *Phyllotreta striolata* (Ps), *Phyllotreta atra* (Pt) and/or *Psylliodes chrysocephala* (Pc), that are orthologues of the *Sitophilus oryzae* target genes described in Table 1.

7.1. RNA Sequencing and Transcriptome Generation of Flea Beetle Insects.

The flea beetle transcriptomes were generated in a similar way as described for *Sitophilus oryzae*. With BLAST most of the orthologuous genes of the *Sitophilus oryzae* targets described in Table 1 were identified in the flea beetles transcriptomes, including for Pa (SEQ ID NOs:452-564), Pn (SEQ ID NOs:565-679), Pu (SEQ ID NOs:680-789), Ps (SEQ ID NOs:790-905), Pt (SEQ ID NOs:906-1020) and Pc (SEQ ID NOs:1021-1133).

7.2. dsRNA Synthesis of the Candidate Target Genes in Flea Beetles.

The same 96 well library synthesis platform was used to produce dsRNA samples for testing against flea beetles. The negative control (dsRNA against a Green Fluorescent Protein—GFP) and the positive control (dsRNA against the species specific ubiquitin protein) were produced in the same manner.

7.3. Testing of dsRNA Samples Against Flea Beetles.

The dsRNA molecules described above were tested for toxicity against different flea beetles in laboratory bioassays. Bioassays were performed using an RNA-treated artificial diet method. Briefly, synthesized dsRNA molecules were diluted to the appropriate concentration in a sucrose solution. The solution containing the dsRNA was divided over three wells of a 96-well plate, the final dose being 1 μg/μl dsRNA in 5% sucrose per well. The plates were then sealed and six pinholes per well were made through the seals. Eight adults per well were added to a 6-well plate which is attached to the reversed sample plate by the use of tape, allowing the insects to feed on the droplets. On day 3 the dsRNA solution was replaced by a 15% sucrose solution to keep the insects until the end of the assay. Each assay was maintained at approximately 25° C. and 16:8 light:dark photoperiod. Mortality was recorded at different days post-infestation, with the final survival percentage calculated at 10 up to 17 days with Abbott correction. dsRNA designed to target green fluorescent protein (GFP) was used as a negative control. dsRNA designed to the specific ubiquitin protein were used as a positive control.

Results confirm that dsRNAs having complementarity to target genes in one or more flea beetle species (Pa, Pn, Pu, Ps, Pt and Pc), which are orthologues to *Sitophilus* target genes described in Table 1, are toxic to the one or more flea beetle species. See Table 5A and 5B.

TABLE 5A

Activity of dsRNA against Pa flea beetles

| Target ID | SEQ ID NO for Target | Putative Gene Name | Putative Flybase ID | SEQ ID NO: (RNA fragment) | Percent Mortality (Abbott corr.) |
|---|---|---|---|---|---|
| Gene00116 | 454 | Rpt4 | CG3455 | 4082 | 90.1 |
| Gene00132 | 457 | pnr | CG10278 | 4085 | 46.7 |
| Gene00140 | 459 | Prosbeta3 | CG11981 | 4087 | 33.3 |
| Gene00143 | 460 | Tm-SR | CG2848 | 4088 | 6.3 |
| Gene00161 | 461 | Bap60 | CG4303 | 4089 | 72.7 |
| Gene00180 | 462 | Pop2 | CG5684 | 4090 | 59.1 |
| Gene00187 | 464 | CCT4 | CG5525 | 4092 | 11.0 |
| Gene00191 | 466 | SkpA | CG16983 | 4094 | 23.8 |
| Gene00196 | 467 | mts | CG7109 | 4095 | 23.8 |
| Gene00220 | 469 | CCT7 | CG8351 | 4097 | 23.8 |
| Gene00228 | 470 | Dhc64C | CG7507 | 4098 | 31.8 |
| Gene00236 | 472 | pont | CG4003 | 4100 | 40.9 |
| Gene00237 | 473 | Cpsf100 | CG1957 | 4101 | 54.5 |
| Gene00242 | 475 | Rpn8 | CG3416 | 4103 | 95.2 |
| Gene00245 | 476 | CCT3 | CG8977 | 4104 | 36.4 |
| Gene00266 | 477 | Prosbeta6 | CG4097 | 4105 | 92.2 |
| Gene00269 | 479 | CCT5 | CG8439 | 4107 | 50.0 |
| Gene00276 | 480 | Roc1a | CG16982 | 4108 | 26.9 |
| Gene00277 | 481 | CCT2 | CG7033 | 4109 | 68.2 |
| Gene00281 | 482 | Prosalpha6 | CG4904 | 4110 | 68.4 |
| Gene00282 | 483 | fand | CG6197 | 4111 | 22.1 |
| Gene00284 | 485 | RpL8 | CG1263 | 4113 | 74.2 |
| Gene00289 | 487 | CCT6 | CG8231 | 4115 | 81.8 |
| Gene00323 | 492 | RpS8 | CG7808 | 4120 | 56.7 |
| Gene00325 | 493 | Rpn11 | CG18174 | 4121 | 100.0 |
| Gene00340 | 495 | Ykt6 | CG1515 | 4123 | 45.5 |
| Gene00343 | 496 | Prosalpha5 | CG10938 | 4124 | 55.5 |
| Gene00356 | 497 | Vha44 | CG8048 | 4125 | 64.5 |
| Gene00416 | 503 | Rpn6 | CG10149 | 4131 | 90.0 |
| Gene00424 | 505 | TER94 | CG2331 | 4133 | 72.7 |
| Gene00428 | 506 | cpb | CG17158 | 4134 | 76.0 |
| Gene00532 | 508 | RpL4 | CG5502 | 4136 | 56.3 |
| Gene00557 | 510 | ncm | CG12750 | 4138 | 30.1 |
| Gene00892 | 511 | Rop | CG15811 | 4139 | 34.7 |
| Gene01649 | 517 | Vha55 | CG17369 | 4145 | 23.8 |
| Gene03652 | 523 | AP-1sigma | CG5864 | 4151 | 81.8 |
| Gene05081 | 526 | pAbp | CG5119 | 4154 | 85.7 |
| Gene05129 | 527 | AP-1-2beta | CG12532 | 4155 | 13.8 |
| Gene05740 | 528 | RpL12 | CG3195 | 4156 | 81.1 |
| Gene06225 | 529 | CG1129 | CG1129 | 4157 | 8.7 |
| Gene08627 | 531 | mesh | CG31004 | 4159 | 73.3 |
| Gene08840 | 532 | RpLP2 | CG4918 | 4160 | 81.5 |
| Gene08867 | 533 | alpha-Cat | CG17947 | 4161 | 30.6 |
| Gene09268 | 535 | Sar1 | CG7073 | 4163 | 77.9 |
| Gene10001 | 539 | Rpn7 | CG5378 | 4167 | 60.9 |
| Gene11055 | 550 | ATPsyndelta | CG2968 | 4178 | 11.0 |
| Gene12327 | 554 | Sec61alpha | CG9539 | 4182 | 85.3 |

TABLE 5B

Activity of dsRNA against Pu flea beetles

| Target ID | SEQ ID NO for Target | Putative Gene Name | Putative Flybase ID | SEQ ID NO: (RNA fragment) | Percent Mortality (Abbott corr.) |
|---|---|---|---|---|---|
| Gene00111 | 681 | CstF64 | CG7697 | 4309 | 49.0 |
| Gene00116 | 682 | Rpt4 | CG3455 | 4310 | 96.3 |
| Gene00120 | 683 | Prosalpha3 | CG9327 | 4311 | 63.0 |
| Gene00129 | 684 | Rpn1 | CG7762 | 4312 | 63.0 |
| Gene00132 | 685 | pnr | CG10278 | 4313 | 88.9 |
| Gene00134 | 686 | garz | CG8487 | 4314 | 40.7 |
| Gene00140 | 687 | Prosbeta3 | CG11981 | 4315 | 100.0 |
| Gene00161 | 689 | Bap60 | CG4303 | 4317 | 74.8 |
| Gene00183 | 692 | CG7483 | CG7483 | 4320 | 42.6 |
| Gene00187 | 693 | CCT4 | CG5525 | 4321 | 40.7 |
| Gene00190 | 694 | Rpt3 | CG16916 | 4322 | 81.5 |
| Gene00196 | 696 | mts | CG7109 | 4324 | 77.8 |
| Gene00213 | 697 | Ubi-p63E | CG11624 | 4325 | 88.9 |
| Gene00220 | 698 | CCT7 | CG8351 | 4326 | 14.4 |
| Gene00233 | 699 | l(2)37Cb | CG10689 | 4327 | 37.0 |
| Gene00236 | 700 | pont | CG4003 | 4328 | 40.8 |
| Gene00237 | 701 | Cpsf100 | CG1957 | 4329 | 25.5 |
| Gene00238 | 702 | Sf3a1 | CG16941 | 4330 | 40.7 |
| Gene00242 | 703 | Rpn8 | CG3416 | 4331 | 100.0 |
| Gene00245 | 704 | CCT3 | CG8977 | 4332 | 81.5 |
| Gene00266 | 705 | Prosbeta6 | CG4097 | 4333 | 92.6 |
| Gene00269 | 707 | CCT5 | CG8439 | 4335 | 66.7 |
| Gene00276 | 708 | Roc1a | CG16982 | 4336 | 59.3 |
| Gene00277 | 709 | CCT2 | CG7033 | 4337 | 48.2 |
| Gene00281 | 710 | Prosalpha6 | CG4904 | 4338 | 81.5 |
| Gene00282 | 711 | fand | CG6197 | 4339 | 74.1 |
| Gene00284 | 713 | RpL8 | CG1263 | 4341 | 40.7 |
| Gene00286 | 714 | His3:CG31613 | CG31613 | 4342 | 10.4 |
| Gene00289 | 715 | CCT6 | CG8231 | 4343 | 59.3 |
| Gene00305 | 716 | Uba1 | CG1782 | 4344 | 37.0 |
| Gene00306 | 717 | Hel25E | CG7269 | 4345 | 61.8 |
| Gene00313 | 719 | Slu7 | CG1420 | 4347 | 51.9 |
| Gene00323 | 720 | RpS8 | CG7808 | 4348 | 100.0 |
| Gene00325 | 721 | Rpn11 | CG18174 | 4349 | 100.0 |
| Gene00337 | 722 | Rpt6 | CG1489 | 4350 | 74.1 |
| Gene00340 | 723 | Ykt6 | CG1515 | 4351 | 88.9 |
| Gene00343 | 724 | Prosalpha5 | CG10938 | 4352 | 100.0 |
| Gene00367 | 726 | CCT1 | CG5374 | 4354 | 33.3 |
| Gene00368 | 727 | Prosbeta7 | CG12000 | 4355 | 63.0 |
| Gene00379 | 729 | pea | CG8241 | 4357 | 11.1 |
| Gene00384 | 730 | CG9175 | CG9175 | 4358 | 60.6 |
| Gene00416 | 731 | Rpn6 | CG10149 | 4359 | 92.6 |
| Gene00418 | 732 | Lam | CG6944 | 4360 | 9.0 |
| Gene00424 | 733 | TER94 | CG2331 | 4361 | 100.0 |
| Gene00428 | 734 | cpb | CG17158 | 4362 | 93.3 |
| Gene00532 | 736 | RpL4 | CG5502 | 4364 | 85.2 |
| Gene00544 | 737 | Spt6 | CG12225 | 4365 | 44.4 |
| Gene00557 | 738 | ncm | CG12750 | 4366 | 96.3 |

TABLE 5B-continued

Activity of dsRNA against Pu flea beetles

| Target ID | SEQ ID NO for Target | Putative Gene Name | Putative Flybase ID | SEQ ID NO: (RNA fragment) | Percent Mortality (Abbott corr.) |
|---|---|---|---|---|---|
| Gene00892 | 739 | Rop | CG15811 | 4367 | 70.4 |
| Gene00949 | 740 | Sec10 | CG6159 | 4368 | 12.3 |
| Gene01074 | 741 | Sf3a2 | CG10754 | 4369 | 55.6 |
| Gene01187 | 742 | SmD3 | CG8427 | 4370 | 23.0 |
| Gene01510 | 743 | UQCR-C2 | CG4169 | 4371 | 41.5 |
| Gene01576 | 744 | Bet1 | CG14084 | 4372 | 100.0 |
| Gene01649 | 745 | Vha55 | CG17369 | 4373 | 48.1 |
| Gene01896 | 746 | arm | CG11579 | 4374 | 96.3 |
| Gene02220 | 747 | CG9667 | CG9667 | 4375 | 25.9 |
| Gene02775 | 748 | Cdc5 | CG6905 | 4376 | 60.2 |
| Gene03652 | 749 | AP-1sigma | CG5864 | 4377 | 100.0 |
| Gene05081 | 752 | pAbp | CG5119 | 4380 | 85.2 |
| Gene05129 | 753 | AP-1-2beta | CG12532 | 4381 | 96.3 |
| Gene05740 | 754 | RpL12 | CG3195 | 4382 | 64.6 |
| Gene06225 | 755 | CG1129 | CG1129 | 4383 | 51.8 |
| Gene06978 | 756 | cpa | CG10540 | 4384 | 100.0 |
| Gene08627 | 757 | mesh | CG31004 | 4385 | 92.6 |
| Gene08840 | 758 | RpLP2 | CG4918 | 4386 | 18.5 |
| Gene08867 | 759 | alpha-Cat | CG17947 | 4387 | 70.4 |
| Gene08949 | 760 | Nup62 | CG6251 | 4388 | 33.3 |
| Gene09268 | 761 | Sar1 | CG7073 | 4389 | 96.3 |
| Gene09812 | 763 | Sac1 | CG9128 | 4391 | 21.5 |
| Gene09966 | 764 | atms | CG2503 | 4392 | 18.5 |
| Gene10001 | 765 | Rpn7 | CG5378 | 4393 | 92.6 |
| Gene10142 | 767 | DNApol-alpha180 | CG6349 | 4395 | 45.5 |
| Gene10189 | 768 | rept | CG9750 | 4396 | 22.2 |
| Gene10649 | 770 | Rho1 | CG8416 | 4398 | 27.0 |
| Gene10683 | 771 | Nup154 | CG4579 | 4399 | 22.2 |
| Gene10692 | 772 | Nup160 | CG4738 | 4400 | 38.3 |
| Gene10724 | 773 | Cse1 | CG13281 | 4401 | 22.8 |
| Gene11055 | 776 | ATPsyndelta | CG2968 | 4404 | 44.4 |
| Gene11554 | 777 | nudC | CG9710 | 4405 | 48.1 |
| Gene11636 | 778 | Srp19 | CG4457 | 4406 | 70.4 |
| Gene11792 | 779 | cm | CG3193 | 4407 | 85.2 |
| Gene12327 | 780 | Sec61alpha | CG9539 | 4408 | 92.6 |
| Gene12739 | 781 | Cyt-c1 | CG4769 | 4409 | 44.4 |
| Gene12888 | 782 | CG6015 | CG6015 | 4410 | 37.0 |
| Gene13224 | 783 | RpL7A | CG3314 | 4411 | 59.3 |
| Gene13823 | 784 | betaggt-II | CG18627 | 4412 | 70.4 |
| Gene13837 | 785 | Fs(2)Ket | CG2637 | 4413 | 30.0 |
| Gene13977 | 786 | noi | CG2925 | 4414 | 42.4 |

Example 8. Identification of RNAi Lethal Genes in the Pollen Beetle, *Meligethes aeneus*

This example describes the testing of dsRNA molecules against one or more target genes in *Meligethes aeneus* (Ma, pollen beetle) (SEQ ID NOs:1134-1248), that are orthologues of the *Sitophilus oryzae* target genes described in Table 1.

8.1. dsRNA Synthesis of Candidate Target Genes in Pollen Beetle.

The same 96 well library synthesis platform described above was used to produce dsRNA samples for testing against Ma pollen beetle. Templates for the dsRNA molecules were produced based on publicly available transcriptome information for the Ma targets. A negative control (dsRNA against a Green Fluorescent Protein—GFP) and a positive control (dsRNA against the species specific ubiquitin protein) were produced in the same manner.

8.2. Testing of dsRNA Molecules Against Pollen Beetle.

The dsRNA molecules described above were tested for toxicity against Ma pollen beetle in laboratory bioassays. Bioassays were performed using an RNA-treated artificial diet method, in a similar way as described above for the flea beetle. Briefly, synthesized dsRNA molecules were diluted to the appropriate concentration in a sucrose solution. The solution containing the dsRNA was divided over three wells of a 96-well plate, the final dose being 1 μg/μl dsRNA in 5% sucrose per well. The plates were then sealed and six pinholes per well are made through the seals. Eight adults per well were added to a 6-well plate which was attached to the reversed sample plate by the use of tape, allowing the insects to feed on the droplets. On day 3 the dsRNA solution was replaced by a 15% sucrose solution to keep the insects until the end of the assay. Each assay was maintained at approximately 25° C. and 16:8 light:dark photoperiod. Mortality was recorded at different days post-infestation, with the final survival percentage calculated at 8 or 10 days with Abbott's correction. dsRNA designed to target green fluorescent protein (GFP) was used as a negative control. dsRNA designed to the specific ubiquitin protein was used as a positive control.

Results confirm that dsRNAs having complementarity to target genes in Ma pollen beetles, which are orthologues to *Sitophilus* target genes described in Table 1, are toxic to the Ma pollen beetle.

TABLE 6

Activity of dsRNA against pollen beetle

| Target ID | SEQ ID NO for Target | Putative gene name | Putative Flybase ID | SEQ ID NO: (RNA fragment) | Percent Mortality (Abbott corr.) |
|---|---|---|---|---|---|
| Gene00111 | 1135 | CstF64 | CG7697 | 4763 | 40 |
| Gene00116 | 1136 | Rpt4 | CG3455 | 4764 | 27 |
| Gene00120 | 1137 | Prosalpha3 | CG9327 | 4765 | 50 |
| Gene00129 | 1138 | Rpn1 | CG7762 | 4766 | 30 |
| Gene00132 | 1139 | GATAe | CG10278 | 4767 | 10 |
| Gene00134 | 1140 | garz | CG8487 | 4768 | 7 |
| Gene00140 | 1141 | Prosbeta3 | CG11981 | 4769 | 82 |
| Gene00161 | 1143 | Bap60 | CG4303 | 4771 | 33 |
| Gene00180 | 1145 | Pop2 | CG5684 | 4773 | 37 |
| Gene00183 | 1146 | CG7483 | CG7483 | 4774 | 48 |
| Gene00187 | 1147 | CCT4 | CG5525 | 4775 | 60 |
| Gene00190 | 1148 | Rpt3 | CG16916 | 4776 | 76 |
| Gene00196 | 1150 | mts | CG7109 | 4778 | 55 |
| Gene00213 | 1151 | Ubi-p63E | CG11624 | 4779 | 100 |
| Gene00220 | 1152 | CCT7 | CG8351 | 4780 | 70 |
| Gene00228 | 1153 | Dhc64C | CG7507 | 4781 | 56 |
| Gene00233 | 1154 | l(2)37Cb | CG10689 | 4782 | 59 |
| Gene00236 | 1155 | pont | CG4003 | 4783 | 20 |
| Gene00237 | 1156 | Cpsf100 | CG1957 | 4784 | 67 |
| Gene00238 | 1157 | Sf3a1 | CG16941 | 4785 | 54 |
| Gene00242 | 1158 | Rpn8 | CG3416 | 4786 | 73 |
| Gene00245 | 1159 | CCT3 | CG8977 | 4787 | 81 |
| Gene00266 | 1160 | Prosbeta6 | CG4097 | 4788 | 35 |
| Gene00269 | 1162 | CCT5 | CG8439 | 4790 | 73 |
| Gene00276 | 1163 | Roc1a | CG16982 | 4791 | 58 |
| Gene00277 | 1164 | CCT2 | CG7033 | 4792 | 65 |
| Gene00281 | 1165 | Prosalpha6 | CG4904 | 4793 | 83 |
| Gene00282 | 1166 | fand | CG6197 | 4794 | 70 |
| Gene00284 | 1168 | RpL8 | CG1263 | 4796 | 30 |
| Gene00286 | 1169 | His3:CG31613 | CG31613 | 4797 | 20 |
| Gene00289 | 1170 | CCT6 | CG8231 | 4798 | 63 |
| Gene00305 | 1171 | Uba1 | CG1782 | 4799 | 100 |
| Gene00306 | 1172 | Hel25E | CG7269 | 4800 | 87 |
| Gene00309 | 1173 | Rpn3 | CG42641 | 4801 | 93 |
| Gene00313 | 1174 | Slu7 | CG1420 | 4802 | 83 |
| Gene00323 | 1175 | RpS8 | CG7808 | 4803 | 80 |
| Gene00325 | 1176 | Rpn11 | CG18174 | 4804 | 90 |
| Gene00337 | 1177 | Rpt6 | CG1489 | 4805 | 90 |
| Gene00340 | 1178 | Ykt6 | CG1515 | 4806 | 93 |
| Gene00343 | 1179 | Prosalpha5 | CG10938 | 4807 | 81 |
| Gene00356 | 1180 | Vha44 | CG8048 | 4808 | 80 |
| Gene00367 | 1181 | CCT1 | CG5374 | 4809 | 83 |

TABLE 6-continued

Activity of dsRNA against pollen beetle

| Target ID | SEQ ID NO for Target | Putative gene name | Putative Flybase ID | SEQ ID NO: (RNA fragment) | Percent Mortality (Abbott corr.) |
|---|---|---|---|---|---|
| Gene00368 | 1182 | Prosbeta7 | CG12000 | 4810 | 76 |
| Gene00384 | 1185 | CG9175 | CG9175 | 4813 | 90 |
| Gene00416 | 1186 | Rpn6 | CG10149 | 4814 | 97 |
| Gene00424 | 1188 | TER94 | CG2331 | 4816 | 93 |
| Gene00428 | 1189 | cpb | CG17158 | 4817 | 3 |
| Gene00532 | 1191 | RpL4 | CG5502 | 4819 | 87 |
| Gene00544 | 1192 | Spt6 | CG12225 | 4820 | 100 |
| Gene00892 | 1194 | Rop | CG15811 | 4822 | 78 |
| Gene00949 | 1195 | Sec10 | CG6159 | 4823 | 25 |
| Gene01074 | 1196 | Sf3a2 | CG10754 | 4824 | 20 |
| Gene01510 | 1198 | UQCR-C2 | CG4169 | 4826 | 100 |
| Gene01576 | 1199 | Bet1 | CG14084 | 4827 | 100 |
| Gene01649 | 1200 | Vha55 | CG17369 | 4828 | 95 |
| Gene01896 | 1202 | arm | CG11579 | 4830 | 91 |
| Gene02220 | 1203 | CG9667 | CG9667 | 4831 | 86 |
| Gene02775 | 1206 | Cdc5 | CG6905 | 4834 | 100 |
| Gene03652 | 1207 | AP-1sigma | CG5864 | 4835 | 100 |
| Gene03841 | 1208 | CG11779 | CG11779 | 4836 | 91 |
| Gene05129 | 1212 | AP-1-2beta | CG12532 | 4840 | 88 |
| Gene05740 | 1213 | RpL12 | CG3195 | 4841 | 100 |
| Gene06225 | 1214 | CG1129 | CG1129 | 4842 | 86 |
| Gene06978 | 1215 | cpa | CG10540 | 4843 | 67 |
| Gene08627 | 1216 | mesh | CG31004 | 4844 | 100 |
| Gene08867 | 1217 | alpha-Cat | CG17947 | 4845 | 88 |
| Gene08949 | 1218 | Nup62 | CG6251 | 4846 | 92 |
| Gene09268 | 1219 | Sar1 | CG7073 | 4847 | 100 |
| Gene09812 | 1221 | Sac1 | CG9128 | 4849 | 57 |
| Gene09966 | 1222 | atms | CG2503 | 4850 | 61 |
| Gene10001 | 1223 | Rpn7 | CG5378 | 4851 | 100 |
| Gene10142 | 1225 | DNApol-alpha180 | CG6349 | 4853 | 19 |
| Gene10189 | 1226 | rept | CG9750 | 4854 | 61 |
| Gene10649 | 1228 | Rho1 | CG8416 | 4856 | 81 |
| Gene10692 | 1230 | Nup160 | CG4738 | 4858 | 73 |
| Gene10724 | 1231 | Cse1 | CG13281 | 4859 | 85 |
| Gene10755 | 1232 | asf1 | CG9383 | 4860 | 11 |
| Gene11055 | 1234 | ATPsyndelta | CG2968 | 4862 | 65 |
| Gene11554 | 1235 | nudC | CG9710 | 4863 | 61 |
| Gene11636 | 1236 | Srp19 | CG4457 | 4864 | 100 |
| Gene11792 | 1237 | cm | CG3193 | 4865 | 100 |
| Gene12327 | 1238 | Sec61alpha | CG9539 | 4866 | 10 |
| Gene12739 | 1240 | Cyt-c1 | CG4769 | 4868 | 65 |
| Gene12888 | 1241 | CG6015 | CG6015 | 4869 | 53 |
| Gene13224 | 1242 | RpL7A | CG3314 | 4870 | 88 |
| Gene13823 | 1243 | betaggt-II | CG18627 | 4871 | 77 |
| Gene13837 | 1244 | Fs(2)Ket | CG2637 | 4872 | 23 |
| Gene13977 | 1245 | noi | CG2925 | 4873 | 81 |
| Gene14143 | 1246 | SmB | CG5352 | 4874 | 83 |

Example 9. Identification of Potential RNAi Lethal Genes in *Ceutorhynchus* Spp

This example describes the testing of dsRNA molecules against target genes in *Ceutorhynchus assimilis* (Ca, cabbage seedpod weevil), that are orthologues of the *Sitophilus oryzae* target genes described in Table 1.

9.1. RNA Sequencing and Transcriptome Generation of *Ceutorhynchus* Spp.

The *Ceutorhynchus* transcriptomes were generated in a similar way as described for *Sitophilus oryzae*. With BLAST most of the orthologuous genes of the *Sitophilus oryzae* targets described in Table 1 were identified in the *Ceutorhynchus* transcriptomes, represented herein as SEQ ID NOs:1249-1360.

9.2. dsRNA Synthesis of the Candidate Target Genes in *Ceutorhynchus assimilis*.

The same 96 well library synthesis platform as described above is used to produce dsRNA samples for testing against *Ceutorhynchus assimilis*. A negative control (dsRNA against a Green Fluorescent Protein—GFP) and a positive control (dsRNA against the species specific ubiquitin protein) are produced in the same manner.

9.3. Testing of dsRNA Samples Against *Ceutorhynchus assimilis*.

The dsRNA molecules described above are tested for toxicity against *Ceutorhynchus assimilis* (Ca; cabbage seedpod weevil) in laboratory bioassays. Bioassays are performed using an RNA-treated artificial diet method, in a similar way as described above for the flea beetles. Briefly, synthesized dsRNA molecules are diluted to the appropriate concentration in a sucrose solution. The solution containing the dsRNA is divided over three wells of a 96-well plate, the final dose being 1 μg/μl dsRNA in 5% sucrose per well. The plates are then sealed and six pinholes per well are made through the seals. Eight adults per well are added to a 6-well plate which is attached to the reversed sample plate by the use of tape, allowing the insects to feed on the droplets. On day 3 the dsRNA solution is replaced by a 15% sucrose solution to keep the insects until the end of the assay. Each assay is maintained at approximately 25° C. and 16:8 light:dark photoperiod. Mortality is recorded at different days post-infestation, with the final survival percentage calculated at 8 or 10 days with Abbott correction. dsRNA designed to target green fluorescent protein (GFP) is used as a negative control. dsRNA designed to the specific ubiquitin protein is used as a positive control.

It is expected that dsRNAs having complementarity to one or more target genes in a Ca beetle (e.g., comprising any one of SEQ ID NOs:4877-4988), which are orthologues to *Sitophilus* target genes described in Table 1, are toxic to the Ca beetle.

Example 10. Activity of dsRNA Molecules in a Spray Application Assay Against Canola Pests This example describes testing of a sub-set of the identified target dsRNAs of the invention for biological activity against insect pests of oil seed rape when applied as a spray. dsRNA molecules are bacterially produced as described above for testing as a spray application on planta. A negative control GFP dsRNA molecule is also produced.

Three 2-3 week old oil seed rape plants (*Brassica napus* L.) are sprayed with bacterially produced dsRNA (200 μg per 3 plants), dissolved in a sucrose solution. 15 insects are put on the plant after spraying, and the infested plant is maintained in a container closed with a mesh. Three days after the initial spraying, the plant is replaced by a second plant sprayed with the same bacterial lysate sucrose solution. Six days after the initial spraying the insects are transferred to a petri dish containing only a sucrose solution (15% sucrose).

Example 11. Expression of an RNAi Molecule Comprising Target dsRNA in Canola Plants This example describes introducing a construct that expresses an interfering RNA molecule into canola plant cells.

11.1. Vector Construction

Expression vectors designed to produce hairpin RNAs (hpRNA) consist of a cassette containing a promoter, a sense strand, an intron functioning as a loop sequence, an antisense strand, and terminator. The hpRNA targets at least 21 nucleotides of an endogenous gene target as described above. The hpRNA expression cassette is cloned into a binary vector. The binary vector also contains a second expression cassette between the left and right T-DNA borders which is designed to express a selectable marker for selection of transgenic cells, tissues, and/or plants following plant transformation. The binary vector also contains selectable markers for selection of the presence of the binary vector bacteria.

11.2. *Agrobacterium*-Mediated Transformation of *Brassica napus*

Each resulting plasmid containing the hairpin cassette is transformed into *Agrobacterium tumefaciens* using standard molecular biology techniques known to those skilled in the art. The vectors described above are transformed into canola.

Stably transformed *Brassica napus* cv. 'Westar' events are obtained using an adapted published floral dip protocol (Wang et al. 2003). Adult flowering plants are infiltrated twice under vacuum with an *Agrobacterium tumefaciens* suspension. The strain used is C58C1RifR harboring the pGV3101 Ti plasmid and a binary vector containing two plant expression cassettes, one for the insect target derived dsRNA which is inserted as a hairpin and an nptII based plant selectable marker.

After the two infiltrations, performed a week apart, the plants are allowed to mature and set seed. To identify the transformation events, the seed is soaked for 2 days in 300 mg/l kanamycin sulphate solution and then sown out into soil (Li et al. 2010). One week after sowing, the putative positive seedlings are identified due to their healthy green expanded cotyledons versus the smaller, shrunken bleached non-transformed seedlings.

The transgenic status of the putative events is checked by plus/minus PCR for the presence of the nptII sequence. Positive events are grown up to flowering at which point racemes are removed for insect bioassay.

For the insect feeding bioassay, racemes are removed from the plant when in bud and immediately the cut end is put through the plastic lid of a 20 ml glass vial containing water. Each raceme is infested with 10-15 wild caught *M. aeneus* adults, and mortality is scored up till day 14 post infestation. The racemes are changed for fresh at day 7.

The events described above are tested for toxicity against flea beetles and/or *Ceuthorrhynchus* spp., in laboratory bioassays. For the insect feeding bioassay three 2-3 week old oil seed rape plants (*Brassica napus*) are infested with 10-12 insects and kept in a container closed with a mesh. Six days after setup the insects are transferred to a wild-type plant. The number of dead adults is recorded every two to three days.

Example 12. Identification of Potential RNAi Lethal Genes in Soy Stink Bugs

This example describes the testing of dsRNA molecules against target genes in one or more soybean stink bug species, *Nezara viridula* (Nv), *Euschistus heros* (Eh) and/or *Piezodorus guildinii* (Pg), that are orthologues of the *Sitophilus oryzae* target genes described in Table 1.

12.1. RNA Sequencing and Transcriptome Generation of Soybean Stink Bugs.

The transcriptomes of soybean stink bugs were generated in a similar way as described for *Sitophilus oryzae* above. With BLAST most of the orthologuous genes of the *Sitophilus oryzae* targets described in Table 1 were identified in the three different soy stink bug transcriptomes; for Nv (SEQ ID NOs:1361-1473), Eh (SEQ ID NOs:1474-1586) and Pg (SEQ ID NOs:1587-1699).

12.2. dsRNA Synthesis of the Candidate Target Genes in Soy Stink Bugs.

The same 96 well library synthesis platform was used to produce dsRNA samples for testing against Nv soy stink bugs. The negative control (dsRNA against a Green Fluorescent Protein—GFP) and the positive control (dsRNA against the species specific ubiquitin protein) were produced in the same manner. The same platform is used for Eh and Pg stink bugs.

12.3. Testing of dsRNA Samples Against Soy Stink Bugs

In vitro assays on Nv stink bug nymphs were performed in 96-well nylon mesh filter plates. Each well of a 96-well filter plate housed a second instar nymph exposed to a parafilm sachet containing a mixture of 15% sucrose and 1 μg/μl dsRNA. Plates were stored in plastic boxes in a rearing chamber at 26° C., 65% RH, and 16:8 hours light:dark. Survival was recorded from 3 to 10 days post exposure to dsRNA. dsRNA molecules to the different targets described above were tested. dsRNA of non target GFP was used as a negative control. A positive control dsRNA target known to be lethal was also included in the assays. The same testing is performed on Eh and Pg stink bugs.

Table 7 shows the results for dsRNAs having complementarity to one or more target genes in the soybean stinkbug Nv, which are orthologues to *Sitophilus* target genes described in Table 1, are toxic to an Nv stinkbug. It is expected that dsRNAs having complementarity to one or more target genes in the soybean stinkbugs Eh and/or Pg, which are orthologues to *Sitophilus* target genes described in Table 1, are toxic to a Eh stinkbug and/or a Pg stinkbug.

TABLE 7

Activity of dsRNA against *Nezara viridula*

| Target ID | SEQ ID NO for Target | Putative gene name | Putative Flybase ID | SEQ ID NO: (RNA fragment) | Percent Mortality (Abbott corr.) |
|---|---|---|---|---|---|
| Gene00101 | 1361 | cactin | CG1676 | 4989 | 36 |
| Gene00111 | 1362 | CstF64 | CG7697 | 4990 | 7 |
| Gene00116 | 1363 | Rpt4 | CG3455 | 4991 | 59 |
| Gene00120 | 1364 | Prosalpha3 | CG9327 | 4992 | 82 |
| Gene00129 | 1365 | Rpn1 | CG7762 | 4993 | 45 |
| Gene00132 | 1366 | pnr | CG10278 | 4994 | 0 |
| Gene00134 | 1367 | garz | CG8487 | 4995 | 45 |
| Gene00140 | 1368 | Prosbeta3 | CG11981 | 4996 | 66 |
| Gene00143 | 1369 | Trn-SR | CG2848 | 4997 | 18 |
| Gene00161 | 1370 | Bap60 | CG4303 | 4998 | 41 |
| Gene00171 | 1371 | l(1)10Bb | CG1639 | 4999 | 3 |
| Gene00180 | 1372 | Pop2 | CG5684 | 5000 | 13 |
| Gene00183 | 1373 | CG7483 | CG7483 | 5001 | 39 |
| Gene00187 | 1374 | CCT4 | CG5525 | 5002 | 68 |
| Gene00190 | 1375 | Rpt3 | CG16916 | 5003 | 62 |
| Gene00191 | 1376 | SkpA | CG16983 | 5004 | 8 |
| Gene00196 | 1377 | mts | CG7109 | 5005 | 68 |
| Gene00213 | 1378 | Ubi-p63E | CG11624 | 5006 | 63 |
| Gene00228 | 1380 | Dhc64C | CG7507 | 5008 | 74 |
| Gene00233 | 1381 | l(2)37Cb | CG10689 | 5009 | 1 |
| Gene00236 | 1382 | pont | CG4003 | 5010 | 56 |
| Gene00237 | 1383 | Cpsf100 | CG1957 | 5011 | 0 |
| Gene00238 | 1384 | Sf3a1 | CG16941 | 5012 | 38 |
| Gene00242 | 1385 | Rpn8 | CG3416 | 5013 | 21 |
| Gene00245 | 1386 | CCT3 | CG8977 | 5014 | 68 |
| Gene00266 | 1387 | Prosbeta6 | CG4097 | 5015 | 93 |
| Gene00268 | 1388 | Ufd1-like | CG6233 | 5016 | 32 |
| Gene00269 | 1389 | CCT5 | CG8439 | 5017 | 89 |

TABLE 7-continued

Activity of dsRNA against Nezara viridula

| Target ID | SEQ ID NO for Target | Putative gene name | Putative Flybase ID | SEQ ID NO: (RNA fragment) | Percent Mortality (Abbott corr.) |
|---|---|---|---|---|---|
| Gene00276 | 1390 | Roc1a | CG16982 | 5018 | 0 |
| Gene00277 | 1391 | CCT2 | CG7033 | 5019 | 76 |
| Gene00281 | 1392 | Prosalpha6 | CG4904 | 5020 | 65 |
| Gene00282 | 1393 | fand | CG6197 | 5021 | 51 |
| Gene00283 | 1394 | Spx | CG3780 | 5022 | 0 |
| Gene00284 | 1395 | RpL8 | CG1263 | 5023 | 39 |
| Gene00286 | 1396 | His3:CG31613 | CG31613 | 5024 | 62 |
| Gene00289 | 1397 | CCT6 | CG8231 | 5025 | 84 |
| Gene00305 | 1398 | Uba1 | CG1782 | 5026 | 51 |
| Gene00309 | 1400 | Rpn3 | CG42641 | 5028 | 68 |
| Gene00313 | 1401 | Slu7 | CG1420 | 5029 | 23 |
| Gene00323 | 1402 | RpS8 | CG7808 | 5030 | 76 |
| Gene00325 | 1403 | Rpn11 | CG18174 | 5031 | 41 |
| Gene00337 | 1404 | Rpt6 | CG1489 | 5032 | 65 |
| Gene00340 | 1405 | Ykt6 | CG1515 | 5033 | 0 |
| Gene00343 | 1406 | Prosalpha5 | CG10938 | 5034 | 44 |
| Gene00356 | 1407 | Vha44 | CG8048 | 5035 | 37 |
| Gene00368 | 1409 | Prosbeta7 | CG12000 | 5037 | 71 |
| Gene00370 | 1410 | Exo84 | CG6095 | 5038 | 0 |
| Gene00379 | 1411 | pea | CG8241 | 5039 | 47 |
| Gene00384 | 1412 | CG9175 | CG9175 | 5040 | 31 |
| Gene00418 | 1414 | Lam | CG6944 | 5042 | 2 |
| Gene00428 | 1416 | cpb | CG17158 | 5044 | 38 |
| Gene00429 | 1417 | fs(1)h | CG2252 | 5045 | 0 |
| Gene00532 | 1418 | RpL4 | CG5502 | 5046 | 25 |
| Gene00544 | 1419 | Spt6 | CG12225 | 5047 | 12 |
| Gene00892 | 1421 | Rop | CG15811 | 5049 | 54 |
| Gene00949 | 1422 | Sec10 | CG6159 | 5050 | 1 |
| Gene01074 | 1423 | Sf3a2 | CG10754 | 5051 | 47 |
| Gene01187 | 1424 | SmD3 | CG8427 | 5052 | 42 |
| Gene01510 | 1425 | UQCR-C2 | CG4169 | 5053 | 60 |
| Gene01649 | 1427 | Vha55 | CG17369 | 5055 | 0 |
| Gene01896 | 1428 | arm | CG11579 | 5056 | 0 |
| Gene02220 | 1429 | CG9667 | CG9667 | 5057 | 40 |
| Gene02411 | 1430 | Ran | CG1404 | 5058 | 47 |
| Gene02760 | 1431 | Ssk | CG6981 | 5059 | 1 |
| Gene02775 | 1432 | Cdc5 | CG6905 | 5060 | 33 |
| Gene03652 | 1433 | AP-1sigma | CG5864 | 5061 | 28 |
| Gene03841 | 1434 | CG11779 | CG11779 | 5062 | 0 |
| Gene04283 | 1435 | CG1542 | CG1542 | 5063 | 0 |
| Gene05081 | 1437 | pAbp | CG5119 | 5065 | 57 |
| Gene05129 | 1438 | AP-1-2beta | CG12532 | 5066 | 27 |
| Gene05740 | 1439 | RpL12 | CG3195 | 5067 | 13 |
| Gene06225 | 1440 | CG1129 | CG1129 | 5068 | 25 |
| Gene06978 | 1441 | cpa | CG10540 | 5069 | 27 |
| Gene08627 | 1442 | mesh | CG31004 | 5070 | 20 |
| Gene08840 | 1443 | RpLP2 | CG4918 | 5071 | 9 |
| Gene08867 | 1444 | alpha-Cat | CG17947 | 5072 | 63 |
| Gene08949 | 1445 | Nup62 | CG6251 | 5073 | 0 |
| Gene09268 | 1446 | Sar1 | CG7073 | 5074 | 40 |
| Gene09812 | 1447 | Sac1 | CG9128 | 5075 | 0 |
| Gene09966 | 1448 | atms | CG2503 | 5076 | 65 |
| Gene10001 | 1449 | Rpn7 | CG5378 | 5077 | 85 |
| Gene10086 | 1450 | Lpt | CG5591 | 5078 | 0 |
| Gene10142 | 1451 | DNApol-alpha180 | CG6349 | 5079 | 17 |
| Gene10189 | 1452 | rept | CG9750 | 5080 | 0 |
| Gene10549 | 1453 | Snr1 | CG1064 | 5081 | 23 |
| Gene10649 | 1454 | Rho1 | CG8416 | 5082 | 55 |
| Gene10683 | 1455 | Nup154 | CG4579 | 5083 | 0 |
| Gene10692 | 1456 | Nup160 | CG4738 | 5084 | 0 |
| Gene10724 | 1457 | Cse1 | CG13281 | 5085 | 64 |
| Gene10755 | 1458 | asf1 | CG9383 | 5086 | 0 |
| Gene11048 | 1459 | Tbp | CG9874 | 5087 | 18 |
| Gene11055 | 1460 | ATPsyndelta | CG2968 | 5088 | 47 |
| Gene11554 | 1461 | nudC | CG9710 | 5089 | 28 |
| Gene11636 | 1462 | Srp19 | CG4457 | 5090 | 0 |
| Gene12327 | 1464 | Sec61alpha | CG9539 | 5092 | 50 |
| Gene12548 | 1465 | Cbp20 | CG12357 | 5093 | 3 |
| Gene12739 | 1466 | Cyt-c1 | CG4769 | 5094 | 23 |
| Gene12888 | 1467 | CG6015 | CG6015 | 5095 | 18 |
| Gene13224 | 1468 | RpL7A | CG3314 | 5096 | 29 |
| Gene13823 | 1469 | betaggt-II | CG18627 | 5097 | 0 |
| Gene13837 | 1470 | Fs(2)Ket | CG2637 | 5098 | 59 |
| Gene13977 | 1471 | noi | CG2925 | 5099 | 45 |
| Gene14143 | 1472 | SmB | CG5352 | 5100 | 63 |
| Gene14302 | 1473 | CG43088 | CG43088 | 5101 | 0 |

Example 13. Activity of dsRNA Molecules in a Spray Application Assay

This example describes testing of a sub-set of the identified target dsRNAs of the invention for biological activity against stink bugs when applied as a spray. The production of bacterial lysate is described above.

Three 3 week old soy bean plants (Glycine max (L.) Jack) are sprayed with a about 15% sucrose solution containing bacterial lysate expressing non-targeting GFP dsRNA and target dsRNA molecules from the expression vectors described above. 25 second instar stink bug nymphs were then placed on each sprayed plant. Plants are placed in a box coated with fluon PTFE to prevent stink bug escape and stored in a rearing chamber (26° C., 65% RH, with 16:8 hours l:d). Photographs are taken on a daily basis to record plant health. The nymph survival rate is recorded 3 to 14 days post exposure to the sprayed plant. These experiments are performed using either E. heros, N. viridula, or P. guildinii nymphs. A dsRNA of non-target GFP is used as a negative control and a dsRNA designed against a known a lethal gene was used as positive control. Percent mortality of the nymphs on day 14 is recorded.

Example 14. Expression of an RNAi Molecule Comprising Target dsRNA in Soybean Plants This example describes introducing a construct that expresses an interfering RNA molecule into soybean cells.

14.1. Vector Construction

A binary vector is constructed that comprises at least one expression cassette designed to produce a hairpin RNA (hpRNA) of the invention. The expression cassette comprises a promoter operably linked to a sense strand of a target nucleic acid sequence, an intron that functions as a loop sequence, a corresponding antisense strand, and a terminator. The binary vector may also comprise a second cassette between the left and right T-DNA borders, designed to express a selectable marker for use in selection of transformed plant cells. The binary vector may also contain selectable markers for selection of transformed bacteria, for example transformed Agrobacterium tumefaciens bacterial cells which contain the binary vector.

14.2. Soybean Transformation

Soybean plant material can be suitably transformed and fertile plants regenerated by many methods which are known to a person skilled in the art. Fertile morphologically normal transgenic soybean plants may be obtained by: 1) production of somatic embryogenic tissue from, e.g., immature cotyledon, hypocotyl or other suitable tissue; 2) transformation by particle bombardment or infection with *Agrobacterium*; and 3) regeneration of plants. In one example, as described in U.S. Pat. No. 5,024,944, cotyledon tissue is excised from immature embryos of soybean, optionally with the embryonic axis removed, and cultured on hormone-containing medium so as to form somatic embryogenic plant material. This material is transformed using, for example, direct DNA methods, DNA coated microprojectile bombardment or infection with *Agrobacterium*, cultured on a suitable selection medium and regenerated, optionally also in the continued presence of selecting agent, into fertile transgenic soybean plants. Selection agents may be antibiotics such as kanamycin, hygromycin, or herbicides such as an HPPD inhibitor, phosphinothricin, or glyphosate or, alternatively, selection may be based upon expression of a visualisable marker gene such as GUS. Target tissues for transformation include meristematic tissue, somaclonal embryogenic tissue, and flower or flower-forming tissue. Other examples of soybean transformation include physical DNA delivery methods, such as particle bombardment (see e.g., Finer & McMullen, In Vitro Cell Dev. Biol., 1991, 27P:175-182; McCabe et al., Bio/technology, 1998, 6:923-926), whisker (Khalafalla et al., African J. of Biotechnology, 2006, 5:1594-1599), aerosol bean injection (U.S. Pat. No. 7,001,754), or by *Agrobacterium*-mediated delivery methods (Hinchee et al., Bio/Technology, 1988, 6:915-922; U.S. Pat. No. 7,002,058; U.S. Patent Application Publication Nos. 20040034889 and 20080229447; Paz et al., Plant Cell Report, 2006, 25:206-213).

Transgenic soybean plants can be generated with the above described binary vector containing an expression cassette capable of producing an interfering RNA molecule using any available transformation method. Optionally, an interfering RNA molecule expression cassette can be present in the T-DNA alongside other sequences which provide additional means of selection/identification of transformed tissue including, for example, the known genes which provide resistance to kanamycin, hygromycin, phosphinothricin, butafenacil, or glyphosate. For example, different binary vectors containing PAT or EPSPS selectable marker genes are known in the art (see e.g., U.S. Patent Application Publication No. 20080229447). Alternatively, selectable marker sequences may be present on separate polynucleotides and a process of, for example, co-transformation and co-selection is used. A scorable marker gene such as GUS may also be used to identify transformed tissue.

TO plants are taken from tissue culture to the greenhouse where they are transplanted into water-saturated soil (REDI-EARTH® Plug and Seedling Mix, Sun Gro Horticulture, Bellevue, WA, or Fafard Germinating Mix) mixed with 1% granular MARATHON® (Olympic Horticultural Products, Co., Mainland, PA) at 5-10 g/gal soil in 2" square pots. The plants are covered with humidity domes and placed in a Conviron chamber (Pembina, ND) with the following environmental conditions: 24° C. day; 20° C. night; 16-23 hours light-1-8 hours dark photoperiod; 80% relative humidity.

After plants become established in the soil and new growth appears (~1-2 weeks), plants are sampled and tested for the presence of desired transgene by TAQMAN® analysis using appropriate probes for the interfering RNA expression cassette, including, for example, for promoters, for example, prCMP. Positive plants are transplanted into 4" square pots containing Fafard #3 soil. Sierra 17-6-12 slow release fertilizer may be incorporated into the soil at the recommended rate. The plants are then relocated into a standard greenhouse to acclimate for about 1 week. The environmental conditions are: 27° C. day; 21° C. night; 14 hour photoperiod (with supplemental light); ambient humidity. After acclimation, the plants are sampled and tested in detail for the presence and copy number of inserted transgenes. Transgenic soybean plants may then be assayed for resistance to stink bug species by a feeding assay, and/or they may be grown to maturity for T1 seed production. T1 plants may be grown and may also be assayed for resistance to stink bug species by a feeding assay.

Example 15. Identification of Potential RNAi Lethal Genes in *Leptinotarsa decemlineata*

This example describes the testing of dsRNA molecules against target genes in *Leptinotarsa decemlineata* (Ld; Colorado potato beetle), that are orthologues of the *Sitophilus oryzae* target genes described in Table 1.

15.1. dsRNA Synthesis of the Candidate Target Genes in CPB

The same 96 well library synthesis platform is used to produce dsRNA samples for testing against Ld. Templates for the dsRNA molecules were produced based on publicly available transcriptome information for the Ld target genes (SEQ ID NOs:1700-1814). A negative control (dsRNA against a Green Fluorescent Protein—GFP) and a positive control (dsRNA against the species specific ubiquitin protein) are produced in the same manner.

15.2. Testing of dsRNA Samples Against Ld.

The dsRNA molecules described above are tested for toxicity against Ld larvae in laboratory bioassays. Bioassays are performed in 48-well plates using an RNA-treated artificial diet method. Briefly, molten artificial diet, is poured into each well and allowed to solidify. dsRNA molecules are diluted to the appropriate concentration. 20 μl of the dsRNA solution is added to the surface of the diet resulting in a final overlay concentration of 1 μg. One L2 larva is placed in each well and 24 larvae are tested per treatment. Plates are stored at about 25° C. with a 16 hour: 8 hour light:dark photoperiod. Mortality is recorded at 3, 4, 5, 6, 7 and 10 days post-infestation. dsRNA designed to target green fluorescent protein (GFP) is used as a negative control. dsRNA designed to the specific ubiquitin protein is used as a positive control.

It is expected that results will confirm that dsRNAs having complementarity to one or more target genes in *Leptinotarsa decemlineata* (Ld; Colorado potato beetle) (e.g., comprising any one of SEQ ID NOs:5328-5442), which are orthologues to *Sitophilus* target genes described in Table 1, are toxic to Colorado potato beetle.

It should be understood that the examples and embodiments described herein are for illustrative purposes only and that various modifications or changes in light thereof of the description will be suggested to persons skilled in the art and are to be included within the spirit and purview of this application and the scope of the appended claims.

All publications and patent applications mentioned in this specification are indicative of the level of skill of those skilled in the art that this invention pertains. All publications and patent applications are herein incorporated by reference to the same extent as if each individual publication or patent application was specifically and individually indicated to be incorporated by reference.

SEQUENCE LISTING (12698 sequences)

SEQ ID NO: 1 - DNA, 2061 bp, Sitophilus oryzae
  misc_feature (1650)..(1650): n is a, c, g, or t
atgccaagatcacgatctagagatggtaaagaacattcttcacgatcaaaacacagtcataaaaaggcatctaggtctccaagctacgagaggaaaaaatctaagagcaaaagacgctcgagttcgtctagaagttctaaaagacgagattttaaatatgtaagtaagaatcgtaagcgacatgatacagacagtgattcttcaaacagtagtagttcttcagacagttctagtagttcacaaaattcattaaaactattagagaagcttgagaaagatagaataagaaatcttgaagagaaaaagagacaaaaggaactattaaaagcaactgagacagcagaggagaaacgtttgcgtagattaaagaagaaggaagagaaagaacgcaagagaaaggaaagaatgggctgggataatgaatatttacattataccaatagtgacaatcctttcggtgatggtaacttattatcaagctttgtttggacaaaaaagttagctaaagaaggcctgacaaatgctagtcatgaagaattggaggcaagaaatagattcaaacaagaggaaaacaaaagagaactggaaaaggtgaagaaaagaaggcaagagcgtgaattagatagacaaagaagagatgaagagaaccagctcttgcaaaggagcaaagaggcagcccagtttgaagaatgggaaagacaagaagatcaatttcatttagaacaagccagattaagaagtcatattcggatccaggatggtagagcaaagcctattgatcttcttgcaaaatatatcagtgcagaggaagaagtagatgctgtggaaatgcacgaaccgtacacatatcttaatggacttcatataaaagatttggaggatcttgttgaggatattaaagtctataaagaactggaaagaggaaagaatttagattattggaacgatattacagttattgttgaagatgagttacaaaaaatgagaaagattcaaaaggaacaggactttgatgctggggttggtagaagagaaggtataaatcaagcagtagctcaagatgttacatcagtttttaaaggcaaaacagccattcagttggcagcccttcaaaaacaaattgaaagtaaaatttctggtaaagcagatggaatcgatatcggttattgggaatctttattgtcccaacttaaagctcacatggccagggcaagacttagagacaggcatcaggaaagtttgaaaaggaaactacaagttttaaaagccgaacaggcggttgctttgcctgaaaacaaccagaatattgaaagtactaaacatagcgataatgagaaacccagtacctcccaagagtctacagaagatagccaaagtgatacagaagctaatgagaatgcagcaaatgatattttgaatgaatgctttattttatatcaaaatggagggtacagtcctaaattattaagtcctgacgagattgaaccaggcactatagtagtgacagaagaggatgacacaaacagactggagtttgcaagaatgcaggtaacagccaaaggcaaaaaagttgagaatgttataacgaaagaagaacttctactacaaaaagaggcaagaaaaggaatgggagaagatgaggcccagttngcaagaaaaggaatgggagaagatgaggcccagtttagtgtggaacaagctttagataatcaagtatatctttggtcagacaagtacagaccgcgtaaacccaggtacttcaacagagtacacacaggttttgaatggaacaagtacaatcaaactcattatgacatggataatccacctccaaaaattgtacaaggctacaagtttaatatattttatccagacttgattgataagaattgtactccagaatattttttgactccttgtccagataataaagaatttgccattttgaaattccatgccggaccgccctatgaggacattgcatttaagatagttaatagggagtgggaatattcatataaaagaggttttagatgtcagtttcataataatatatttcag

SEQ ID NO: 2 - DNA, 1266 bp, Sitophilus oryzae
atggacaatctagaagccaatatcatggacaagtctatgagatccgttttcgtgggaaatattccctatgaagccaccgaagaaaaactcaaagatatctttggtgaggtcggtcaagttttgtcgttcaaacttgtttttgatcgagagactggcaaacccaaaggatatggattctgcgagtatcgtgaccaggaaacggcacttagtgccatgaggaacttaaacagctacgaaataggcggtagaaacttaagagttgataatgcttgtacagagaagtcaagaatggaaatgcagaatcttctcaatcagccaccagtggaaaatccttatggagagcctattcaagctgaaaaagctccagaggctatcagcaaagctgtggcttcactacctcctgaacaaatgtttgaacttatgaagcaaatgaaaagcacaattcaaaataatcctacagaggctagacagatgctattacaaaatccacaacttgcatatgctttgctacaagctcaggtggttatgaaaattattgaccctcatacagcagcttcacttctgcatccagtaaaccaagtgccagctactctgatgcctggagacaagaatgttcctgttcaggtaccaattagtgctcagttccaacagcctccaactccagttgcacctcccagacaagagttccaacccgttcctgctccaattatgcacccaaattcccataacgcccccgtatttacaggccaagatgttgacttaagatctctagatcctcgtggtacctcagatccaagactgggcagaatggcagatcaggatatgagacagttacctccaccctctcagcttactaatcctttacctccacctgtggctgaaagtttttcgcgagaaccaagagatccacgcgatccaagagcagttggtcagtcatttcctgctgatcctagacaagcagcaagagctgatcctagacagaaaactatggttccgcctccaacggccgtgcctcctccatctgtcagaccgcctcctgtcacctcgattacgtcatcgcccacgtcaaaccagccttcgagagccagcgtagcgtcagctgtcagcggggccaccaatccgggtacttctgatcaagaaaaagctgctcttattatgcaagttcttcaattatccgatgagcagatcgctatgttacctctggaacaaaggaatagcattttggtgctgaaggaacagattgcgaagagtgcacagggtcgttaa

SEQ ID NO: 3 - DNA, 1209 bp, Sitophilus oryzae
  misc_feature (664)..(664): n is a, c, g, or t
atggaagccgaacgtgaaaaagctctacaagattataggaaaaaactgatggagcataaggaagtggagtcccgtttaaaagaaatgcgagagcaacttaaagatctaacaaagcagtatgataaatcagaaaatgatttaaaggctctacaaagtatgggacaaattgtcggtgaagtactaaagcagctcacagaagagaagtttattgtaaaagcaacaaacggaccccgctatgtcgtgggctgtcgcaggcaattggacaaggccaaattaaaagcaggtactcgagtagccttagatatgactactttaactattatgaggtatcttcctcgtgaagttgatcctctagtatacaacatgagtcatgaggatccaggtgatgtgacctattctgctattggaggattatcagaacaaatccgtgaactaagagaagttattgaactgccactcctcaatccagaactttttatgagagttggtattacacctccaaaaggctgtcttttatatgggcctcctggcactggtaaaacattacttgccagggcggtggcctcccaactcgatgcaaatttcttgaaagttgtctctagtgctattgtcgataagtatattggtgaatcggccaggctgattagagaaatgtttaactatntcgataagtatattggtgaatcggccaggctgattagagaaatgtttaactatgctaaagatcatcaaccctgtatcatatttatggatgaaattgatgctattggaggtcgacgtttttctgaaggtacatctgctgatagagagattcaacgtacgttaatggagcttctgaatcagatggacggttttgattcacttggacaagtaaaaatgataatggccacaaacagacctgacacattagatcctgcacttcttagacctggcagattagatcgtaaaattgaaattcctctgcctaatgaacaggctaggttagaaattttaaaaattcatgcaggccccatagctaaacatggtgaaattgattatgaagcaattgtaaaactctctgataactttaacggagctgacttgagaaatgtgtgtactgaagcaggattatttgctataagatctgaaagggaatatgttatacaagaagattttatgaaggcagttagaaaagtagcagataacaagaaacttgaaagcaagttagat

SEQ ID NO: 4 - DNA, 780 bp, Sitophilus oryzae
atggcccgaagatacgatactagaacaactatcttttctcctgaagggagattatatcaagtagaatatgccatggaggccatttctttagcaggaacctgcctaggaattttagccaacgatggcattttattagccgctgaaagaagaaatactaataagcttttagatgaagtattcacttctgaaaaaatttacaaattaaatgatgacatggtatgtagtgttgctggtataacatcggatgccaatgttctaactaacgaactaagattgattggtcagagatacattttccaatatggagaatcaattccatgtgaacagttggtttcttggttgtgtgatgttaaacaagcttatacacaatatggtggcaagaggccatttggtgtatctattctttatatgggttgggataaacactatggctaccagttgtatcagtctgaccctagcggaaactatagtggatggaaagctacatgtattgggaacaatagttctgctgctatttcaagcttaaaacaagaatataaggagggagaaatgacactgaatgatgcaaaaagtttggctgtgaaagtattgagtaaaactttagatatgacaaagctaacatcagaaaaagttgaaatggcaacactaactagagtgaataataaaacagttattcatattcttactgctaaagaagtggaagagttgatctcacagtttgagaagagcgaagcagcattggaagcttcaaagaaagaacaacaaaaagtaactgcttga

SEQ ID NO: 5 - DNA, 2673 bp, Sitophilus oryzae
atggccgaagcaaaggcagaagcacccactaaagtagaagcaaaaaaggatactgaagaagataaaaatgaattatcagaagaagataaacaactgcaagacgagctaaacctttgtgttgaaaggctgactgaaaacgatgaaaatctatatctttctgctctgaatgtgctcggtacaaaaataagagcctcaactacatctatgacgtccgtcccaaagcctcttaaatttatgaagccacattatgatacaatgaaacaagtttacgataaaattaacaatcccaatgtaaagaaggtttgtgctgatgtagtttctgttctagccatgactatgggcgaagcacgtgagtgtttaaagtatagacttctatcagatttagatcaaatacgagaatgggggcacgagtatgtaagacatttagctggcgaaattgctggagagtgggcagacaaagaagtagatgataaagatatggaagttaaacttatacagctagccaagcaaatagtgccttataacatggcacacaatgctgaagccgaagcttgtgacttgttgatggagattgaacgtcttgatttgcttgaagaatatgttgatgacaatatttatcctagagtttgcttatatcttacaagttgtgtaccatatgtagctgacccagagaatacaactttacttcagacagctctgttattatttaggaagtttaatcagtatcctcagtccttaagactagctttgcagttaaatgaccatgcacttatagaagaaatatttttgtcgtgcaaagatacgacaatccaaaaacagcttgcattcatgttggggcgtcaacagatttatattgaaattcctgaaactactccagaatatgaggaccttgctgaaataatggctaactgtcatttgaataaccatttcttgaatttagcaagagaacttgatattatggaacccaaaactcccgaggatgtgtataaatcccacttagaaaacaccagaccctcttttggtggaagccaagttgattctgccagacagaatctagctgccagttttgttaatggttttgtcaatgctgcttttggccaagacaaactgttaatggaagatggtaataaatggctttacaagaacaaagaacatgggatgcttagtgctactgcatctcttggtttggtgcttttatgggatgtcgatggaggtttaacacctattgataaatacttgtattcttctgaagatcacatcaaatcaggagcacttctagcttgtggtattgtaaactgtggtgttaggaatgagtgtgaccctgctctggctcttctcagtgattatgtcctgcataatgctccaattatgagaactggagcgattttaggtctaggtttagcctatgttggttctaaccgtgaagctgtgttaagtttattgttcccagtattttctgatcctaaatctaacatggaggtaattggaatggcggcattagcctgtggaatgattgcagtaggatcaggcaattcacaagttacaaccaccattatgcagactctaatggagaagagtgagactgaattgaaagacacttatgctagattcttgcctttggctataggattgtgccatttgggcaagcaagaaagcattgataccattattgctgctttgcaagttattccagagcccttcaggtctatggcaacaacaatggttgatatttgtgcttatgctggcacaggaaacgttctaaaggttcagcacttactccacatctgttctgaacattatgaaccccctgagcctgtagaaaaagataaaaaggacaaggaaaaagataagaaagagaaacctgaagaaaaggaaaaggatttgtcagctcgccaagccattgcagtccttggaatagcgttaatcagtatgggagaagatattggcagtgaaatggccttcagaacatttggacatttactcagatactgtgaaccagttattagaagagcagtgcctcttgctttgggtctcatatcagtttccaatccgaaattgagcattctagatacactgagcaagttttctcatgacagtgatgctgaggtagctcacaatgccatctttgctatgggattggttggtgctggaacaaacaatgcaagattagctgcaatgttgagacagttggcacagtaccacgcaaaggatccaaacaatttgtttatggtcagaattgcacagggtctatgtcacttaggaaaaggaacacttactttgagcccatatcacagtgacagacagctgatgagtcctgtagctgtagctggcttgatggcaaccttggtgggatttttagatgtcaaaacaattatcttgggaaaatctcattacctcctgtatactttggcagcagctatgcagccaaggatgctggtcacctttgatgaagatctcaatgcattacctgtacctgtcagggttggtttggctgttgatgtagtaggacaagcgggcaaaccaaaaacaattacaggctttcagactcacacaactccagtccttttggctcatggtgagagagcagaactggcaactgaggaatatatttccctcacgcccattatggaaggatttgtaatattgaggaagaatccagactttaatccgtag

SEQ ID NO: 6 - DNA, 435 bp, Sitophilus oryzae
gacagcacgggcggcccatcccagcagtactacatcaccacccagtggcctgccccgggaaacaatatggaagatggtggtgctagcgtgggcacttctggcggccaacaccagcagcgatctggcacagagactggcaacagaagaacaggagtttcatgtgcgaactgtaaaacagtgaacacgacactttggagaagaaataatcaaggtgaacccgtatgcaatgcttgcggactatacttcaagttacacaacgtgaacagaccaattagcatgaagaaagaggggatccaaacgagaaaaaggaggccaaaaaattccaacagcaatcagcaacatcccaacagtccaaccacatccggcatgcaccaacaaagaatgaaattgatcctcccagacagtagcacagagctaagacttatggcggtttag

SEQ ID NO: 7 - DNA, 3918 bp, Sitophilus oryzae
atggctttaccaggcaacgggatatttgttgtaaagggcgagatgactatattgatggctgccatgaaaagaggcacaagatggtcatcccactcatatttagacgaagaactagatttactaatgaaaagtttccaagaactcaaagaattactgagcagaatcgatgatcttagacttatcgaaccagaagtgttcctaaccccatttcttgaagttattcgtagtgaggatactacagggcctgttaccagtttagccctagctgctgtaaataaattcttgtcatatggcttgatagatcctacacattcctctgttccacaaaccgtacacaacatagccgatgctgtgactcatgctaggtttgtgggaacagaccaatcctctgatggggtggttttgatgaggattttacaagttttaaggacactaactttgactcctgagggagcaatgttaaccaatgaaagtttgtgtgagattatgctgagttgttttaggatatgttttgaaacacgcattcatgaattgctaaaaaagactgcagaatactacttaaaagacatggtgcaattagttttcatgagattacctcagttttccgatgatgtcagatcattgagtatcaagaatttgaagatgagagctggtacaggtgtggaacagacaaaattgaagaaaaagagtaggcattcgttcaggaaaaaaagccaaacagaagacagagatgctgttgaagagaatgtatcaattagtagatcagtgtcggtagaaacaaattcactaaataatgtggataacgttgtggatgtacagaatcatctgatttcaacagatgcagcgttagaaggtaatgaacaagaaaatatcgagaacataagtatagaaagtgataaaattcagacagaaaatgaagaagttacaggagaacaacctgagataaatgaagttaaaaattcagaatcggtctctgtgaatttagaaactgttcaaaaacaagtgtcagactcaccagagtcattgaatgtaccagatcaatcagtgaattcaagtgattcgaataaagagtatgttaatcagagagggataagatttacaccacaaatgattcagccagatgacttagttctgattccttacggtttggcatgtgtcagggaattgcttagatttttaatcagtctatgtaatccaaacgacaagcaaaacaatgaggttatgatccacttagggttgacgttattgacagttgcattcgaggtgggagctgacagtataggcaaacatgcagcactactgtcactggtcaaagatgatctatgtcgaaatttgttttctcttctgaattcggagagaatatctatttttgcggcagatttgcaagtgtcgtttttgatgtttgagtcactgagaactaacctcaaattccagatggaaaaatacttgacaaagttgatagaaatcgtagttagtgaaaatcaaaaagtgacatatgagcacaaggaaatcgccctggataacattttacaactttggagaataccaggatttgtgaatgaactgtatttgaattatgattgcgacatgtactgtacaaatctctatgaagatttgacgaaacttttggcaaaaaatgcttattctgcgtcgaatggtgtatggcacacacatctcctgtcattggacgctcttttgacagttatagaaggtatagaaatgcattgctcagatagtaaaagttctcaggatttgcctcatagtaagaagtcaactagtgaaagcaatgaaactattgaaagtataggaaatattataggaaaacataatcgcgttaagtatagtgaatctgtacctccactggatgatttgctggccaaaaaaagtatcaaaaagcggttacctcaaggcactgaacacttcaacatcaaaccgaaaaaaggtatacaattcttccaagagcatggcgttttgaagagcgattctgacaatcaagagatcgccttatttttgagggaaaatcctgctttagataagaaaatgatcggcgaatatattagtaacaggaacaacctgcatattttagacgcttttgtgaagacttttagtttcactggtgtcaggatagacgaagctttgagaagttttttggagactttcaggttacccggggaagcaccgactatatcgctgattttggaacaatttgccgaacactggcataaaagcaatggagagccttttgccgatgtagattccgcctttaccctagcctacgctgtgattatgttgaacgttgatcaacacaacgaaaacgccaaaaaacagactatacctatgacgccattggcttttaaaaagaatttaaaaggtgtgaatggaggtgacgatttcgatgaacaaatgttagatgagatctacaacactatcaaaaacgatgaaatcgttatgcccgcagaacaaacaggtttggttagagaaaactatctgtggaaggtgctattgagaaaaggagcttcaaaagagggtgtctacttgcatatcccccaaggcacttacgattccgagctttttaagttaatctatggtccggtggtcactgccctatgcgcagtttacgaaaaatcggaagattcgggcattttcaagcgcatcatgctcgggttcgaaaaatgcgcgtttgtggctgcgcatttcaacatgacagagaatctggacactttgatactctccttgtgcaaatacaccgtctttttcaatcaaaaaagacaaaataacattgcgatatcgtttggatccaaccaaaaagctcaactagcactaaaaactgtattttccttggttcatcttcatggagacaatattcgtgatagttggaaacatatttttgatttaattctagctctatacagtaacaatttgttacctaaaagttacattgaagtggaagattttatcgatcccagtggaagaatagttttgagttataaagaaatcgaaaatttacagaaacaggatacaagtttgttgagttcgctgtattcttatatggtatcggcagaaaatctctcaaaagtaccatcgccagaagaacaacaattcatagccatagccaaagaatgtctgaaggattgtaacttagatcagctaatcacagattcgaaattcttgcacgaagaggctctgctggaactggcaaaggccttgattgaactgtccagaggtccagatggacagagaagcgtagagtatggctataacgagagcgagactgtgttttttatggaattacttttcaaaatcgtcattcagaacagggatcgtgttatgacagtttggcaacctgtcagagaccacatctacaccctaatgatgaacgcatcactgtttgactaccagttcctcctcgaaagatcggtaataggcttactgcgcatagcgattcgcctgatgcgcaacgaagacatgtgtccaatagtaatacagtcgctgcgcatgttgctgctgctcaaaggcacgactttgtgcaggatttccaagcagatttctttcgggttatatgaactactcaagacttctgcgcagaacatccataccactaccgattggacgattatttttactttgcttgagtgtgttggagctggagctcagcctcctaagcccattgtggacgatggagtcagtcatgttgatcctggtacaaagtcagaaggcgagaaccaaataaacagcgacgacgaaagtatcgtttcggacagaggctacacctctgataccgaactgactaaagccgctcggaccaatcagagagctcccagcccgattttagtaccaaattcaccaataggaacgcccaatactggaggatggatactagttggtaacgaaggagaaatacagccagttataggtcgt

SEQ ID NO: 8 - DNA, 618 bp, Sitophilus oryzae
atgtctatattagcgtataacggtggggccatggtcgccatgaaaggcgagaactgcgtatctatcgctgcggacagaagatttggtatccaggcccaaactgtcgcgacaaactttgagaaaatcttcgaaatgggtccccaattatacgtaggccttcctggtttagccactgatacgcagacggttatggagaaactccgtttccgaaagaacctctacgaactgaaagagaatcgatcaatttcacctaaggtatttagcgctatggtatctcatatgttgtatgaaaagcgttttggcccattcttcgtcgaaccggtcatagctggtttggatccgaaaacttatgagccttttatctgtaatatggacttgattgggtgcataaatcaaccaaaagattttgttgtgggaggaacagccagtgcacaactttacggtatgtgtgaagctttgtgggaaccaaacttaggtccagatgatttatttgagatcacttctcaagccctcattaatgctttcgatagagatgctatgtctggttggggtgccacagtttatataattgaaaaggacaaggttacaattagaaacttgaagactaggatggattaa

SEQ ID NO: 9 - DNA, 1911 bp, Sitophilus oryzae
atggagtattgtagattatttacagaattggctgaatcatttttagataaaattgtgtcgtcgagcgcacctaataatatgcatcactctgtgaaaattttagatttagtgttgatgtgcgtgggacatcacgattatgaagttgccgagattacttttaatctgtggtatcttctcagcgaacagctctaccagttgagcaacaataacataagtgacctttttagaccgtatattgaaagattgattactgcgctgtgtaggcattgccagatggaacccgattgtgaaggaatattagaggatggagatgaatttaaggactttagaataaaagtatctgagctaattagggacgttgcatttatagtaggaagcaccagttgttttaggcagatgtttctcaatttgcaaaatccgggtgtgacctgggatcagactgaagcggctctttatattatgagggctgttggtaaatatgtattaagttctgaaaatgaggtcgttccaaatgtaatagaagcaatcataaatattccagaaaccactcatatcgcagtgcgttacacttcagttttactactaggagaattatgcgaatggattgaatcccattctcaagtcttagatccagttttaaattttctaattcatgctcttgcccaacctggtttaggtgctgcagctgctaatgcattacagaacatttgcgcaacgtgcagtgacaatttgtctagacatgtgccgattcttttgcaattgttgcaccaaattgacactttcggaatcagtgatgaggctgtagtgggactttttaaaggtgtcagtacaataatagcacttatgccactgaatgaaataacgcccgcaatgcgtgaattgtgcttaatgcaggtaaatcctctttgccatcttattgaccaaaatgttagccccaccaagggtaccaagactgatccggttatgtggtttgacagactcagctccattttaagacacgttattgtaaataatattccagaaggggaagttcatccatgtaagccagtgattttggaaatatggccagttttatccagggcatttgacaaataccaaaacgacattaggataatggagaggtgttgtaggagcgtcagatttatgcttaggtgtgctagtcatcaaattcacgaagtcctagaaacgttagttggccaaatagtaaggatttatagcgtccacaagcattcgtgttttctatatgttggcagcatactagtggatgagtacgctaccgacccgcgatgtataggcggtcttatcgacatgttacagatgtttatagaacccacattccagatgttacaagaagaacacggacttagaaaccatccagatacagtggatgattttttcagattatgtggccgatttatacgccgcgcccccatgtccttcctccagtgttccgccctcgttccgatcatccagtgcgccctgctggcctcccagctggaccacaaggaggccaacgtgtccgtgatgaagttcttttgcgacctgatcaaccagggccagactggacagtcccagcccgactacgccgaacgacacaagctggtcaaggacattctggaccagttcgggcagcaattggtgaccagtctgctgcaggcgtgcgtgttctatttgcagatgtacctgttgcctgaagtaagtgacgtatttgtccagctcctagacttcaacagaacaacaacgagtaagtggttaatgaatggattggatacgcttccgaaaagaaataatggcggtatcatggcggccaccccagaacaattgaatgaccttcatgtgacatttataagagccacctcttctagatcggtaacttacgtactgaaagatcttatccggtattaccgataa

SEQ ID NO: 10 - DNA, 1506 bp, Sitophilus oryzae
  misc_feature (1220)..(1220): n is a, c, g, or t
atggctcagagatttccgggacctggggctgctccagttcccagtgcacctcctccacaacggtaccaacaaccccaaaatccaggcatgcgccaatacaaccaacaaaattttccgcaacgtgcgggatataataatccgccgccaaatatgaatactagtggcggaaccatgatacaaagaccgtccggagcaccatactcccctatgcgaggagctcaaattcccacccagcccacaggaaagagaccggctgataatcgtagcaccatacaacaaaaaagtgattacagtcacagtacaagcaagaaaaagaagaaattggcggacaaaattctgcctcagaaagttcgtgatttagtgccggagagtcaggcttatatggatctgttggctttcgaaaggaaactcgatgcgacaataatgcggaaacgtttagatatacaggaggcattgaagagacccatgaaacaaaaaagaaaattgagaatttttatttccaacacattctatccagctaaggaaccgtgtcctgatagcccagatggatctgcacaagaaggatctgtagcctcttgggaactacgcgtcgaaggaagattattggacgatgccaagaatgatcccaataaggtcaaaagaaaattctcttcattctttaaatcactagtgatagaattggataaggaattatatgggccagataatcacctggtggaatggcatcgcaccttaactacccaagagacagatgggtttcaagtcaaacgaccaggagataaaaatgtccgttgtaccatactactccttctagactaccaaccgttgcaatttaaattggatcctagactggcacggttgctgggcgttcacactcaaaccagacctgtcattatatcagctctgtggcaatacatcaaaacccataagctgcaagattcacatgagagggagtatattgtttgtgataaatatctggaacagatttttaactgttcaaagatgaaatttgctgaaataccgcagagattaaatccattgttgcacccaccagatccgatagtaattaatcacgtgatctcggtcgagggcggagctgagagcaaacagactgcctgttacgatattgacgttgaagttgatgatacgttaaagacccagatgaacaatttcctgttgagcactgctagccagcaagagattcagggattggattcganttcgaaaattcacgaaaccgtcgatacaatcaatcaactgaaaaccaacagagaatttttcctgagctttgccaaagatcctcagcaatttattcataaatggattgtctctcaaactagagacctaaagaccatgactgatgtggttggcaaccctgaagaggagcgtcgctcagacttcttttaccagccctgggcccaggaagcggtgtgcagatatttctacactaaagtccaacagaaaagggccgaattggaacaagccctcggtatacgtaataactaa

SEQ ID NO: 11 - DNA, 435 bp, Sitophilus oryzae
atgcctaaagttcgaagaagcaaaaaagcaccaccagaaggatgggagctaatagaaccaaccttagatgagctagaacagaaaatgagagaagctgaaactgaatcgcacgagggtaaacgaaaaaacgagtcgttatggcctattttcaaaatccaccatcagaaatccagatacatttacgacctgttttatagaagaaaggcaatttccagagaactgtacgagtattgtttaaatgaaaatatagcggacaagaaccttatagcgaaatggaaaaaacaaggatacgaaaacttatgttgtttaaggtgtattcaaacgagggacaccaattttgggactaattgcatttgtcgagtacctaagggcaaattagaagagggcagaatagttgaatgtgtccattgtggatgtcgaggatgttcaggttga

SEQ ID NO: 12 - DNA, 915 bp, Sitophilus oryzae
  misc_feature (676)..(676): n is a, c, g, or t
atgccaacagctacagttggtagcttacaactaccaaataatgaagattgtggaatcagagatgtttgggctcataacttagaagatgaatttcgcactatcagacagatcgttcagaaataccagtatgttgccatggatactgaatttccaggagttgtggctcggcctataggggaatttagaagttcggctgattatcagtatcaaatgttaagatgtaatgttgatttgttaagaataatacaacttggtcttacattcttagacgataatggcaagacacctggtggatcatacactacatggcaatttaactttaaatttaatttacaagaagatatgtatgcacaagacagtatagacctgttaaccaactccggaatccaatttaaaaaacatgaagatgagggtattgagccattagaatttgccgaactacttatgtcttctggcattgttttaatggataatatcaaatggttaagctttcattcggggtacgattttggatatctgatcaaattacttaccgataataacttgcctcaagatgaaaacgaattttttgacttgttgaaattgtactttccaacaatatatgatgttaagtacctcatgaagtcttgcaaaactttaaaagggggtttacaggaggtagctgagcaacttgagnggggtttacaggaggtagctgagcaacttgagttggaacgtgtaggaccccaacatcaagctggatctgattctctacttactggaatggcctttttcaagatgaaggagatgttttttgaggatactattgacgattctaaattttctggtcacctgtatggtcttggaacatcattcgctgtgaatggaacaaataattacccacctgataatggagataatgcaaactcagcataa

SEQ ID NO: 13 - DNA, 1212 bp, Sitophilus oryzae
atgtcggaagcggggaagagccgtaataatatttacgaagatttatcgaatgttgaattcgaaaccagtgaagatgtggacgttatcgataaattctctaaaatgaaccttaaagaagaactaactagaggaatatacgcatacggtttcgagaagccctcggctattcagcagcgagctatcaagcccattatcaaaggcagagacgttatcgcacaggcccagtccggtacaggaaaaacagcaacattttccatttcaatcttgcaaacactcgacctgaccgttcgtgaaactcaagtcttgtgcttgtctcccaccagagagctggcagtacaaattcaaaaggtaattctcgctctgggcgattttatgaacgtgcagtgccatgcttgcattggggggactaatttaggggaggatattagaaagcttgattacggacagcatgtggttagtggaacgccagggagagtttacgatatgataagaagaagagcacttcgtactcggtcagttaggatgcttgtccttgacgaagccgatgagatgttgaataagggattcaaagaacagatttacgatgtatacagattcctacccccctcaactcaagtggtcctaatttcggcaacactaccccacgaaatcctggaaataacctcaaaattcatgacggatcctatcaggatcctggtcaaacgtgatgaattgactctggaaggtatcaaacagttctttgtggccgtggaaagggaagaatggaagtttgacactctttgtgacctgtacgatacactgacaataacacaggcggttattttctgtaatacaaagaggaaggtggattggttgactgagaaaatgcgagaaagtaattttacggtgagctgtatgcatggtgacatgccccagaaggagagagataatattatgaaggagtttaggtcgggacagagtcgggttttgatcaccacagatgtatgggccagaggcattgacgtgcagcaagtcagtttggtaataaactacgacttgcccaacaatcgtgaattgtacatccacagaataggtagatcgggaaggttcggcagaaaaggtgtggcaattaattttgtcaaatcggatgacatcaggattttgcgggatatcgaacaatattattcgacacaaatcgacgaaatgcctatgaacgtggcggatcttatttaa

SEQ ID NO: 14 - DNA, 1608 bp, Sitophilus oryzae
atgacagcccccaaggcgtcaggagatgcaaatcgtaataatagaaatgccgcatacaaggataaaagcaaacctaccgatgtaagaactagcaatataaatgctgcaaaagccgtttgtgatgcgattcgaacaagtttgggacccaggggaatggataaaatgatccaagccagtaatggggaagtaacaattacaaatgatggagctaccattttaaagcaaatgaatgtaattcatccggctgcaaaaatgctggtagaattgtcaagggctcaagatgttgaagccggcgatggtactacttcagttgttgttattgctggagcattattagatactgctgaaaaactattgaacagaggcattcatccaacggcaatatcagagtcttttcaaaaggctgcttctcatgctgtagagatcttaaacaacattgctactccagttgaattaaataatagagaacagttaattaagagtgcatctacttcgcttaattcaaaagttgtctcacagcaatcaactcagttggcacctttagctgttgatgcagtattaaaagtacttgaaccaggtcgagaaagcgcatgtaatttgacagatattaaagttttaaagcaattaggcggtacagtggaggacactgaactaattaatggtcttgtgtttccaagaactctggcaaatgttgttggccctaaacgattagaaaaagtgaaaattggtcttatccagttctgcatttctccaccaaaaactgacatggatcataatgttatcgtttctgactatgccgctatggatagagttttgaaagaagaacgagcatatattttaaacattgttaagcaagtgaagaaagctggctgtaatgtgttacttgtacaaaaatctatcttaagagatgccatctctgacttggctttacactttttggataaaattaaatgtatggtggttaaggatattgagagggaagatatagagtttgtttgcaaaactttaggctgcaggcctattgcatctttggatcattttgtagctgagaatttagtgtcggcagatttagccgaagaagttggatttggagcaaacagaatggtcaaaatatcagggattcagaatcctggacgtaccatcaccctcttggtgcggggttcaaacaagctggtccttgaagaagcagagcgatctttgcatgacgccttatgtgtagttagatgtcttgttcgtaaaagagcggtaatagcagggggcggggcccccgaaactgaactggctctgcgattggctgctcttgcagataaaatggaaggagtcgacgctatctgccttagggcatatgctggagccctggagattattccatttactttggcagaaaatgctggtttgaacccaattcagactgtaactgaattaagaaataggcacgcaaagggagagatttctgcaggaatcaacgtacgcaaaggttgtatttctgatatattagaagagaatgtaattcaaccattgctggtgaccacatctgctttgtcttttgctacagaaacagtgagatcaatcttaaaaattgatgatattgtgaacacaatgacatga

SEQ ID NO: 15 - DNA, 1335 bp, Sitophilus oryzae
  misc_feature (699)..(699): n is a, c, g, or t
atggaagcaatggatgttgttttacccgaaaaagaagaaggtagcccttcggatacaacgaaaccaaatcttcaggatctagacactgaagatttatacacaaagtataaaaaactgcaacaaatgctcgagtttttggaagttcaagaggagtatattaaagacgaacaaaggaatttaaaaaaagagtatctgcacgctcaagaagaagtcaagaggattcagtctgttcctttggttattgggcagtttttagaagctgtcgatcaaaatacaggtattgttggatcaacaactggttcaaactactatgtaagaatcttatcaaccattgacagagagttactaaaacctagtgctagtgtagcattacataaacacagcaatgccttagttgatgtattgcctcccgaagctgattcatcaatcagcatgcttcaagcagatgagaagcctgatgttagctacagtgatattggtggtatggatatgcaaaagcaggaaattcgtgaagcagtagagctacccctaactcactttgaattatataaacaaattggtattgatcctccaaggggtgtgttaatgtatggaccaccagggtgtggcaagactatgttagctaaagctgttgctcatcatactacagctgcctttatccgagttgttggttccgagtttgtgcaaaaatacttgggnggcaagactatgttagctaaagctgttgctcatcatactacagctgcctttatccgagttgttggttccgagtttgtgcaaaaatacttgggtgaaggtcccagaatggtaagagacgtttttcgtctagccaaggaaaactctccagccattatttttattgatgaaatcgatgccatcgctacaaaacgtttcgacgctcaaacgggcgccgatcgtgaagttcagagaattcttttggagttgttgaatcaaatggacggatttgatcaaactactaatgttaaggttattatggctacaaacagagctgacaccctcgatcctgcccttcttagacctggtcgtttagataggaagatagaattcccgctacctgacagaagacaaaagcgtttagtttttagcactattacctcaaggatgaacttatctgaagaggttgatttggaagactatgtagccaggccagataaaatttctggagccgacataaacgccatttgtcaagaggcaggtatgcatgcagtgagagaaaaccgttatattgtgctgccaaaagattttgagaagggctacaaaaacaacattaagaaggacgagagcgaacatgaattctacaaaaacaacattaag

SEQ ID NO: 16 - DNA, 585 bp, Sitophilus oryzae
  misc_feature (380)..(380): n is a, c, g, or t
atgccgaaaatcaaactgcagtcgtccgatggcgaaatattcgacgttgaagtggagaccgctaaatgctcggttaccatcaaaaccatgttggaagatctaggtatggatgacgaagaggaagaaatagtgcctctgcccaatgttaattcagccattcttcgaaaagtcctacaatgggctaccttccacaaagatgatccaccgccacccgaagatgacgaaagtaaagaaaaaaggactgacgacatttcatcgtgggatgctgatttcctgaaagtcgatcaaggaacactgttcgaactgattttagccgccaattatctggacattaaaggcctgctagatgtcacctgcaaaactgttgccaatatgatcantcaaggaacactgttcgaactgattttagccgccaattatctggacattaaaggcctgctagatgtcacctgcaaaactgttgccaatatgatcaagggcaaagcgcctgacgaaattcgcaaaacgttcaatattaagaatgattttacagcctccgaggaggatcaggttcgaaaagaaaatgaatggtgtgaagagaaatag

SEQ ID NO: 17 - DNA, 1035 bp, Sitophilus oryzae
atgaaagcaacaacctctccaaagttaaataaactgttcatttctaagcaaaatgaatttcaggatattcaaagtaaagctgagcaggggcttattaatatggcgattgacgaaaaggcatcatgtaaggagttggaccagtggattgaacaactaaacgattgcaaccaattaacggaaaatcaagtgaagaccctatgtgataaggctaaagaaatattgtccaaggaatccaatgtacaggaagtaaaatgtccagtcacagtatgtggagatgtacatggtcaattccatgacttgatggaattgttcagaataggcggacgaagtcctgacacaaactacctgtttatgggagattatgtcgatcgtggatattattcagtagagacagtcacattgttagtagctttaaaggttcggtataaggagagaattacaattctaaggggcaatcatgagtccagacaaattactcaagtatatggcttctacgatgaatgtctccgaaaatatggaaatgcaaatgtttggaaatttttcactgatttgttcgactacttgccactgacagctctagttgatggtcaaatattctgtttgcatggtgggttaagtcccagcattgacactttggaccatattcgtgcattggatcgtttacaagaggtacctcatgaaggaccaatgtgtgaccttttgtggtccgatcctgatgaccgcggtggatggggcatcagtcctcgaggtgcgggatacacttttggacaagacatctctgaaacctttaatcattctaatggattaaccttagtttcgagggcccatcagctggttatggaaggttataattggtgtcacgataggaacgtcgttactatttttagtgctccaaattattgttatcgttgcggaaatcaagctgctattatggaattagacgacgccctcaagtattctttcttacagttcgatccagcaccgagacgcggggaaccccacgtgactcgccgaactcccgactatttcctgtaa

SEQ ID NO: 18 - DNA, 3882 bp, Sitophilus oryzae
atgcagattttcgtaaaaaccttgactggtaagactattaccctagaggtagaaccttcagataccattgaaaacgtgaaggctaagattcaagacaaagagggtattcctccagaccaacagcgtttgatcttcgctggtaaacagttggaagatggacgcactttgtccgactacaacatccagaaggaatccactcttcatttagtactgagattgagaggaggaatgcagatttttgtgaagactttgaccggcaagaccatcactttggaagtcgaaccatctgataccattgaaaatgtaaaagccaaaatccaagataaggagggcattcccccagaccaacagcgtttgatctttgctggaaaacagttggaagatggtaggactctttctgattacaacattcagaaggaatctacccttcacttagtattgagattaagaggaggtatgcagattttcgtaaaaacattaactggaaagaccattaccttggaagtggaaccatcagataccattgaaaacgtcaaggcaaaaattcaagacaaagaaggaattcctccagaccagcaacgtttgatctttgctggtaaacaactagaagatggtaggactctttctgactacaatattcagaaggaatcaaccctacatttggtgcttagactgagaggtggtatgcagatttttgtcaaaactttaaccggcaaaactattacgttggaggtagaaccttcagacacaattgaaaatgtgaaagctaaaattcaggacaaagaaggtattcctccagaccagcaacgtttgatctttgctggtaaacaactagaagatggtagaactctttctgactacaacatccaaaaggaatctacccttcacttggtactgaggttaagaggtggtatgcagatttttgtaaaaaccttgacagggaaaaccatcactttggaagtggaaccatcagacaccattgaaaatgtcaaagctaaaattcaggacaaggaaggaattcctccagatcaacaacgtttaatctttgccggcaaacagttagaagatggtagaactctttctgattacaacatccagaaagaatctactcttcacttggtcctgaggttaagaggtggtatgcagatctttgttaaaaccttaacaggaaaaactattaccctagaagtagaaccctccgacactattgaaaatgtcaaggccaaaatccaagacaaggaaggaattcctccagatcagcaacgtttgatctttgctggtaaacaacttgaagatggacgaactttgtctgactacaatatccaaaaagaatctactcttcacttggtactgaggttaagaggaggtatgcagatatttgtaaaaacattaactggaaaaaccattacattggaagtagaaccatccgacaccattgaaaatgttaaggctaaaattcaagacaaagaaggaattcctccagaccagcaacgtttgattttcgccggcaaacaattagaagatggtaggaccctttctgactacaatattcagaaggaatctacccttcacttggtattgagattaagaggaggtatgcagatttttgtaaaaacattaactggcaagaccatcactttggaagtcgaaccttctgataccatcgaaaatgtaaaggctaagatccaagataaggaaggaattcctccagaccaacagcgtttgatctttgctggaaaacagctcgaagatggtaggaccctttctgactacaatattcagaaggaatccaccctacatttggtgcttagactgagaggtggtatgcaaattttcgtcaaaactttaacaggcaaaactattaccttggaagtagagccatcagacacaattgaaaatgtgaaagctaaaattcaggacaaagaaggtattcctccagaccagcaacgtttgatcttcgccggcaaacaactagaagatggtagaactctttctgactacaacatccagaaggagtctaccctccatttggtactgagattaagaggaggtatgcaaatctttgtgaaaactttaactggaaaaactatcaccttagaagtggaaccatcagatactatcgaaaacgtcaaagccaaaattcaagacaaagaaggaatacctccagaccagcaacgtttgatcttcgccggcaaacaactagaggatggtagaaccctttctgattacaacatccagaaggaatctacccttcacttggtactgaggttaagaggaggaatgcagatctttgtgaaaactttaactggaaaaaccattactttagaagtagaaccctcagataccattgaaaacgtcaaggctaaaatccaagataaggaaggcattcctccagaccaacagcgtttgatcttcgccggcaagcagttggaagatggtagaaccctatcagactacaacatccagaaagagtctacccttcacttggtactcaggttaagaggaggtatgcaaatttttgtaaaaaccttaactggaaaaacaatcaccctagaagtcgaaccttctgataccattgaaaacgtcaaagccaaaattcaagacaaggaaggaattcctccagatcagcaacgtttgatcttcgccggtaaacaactggaagatggcagaactctttcagactacaacatccagaaagaatctacccttcacttggtactcaggttaaggggaggtatgcaaatttttgtaaaaaccttgactggcaaaaccatcactttggaagtagaagcctctgataccattgaaaacgtcaaggctaaaatccaagacaaagaaggtattccaccagaccaacagcgtttgatcttcgccggcaaacagttggaagatggtagaaccctatcagactacaacatccagaaagagtctacccttcacttggtactcaggttaagaggaggtatgcaaatctttgtaaaaaccttgactggaaaaacaatcaccctagaagtagaaccctctgataccattgaaaatgtcaaagccaaaattcaagacaaggaaggaattcctccagatcagcaacgtttgatcttcgccggtaaacaactggaagatggcagaactctttcagactacaacatccagaaagagtctactcttcacttggtactcaggttaagaggaggtatgcaaatctttgtaaaaaccttgactggaaaaacaatcaccctagaagtagaaccctctgataccattgaaaatgtcaaagccaaaattcaagacaaggaaggaattcctccagatcagcaacgtttgatcttcgccggtaaacaactggaagatggcagaactctttcagactacaacatccagaaagaatctacccttcacttggtactcaggttaagaggaggtatgcaaatctttgtaaaaaccttgactggcaaaaccatcactttggaagtagaagcctctgataccattgaaaacgtcaaggctaaaatccaagacaaagaaggtattccaccagaccaacagcgtttgatcttcgccggcaaacaactagaagacggtagaaccctttctgactacaacatccagaaggaatctacccttcacttggtattgaggttgagaggtggtatgcagatcttcgtaaaaaccttgacaggaaagaccatcaccttggaagtggaaccatccgacaccattgaaaatgttaaggctaaaattcaagacaaagaaggaattcctccagaccagcaacgtctgatcttcgccggcaaacagttggaagatggaagaaccctttccgactacagcatccaaaaggaatctacccttcatttagtattaaggttgagaggaggaaactga

SEQ ID NO: 19 - DNA, 1680 bp, Sitophilus oryzae
  misc_feature (584)..(584): n is a, c, g, or t
atgatgcaaccacaaattctcttattaaaggaaggaacagacacatctcaaggaaagcctcaattaatatcaaatataaatgcttgtcagtctattgttgatgctgttcgtacaacattgggcccaaggggtatggacaaattaattgttgtcagatctggcaaggctacaatatctaatgatggagctactataatgaagctccttgatgtagttcatccggctgcaaaaactctggtagatatcgcaaagtcacaagatgctgaagtcggagatggcaccaccagtgttgttcttttagcgggtgaatttttaaaacatataaagccatatgttgaagagggagttcaccccagaattattatcaaggctgttagaaagtccctgcaactctgcttggagaaaatacaggaaatttctgtgaaaattaataaatccaatgctttagaattcaggtcattattagaaaaatgtgcttcaactgcaatgagttcaaaactcattagtcaacaaagggcatttttctctaaaatggtagtagatgctgtattattgttagatgatctcatgccattaaatatganctctaaaatggtagtagatgctgtattattgttagatgatctcatgccattaaatatgattggaattaaaaaggtgcaaggtggaggtcttgaagactcaactctagttgctggtgtggcttttaagaaaacgttttcatatgcaggatttgaaatgcagcctaaagtctataagaactgtaagattgcattgctcaatattgaacttgaattaaaggctgaacgggataatgctgaagttagggttgatagtgttaaagaatatcagaaaattgtcgatgctgaatggaatatattgtataacaaattgaaaaagattcacgaatctggtgcaaatgtggttttgtcaaagttaccaattggagatgtagcaactcagtattttgctgacagagatatgttttgtgctggtcgagtagcagaagaagatctgagaaggacgttaaaagcttgtggtggagctgtaatgactactgtaaatgatcttaacgattcagttttgggtaattgtgatttgtttgaagagaggcaaattggaggagagagatataacttctttagaggttgtccgaatgcaaaaacctgcactataatcttaagaggtggtgcagaacaatttcttgaggaaacagaaaggtcactccatgatgccatcatgattgttcgcagaaccattaaaaatgatgctgttgttgctggtggaggtgcaattgagatggaactgtccaaaattctgcgcgattattccagaacaattgccggcaaagagcagctactaatcagcgctgttgccaaagcactagaaataataccgaggcagttgtgcgacaatgccggtttcgatgcgacgaacatattaaacaaactgagacaaaaacacgctcaaggccattgttggtacggagtggacgtcagtaaagaagacatcagcgacaacttcgagtcctgtgtctgggaaccggccattatcaaaatcaatgctctgactgccgctacggaggccgcctgtttgattttgtcggttgacgagaccatcaaaaatcaaaagtcggccgaaccacctcagatgggaagaggaatgggaagacccatgtga

SEQ ID NO: 20 - DNA, 8805 bp, Sitophilus oryzae
  misc_feature (6191)..(6191): n is a, c, g, or t
atggaatggtgcgacaaatatcaagctcaaatcgttgtattggcagctcagatattctggagcgaggatgtagaagctgctttgtcaaaaatgaatggagaaccacagaaaggtccgttggaaaaagtgctgcaacaagtcgagaataccttgaatgtattggccgattcagtgcttcaagaacaacctcagttaagaagaaagaaattggaacatttgattaatgaatttgtgcataagagaaccgttactaggaagcttatagtttctggagtgtgcagcaataaagcttttgaatggctttgtcaaatgagattttactttgatcctcgtcaaactgaggttctaaaacaactaaccatccacatggctaatgcaagattctactacggctttgagtatcttggtgtccaagatagactcgtccaaacgcctttgaccgacagatgctatttgacaatgacgcaagctttagaagctagattaggaggatcgccttttggcccggctggtactggtaaaactgagtccgtcaaagctctcggcaatcagctgggtcgcttcgtgttggtgtttaactgcgacgagacattcgattttcaagcgatgggtagaattttcgtcggtttgtgtcaagtaggcgcgtggggttgttttgacgaattcaacaggttagaagagagaatgctatcggcggtatctcaacaaatccaaactatccaagaagcccttaagagccagaaagaaagtagcgacagtcaaggacagcaaggaggcagtatcagcgtggaattggtcggaaaacaagtcagagtttccccagatatggcaatctttattactatgaaccccgggtatgccggaaggtccaacttgcccgacaatttgaagaaactctttaggtcgttggctatgaccacaccagataggcagcttattgctgaagttatgttattctcgcaaggttttagatctgctgaaaagttagcctgtaaaattgtacccttcttcaagctttgtgatgaacagctgtccaaccagtcgcattacgattttgggcttcgggccttaaaatcggtgcttatttctgctggaaacgtaaaacgagacaggatacaaagaataaaagaaaacatgaagcagagaggagaaacaaatattgatgaagctagtattgctgaaaacttaccggaacaagagattttaattcagtcagtttgtgaaactatggtgcccaaattggtagctgaagatattcctcttctctttagtttattgaatgatgtgttcccgaatgttcaatacaccagagctgaaatgaagggattaaaagatgaaattcgtaaagtttgtgccgaagaatacttggtttgcggcgaaggagacgagcaaggttccgcttggatggagaaggttcttcaattataccaaatctgcaacttaaatcatggtttgatgatggtgggcccaagcggttctggaaaaagttccgcatggagagtacttcttaaagcactggaacgatttgaaggtgtggaaggtgtagcccatgttattgatcctaaagccatcagcaaggaagcattgtacggtgttctggatcccaacactagagaatggacagatggtctctttactcacatactaaggaaaatcattgacaacgtaagaggtgaaattaataaacgccaatggataatattcgatggcgatgtagatccagaatgggtagaaaatttgaactctgtcctggatgataacaaattgcttacgctacctaacggcgaacgtctttctctgccacctaatgtccgtgtaatgtttgaggtgcaagatctgaaatacgctactctagccaccgtttctcgttgtggtatggtatggttttcggaagatgtattaaccacggaaatgatcttcgagaactacatgcttcgtcttaaacatattcctctagaggaaggagaagacgatagctttggaaagaaaatagaaaacaaggaagatacagtgtctcctacactacaagtacagcaggatgttgccaatctgcttcaaccgttccttcaaccggatggtttagtcatcagatgtttagaacattcaatggaacaggaacatattatggactttaccagactaagagctttgagttcgctgttttctatgttaaatcagagcgtcaggaatgttttacaatacaatcactcccacaacgactttcctttagccttcgaaaccttggaacgctacattcccaaatgtttaatttacgctatactatggagcttcgccggcgatgccaagcttaaagttcgttcggagttaggcgactttgtcagatctattacaacggtaccgcttcctcccgacaacaatacgccaataatcgattacgaggtcaccatagaaggggaatgggcgccttggtctaacaaggtacctcagattgaagtggagacccataaagtcgcttctccagatattgtagtacccacattggataccgtacgacacgagtcgctgttgtacacttggttagcggaacacaaacccttagtattatgtggtccacccggttcaggcaaaaccatgacattattctcggctttaagagctctgcctgacatggaagtagttggtctcaatttctcgtcggccacaactcccgaacttttgcttaaaacctttgatcactattgcgagtacagaaaaacacctaacggagttgttctatcaccagtacagcttggtaaatggttggtactattctgcgacgaaattaacttaccggacatggacaattacggtacccagcgcgttataatgttcttgcgtcaaatagtcgaacagaaaggattctacagagccagcgatcaaacttgggtgtctttagaacgcatccagtttgtgggggcttgtaacccacctactgatccaggaaggaagccactttcccacagattccttcgacatgttccagtaatttacgtcgattatcctggagaaacttcgctgaaacaaatctacggcacatttacaagggctatgctgcgtctcactccgggattaaaaggttacgccgaaccattgacaaacgctatggttgagttttatttggcctcccaggacagattcactcaagatatgcaaccgcattacgtgtactcgcctcgtgagatgaccagatgggtacgtggaatatgtgaggctataagaccactggatagtttaagtgtagaaggtctggtaagactctgggcccacgaggctttgcgtctcttccaagacagactagtcgaagattctgaaaggcaatggaccaacgagaacatcgactcggtcgccctgaaacacttcccttcggcgaattgcgaaagggcactggaaaggccaattctttacagcaactggctttcgaaggactacacgcccgtggagagggagaagcttagggaatacgttaaagccaggctaaaggtgttctacgaagaggaactggacgtgcctctggtacttttcgacgaagtgctggatcacgttttgaggattgacaggatatttaggcaacctcaagggcatttgttactgatcggtgtttccggtgctggtaaaacgacgttgtctcgatttgttgcctggatgaatggattatctatcttccaaattaaggttcataataaatacacggccgaagattttgatgaagatttaagatcagtattgagacgatctgggtgcaaagatgaaaaaatcgcttttattttggacgaatctaacatgctggattccagcttcttggagagaatgaacacattattagccaatggggaagttcccggcttgtttgagggcgatgaatacacaacattgatgacacagtgcaaggaaggagctcagcgagaaggtttgatgttagattcaagcgacgaactctacaagtggttcacccaacaagtaatgcgcaatttacacgttgtctttactatgaatccatctaccgatggtctcaaggatagagctgccacctcccctgcattgttcaacagatgcgtcttgaattggttcggagattggtctgatggagctttgttccaagttggaaaagagtttacttaccgtttagatctcgatagaccaacttggaaatcgcctgactttttccctgccgcgtgcaagtttgttccaacctctccaaatcacagagaagcagttatcaatgcttgtgtatatgtccaccagacgctacacaaagccaatgttagactagctaaaagaggtggacgtacaatggctattactccaagacactatctagactttatccatcattttgtcaaattacacaacgagaaaagatcagatttggaagaacagcagctacatctgaacgttggtctgaacaaaattgcagaaaccgtggaacaggtcgaagaaatgcaaaagagcctcgcggtaaaatctcaggaactgcaggcaaagaacgaagctgccaatgcgaaattgaagcagatggtgaaagaccagcaagaggccgagaagaagaaagtacagagtcaagaaattcagcaacaactggctgagcaaactgtccacattgaacagaagcgtacagaagtcatggcggatttagcacaagtggaaccggctgtaattgatgctcaaactgccgtaaagtccatcaaaaagcaacagctcgtcgaaatccgttctatgtcgaacccgccggccatcgtaaagctcgctctcgaatccatttgccttttgctgggcgagaacgccagcgattggaagtccattcgatcggtgattatgcgcgacaatttcatcaacacggtcgtcaacaatttcaacacggaggacattagtgacgacgttcgcgacaagatgaagtcgaagtacctcagcaatccagactacaacttcgaaaaagtaaatcatgccagtaacgcttgcggtcctcttgtcaagtgggccatggcccaaattcaatacgctgacatgttgaagaaggtcgaacccttacgtcaagaacttagctctctcgaaacccaagccgaaacaaacaaaaagcgtggagaggaagtcaagaatctaatcagccaactggaacacagtatcgcatcctacaaagacgaatacgcacagctgattgcccaggctcaagctatcaagaccgacttggagaacgtacaggctaaagttgaccgttccattgcgttattgaagtcgttggttattgaacgagaaagatgggaagccacgagcgaaacttttagagcccaaatgtcaactatcgtaggtgacgtgcttttatctgcagcctttatcgcttatggtggttacttcgatcagcactaccggcaaaatctgttcatggcgtggtgccagcatttaactcaggcttctattcaatacaggcccgacattgccagaaccgaatacctgtctaatccggatgaaagattaagatggcaagctaatgcgctaccctcagatgacctatgtactgaaaatgccatcatgttgaagagattcaacaggtacccacttataatcgatccttcaggccaggcaactgacttcattatgaacgaatataaagataagaaaataacaaagacgagtttcttggatgattccttcaggaagaatctcgaatcagccctacgttttggaaacccacttttagttcaagacgttgaaaactacgacgctatattgaacccagttctaaacagagaactgcgacgaacaggaggtcgagttttaataacccttggcgatcaagacattgatttgtctccgtcgtttattattttcttatctactcgtgaccccactgttgaattcccaccggacatatgctcgagggttactttcgtcaacttcaccgttactagaagttctttacagagccagtgtttgaatcaagtactaaaagccgagaggcccgacatcgatgctaagcgttctgatttgcttaaacttcaaggcgaattccatttgaggttgaggcagttggagaaatccctactgcaagccttgaatgatgctaaaggcaagattctggacgatgatagcgtgataacaactctggaaactttgaagaaagaggccgcagaaatcgggcagaaagtcgaagaaactgataaggtcatttcagaaatcgaggcggtttctcagcaatnaactgataaggtcatttcagaaatcgaggcggtttctcagcaatatttaccgttatcgcaagcttgcagcaacacgtatttcaccatggatagtcttaaccaagttcatttcttataccaatattccctgcagttctttttggatatgttcaacagtgtactgttgagcaatccaaaattagatggcacttccgactatcaacaaagattgactataataactactgacttattccaagttgtatatgaaaggatagcacggggaatgatacacaacgacagattgacgtttgcaattcttctgagtagaattttcctgaaaggtcttcctaacgaacctaattacgatcaagaattcaatttcttcttgagggcgaaggaaggtcttttgagttcatctactgggcctattgtggacggactaaacagcgaacaacaagaagcgctgacaagactatcaacaagattgccagcttttaagaaacttcctgaaaagatcaaagaaatgcccgagttcggtgcttggcttcaacagagcacacccgagcaagccgtgcctggtttgtggatagaagagaagcaattaagtccgattggtacagcaatgtaccagctactcgttattcaagctttcagaccggacagagtcatagctgcagctacactctttgtttctagtgttatgggacaagactatctagcttctgcggagaaggagattgatttaggtgtgatcgtggagaaagaaattaaagctagtgttccggttctcctatgctcagtacctggatttgatgcctcaggtagagtagacgacttagctactgaactcaacaagcaaatatccagcattgctattggttctgcggaaggatttaatcaagcagatagagctattaacatggcctgtaaaactggaagatgggttatacttaaaaacgtacatctagcaccacagtggttggttcaactggaaaagaaactacattctcttcaacctcacgccaactttaggttattcctaactatggaaattaaccctaaacttcctgtcaacctgttacgagccggaagaatatttgtatttgagcctccgccaggcatcagagctaacttattaagaacatttagcacagtaccagcaagcagaatgatgaaagctcccaacgaaagagcaaggctgtacttccttctcgcttggttccatgcaattgttcaagaaagactgagatactgtccgttgggatgggctaagtattacgaatttagtgaatctgatctgagggttgcctgtgatactcttgacacttggattgatgctacggcaatgggaagaacaaatttgccaccagaaaaagtgccatgggatgctttggttactcttctttctcaatctatctatggtggaaaaatcgacaacggtttcgatcaacgacttctgcaatcattccttaacaaactcttcactttcaaaagttttgaagctgattttgctctggttgctaacattgataatggacctaacggtactagacacattactatgccagatggaaccagacgcgatcatttcttaaaatggattgaaagtctagcggataggcaaactcctgcatggctcggactaccaaataatgctgaaaaagtgctgttgacaacaagaggtactgatctgattggtaaattgcttaaaatgcagcagttagaagacgatgatgagcttgcatattcgatggacgaatcttcaccaaccgatcccaaggctcaaattgatggtaggccatcgtggatgaaaaccttacataactctgccctgacatggctccaacttttaccaaaatctttacacacgctaaaaaggaccgtcgaaaatattaaggatcctctctacagatactttgagcgcgaagtgaattctgcgtctaaactattaatagatgtcattcacgatttgaatgacgttcttttaatttgccaaggtgataaaaaacaaaccaactaccatcgtactttgttggaagaactcgtcagaggtatcattccggccaactggcataggtacactgtacccaaagggtgcacggttatccagtggattaccgacttcagcaatagagttaagcaacttcaacaaatatcccaggtggtttccagttctggagcaaaggaactacagagttttccagtttggttaggcgggcttctcaatcccgaagcctggataacggctactagacaatgcgtagcccaggctaatagttggtccttggaggaacttcatttggatgttactatcaccgattcccatgacaaatctagcattccgcatgactgttttgctattgttggactgaaactacaaggtgcccaatgtaagaacaaccagctccttcttacatccagtataatgtcggaactacccataaccctactgcgctgggctagaactggagacgaaaaaccttccggtagcaagctctccctaccgatctacctaaattccacaagaacagagttactctacacggtagacctcaacatagcaccgggccaagacccgcatagcttctatgagcgcggtgtagcgctgcttacatcaactgctttaaattaa

SEQ ID NO: 21 - DNA, 2004 bp, Sitophilus oryzae
atgccaggctcaagagataaaataaagaaagaaccagaacttactgaacaagaaaagaaaaagctgacaattgaagaaactaaaattagtttgccaatttttccatttaaggaagatcttatacaagccgttcaagaacaccaagttttaataattgaaggagaaactggatctggaaaaacaactcaaattccacagtatttacatgaagcaggatttacaaatgacaataaaaaaattggctgcacacagccaagaagagttgcagcaatgtcagttgcagcgagagttgctcaggaaatgggagttaaattaggcaatgaagttggatatgcaataagatttgaagactgtacatctgaaagaactataattaagtatatgacagatggtactttgcacagggaatttttatctgagccagacttacaatcatacagtgttatgataattgatgaagctcatgaaaggactttgcatacagatattttatttggtttagtaaaggatattgccaggtttaggcctgacttaaaattattgatatctagtgcaaccttggatgctcaaaaattttcagaattttttgatgatgctccgatatttagaataccaggaaggagatttccagttgatatttattatactaaagctcctgaagctgattatgtagatgcatgtgtgatttcaattttacaaatacatgtcacccaaccattaggtgatattttagtattcttaactggtcaggaagagattgaaacatgtcaagaattattacaagatcgtctaagaagactgggttctaaagtaaaggaactaattgttttaccagtttatgcaaatctgcctagtgacatgcaggcaaaaatttttgatcccacaccaccaggggccaggaaagtagtattggcaaccaacattgcagaaacatcattaactattgataatattatttatgttattgatcctggatttgctaagcaaaattattttaactccagaacaggtatggaaagtttaatggtagtaccaatttcgaaagcgtcagctaatcaacgtgcgggaagggcaggccgagtagccgcaggaaaatgttttagactttatacagcatggtcatataaacatgaattagaagataatacggtacctgaaatccagaggataaatctgggaaatgcggttttaatgttaaaagctctaggtatcaatgatcttgtacattttgatttcttggacccgccaccccacgaaacgttggttttagctttggagcaactatatgctttaggagctttaaaccatcacggcgaactaactaaaatgggacgacgaatggccgaatttccagtcgatcctatgatggcgaagacactgttggcatcagaaaaatacaaatgttccgaagaagtggtaactattacagctatgctgtcagttaacagtgctatattttatagaccgaaagataaaataatccacgccgatacagcaagaaagaattttaatcatgtagctggggatcatcttagtttattaaatgtatataatcaatggagggacactgatttttcgacacagtggtgttatgaaaattttattcagtataggtccatgaagagagctagagatgttagagaacaacttgtgggattaatgcaaagagtagaaatcgagatggtgtcaaatatttccgaaaccgttgacattagaaaagctataaccgctggctacttttatcatatagcaagattttccaagggggggaattataaaacagtaaaacataaccagacagtaactatacatccaaatagttcgttatttgacgaactcccaagatggattttataccatcaactagtttttactacaaaagagtttatgaggcaagttattgaaattgagagtaaatggctattggaagtagcaccacattattataaaccgaaagaattagaagattcaaccaacaagaaaatgccaaagactattggaaga

SEQ ID NO: 22 - DNA, 1371 bp, Sitophilus oryzae
atgaaggtggaagaagtaaaaagcacggtaaaaactcaaagaatcagcgctcacagccatatcaaaggcctagggcttgacgaaaatggattcgccatacaacaagcggccggcttggtcggccaagagcaagcaagagaggcagcaggggttgtagtcgatatgataaggagcaagaaaatggcaggaagagcggtacttctagcaggaccacccggtactggcaaaactgccatagccctggctatcgcgcaagaactaggcaacaaagtacctttctgccctatggtcggttcagaagtatacagttccgaaataaagaaaacagaagttctgatggaaaacttccgcagagccataggtctgagaattcgcgaaaccaaagaggtttacgagggtgaagtaagcgaactcacacctgtagaaactgagaaccccgctggaggctacggtaaaactgtgagtcacgtcgtcatcggtctaagaacggccaaaggcagtaaacagctgaaactggaccccagcatttacgaggcactccagaaagagaaggttgaagtgggtgatgttatttatattgaggctacaagtggggctgttaagagacagggaagatcggatgcttatgctactgagtttgatttggaagctgaagagtatgttcctttaccgaaaggtgatgttcataagaagaaagaggtggttcaagatgtaacacttcatgatttggacgcggcaaatgcaaagcctcaaggaggccaggatgtcttgtcgatgatgggacaacttttgaaaccaaagaaaacagaaataactgacaagttgaggaaggaaataaacaaaattgttgataaatacattgatcagggaatcgcagagttagtaccaggagttctttttattgatgaagttcacatgctagatattgagacttttacatatctacacagggcactagaaagtgccattgctccaatagttatttttgctacaaacagaggaagatgtcttatcagaggtacggatgatattttttcacctcacggtatacctctggatcttctcgacagacttttgatcattaggactgtgccgtatgatcggcctgatatggaacaaattttgaaactgagagctaaaactgaaggcctggaaattgacgaagaagcaataacaactttaggggaagttggagtaaaagccacactaagatacgttgtacagcttttgacacctgcacatctgacagctaaaatcaacggcagaactaatattacgcaatctgacgtagaagaggtagcttccctgtttttggatgccaaacaatcggcaaagatattgtcagaaaataaggagaagtttatgaattaa

SEQ ID NO: 23 - DNA, 2193 bp, Sitophilus oryzae
atgacttcaattataaagctccaggtactttcgggggctatggacgagtcccctccggcttatctcttacaggtcgacgatgtaaaaattttgttagattgcggctgggacgaaaaatttaatatggaatttattaaagaagtcaaaagacatattcatcaaatcgatgcagtattaatatcatatcccgatccgtcacatttaggggctctcccgtatcttgtcggtaaactaggactaaattgcccaatatactccacaatccctgtttataagatgggtcagatgtttatgtacgatttgtaccaatcccaatacaatatgaaggatttcttcctgtttaatttagatgatgtagacgccacattcgataaaatcattcagttaaagtataaccaaagtgtaccattgaaaggtaagggttacggtttaacaatcaccccgttgccagctggtcatatgattgggggtacaatttggaagatcatgaaagcaggggaagaagatataatctatgctaactcgtttaatcataaaaaagaacgtcatctcaatggctgtgaattggagaagctccagagaccttctctcctaattattgatgcatttaacgcaacataccagcaggctaggcgaagagctagagatgagaaattgatgacaaatattttacaaactcttagaaacaatgggaatgttttgattgctgttgatactgccggtagagttttggaactagctcatatgttggatcagttgtggagaaataaggaatccggacttcttacatattctttagccctgataagtaacgttgcttataacgttgttgaatttgctaagtcccagatagagtggatgagtgataagttaatgaggagttttgaaggagctagaaataatccttttcagttcaagcatttatatttgtgccacactttatcagaactgaataaagtagctagtcctaaagtagtactggccagtagtgctgacttggaaagcgggttttcgagggaattattcttgcagtggtgttctaattcaaacaatagtgttattatcactacaagaacatgtcctggaactctagcgagagatctaatagacaacaacgaaaaaggcagaaccatcgatatgattgtagaaagaagagtgaaattagaaggtgcagagctggaagagtttgaaaaaagacagcaacaaaggacgcatataagcaacgggaccaaagatgatgtagattcagattccgatagtgatatagagatgtcggttatatccaaaggaaggcacgatattgttataaaacaggaaggtaaagttagtggaggatttttcaaagtgaccaaaaaacagtatcctatgtatccgtttcgtgaggacaagataaagtgtgatgaatatggagaaattgttaaaattgaagattacaggctggccgatgttaatcctgaagctgaagataataaagaaaacttagaggttaagagagaggaagaagaagaagaaataattgaaattctggaagttccatcgaaatgtatcgctctggagaggacggttcaagtgaactgtcaagtacaatacatcgatttcgaaggccggtccgacggggaatccctgatgaaaatcctgtcccagctgcgacctaggagggtgatcgtggtgcacggcactgaagacaacacggaagtcattgcggcgcactgcagggataacattagggcgagagttttcacacctcaaaggggggagacggtggatgcaaccagcgaaacacacatataccaggttaggttaacagattcgctggtatctcagctagacttcaaaaaggctgcgaaagatgccgaggttgcttttataaatgcccagatagctctgagagaaatccaagctgatgccaagagaatgaccaccgataatgaaccaatggaagtagacgatgatgaccagaagatactaactttagaaccacataccgcggaagcacatcatgaacctgtttttatcaacgagctgaaattgtcagatttcaagcaggttcttgctaaagccaatgtttcttcggaattttctggtggtgtattgtggtgttgtaatggcacaatagctgtaagaaagcttgatactgggaagattgtgtttgaaggttgcatatccgaggattattacaaagtaaaagacttg

SEQ ID NO: 24 - DNA, 2283 bp, Sitophilus oryzae
  misc_feature (1998)..(1998): n is a, c, g, or t
atgcctcctttagaagtagcaaatgctgctacggaagagtctgcccccacaaatccagtggtgggcattatttatccgcccccggaagttagaaacatagtcgacaaaactgctagttttgtagctagaaatggtccagaatttgaagctagaatccggcagaacgaattgggaaatccaaagtttaattttttaaataccggagatccctatcatgcctattatcagcataaagttaacgaatttaaggaggggaaaggtcaagaaccaaccatatcacatggcgtgtccaagctcactgtttcggccagtgcccaacagaaacagcacgaaatacttaagcaagtcgaacagccttttgttcctaaagatccaccttctgagtttgaatttatagccgatccaccatctatatcagcattggatttggatatagtaaaattgactgctcagtttgtggcaagaaatggacgagcttttctaacacaactcatgaatcgcgaacagagaaactttcagtttgattttttgagacctcaacattcactctttcagtattttaccaagttactggaacaatacactaaggtcttaatcccaccaaaaacgatgcaacaaaaactgaaagaggaagtcaaaagtaccaaaaccgttctggaacaggtgaagtaccgggcggaatggcaaaagtaccaggaagcccagaaagccaaagaagaagagatattggaaagagaaagaatcgcgtacgctcaaatcgattggcatgattttgtagtagtggaaactgtcgattatcagccgtttgaaattggaaattttccacctccaacaacaccggaagaggtgggggcaagaattctaattcaagaaaggcttgaagatggggacgatattgagatgcaactggaaagcgacgaagaagatggtggtcaggaggatcaaagtttaagctatatggaagatcgtaccaatacgaacagaaaagatgcgagggataataatcaagtgcaagatatggacgaggagagttcagatgatgaagatcaggataaacgttcagatcaaccgtcaattcagcctccactaccgccagttcccgataaagttttggttaagaaatacgatcctaagcaagctcctaaagtcactcggccgactgttggtgacgattatctagtatcaccaatcactggggagaaaattccagctagcaaggtgcaggagcacatgcgtattggtctgctggatcccagatgggtggagcaaagagataaacacgttactgataagatgaaccaagacacggtgtacgcccaaggtaccgccatcgaggccagcttgaaactgttggccgaacgtcgtaccgatattttcggcgtgggcgacgaggaaaccgccataggaaagaagatcggcgaagaggacatccgcaaagacgagaaggtcacctgggacggtcacacctccagcgttgaggcggctactagagcggccagagccaacattactctggaagagcagattcatcaaatccataaggtaaaaggtctcttgccggacgaggagaaggaaaaaatcggaccgaagaacgttaccgggggaagtaagatgaaaggtaccggtcagatgatcaagccaccgcctccccctcagctgcaagctccgaaagcaaccattgtaaccgtacctccgcagcctattctggctccacaaccgccgattatgatgatggctgctccgccgatgcctccgatgcgtccgtctttaatggttccaacacatcctccaatggccggttttgtaacacctctacctccacctccaatgggtcctccagtaaccatgcccatgaagcatcctagcgaggtgcaactggatgatgaacctagcaacaaaaaaatgcgaaacgaggactccctggtacccgaagaggtgttcttggccagaaacccaagtcctgtaatggtgaaagttactatcccgatgatgccgganagaaacccaagtcctgtaatggtgaaagttactatcccgatgatgccggaaaaatccgaatggaaactaagtggtcaagtgttgaattttactctgcccttgggagagtctgtggctaatttgaaggctaagatccaggaggagataagtatgccgccggctaagcagaagttgttctttgatggcatgttcttcaaagattcaaacacgctggcttattacaacatcactccagcggctgtcattcaacttcaggtgaaggaaagaggcggaaggaaaaaataa

SEQ ID NO: 25 - DNA, 963 bp, Sitophilus oryzae
atgccgagccaagaagtaacaactagtaaagtggtagtacaccccttagttttattaagtgtggtggaccattttaatcggatgggaaaaattggcaatcaaaaacgtgttgtgggtgttttattaggctgttggagagctaaaggtgttttggatgtatcgaatagctttgcagttccttttgatgaggacgaaagagataaatctgtatggttcttagatcatgactatctagaaaatatgtatggaatgtttaaaaaagttaatgctagagaaagagtggttgggtggtatcatacaggacctaagctccatcaaaatgatattgctatcaatgaacttgttagaagatattgccctaattctgttcttgtaataattgatgctaagccaaaggaccttgggttacctaccgaagcttatcaggctgtggaagaagtccacgatgatggatcacctacttcaaaaacttttgaacatgtgccaagtgaaattggcgctgaagaagctgaggaagtaggagttgaacatttattgagggatattaaggatactacagtcggtactttgtcacaacgaattaccaatcaacttttgggattaaaagggttatattctcagttaagagatatacgtgactatttaattcaagttagcgaagaaaaacttccaattaatcatcaagtaatttatcagttacaagatatatttaatctcttaccagatataaatcagatgcaattcaataaatctttttatgtaaaaaataacgatcaaatgttagtcgtatacttagcagctttagttcggtctatagttgctttacacaatctaataaataataagttaacaaacagagatgccgaagaaggcaaaaaagaggacaaaaaagataaagaaaaggaaaaggacaacaaaaaggaagagaaaaaaaagaggacaaaaaagataaagaaaaggaaa

SEQ ID NO: 26 - DNA, 1683 bp, Sitophilus oryzae
  misc_feature (672)..(672): n is a, c, g, or t
atgtttggcggtggaagagctcccattttagtgttgagtcaaaatacgaagcgcgagtcaggccgcaaagttcagctggaaaacatcaacgccgggaagcaagtcgctgatgttattcgaacatgcctcggcccccaagcgatgctaaaaatgctcatggaccccatggggggcatagtcatgaccaacgacggaaacgccatactacgtgagatcactgtgcagcatccggcagcaaaaagtatgatagaaatcgcacggactcaagacgaggaagtgggagatggaaccacgtcggttattgtgctggccggagaaatgctagcttcggcagaacagtttctagaacaacaaatccaccctaccgttattattaaacagtacagacaagctttagaagatattattgctttgctggaaggtccgcttagtgtttctattgataaaaatgacaaaaaagcattagctaatgttgtaaaaggctgtattggtactaaatttattagtaagtggtctgatttagctgtgaatattgctctggatgctgtacagacagtaatgttggaggagaacggcaggacggaagttgacatcaaacggtatgcaaaagtagagaaaataccaggcggatctttggaagattcagaaattctcaaaggcgttatgctgaangattcagaaattctcaaaggcgttatgctgaataaggatgtaactcatcccaaaatgaggcgttatattgagaacccaaaaattattttattggattgctctcttgagtacaaaaagggcgaatctcagaccaatgtagaaataactgccgaaggcgattttaccaggatgctagagattgaagaagagcatgtcagaaaacagtgcgatgatattatagccttgaagcctgacgtagtgttcacagagaagggtgtgtcagacttggcccaacatttccttttaaaggctggaataagcgcagttcggagagttcgcaaatctgacaataacaggatcgcccgagcttgtggggccgtcatagtgaacagaacggaagaactacaagcctcggacattggaactggagcgggactctttgaaatcaaaaaattgggtgacgaatacttttgttacatcactaaatgcaaaaatcctaaggcctgtactatcgttctgcgtggggccagcaaagacatcctgaatgagaccgagaggaatctccaggacgcgctccaagtggccaggaatattgttttgaaaccccgtctggttcctgggggtggggctatagagatggctgtagctcagagacttttacagaaagccactcacgggccttacagggccttagcccatgctttggagataatacctcgaacgctgtcccaaaactgcggcgcgaacactatcaggactttgacggctttgagggcgaagcacgccaatcataccgatcaaaacagtccttgtacgtggggtattgatggtgaaagtggggaattagttgagcagaaggacaaaggaatctgggaacccctggctgttaagctacaaacgtacaaaactgccatagaaacagctattttactgttgcgtatcgatgatattgtgtcgggatccaagaaaaaggacaaggaacccaatacacccagtcaaatacaagaacagactgcggcaatgcaagattaa

SEQ ID NO: 27 - DNA, 699 bp, Sitophilus oryzae
atgtctcttgcgattaggccttattatcctgattattccacagtaccaacacagcatcattttaatccttatgccgataatggagggagcatagttgctatcgccggtaacgactttgtaattattggagctgatacacgtcttagcgcaggattctctatttatacaagagagcaaaacaaattattttcattgtctggtacaacagtactaggatgttcaggatgctggtgcgatacactaactttaacgcgtattttaaagtccagaatgcagatgtaccagcaggaacataataaagttatgtcaactgaagcatgtgcacaaatgttatcaacaatgctatattataagcgattttttccatactacatatccaatgtattagttggattagataatgaaggtaaaggatgtgtctacagctatgatccaattggacactgtgaaaaagcaacatacagagctggaggatctgcaggagctcttttacaaccacttttagataaccaaattgggcaaaagaatatgctaaatgtcaaacccgaatcggtaacaaaagaaagggcattgtcaattattaaagatgtgtttatctctgctgctgaaagagatatatacactggagatagcatttcaattaatataatcactaaagatggtattacacaggagacttttgaattaagaaaagattaa

SEQ ID NO: 28 - DNA, 975 bp, Sitophilus oryzae
atgtccagaagacctagaaccagacaaagcacaagaagggtattcatggaaggagcagactctattggaggaaacgcagcgtttcagtttggctttaacatgttcccggacattcccaggccctttaacgttacgtaccactgttattccgtggctatgcttccaggaaacgaacgacaagatgtagaaagaggaggaaaaattattatgcctcccagtgctctcgaacaactaacaagattaaatattaactatccgatgctgtttaagttaacaaataaaacaaccagcagagttacgcattgtggtgtattagagtttgtagcggacgaaggaaaagtttatctgccattatggatgatgcacaatatgacactggaagaaggtgatttagtacaaatggaaagtgtctccttacccgtcgggacattctcgaaattccagcctttatctcccgagtttttagacataaccaaccccaaagcagtcttggaaaattgcctaagatcatttgcttgtttaaccactggagatgtcattgcagttcaatataatcaaaaagtatatgagctgtgtgttttagaaaccaaaccgggcgatgctatcagtattatcgagtgcgatatgaatgtagaattcgcagctcccgttggttataaagagcctgaaattgaaaggaaaattgaagatgaagagatggcagtcgatccttcagatttaatgcctgaaccatcgggttttgttgcttttaaaggcgcaggtaaccgtctggatgggaaaaaacgcaaggattctgtaacaacagatgctgtgcccaaatctacatatgttcgaggtataccggactacgattatcaaattgggacactaaagttcattagaagatcggttaaacaaaaaggcaacgataccgaggataataacgaatttaaagcatttagtggagctggctttagcttaagaggaaggaattaa

SEQ ID NO: 29 - DNA, 1683 bp, Sitophilus oryzae
  misc_feature (639)..(639): n is a, c, g, or t
atgtcagcctttccaggcagtatagctttcgatgaatatggtagaccttttatcatacttcgagatcaagatcaacaaagacgattaaccggaattgatgccttaaagtctcatattctggctgccaggcaaattgcaaacacaattaggacttctttgggccctaaaggtctagataaaatgatgatttcgcctgatggtgatgtcactgttacaaatgacggggcaaccattttaaaactgatggatgttgagcacgaggttgggaaattgttggttgaattatctcaatctcaagacgatgaaattggtgatggaacaactggcgttgttgttcttgctggggcattgttagagcaggctgctactttattggatcgtggcattcaccccattagaatagctgatgggtttgagatggcatgccaaactgctgtttctcatttagagaaaattgcagagttgttccctgtttcagacaaaaacccagaacctttgattaaagttgcaatgactactttgggttcaaaaataatcaacaagtgtcacaggcaaatggctgagattgcagtcaatgcagtattagctgtagccgatttagaacaaaaagatgttaattttgaattaattaaagtggangctgtagccgatttagaacaaaaagatgttaattttgaattaattaaagtggaaggaaaggtgggtggtaaacttgaagatacagtattagttaaaggtgttgtgattgataaaaccatgtcacatcctcaaatgcctaaagaacttaagaatgtgaaattggcaattctcacatgcccatttgaaccaccaaaaccaaaaacaaaacataagttggatgttactgatgttgctggatataaagagctcagacagtatgaacaagataaatttaaggaaattgttggccttgtgaaaaaggccggagctaccttagctatatgtcagtggggatttgatgatgaagctaatcatcttttgctacagcaacagcttcctgctgtgcgttgggttggaggtccagaaattgaattaatagcaattgctactggtggacgcatcgtgcccaggtttgaagaactcagccctgaaaagttaggatccgctggtttagttcgtgaaatatcatttggaaccactagtgacaaaatgcttataatagaagaatgttctaattcaagagcggtcactattttagttaggggaggaaataaaatgttagttgaagaagctaaaagaagtttacatgatgcattgtgtgtagtccgaagcttagtacaggaacctagagttgtttatggtggtggagcagctgaaattgcctgtagtttagctgtagcagctcaagctgatcagctagcctcactggagcaatatgcttatagagcatttgctgaggctttggaagcaattccattggctttagcagaaaatagtgggctctcggcaattcatgcacttggagaagtaaaggctaaacaagcctcctctggagacccagctcttgggatcgattgtatgttcaccggtaatcttaatatgcgggaacaacatgttattgaatctctcagatcaaagaggcaacagttattacttgccactcagcttgtcaagatgattttgaagattgatgatgtccgttcacctggcaatcgtgaagaataa

SEQ ID NO: 30 - DNA, 342 bp, Sitophilus oryzae
atggcttctgcaatggacgtagacgttgacgaagtagaaatgccaacatcgagcagctctaaaggcgaccgaaaacgcttcgaagttaaaaagtggaatgctgtcgctttatgggcttgggatattgtcgttgataattgtgctatttgtcgcaatcatattatggatttgtgcatcgaatgccaagcaaatcaagcttctgcaactagtgaggaatgtacagttgcttggggagtatgcaaccatgctttccattttcattgcatctcaagatggttaaaaacaagacaagtgtgtcctttggacaacagggaatgggaattccaaaaatatggtcactag

SEQ ID NO: 31 - DNA, 1605 bp, Sitophilus oryzae
atggtttcacttaatgcagtgcgaattttaagagaaaatgccgaagaagaaaaggcggaaattgctcggttgagcagttttgtaggagccattgcaattggggatttagttaaaagcactttgggacctaaaggtatggataaaattttggtatccagcggtcgtaatgccggttctgtagaagtaacaaacgatggagcaactatattaaagtctgtcggtatagataatcctgctgcaaaagtacttgtcgatatgtctaaagttcaagacgatgaagttggtgatggaacaacttcagtcactgttttggcttctgaactacttagagaagctgaaaagttgattgaccaaaaattacatcctcagataataatagctggttggagaaaggctgttgacattgcccgtaaagctttaacagatgcatcacaggataatagtgcaaattcagacactttccgtgaggatttgttgaatattgcccgtacaactcttagttcaaaaattttgtctcagcataaggaacattttgcaaaactagcagtcgatgctgtattaagactgaaaggatctggtaatttacaagctatacaaattattaagaagtctggcggaactctggaagaatcctttctggaagagggatttttgttagacaagaaaccaggagtccaccaaccgggtagggttgaaaatgctaaaattctaattgcaaacactcccatggatacagataaaataaaagtttttggatcgacaatcaaagtagactctatggcaaaaattgccgaattggaatcagccgaaaaggaaaaaatgaaggacaaagtagccaaaatactgaaacataattgtactgtgttcattaatcgtcagttgatttacaattatccggaacaactctttgctgatgctggagtgatggccattgagcatgcagactttgatggaattgaaaggttagcattagtaactggaggtgaaatagtctcgacttttgatcagccagaaagtgtcaaacttggaacttgcgatcttattgaacaaattatgattggagaagacacattacttagatttagtggggttgctttaggagaagcttgctcgattgttattcggggtgcaacacaacaaattattgaagaggcagatcgttctctgcatgatgcattgtgtgttttggctgctacagtcaaggaaagccgcattgtgtatggaggaggttgcagtgagacactgatggcggtagctgtgagtaaagctgcactgagtacagcaggaaaagaagcagttgctatggaagcctttgccagagctttgctgcaactacccacaattattgctgataatgctggttatgattcagctcagcttgtaactgaacttagagcagcccatactagtggtcaattcacaatgggcttgaacatggacaaaggcgaaatcggtgacatgcgcacattaggcatcaccgaatccttcgcagtcaaaagacaggtcctggtttcggcttcggaggctgcagagatgattctcagggtcgacaacatcatcagggcggcgccaaggaagcgcgtcgaagacaggggacactgttaa

SEQ ID NO: 32 - DNA, 948 bp, Sitophilus oryzae
  misc_feature (390)..(390): n is a, c, g, or t
atgtttagaaatcaatatgatagtgatgttacagtgtggagtccgcaagggcggctacatcaagttgaatatgctatggaagctgtaaatttgggatctgcaacagttggccttaaaagcaatgcatatgcagtactgattgcacttaaaagggcttcttcggaactttctgcgtaccaaaaaaaggttattaacattgatgaccacattggagtgactatatcaggattaacagcagatgcaagaattttgagtcgttatatgagaactgaatgtttgaactataaatattcgcatgatacttatttacctttaaatagacttataacaacattaggcaacaagatgcaagtatgtactcaaagatatgaccgcagaccatatggtgtnaaatattcgcatgatacttatttacctttaaatagacttataacaacattaggcaacaagatgcaagtatgtactcaaagatatgaccgcagaccatatggtgtagggcttttggtagctggttatgatgataaaggaactcatatatatcaaacatgtccatcagctaattattatgactgtaaagcaatgtctattggctcacgttctcaaagtgcaagaacttatctagaaaaacatttagatcaattttctaatagtagccttgaagaattaattaaacatggacttagggcattgagagatacgctacctccagaagttgatttatcaaccaagaatgtgtcaatcggttatgttggtaaagaacagcagttcaaaattctagatgaagaagaaactgctccttatttgcgccttattgaaggagaagagcgcagaggagctacgtctgaaaagcctcagggacccttaagagatgaccagggggacgagccaagagatccaatgccagatgtagcaatcgaggcagccgaacatgcaatggatacagactaa

SEQ ID NO: 33 - DNA, 2565 bp, Sitophilus oryzae
atgcctatgaaagaagcaaacaaagatgttcctatggatattgtgtttactgaagaagatttgccttatgaggaagaaatactgcgaaatccttattcagtgaaacattggcttcgctatatagaacataagaaaaaggcacctaaacatggtgttaatttaatatacgagcgagctttaaaagaacttcctggttcttataaactttggtacaactatttaagaactagaagacagcaagttaagaacaagtgtataacacatccaggatatgaagaagtaaataatgccttcgagagatctttagttttcatgcacaaaatgccaaggatatggatggattattgtacttttctaactgatcaattcaaaataactagaactaggaaagtgtttgatagagcgttaagagctttgccagttacacagcaccatcgtatctggcctttatatttaggttttgtaaaaaaacatgatatatctgaaacggcagttagagtttttagaaggtacttaaaattatcacctgaaaatgctgaagaatatgtagattatttaaatagtgttgggagattagacgaagcagcaattactttaggaaagatagtgaacgatgaaaattttgtatcccaatatgggaaatcaaagcatcaactttggaatgaattgtgcgagttaatttcaaataatcctgataaagtgcagtctttaaatgttgatgctattattagaggtggtttgagaaggtatactgatcagttaggacacttatggaattctcttgcaaattattatgttagaagtggtctttttgatagagcaagagacatatatgaagaagctatccaaacagtcacaacagttcgagattttactcaagtttttgatgcatatgcgcaatttgaagaacttagtttaagtaagagaatggaggaagtttcaaaaatgaccaaaccaacagaagaagaaaaccttgatttagatttgaaactggctaggtttgaacatttaatggaacgtagattattattattaaattcagtacttttgaggcaaaatccacataatgttcaagagtggcataagcgagttcagttatatgaaggaaagcctcatgaaataataaatacttatactgaagctgtacaaactgtagagcctaaattagctgtgggaaagttgcatacgttatgggtagaatttgccaagttttatgaaaaaaatggacaagttgatgatgctcgaattatttttgaaaaagctactgaggtacctttcattaaagttgatgatctagcttctgtttggtgtgagtgggcagaaatggaaataaggaatgaaaactacgaagacgcgttaaaactgatgcatagggcaacaactatgcccgcacgcaaggttgcatatcatgacgatacggagcgggttcaagatagactgtataagtctttaaaagtttggtctatgtatgctgacttagaagaaagtttcggtacatttaaatcctgtaaagcagtatacgatcgtataattgacttaagaattgccactccgcaaatcattattaattatggtgtatttttggaagagaataactattttgaagaggctttccgtgcctatgaaaagggaatttcattatttaaatggcccaacgtatatgacatttggaatacttatttatcaaaatttttgaaaagatatggtggatccaagctggagagagcaagggatttgtttgaacaatgtttagaaaaatgtccaacacaatttgcaaaaaatttatatctattatatgctaagttagaggaggagcatggaatggccagacatgctatggctgtgtatgaacgagcaacaaaagctgttccagaaaaagaaatgtttgaagtatttaatatttatattaaacaagcggctgatatatatggaatacctaaaactcgagaaatttataaaaaagccattgaagttctgcctgacgataaaacgagagaaatgtgtttaaggtttgctgacatggagacaaaacttggcgaaattgacagggctagagcgatttatgactattgtagtcaaatttgcgatccaagggtaacagtcgaattttggcaaacttggaaagagtttgaagtgagacacggcaatgaagatacaatgagggaaatgttaagaataaagagaagcgttcaagcgatgtataatacacaggttaacatgatgtctgcccaaatgctcagttctgccgggtcattaacgggaactacggccgatcttgcgccaggtgaaaaagatggaatgcgtcttttggaagcaaaagctgcagaaatggctggtgctggtacatcaggaataagttcccgaccaggtaatataatgtttgtgagaggtgaaactcaaggcgacaagaaagataaagtcgttaatccagatgaaattgatatcgacgatgatgacgaggaggaagaagacgaagttgaagtaccccttgagaaacaagctgtaccttctgaagtatttgggagtctaaagaaaaattcgactgaagatgataatgatgattaa

SEQ ID NO: 34 - DNA, 1206 bp, Sitophilus oryzae
atggctaacggaccaatcgctgaacgaaatagagatgcaacaatatacgttggaggtctcgacgataaggtttccgaatctttactgtgggaactttttgttcaggcaggtccactagtaaacgttcatatgccgaaagacagagtgactatgatgcaccaagggtacggattcgtcgagttcatgggcgaagaagacgccgactatgccataaagattatgaacatgataaagttgtatgggaaacctatacgagtaaacaaagcgtcggcccatcagaaaaacttggatgtgggagcgaatatatttataggaaatttagatccggaagtggacgaaaaattgctgtacgacacgttttcagcctttggagttatacttcaaacgcctaagataatgagagacccggaaaccggcaactccaaaggcttcgccttcatcaacttcgccagcttcgaagcctccgacgcctcgattgaagccatgaacggccagtacctctgcaaccgacccatatcggtgtcatacgccttcaaaaaagactccaaaggcgaaagacacggctcggcagccgaaagattactagcagctcaaaacccactctcccaagcagacagacctcaccagctgttcgccgatgcacctccgatgggcatgatgggcatggccatggctcctccacctcctcctgttattttagggggtcttatgcctatgcctcctccgacggccatggctcctccacctcctcctgttattttagggggtcttatgcctatgcctcctccgacgccggcgagtatggcgcctccaccaccgcctccggtgcctccgccatcgtcgtttccctcggggattcccccgccacctttgcctcccagtcaacctccgctgccgcctggagcgccgcctatatctgctgcgggggcaggtggagcgcctaggcctccgctgcctgcaggagggatgccgagggggatgatgcctccgccgccgccgtggcaggctggagggatgcctccactgcctacttcaggacaagcagctgctaacagcaatttcccgaacatattcccacctccgccgcctccaggagctaggcctccgccccccaactggagaccgcccccaccgccaaacttcgcaggggcacgacctccgtttcccccaagaggacctcccccaccaccaccttcgatgcagtag

SEQ ID NO: 35 - DNA, 774 bp, Sitophilus oryzae
atgggtcgtgttattagagctcagcgaaaaggtgctgggtctgttttcaagtcccacacgaaaaggaggaagggagccccaaaactgagatatctcgacttctcagagcgacatggatacattaaaggtgtcgtcaaggatattatgcacgatcctggcagaggagccccgttagctgttgtgcatttccgtgatccttacaagttcaagacgagaaaggaactgtttattgcccctgaaggaatgtacacaggacagtttgtctattgtggaaagaaagctaacttacaaattggaaatgttttgcctgtgggtactatgcctgaaggtactattgtatgtaatttagaagaaaagactggcgatagaggtcggttggccagagcttcaggcaattatgctacagttattgcacacaaccatgatacaaaaaaaactagagttaaattaccatctggtgcaaagaaagttattccatccaacaacagagctatggttggtatcgttgctggaggaggtagaattgacaaacctattcttaaagccggtagagcgtaccacaaatacaaggttaagcgtaactgctggcctaaggtgcgtggtgttgccatgaaccccgtagagcatcctcacggtggtggtaaccatcaacacattggtaaagcttcgacagtcaagagagggacctctgctgggcggaaagttggtcttattgctgctagaaggacgggtcgtattcgtggtggtaaagtggacagcaagaaagaagattag

SEQ ID NO: 36 - DNA, 411 bp, Sitophilus oryzae
atggcacgtactaaacaaaccgctcgtaaatctaccggtggaaaagctccccgaaaacagttggccactaaggctgccaggaagagcgctcccgcaacaggaggtgttaaaaaaccacatcgttacaggcctggaactgtggcgcttcgtgaaatccgtcgttatcagaagagtaccgaattgttaatcagaaaattgcccttccaacgtttggttcgtgaaatcgcccaggatttcaaaaccgatcttcgtttccaaagttccgctgttatggctttgcaagaggccagcgaagcttatttggtcgggctttttgaagataccaacctttgcgccatccacgccaagcgcgtcaccattatgcctaaggacatccaattggctaggcgtatcagaggagaacgtgcttaa

SEQ ID NO: 37 - DNA, 1638 bp, Sitophilus oryzae
  misc_feature (217)..(217): n is a, c, g, or t
atggctattagtttattaaatcctaaggctgaagtagctcgagctgcgcaagcattagcagtaaatatttcaggtgcgaaaggtattcaagatgtcatgaaatccaacttgggacctaaaggaaccatgaaaatgttagtgtcaggtgctggtgatataaaaataactaaagatggtaatattttgctgcatgaaatgcagatacaacatcctaccnatggtaatattttgctgcatgaaatgcagatacaacatcctaccgcttcccttattgcaagagcgtctactgctcaagatgatatgacaggggatggtacaacatcaactgttttattaattggcgagctcttgaagcagggcgacatatatattgctgaaggtctacatcctagaattctaacagatggttttgataaagcaaaaactaaggctttagaggttttagataaaattaaaattgcaattgaacccaataaggagaatttaacagatgtttgccgtacaagtcttaggactaaagttcatcagaaattagcagatgttctaactgacgtttgtgttgaagctgttttggctttgaaatcgcaagataaacctgttgacttacacatgattgaacttatgcaaatgcaacataaaactgaaactgatacaactcttgtaaaaggtttagtattagaccatggttctcgtcatcctgatatgccaaaacgtttggaaaattgttacattttaacctgtaatgtgagcttggaatatgaaaaaagtgaagttaactctggatttttttataaaacagcagaagaaagagacaagatggtagcagctgaaagagaatttatagatcaaagagtgaagaaaattattgagttaaagaaaaaagtatgtgctgggaacaataaatcttttgtagttataaatcaaaaaggtattgacccaatgagtttggatcagttggctaaagaaggaattattgcattaagaagagctaaacgtcgtaatatggaacggttagcattagcctgtggtggtgttgcaatgaattcctttgacgatctttcggagtctgttcttggatatgctggtgtagtttatgaacacgtacttggtgaaaataaatatacctttgtagaggactgcaagaaccctcaatcagtaactattttaatgaaaggcccaaataaacattcgttagatcaaattaaggattccattagggatggccttcgtgctattaacaatgctcttgaggataaagcagttattccaggtgctggtgcgtttgaagtaatggctaataaggaacttatgcaatggaaagatactattaagggtaaatcgcgattgggagtcattgcttatgctgaagcactgctaattattccaaaagtattggcaacaaattctggttttgatgttcaggaaactattgttaaactacaagaagaatctaggattaatcccgaaccaattggacttgatctggtatcaggagagccaattaatccaaaagatgcaggcatttttgataattatatagtaaagaaacaaattattaactcctgctcagttattgccagcaaccttttacttgtggatgaagttatgagggctggcatgagtagtcttaaaggataa

SEQ ID NO: 38 - DNA, 3183 bp, Sitophilus oryzae
atgtctagtgctgatacggcagatagctccgtcgatcccccatcaaaaaagcggaagctagatacaagcggttccattgatatggcgaacaacggagtagcctctggctcgcaagcacagaataatgcagctgaaatcgatgagggcttgtattctagacaactttatgtgttgggtcatgatgccatgcgacgtatggcatcaagcgacgtccttatatctggtttaggtggcttaggtgttgaagttgcaaaaaatgtgattttaggtggtgttaagtcagttaccatacacgatgaaaaacaggtatccataactgactttagttctcagtttttctttgtaccagaagacacaggtaaaaatcgtgctgaagttgtttgtaagaagttgtctgagctgaacaattatgttccaactcgttcgtacactggacccctcaatgaggattatattaagaagtttagtgtagtagtgttaactgattcgaccagagcagaacaattaagaattagcgaagtaactcatgctaataatattgccctaattgtggcagatacgaaagggttgtttgcccaagtattttgtgattttggtgacagtttcactgtagtagatacgaatggggagcctgtggtttcagctatgattgctgatattagtactgataaagaaagtgttgttacttgcattgatgacacaagacacggtatggaagatggagactatgtcacattttctgaagtacagggtatgacagaactaaacggttgtgcaccaaaaaaaattaaggtgctgggaccatacacattcagtattggagatactacaggtttttcaaaatatgagagaggtggtatagctactcaagtaaaaatgcccaaagaattgagtttcaagtctctgaaagaatcgttagaaaacccagaatttgttattacagattttgccaaatttgaccatccatctcaactgcatcttgcttttagtactttgcataattatgtagaaagaaacaagaaattacctaaaccgtggagttctgaggatgcttcacagtttttatctattgctaaaacactagttagtggtgatacagaagtaaacactgaattgttggacctttttgcaaagacttctgctggtgagctaaatccaataaacgctactataggaggtatagtcgcccaagaagtgatgaaagcatgttctggcaagttccatccaatcttacaatggctgtactttgacgccattgaatgtttaccatccgatccaaaagacagattacttattacagaagaggatgcagcaccgacaggcagtagatatgatagtcaaatagcagtgtttggcaaagagttccaaaagaaaatcaattcactgaaataccttattgtgggtgccggagctattggatgtgaacttttgaaaaatttctccatgatgggtgtgggatctgacaatggtcagatttttataaccgacatggacttaatcgagaaatctaacttgaataggcaattcttattccgacctcatgatgtacagaagtcaaaatcagtctgtgcagccaaggctgcaaagaagatgaacgaccaaataaatgtgatcgcccacgaaaatcgagtcggtcccgaaaccgagagcatttatgatgatgacttctttgaaaatttagacggtgttgccaacgctttagataatgttgatgccaggatatacatggacagaaggtgcgtttattaccgaaaacctttgctcgaatctggcacattaggaacaaaaggaaacgtccaagttgtagttccgttcctcactgaatcctacagttcgtcccaggaccctccagaaaaaagcattcccatctgcaccttaaagaatttccccaacgccatcgaacacacgttacaatgggcgagggacgcatttgaagggctgttcagacagagtgcagagaacgcttctcagtatcttacagatcccgattttatcgagaggactgtcaagttgccgggtgtacagccattggaaacgttggaatctgtcaaagcagctttggttgatgataggcccaagtcgttcgaagagtgtattgtttgggctcgaaaacattggcaggaccaatatcacaatcaaatcagtcagctgctctacaattttccaccagatcagctcacaagtaccggtcagttgttctggtccggtccaaaacgttgtccagtaccactcacctttgacataaatgacacgttacacttggattacgtcatagccgctgcaaatctgaaggcgcaggtgtatgggattcccacgaatagggatagagcgtatatcgcaggagtggcttcaaaagttgaggtcccaccgttcgtaccaaaatccggcgttaaaattgccgtaaccgactcacaaatggcagcaaacggcaacagcatcgacatggaccgcattacccagctcagaggtgagctacctcctcccgaagaagtcgcaggtttagtgctgactcctctggacttcgaaaaagacgacgacagcaatttccacatggacttcatcgttgcagcgtcgaatttaagagcggcgaactataaaattcctccagccgatagacacaaatctaagctgatcgcaggtaaaattattcctgctatcgcaacaacaacgtccgtcgtagccggtctagcctgcttggaactgtacaagttggctcgttcattgaagagtctcgaaccgtttaaaaacggtttcgtcaatttggcgttaccgttctttggatttagcgaaccgatcgcagcgccgcagatggaatactgcggaaacaagtggaccttatgggacagattcgaggtccagggcgagatgaccttggcagagtttctacaatatttccaggataaacatggtttggaaatcacgatgctttctcaaggtgtctgcatgctgtactccttcttcatgcagaaagctaaagcacaagaacgtctcggcctgaccatgtctgaagtggtcaagcgagtatcgaagaagagaattgagcctcacgttagagcgctagtgttcgaactgtgctgcaacgatgccgacggcaacgacgtagaagtgccctacgtcaaatataacctgggccccaaggaacgagactcctccgactgcaacagtgtgaataagatatggtga

SEQ ID NO: 39 - DNA, 1272 bp, Sitophilus oryzae
atggccgaacctgaagatcttctcgactatgaagatgaagaaccaaccgaacaaacggcaaccgaaaccacagccgaaacaaaaaaaggtgtaaaaggttcttacgcctcaattcacagttcaggatttagagattttttgttaaaaccagaaattttgagagctattgtagattgtggttttgagcatccatctgaagtacaacatgaatgcattccccaggctgttcttggaatggatattctttgtcaagcaaaatctggtatgggaaaaacagctgtttttgttttggccactttgcaacaacttgaaccgaccgaaaatgttgtgtatgttctcgcgatgtgccatacgcgtgagctagcttttcaaatcagcaaagaatatgaaaggtttagcaaatatatgcccaacatcaaagttggtgtattctttggaggaatgcccattcaaaaagatgaagaagttttgaagaataattgtcctcatattgttgtcggaacgcctggacgtattttggccctagtaagatcgaaaaagctgaatctaaaacatttgaagcattttattcttgacgaatgcgataagatgctcgaagtgctagatatgagacgtgatgttcaagaaatctatagaaatacaccacatggcaagcaagttatgatgttcagcgccacactaagtaaagagattcgtccagtgtgcaagaagtttatgcaagatcctatggaagtttatgttgatgatgaggctaaactcactttacatggtcttcaacagcattacgttaagttaaaagaaaatgaaaaaaataagaagttatttgaattacttgatgtgttagaatttaatcaggttgttatttttgtgaagtccgtacaaagatgcgtcgcattggctcaactgttaactgaacagaattttccagccattggtatccacagagcaatggatcagaaagagagattatcacgatacgaacagtttaaggattttcaaaaaagaattcttgtcgccactaaccttttcggacgaggaatggatattgaaagagtcaatattgtatttaattatgacatgccagaagattcagacacatatttacatagagtagccagagcaggacggtttggtacaaaaggattagcaataacatttgtgtctgaggaaagtgacgctaaaattttaaatgaagttcaagacagattcgatgtaaatattacagaacttcctgacgaaatagacctcagttcttatattgaaggacgataa

SEQ ID NO: 40 - DNA, 1479 bp, Sitophilus oryzae
  misc_feature (448)..(448): n is a, c, g, or t
atggttctcatagaaaacgacgtagaaatgaagaacgccgatagtcctccgggccccgaagcaggtgatagtaaaagagacacggatttgcaaagtttgcaggaaataagggaacatgctaggcaaattgaaaaagcagttagcaacaaggaaaatcgctttatcatgagaatcttaagatgtttaccaaacacaagaagaaaattaaatggtgttgtattgagaagtttaataactcaaatttaccctccgtcagaaagagaagcgttactagcctttgttgaagaagcaacgggtgaaattgatagttcacaaaccagaactagatcagctacaaagagtccagttcctgaagtagacgtttacattaatttactcatattggttcgtttaattgatacaaacaagctggaagaggcttctagatgttctcaagcattaatgaatntgaataaaataacgagtcaaaatcgtcgtaccatagatcatctagcagctaaatgctatttttatcactcaagagtagccgaattaacaaacaagttggactccataagaagtttcctacatgcgagattacgaactgctaccttaagaaatgattttgagggtcaagctgttctaatcaattgtcttctcagaaactacttacattattctctctatgatcaagctgataaattagtttcaaaatgtgttttccctgaaactgctagtaataatgagtgggctagatttttgtattatttaggaagaattaaagctgctaggttagaatacagtgttgctcacaaacatttagtacaagctttgaggaaggccccacaaaacactgcagtaggttttagacaaactgtgcaaaaactattagtggtcgtagaacttcttttgggagatattccagaaagacaagtattcagacaagctcaaatgcgtcattctctgagttcatattttcaacttacccaggcagttcgtatgggcaatttacagagattcggtgaagttttggaaaattttggaccacaatttagacaagatcatacatacactttaattttacgtttacgccataatgtcatcaaaacagctataagaagtattgggttgtcatactctcgaatttcccctcaggatattgccaagaaattaggactggattcagccgaggatgcggaatttattgtagcaaaagcaatcagggatggagtcattgaggctacattggatccacaaggaggatacatgagaagtaaagaaagcacagatatttactgcaccaaagagccacagatggctttccatcaaagaatatctttttgtctagatctacacaatcagagtgttaaagctatgagatatcccccaaaggcttatggaaaggaattagaaagtgcagaagaaagaagagagagagaacagcaagatttggaacttgccaaggaaatggcagaggaagatgacgatggcttcccttaa

SEQ ID NO: 41 - DNA, 1764 bp, Sitophilus oryzae
  misc_feature (513)..(513): n is a, c, g, or t
atggcaaatcctactcagggtttaacagtatcccaaatattgaagagtaaggcggaatttgacgatgaacccaaaaagaaatcaagggaagattggaggaaagctaaagaactagaagaagcacgaaaagctggtactgctccagccgctgttgatgaagaaggaaaggatatcaatcctcatataccccaatatatttcgaatgcgccttggtattatgggacaagtggtcccaccttaaagcatcaaaggcctcaagatgataaacagcaagagtactctgctatagatgaatggtataaaagaggtcttgacacaactaaaattgttaccagatacagaaaaggagcttgtgaaaattgtggcgctatgacccataaaaagaaggattgcatggatcgcccgaggaaagtaggtgctaagtactctaacacagatattttacctgatgaatttgtacaaaagaatttatcattgagtttcgatggtaaaagagacagatggagtggttanacagatattttacctgatgaatttgtacaaaagaatttatcattgagtttcgatggtaaaagagacagatggagtggttacaatccactagagcacacatcagtgatagaggaattccagaaagtagaggaagcaaagaggcaactgaaagctgaaaaattagatgctgaaaattctgataatgatgaagatgaagacaaatatgttgatgaagtagatatgcctggtacaaaagtagatagcaaacaaagaattactgtaaggaatttacgtattcgtgaagatacagcaaaatatttaagaaatttagatccgaattctgcatattatgatccaaaaactagatctatgagggaaaatccaaatccaggaaaagatgatacatacaaaggagaaaactttgtaagatttagtggtgctacaaaatctcatgcaacagctcaactttttgcttgggaagcctacgagaaaggtgtggacgttcatctcttggccgagcctacaaaattggaactgctacaaaaggaatatgacaaaaagaaggaacagttcaaaaccaaagttcagtctaatattttagaaaaatatggaggagaagaacatttggaagctccaccaaaaactttattgcttgcccaaacagaagattatgttgaatattcaagatcaggtaaaattatgaagggccaagaaaaagaggagatacgttccaaatatgaggaagatatttatattaacaatcatacaagtgtttggggttcatattggaaaggtggtcagtggggttataaatgctgtcattcttttatcaagaattcatattgtttgggtgaatctggaaaaagtactaacaatgacacagaattaaaaaatagttctgatgctaatattaaccaaagtgaatgtattaataatacatcagaaactacacaagaaagtgaattgacttgtgataaagaatcagatgattccagtgaagatgatatcagaacaaagtctgaaaaaaagaaaaagaaaaataagcataaaaagaaaaagcacaaagagaaaaaagccgaaaaagacaaattatcagaggctttaaaagctgaagaacagcatcaaaaacaagccgattatttgttgtctttggatgaaagaaagcgaccttacaacagtatgtttgaagcaaagaaaccgacggaagaagaaattgaagcatattacctaaaaaggaaacgagaggaggatccaatgagtcagtttttataa

SEQ ID NO: 42 - DNA, 630 bp, Sitophilus oryzae
atgggtatcagtcgagaccattggcataaaaggagggccaccggaggcaaaaggaagcctctccgtaagaagaggaagttcgaattaggtcgcccagcggctaatacgaaactaggagctagcagaagagttcactatgtaagaactcgagggggcaaccttaaatacagagccttaaggctgacccatggcaactgggcttggggtagtgaaagtatcacccgagaaagccgtattatcgatgtcgtttataatgcaagtaacaatgaattagtacgtacaaaaacattggtcaagaatgccattgtagttgttgatgccacaccattcagacagtggtatgaaggtcattacattctaccgctaggacgtaagaagggtgctaaattgactgcggaagaagatgcagcatttaacaaaaaaaggagtaagaagattcagaaaaaatatgaaaccagacagaaaaccgctaaggtagaaccagctatcgaagaacaatttcacactggtagattattagcttgtatttcatcgagaccaggacagtgtggaagggctagtgggtatattttagaaggaaaagaactcgagttctacttgagaaaaattaagtctaagaaagcaaaataa

SEQ ID NO: 43 - DNA, 1002 bp, Sitophilus oryzae
  misc_feature (808)..(808): n is a, c, g, or t
atggatagactactgagattaggaggtggaatgcctggtttaagtcaggccccaccaccaagcgacgctccggttgtagatacagcagagcaggtttatatttcatctttagctcttctaaaaatgttaaaacatggtagagcaggagtcccaatggaagttatgggtcttatgttgggagagtttgttgatgattacacggtgcgtgtaatagatgtttttgctatgcctcagactggtactggagtgagtgtagaggctgtcgaccctgtatttcaagcaaaaatgttagacatgttaaggcaaacaggccggccagagatggtggtaggatggtatcattctcaccccgggtttggatgctggctttcaggtgttgacattaatacacagcaatcatttgaggctttgtcagagagagccgttgctgtagttgtagatcctatacaatcagttaaaggaaaagttgttattgatgcatttagattaattaatccaaatatgatggttcttggtcaagagcctagacaaacaacctcaaatttgggacatttacagaaaccttcagtgcaagctttaatccatggattaaatagacattactattcaatcagtataaattatagaaaaaatgaacttgaacaaaagatgcttcttaatttacataagaaatcctggatggacggtttaactttggcagattattcagaaaattgcactactaatgagaaaactgttgctgatatgttagaattagcaaagaattataataaagctcttgaagaagaggaaaaaatgacccctgaanatatgttagaattagcaaagaattataataaagctcttgaagaagaggaaaaaatgacccctgaacaactcgccattaagaatgttggaaaacaggacccaaaaaggcatttggaggaaaaagtggacgttcttatgactaataatattgtacagtgtttaggtgcaatgctcgatacagttgtatttaaataa

SEQ ID NO: 44 - DNA, 1257 bp, Sitophilus oryzae
atgaccgtaattaacaagatggagattgatgggggccctaaaggcgaagggttccgttcttattacattacaaaaatcgaagaattgcaactggttgtggcggagaaaagtcagaatctgagacgattacaagcccaaagaaatgaactgaacgcaaaagtgcgtatgcttagagaggaactgatgcttttgcaagaacaaggcagttatgtgggtgaagttgtcaaaccaatggataaaaagaaggttcttgttaaagttcacccggaaggaaaatttgttgtggatatcgataaaaatattgatatcaacgatgtaacaccaaactgcagagtagctctgagaaatgaaagttacaccctacataagattcttccaaacaaggttgacccattggtctccctcatgatggttgaaaaagtaccagactctacttatgagatggttggtggtttagataagcagattaaagaaataaaggaagtaattgaactccctgtcaaacatcctgaactattcgatgctcttggaattgcccaaccaaaaggtgtactgttgtatggtccaccaggaacaggaaagacacttttagctcgtgccgtagcccaccacactgaatgtacatttatcagagtgtcgggttcggaattagtacaaaaatttattggagtcagagtgtcgggttcggaattagtacaaaaatttattggagaaggatctcgaatggttagagaattgttcgttatggccagggaacatgccccttctataatttttatggacgaaatcgattccattggttcttcacgtattgaatcaggttcgggaggtgactctgaggtacaaagaaccatgttggagcttctgaatcaactggacggattcgaagctaccaaaaatattaaagttattatggccactaatcgtatagatattttggatccggccctcctcagacctggtagaatcgataggaaaattgaatttcctccaccaaacgaagaagctcgattggacattttgaaaattcactctagaaaaatgaatttaacgagaggaattaatttaaggaaaattgctgagcttatgcccggtgctagcggtgcagaagtcaagggtgtttgtaccgaagctggtatgtacgctttaagagaaagaagggttcacgttactcaggaggattttgaaatggcagttgccaaagttatgcaaaaggattctgagaaaaatatgtctatcaaaaaattatggaaatag

SEQ ID NO: 45 - DNA, 609 bp, Sitophilus oryzae
  misc_feature (553)..(553): n is a, c, g, or t
atggtaaaattatattgccttagtattctgtacaaagggaccactgcagctacttggctaaaatccgcattcgatttgcagagcgtaagctttttccagcggggatctgtacacgaatttatgcagttttgttgcaagactgtcgtagaaagaacactcccggcctcaaggcaatcagtacagcagggtgactacttttgccatgtgtatgttagatctgacaacctcgctggcgtagtaatatcagatcatgaatatccacagagggtatcacatactttactcacgaaaattcttgacgagttctcagaaaaaataccagcctcgaattggccaaacctacaggaaaaagatgtggcttttccacaacttaacacctacttagccaaataccaaaacccgcgagaagcagatgctttgacgaaaatccagaatgaactagacgaaactaagattattttacatagtaacattcaagccgtattggagagaggtgaaaaactagatgatttggttgccaaatcggaggtgctaagtactcaatcgaaggctnagtactcaatcgaaggctttctatacaacagcgagaaagacaaactcttgctgtaa

SEQ ID NO: 46 - DNA, 795 bp, Sitophilus oryzae
  misc_feature (649)..(649): n is a, c, g, or t
atgttcttaacaagaagtgaatatgatcgtggtgttaacacattttcaccagaaggtcgtctttttcaagttgaatatgctattgaagcgattaaattaggatctacagcaattggaatatctacaagcgaaggagttgttttagcagttgagaaacgcattacttctcctctaatggagccaacaacaattgaaaaaattgttgaagtggataagcatattgggtgtgcattttctggtcttatggcagattcaagaacaatgatcgatagagcgcgtgtagaatgtcagaaccattggtttgtctacaatgaaaacatgagtgtagaatcttgtgctcaagctgtttctaatctagcaattcagtttggtgattcagatgatgatggggcagctatgtccagaccttttggagtggcgatactatttgctggcattgatgaaaagggacctcaactataccatatggacccttcaggtacatttgttcaatttgatgctaaagctatcgggtcaggttctgaaggtgctcagcaaagtcttcaagaagtgtatcatcgtagtatgactttagaagaagctacaactgcagctttgacgattttaaagcaagtcatggaagaaaagttgaattcatcaaatgtagaantgaattcatcaaatgtagaagtgatgaccatgactccaaagaatctgtttcatatgtttactaaagaacaggtggaagaggccttaacaaatgtattccctgctgaacatcccactcccataaaagttaacaagcaaaaagtttaa

SEQ ID NO: 47 - DNA, 1359 bp, Sitophilus oryzae
  misc_feature (1103)..(1103): n is a, c, g, or t
atgacggagtattggttgatatcggcaccaggggacaagacgtgccaacagacatgggaaacgatgaacaatctcacggccaagcaaaattccttgtgtgtaaattataaatttcaaattccggacctcaaggttggtactctggatcagctggtgggtctctccgatgaccttggcaagctggacggattcgttgaacaggtgaccaggaaggtcgcttcgtatttgggggaagtactggaagaccagagggataagcttcaagaaaacttgacggctaataacactgacctgccgagctacctgaccaggttccagtgggacattgccaaatacccgatcaagcagtccttgagaaacatcgctgacattatcagcaaacaagtgggtcagatcgatgccgacttgaaaaccaagtctaccgcttataacaacttgaagggcagcttacagagcttggaaaagaaacaaactggcagtttgctgacccgtaatctggccgatctagtgaagaaggaacattttattttggactctgattatctgcagactttgttggtgattgtgcctaaagcgtcttttgccgattggaatgccacctacgaaaaaatcaccgacatgatcgttcctagatcgtctcagttgatcacgcaagacaacgaatatggcctgtacacagtcacgctgttcaagaaggtgattgacgagttcaagcatcatgctcgcgagcgcaagttcatcgtgagagacttcacttacgacgaggaacagttggcggccggcaaaagcgagatcactaagttgaccactgataaaaagaagcaatttggtcccctggtgcgttggctgaaggtaaacttcagcgagtgtttctgcgcgtggatccacgtgaaagcgctgcgcgttttcgtggagtctgtgctgcgctacggcctacccgtcaatttccaagccattctcatccaccccaacaagaaaacgatgaagcgactcagggacgtcctgaatcaactgtacggccacttggacggcagcgtgggccaccagggctcgcacgtcgacaacgtcgacattcccggcctgggtttcggccaatcagagtnaccagggctcgcacgtcgacaacgtcgacattcccggcctgggtttcggccaatcagagtattatccctacgtttactacaaaatcaacgtcgacatgatcgagtcgaaggtctaggttcgatgaacaggcaaaaaacacaatattccatttttaatattaattcctcccgtagatttttcttatacacttataagttcgaggtaaaattgtcccttttttcgtccctaaacgtccggaatttttgcacgagttga

SEQ ID NO: 48 - DNA, 1674 bp, Sitophilus oryzae
atgtcgattttagcgagtccattatccgtagcaggtcagaggcaatcgggggcttcagtccgtacacaaaatgttatggccgccgcttcaattgctaacatcgtaaaaagctccttgggtccagtcggattagataagatgctagtggatgacataggtgatgttacagtaaccaacgatggtgccacaattctaaggctcctcgaagtggagcatccagccgccagggttcttgttgaattagctcagcttcaagatgaagaagttggtgatggtacaacctcagtagtcattattgcagcagaattacttaaaaatgctgacgaactagtaaaacacaaaatacatcctacctctataatcagtggttatagattagcttgcaaagaagcatgcagatatatacaagatcatcttacaattcctgttgaagagttgggtaaagactgtattgtaaatgttgccaagacatcaatgagttctaaaataattggagctgatgcagatttcttttctgcaatggttgtagatgctgcctatgcagtgaaaattacagatgtcagaggtaatcctatgtatcccattaaagcagtgaatattcttaaagcacatggttgtagtgccagggagagtattttggtacaaggatatgccctaaattgcactgtagctagtcaggctatgcccaagaaaattgtaggtgcaaaaattgcctgtcttgatttttcattgcagaaagctaaaatgaaaatgggtgtccaggttttaataaacgacccagaaaagcttgagggaatcagagcccgagagttagacatcactaaagaaagaatccaaaaaattttatccactggtgttaatgttatactaacttcaggaggaatcgacgatttatgtttgaagtattttgtcgaagccggtgctatgggagtgcgaagagttaagaaggtcgatttaaaaagaatcgcgaaagcaacaggagcgacatttttgacgtctttatctaacatggatggtgatgaatcttttgatgctagtatggtcggagaagcagctgaagtatatcaagaaagagtatctgatgatgaattgattattattaaaacaccaaaacagcgtacagccgcatctattattttacgtgggcccaatgatttctattgtgatgaaatggaaaggtcagttcatgacgctctgtgtgttgtcaagagagttttggaatcgaagaccgttgttgttggtggtggagcagttgaagctgctctttccatttacttggaaaactttgccacgacactgagtagcagggaacaattagctattgcggaatttgctaaaagtctcttggttattcccaaaactctggcagtgaatgctgcaaaggacgctacagatttagtagcgaaattgcgcgcctaccataattccagccaaactaaggtcgaacatgcacatctaaagcatgtaggattggatctcattgagggcacggtaaaagataataagaaagccggtgtcttagaaccaacaatttcgaagattaagtcgctgaagtttgccacagaagcggcgatcacgattttgagaatcgacgacatgattaagttggacgcgcaagaaaaaggcggcaagaattacagacaagcgatggagagcggagaattgtataactaa

SEQ ID NO: 49 - DNA, 837 bp, Sitophilus oryzae
atgatacggcgaccaccgagatctacactctttccctacacgacgctcttccgatctaaaatatcaaaaatgttttcagcaccacccttttgggaaaatggccctgctccaggaagtttctacaactttcccaatttgcaaccacaagtacaacaacctcaagatttcagacaacattctcagtctccagtaacaacatcaacatctttggttggaatcacatacgataaggggattctagtagctggcgatttgctagcatcatacggttctcttgcacgttacagaaactgtcctagaatagtaaaaattaacgagaacatcattttgggtgccagtggagattatgccgattttcaatatgtaaaagactttgttgagcaaaaagtcataagtgaagaatgtctagatgatggtcttgctttaaaaccaaaatctctgtattgttggttgactagaattctatacaatagaagaagcaagatggacccattgtggaacaactttatagtagcaggaattcaagacggacaaccgttcctgggaacagttgataaacatggtactgcttatgctgataaagttatctgcacaggttatggggcacatattgccacacctttgctgagggacagtttggacaagaatccccaattaaatttagccgaagctaaggctttaatcgagaaatgtctggaagtcttatactacagggatgccagaagttatccaaagtatcagttgggaattattgatgtcgaacaaggagtgtctattgaaggacccttggaagtaccacaaaaatgggaaattgcttatcattctaaacgtttctaa

SEQ ID NO: 50 - DNA, 2088 bp, Sitophilus oryzae
atggaacagttgaaagaaccaagttctcaattattcggtgatccagaatttgttgccgaaaagtatgtacgagacacatcgcaaaattatgtaggtggttccgaattgcagaatattaaaaagaaaattcaagctttagcagatgaaaccagtagcagtttgaagagaaacgtgtatcagaattatgtacagtttattgaaactgctaaagaaatttctcacttagaaagtgaaatgtaccaattatcgcatttgctttccgagcaaaaatctttattaaatgccttatctgctacatcaattttagaagatggtactcacgttaatgttgaaactaataataaattaagtgagcaagaagttgaggaggaaaacaagcaaaaactatcaatgatccttgaaaaagtagaaaactgtaaggatttactggaagtgcctggtagaactttactttttgaaggtgacttattggaaattgatcctactgaaagtacggctttgaaatttgtgcatgtttatttatttaatgatgggttaatgataacaattagaaattcaaacagtcgaggcataatgaggtatgcatttgaaagtatgtacgaattgggtagtttagctgttgtaaatgttcgtgatttgggcaatatcaaacatgcttttaaattattaatttttcctgatactagagtttttcagtgttcatcaaatacaagcaagaaagaatggttagataaaatagatcaggccaaaaaaacaaagttagctgctgaacaacaaaaaagggaatcgactttgtcagaaaaattgtcaccctctaggtcaacgtcggttgatttaagtatcaataataaaccagaagaagttactataatacatcctgaatggtttttggatgtagctgatgaacttgatgtctgcattgcccaaagacattttgaagatgcagccaattacttacaaaaagcccaaaattacataacaaaaattacagcacaaaatggtgaactcgatcatgttatcatagatgttaagaaaaaagttgaacaaaagcaagacagtttaatagagaccctgatgaaggaactagaagttaaccctgataaatcactacaaggtggattaagggctacaagaagagctgtgagattgcttaatcagttgggaagatctactcaatcatgtgacttgttcttaaaattatgtagtagtatgttgaaaactcaatgtaaaagagtaaaaagagaaggctcgacgacaatgtatgtcaggcatttggctagtgtcgtttttactaatatgtgtcatatgtcagaggaatttttgagagcttttcctgattcagttgactgtgcctctgcttatgtagtctgggcgagtggagaacttaatctattcactacacattttatcaaacaagtttttatgccacaaactagtctttctacaatcactgaatgcgtgctgttagtaagatctcagtgtgaaaggttatgttcatacggtgttgattttcgttatcagttagatggggcattaagatcttcatttgtaaaagcattgagagatacaagggagaaacttgtagattcaatgaagttgagagcctctgaagacaaatggattccaatgaatttagtatcaaaagccagtttggccaaatatctacaagaatacagcaatatgggacttaaattagacttctatgttactggagacgtgtggcttcaattaacatcatgtaatgtagctttcacaaaaatttatttgacattagttgacgattgcctaaaactgaaaaccactgaattactacacgtgatagaagaaacgctttatattgtttttgagtcccaaatgaggcacaatgttgtttcttacaataatgagcaacaaatagagcaaaaaaggtttattttgaagaacattgaatttttgttagttgctgttcttgaactggtgcagaaaaaattcaagggcgaaacaggatacgaatcagaacatttaaacaaactctggaacgagtattctggtttattaaagcaatcctctcgcaacaccaagacaaaatattcatcagattttttataa

SEQ ID NO: 51 - DNA, 2655 bp, Sitophilus oryzae
atgaaagatgtagaccaactcacaggaaaagatttgaatccattatctcatgctccagctgaaagagaagacaaagatcgtaatccggatagaccaatgcatagcagcacatcagtactgagacttcctgtaaatctagatgaaggtgaagaagattctagaaaaagggttaccaggatatcaagtcctgaaaggtgggaaataaaacagatgatatcttctggatgtatagacaaaagcgaattgcctgactttgatgatgaaactggactccttcccaaagatgaagaggatggtgaagcagacattgaaattgaattagtagaagacgagcctccatttctgcaaggtcatggtagagctttgcatgacctaagtcctgtcagaattgttaagaatcctgatggatcccttgctcaagcagctatgatgcagtcagcactagcaaaagaaagacgcgaacaaaaaatgcttcaaagagaagccgaagttgattcacaaccctctggtaaaaataaaacttggatagatcctttgcctgaagaggaatccaaagatgtgtcagcaaggggaattggtttgcagtcccaagacttaccagaatggaagaaacacattattggtgggaaaaaatcttcctttggtaaaaaaacgaacctttctatcatagaacaaagacagtcgctgcctatatataaactgaaagaggaacttcgtaaggcggttactgataatcaaattctgattgtcattggtgagactggttcaggaaaaacgactcaaataactcagtatttagcagaagaagggtttacagcaagaggcaaaatcggatgtacgcaaccacgtcgtgttgcagctatgtctgtggctaaaagagtagctgaagaattcggttgtagattgggtcaagaggttggatacaccatccgttttgaggattgcaccagccctgaaaccattataaaatacatgactgacggtatgttgctgagagaatgtctgatggatttagacttaaagggatactcagtcatcatgttagatgaggctcatgaaagaactattcatactgatgtactttttggactactgaagcaggctgttacaaagagaccagagctcaagctcattgtaacatcggccacattggacgcagttaaattttctcagtatttttttgaagcaccaatttttactatcccaggaagaacctttcctgtggaagttttatacactaaagaaccagaaaccgattatttagatgccagtttaatcacggttatgcaaattcatttgagagaaccaccaggtgacgtattattgttcttaactggtcaggaggaaattgatacagcatgtgaaattctttatgaaagaatgaagtctttaggttctgatgtgcctgaactgataattttaccggtatattctgctttaccgtcggagatgcaaacaagaattttcgaacctgcacctccaggtagcagaaaagttgttattgctacaaatattgcagaaacatccctcaccatcgatggaatattctatgtcgtcgatccagggttcgtgaaacaaaaagtgtataattctaagactggtatggattctttggtggttactccaatttcacaggcccaagccaaacaaagagcgggtagagcggggcgtacaggtcctggaaaatgttacaggctttataccgaaagggcatatagggatgagatgttacctactcctgtacctgaaattcagcgaactaatcttgcaactacggttcttcagttgaaaacaatgggaataaatgatttgttacattttgattttatggatgccccaccagtagagtccttgataatggcgctagaacagttacattcgctgtcagcattagatgatgagggactattgacaagactaggaagaaggatggctgaatttcctcttgaacctaacttatcaaaaatgctgatcatgtctgtcgccttacaatgctccgacgaaatccttacgatcgttagcatgttgtccgttcagaacgtattctaccgacctaaagataaacaagcgttggccgatcaaaaaaaggccaaattcaatcagcctgaaggcgaccacttaaccctattggccgtctacaacagttggaaaaacaacaagttctctaatgcgtggtgttacgaaaatttcgtacaaattcggacgctgaagagggcccaggacgtgcgaaaacagcttttgggaatcatggacaggcataagcttgatgtcgtgtccgctgatagaaacagtgtaagagtgcagaaagctatttgttcaggtttcttcagaaatgccgcgaagaaagatccacaggaaggatatagaacgttggtggacagtcaagttgtctacatacacccgtctagtgcgttatttaataggcaacctgagtgggttatctatcacgaattagtctgcaccacaaaggaatacatgcgcgaagttactacaatagatcctaaatggttggtcgaatttgcaccggcattctttaaattttccgatccgaccaaactcagtaaattcaaaaagaatcaaaggctcgaaccattgtataacaagtacgaggaacctaatgcttggagaatatcccgagttaggagaagaagaaat

SEQ ID NO: 52 - DNA, 1275 bp, Sitophilus oryzae
atggcaccttataaaagaaatatagatgatgttcttgctcgtattaattttcctctttttaccgtccaaatgcttacaaacagacatgtattagttggtgggggcggaggctcagcaaaaactggtgttgcgaatggatttgaaatttttgaactgtcgcatgacggaaacaaattccatgtcgaggaagtaactagacatgaaacaggtcctaatgttgttatgaattgtgcagtggctttaaaaaataatcatacttatttagttgctggtcaagagagtcattgtcaattatacaatgtaaactctgaattggtagctcaagaaaacggtgatattgaaaaccttggaactgaccaccatactaatggtaaactgaggcacagaaaatcagcgcctaccagtaaaaataatgacattaataagaatttaaggaaaaggttaaaatttattttaagtccgtcagatagtgtacagactgattttaatgagcctgaacctttatgtagagtggtaagggtacacccagaagggaatctaatggctacaggtggaacagatggcactatacagatgtggagatttccaagtcttaagcctctaaccaaattaaaaggtcacacaaaagagatagatgatatagattttagtttattcgacaattatattataacagtggcaaaagatggtcaagcaattttgtgggactgtgttagaggaaaagaaattaaaaaactaacatggaatcaaccgcagggttcgaaatatctatataaaagatgcagatttggtatcatagaaggtgaaaagaagtgtgcactttatatgctttccaatccaaccggtgttgccaaaaagcaaaaatcttttttgcaacagtggcagcccgaagaagagacaattaaaagagttgcaatatttgatgaaagtatttcggccctagcagtaagagatgatggaagatttgtagctgtgggaactatgttcagtggatcagtttcgatccatacatcatttaatttacagattgttttaaaggtacctggagcacatgccatgtttgtaacaggtctagagtttttaccggtcttgaatcaggaaaaccaaactgtttgtagtgtagctgaagctgcagtattatcaatttctgttgataatcaagtttgcatacacacattgccttatagaaaaactataccattgtggctggcgatagtaatattaatgattactttatttttaacttttttgttttgttcatacataggtctgtag

SEQ ID NO: 53 - DNA, 1251 bp, Sitophilus oryzae
atggcgggcgcaatgttgtttgaaagaagccaatctgttcgttctcagcatgaaaatttgatgaaattaaaacgtggtgatgataatgaagacagtgatgaaaaaagtatccaaaataaagaacaggatatcctaaacctcggcgagaagtataagaaagaaggtaaggccaaagagcttgcagacctgatcaaacaaacacgtcctttcttaagtgaaattagtaaagcaaaagcagcaaaattagttagatctctagtagatttctttttggatctcgaggcgggcattggtatagaagtacaactttgtaaagaatgtatagaatgggcgaaagaggaaaaacgaacatttttacgtcagtcattggaggcgagattagtagccctatatttcgatactggaatgttctcggaagctcttcaattaggatcaactttattgaaggaattgaaaaaattagatgacaaaaatttattggtagaggtgcaactgttagaaagtaaaacgtaccatgctttaagtaatttaccaaaagccagagcagctcttacctcagcccgtacaactgcaaacgctatctattgtccacctaaaatacaagcttctttggatcttcagtcaggtgttttacatgccgcagatgaaaaagactttaaaacagcttattcatatttttacgaggcttttgaaggttttgacagtgtcgaatctcctaaagcattaacagccttaaaatatatgttgttgtcaaagatcatgcttaatacccctgaagatgtccaacaaattgtaagcggaaagttggcaattaaatacgccggtcgggatattgatgcaatgaaggctgtagctcaagcatctcataaaagatcgttagcggactttcaacaagcagttaaattatttaaaagagaactagaagatgatgttatagttagggcacatttgggtactttatacgataatatgttagagcaaaacttgtgtagaattattgaaccctacagtagagtacaagttgattatatcgcaaaaactataaagctacctatgccacaagttgaaaagaaattgtctcaaatgatcttggatgcaaagtttcatggtatattagatcaaggagaaggtgttctaattatttttgaagaaactccagtagataaaacttacgaaatggcattagagaccattcaaagtatgagcaaagtagtagatacactttatcaaaaagctaaaaagctgtcatag

SEQ ID NO: 54 - DNA, 1773 bp, Sitophilus oryzae
atgtcttcaagatcgaagaagtcggccacaccggcgtcgcaacctcccccgcgtccttcgagccccctgagccctacccggcattccaggctccaggaaaaggccgatttgcagaacctcaacgatcgattggcgtgctacatcgataaagtcaggtatttagagtctgaaaacaacagactcactcgggaaattcaaacaacacaggagactgttactagagaagtgtccaacataaaatctatgtacgatcatgaactaagcgatgcacgtaaactattagatgaaacacacagggaaaaagcacgattagagatcgatgtgaaacgtttgttagacgagaatgatgagttaaaacaggaactagccaagaagtcgaaggatttaacgttggcagagaattctgctcgaatctacgagactaggtgtaacgagttgcagctgaaatacaaccaggctaatgccgatgctaaaaaagccatcggtgatttgaaagatctggagaaggaacgggacaaacttaaaaaacttctagacgaacatagaaaacagctcgaggaagaatctctggctagagtggaagttgagaatgccaatcaaagtctaagagaagaattatcctttaaagaccaggtctaccaacagcagctaaccgaaacacgtacacgtcggcagatcgaaattagcgagattgacggacagttggctgaaaaatatgaagccaagctgcaacaagctttgcaagatctcagggaccagtatgagagccaaatggctagcaacaggtcagagatcgagctgctctacgaaaataaaatcaagaatctccaagctgccgcaaatagacagtcaaacgccgcttccaatgctctggacgaagccagacaaatccgatccaaaattgacacccttaccaacagggtaacgcagttagagaatgaaaactcaggactagttgccagagcccgagatttggagaagttattagagaacgaacggttacgtcacgccgaagacttggcagcgctggaaggcgaattggccagactgcgtgaagagatgtccaaccagttgcaggagtatcaagatctgatggacattaaggtgtctttggacatagaaattgccgcttacaggaagctgttggaatcggaggaatccagattaagaattacaccatcgggaggagaacgtgaagtgatccactctaccagcactcgtagttcttcatctcgcctcacgcctagcaggttgggtgccaagcgcaagcgcacgctcatggacgaaagccacgaatccagtttttccgactacagcgtcaccggttccagcaaaggcgacattgaaatcttggaagccaatcctgacggaaagtttgtcaaactccataacaagagtaaccaggagataactgttggtggctggcagattattttgagggccggagacaacgaaaccaaatacaaatttattcgttcggcgaaaattgaacccaaaggtacagtcaccgtgtggtctgcggatcaaaacaaggatcatgaaccaccacatgatctagtgatgaaagggcaaaggtgggtcactggagacaacatcacaaccacgctgttgaattttgatggcgaagaagttgcagtttcggaaagagtaaaacgacagctgtcaagctcgcacctaagacaccgagagatggcgggggggtttataggggccgaggatctccatcatcaagtcggcgatccccaaggcgatgaaaaatgtcgactcatgtaa

SEQ ID NO: 55 - DNA, 2475 bp, Sitophilus oryzae
  misc_feature (829)..(829): n is a, c, g, or t
atggccgatcaacaaaatccggaagatctagctacggcgatccttcgcaagaaggacagaccaaacaggctaattgtagaggaagctgtcaatgatgacaattccgttgtggccctatctcaaggaaaaatggacgagctacagcttttcaggggggacaccgttctcctcaaaggcaagaggcgcaaggaaaccgtctgtatagtgctctcggatgattcttgcagcgacgaaaaaatcagaatgaacagaaatgtgaggaataatctcagagtgaggctgtcagatgttgtttcagttcaaccatgtcccgatgtgaaatacggtaaaagaatacatgtccttcctattgatgacaccgttgaaggtctcactgggaatctttttgaagtgtacttaaagccatacttcttggaggcctacaggcccattcacaaagacgacgtgtttattgtacggggtggtatgagagctgtagaattcaaagtggtggaaactgatcctgctccgtattgtattgtagccccagatacagtgattcattgcgatggagatccaattaaacgtgaggaggaggaggaagctctgaacgctgtgggctacgacgacatcggaggctgtcgcaagcaactggcccaaatcaaagaaatggttgaactgcccctacgtcacccatccctcttcaaagccatcggcgtgaaaccgccgcgtggcatcctcttgtacggcccccccggcacaggaaagaccctcattgcccgagccgtagccaacgaaaccggcgctttcttcttcctgatcaacgggcccgaaatcatgagcaagctcntcttcctgatcaacgggcccgaaatcatgagcaagctcgctggcgagtcggaaagtaacctgagaaaggcctttgaggaagccgacaagaattctccggctatcattttcatcgatgaattggacgccattgctccaaagagagaaaaaacccacggcgaggtcgagagacgtatcgtgtctcagctgttaaccctgatggatggtatgaagaaatcctcccatgttattgtcatggcggctacgaacagacctaattccatcgacgcggctttgagacgctttggacggttcgatagggagatagatatcggtatcccggacgctacaggaagactggagatcttgcgaatccacacgaagaacatgaagttggccgatgacgtggatttggaacagatcgctgcggagactcacgggcacgtcggggccgatttggcgtcgctttgttccgaggccgcgcttcagcagatcagggaaaagatggatttgatcgacttggaggacgatcaaatcgatgcggaggtgctgaacagtttggcggtgacgatggagaacttccgctacgccatgacgaagagcagtcccagcgccttgagagaaacggtggtggaagtacccaacgtcacgtgggaagacatcggaggcctgcaaaacgtcaagaaagaattacaagaacttgtgcagtacccagttgaacaccccgataagttcctcaagtttggtatgcaaccgtccagaggagtcctattctatggtcccccgggttgtggtaagactttgctggccaaagccatcgccaacgagtgtcaggccaatttcatctctgttaaaggccccgagttgctcaccatgtggtttggtgagtctgaagcaaacgttagagatattttcgataaggccagatctgccgctccttgcgtgctgttcttcgacgaattggactcgatcgccaaatccagaggcggaaacgtgggagacgccggtggggcggccgaccgcgtcatcaatcagattttgacggagatggacggcatgggcgccaagaagaacgtctttattattggagctacaaaccgaccagatattatcgatcccgccatcttgagacccggccgtctggaccagctgatctacatcccgctgcccgacgagaagtcgagggaggccatcttcaaggccaacctgcgtaaatcccccgtggccaaggacgtggacatgaactacatcgccaaggtgacgcacggcttttccggcgccgacttgaccgagatctgccagagggcgtgcaagctggccatcagacagtcgatcgaggcggagatcagaagggaaagggagagggctagtaatcccgcggccgccgcagctatggacttggacgaggacgaccctgtgccggaaatcacgcgcgctcatttcgaggaggccatgcgtttcgcgcgtcgatcagtctcggacaacgacatccgcaagtacgaaatgttcgcgcaaacgttgcaacagtctcgcggtttcggtaccaacttccggtttccggccggcggcggcgcccccaatcccggccagggcggcacggtaccgcccccggtcgctcccggtgaccaggctaactttgacgatccggaggacgatctttacagttag

SEQ ID NO: 56 - DNA, 825 bp, Sitophilus oryzae
atgggagacaaatttgactgtgcattagaccttatgaggagattgccaccccaacaaatagagaaaaatctaagtgatcttatagatttagttcccagcttgtgtgaggatttgttatcatctgttgatcagcctttaaaaattgctaaagataaccaaaatggaaaagattatttattgtgtgactacaacagagatggtgattcatacagatctccatggtccaatacatattatccaccactggatgatggtcaaatgccttctgaaagattaagaaaactggaactcgatgccaataatgcctttgatttatatagagaaatgtattttgagggtggtgtaagctcagtttatttttgggatttagatcatggatttgccggtgttattctaatcaagaagactggagatggcagtaaaaaaattaagggatgttgggactctttgcatgttgttgaggttcaggaaaagagttctggtcgtacttctcattataaaatgacatctacggctatgttatggctacaaactaataaaccaggatctggaactatgaatctaggaggaagtttaactagacagacagagcaagatgctgcagttaatgaaaataatcctcatattgctaatataggaaaaatggttgaagacatggaaaataaaattcgaaatacactaaatgagatctattttagcaagactaaagacatagtaaacagcttaagatcagttcagcccttaactgagagcagacaacaggatgctttaagacaggatttagctgctgctttgcaaagaaggcataacagaggtgacaattga

SEQ ID NO: 57 - DNA, 2682 bp, Sitophilus oryzae
  misc_feature (2584)..(2584): n is a, c, g, or t
atgcaacaagtggaggctacagttcaaaataacacaagtggtaaaatgaatgaacaggcctcatctggcaacggtgtagctgctccaccagcatctgctgctacaatggcctcccgtgaagttcgtgagcctccaccaaggaatgagccagtggttgaacccgttaacggtgtagttcaaccactagtaatgcctcctccagagagacctggcaggatcaccaatcaattgcagtttctgcaaaagactgtacttaaagcgatctggaagcatcagtttgtatggcctttccaacagcctgtagatgccaagaaactaaacttgccggactaccacaagattatcaagcaaccaatggacttgggtacaataaaaaagcgcttagaaaacaactactattggtcgggcaaggaatgcattcaagatttcaacacaatgtttacaaattgttatgtatataataaaccaggcgaggacgtggtcgtaatggcccaaactttggagaaggttttcttgacgaaagtggctgacatgcctaaggaagaatttgtagtagagacacaagccaaaggtgcaaaaggtaaaaaaggtagaactagtactggacctactggagttactaccccaggtagaggaagaccaccagcaactgtgtcatccacagtatcaaatcctgtagctacaacaacaggttctatgggtattcctttgggtaccagcgccccagtcacagttccgggcagtaccgctaccaccaccatagcacaacccaacaatgcccaagtcacgcctattactcctacggggccctcttacgctgctgctcaggccatggacactccagtatccgcgctgggcgtggtacctcctgcccagccggccaagagcaaaaagggcgttaagagaaaggctgatactaccacgccggccacagcttatgattaccttccatctggcgctgattcgaattcctcgtcgtccgcgagcaagatctccaaacgtcgagaatccggtcgccagataaagaagcctctacgtaatcaggagctggacggtttggggccttatggaggttcagcggcggctggtgctgtaccatcaccagcagctcaggccggggcgcacgcgcttaaaaacaaggaaaaactcaatgacacattaaaagcctgcaatgagatactgaaagaactcttttcaaagaaacattgtagttatgcttggcctttctacaaaccggtagatgcggaactgttaggtttacatgactaccacgacattataaagaaacccatggatctcggaacagtgaaggaaaagatggacaatcgcgaataccgttcggcgcaggaattcgcgcaggacgtgcggttaatctttaccaactgttacaagtacaacccctcggatcatgacgtggtcgccatggccaggaaacttcaggacgtgttcgaagtcaagataggtttggtgccgcacgagtccagttcgtccggatccagttcggagagttccagcgatacggaggactccgaggaggagaggcggaacaagcaactgaaacagctcgaaaaagaattgacggcgatgcaggaaagaatgagaaaactggtagaagagagtacgaggcgtaaaaaagagaagaaaaagcaaaaactcaaagacaaacccaagaaaatgacagcagcggcgcaagcggtgtctgccatccccaacagtacgggccctcgaggacccaaaccagcagcggcggcgccatcgggggcggcagcgggaccagcggcgaaaagggccaagacaggtagaggggctggagcaggaaccggtcccggaagaaagaaggcgcaagcagcaatgccagcgccggctttcgactccgaagatgaagacaacgctaagccgatgtcgtacgacgagaaacggcaattgtcgcttgacatcaacaaactacctggtgacaaattaggtcgggtggtgcacatcatccaatcgagggaaccctcgttgagggactcgaaccccgacgagatagaaatcgacttcgagacactgaaaccgtccaccttgcgagagctggagaactacgtcgcctcgtgtctgagaaaaaagccacacaaaaagctttctggcaaaacaaaagaagaacaaatagcagagaagaaaaaagaacttgaagacagacttttggacgtcaatcacaaaataggacctagtaaaaaagcccctaagaaagatgccaaggctgatccgacaggcgcaggtgctggcagaatgtcttcctccagttccagttcggacagcgacagctcgtcatcgtcactatctagtagttccagcgattcaagcgacagcgaagcaggtcctggtgcgacaacaagacagactaagaagaaacctggattgaaaaaatcgcctaatctttcggttcaccctagcagtattgcatcgacgactttgtctatcaccacaactctacaaaaatcgtcgtccacgaccgcgacgcctaccgtcgcgcccataaccatctcggccacgccctcagtcaattccgcccctcccgcacctcaacaaccaccaccggtaacgnaccatctcggccacgccctcagtcaattccgcccctcccgcacctcaacaaccaccaccggtaacgttacctgtcaacggtccggtgctggctgctaa

SEQ ID NO: 58 - DNA, 1290 bp, Sitophilus oryzae
  misc_feature (1138)..(1138): n is a, c, g, or t
atggcgttgtctacggcacgtccccttataagtgtttacgatgagaaatctgaagaagttaagggagctagcattgctctccctgctgtctttaaggctccaattagaccagatgttgtaaactttgtccatcagcaaatttcaatgaaccatcgccagccttattgtgtcagtgataaagctggtcaccaaacttctgccgaatcgtggggtactggtagggccgttgcacgtattcctcgtgttcgcggtggtggtacccatcgttccggccagggtgctttcggcaacatgtgtcgcggaggacgcatgttcgctcccaccaaaccatggaggcgttggcacagacgtgtaaatatcaaccaacgtcgttttgccctagcagcagccattgctgccagtggcgtcccagctttggtaatgagcaaaggacacgtcgttgaccaagttccagaactcccattggttgtctctgacaaggtacaggaattcaagaaaaccaaggaagcagtgcatttcttgagaaggttgaaagcatggcctgatatacaaaaggtatacaaaagtcagagattccgtgctggtaagggtaaaatgcgtaacaggaggagaattcaacgtagagggccattggttgtttaccatcaagatcaaggtttgcgtagggctttccgtaacatccccggcatcgacctaatcagcgtagaaaaactgaacctgttgaagttggctccaggcggtcacgttggccgtttcgtcatttggaccgaatcggccttcaaaaaattggataaagtcttcgaaaactggaaggcaccatcgacgaagatgtccaataccgatttgtcaagattattcaagtcggaagaaatcagagcagtacttcgtgcaccacaaaagaagattgttcgacgtgtacgtcgtctcaatccattgaataataccagagctctattggctctgaacccatacgctgccgttcttaagagacaagctgtcttggacgacaagaagagaagtttggccagggaagaattattggccaagaaacgcggtatcactttacccagcagtagcccggtaatcaggtcggcaaaattgcaagcccgcaggagggcagccattttgaaagcgaaanaaattgcaagcccgcaggagggcagccattttgaaagcgaaaaaagcgaaaccgacgaaacctgcaaagcccgcggcgaaaaaagcacccgctcccgccaagaagtaactgaggttgctatagttgttaactgtggtgacaagataaaataa

SEQ ID NO: 59 - DNA, 5340 bp, Sitophilus oryzae
atggctgattttattgaatccgaagcggaggaaagcagcgaggaggaagagttagagccccatgaaagaaagaaactaaaaaaagttaaggcaatggatgatagctctgaagaggaagacgatgatgatgataaactacgtgaagaacttcatgacttaattgatgataatcctattgaggaaagtgatggtgaagattcagatgcatctggtggagaaaaaaggaaaaaatcagacgatgaagacttagatgaccgacttgaagatgatgactatgatctacttgaagaaaatttaggcatgaaagtagaaagaaggaaatttaagagattaagaagaattcaagatgaagaaagtgaaggtgaagatgaaaatgatgctgaccaagaaagggaacatattgctatggacttattttctgaagatgacgatgaaaggcgctccgaacgtagtcatcgaccagcggccgaacaagaacaatttggtgaagaggaagaagaaggtgaatactcagatactgatgattttatagtagacgacgatggaaaacctatagtaagaacgaagaagaagaaaatattttcagatgcggctttacaagaggcgcaagaaacttttggtgttgattttgattatgatgagttttctaaatatgatgacgaatatgatgaagaagaggatgatgaagaagatgaatatgaagaagatgaagaaggagaaagaaggcatagacagaaaaaagctggtaaaaaacgtccaactaaaaaatcgatatttgaagtttatgaaccatcagaacttaaaaggggatttttcacggatttggacaatgaaatacgtaatacagatattcctgagagaatgcaactaagagatgttcctttaatggctgttcctgatgattcaactgaacttgatgaagaggctgaatggatttataagcaagcattttgtaagtcaactatttcaaacacagatgcgcatttgagtcaggaagctagagaaaaacaacggaaaggaccccaaactattggcaaaattaggaaagctttggactttatgcgtaatcagcaacttgaagtaccatttatagcattttatagaaaggagtatgttcaacctgaacttaatatcaatgatttgtggcgagtgtacaaatacgatgcaaaatggtgtcaattaaaaactaggaaagaaaaccttttggctctctttgaaaaaatgaggtcctatcaaatagaacaattaatgaaaaatccagacgctgctattccagataatgttagagttatgaaagattcagatattgaaagattgaagaatgttcaaacaactgaggaacttaatgatgttcataatcattttatcttatattatgctcaagatcttgctgctatgcatgcagcttggagaataaaagaaaaagaaaggaaaaaacaggaaaaacgtgaagcacgactgaaagctttagccgaagcggaagacggagctgaaatccctgacgaaattcctgaagacgaagatgatgatgaacccgaacctgaaactataaaatatgctaatcgttcaggctcttatgcattatgtagcaaagctggcttagatacactagcaaagaaatttggtttaactcctcagcatttcgctgaaaatttacgtgataactatcaacgacacgatgttgatcaggaacctacagaaccagcagaggttgcaaaagaatttttgtcagccaaatttcaaactgtggaggaagtacttcaggcaacaacatatatggtcgctttacaaattgctagagaaccattggttcgaaagtgcgtaagggaggcgttttatgaacgagctaaattaagtgtggcgcctacaagaaaaggacaaaaagttattgatgaagctcattcttgttatagcatgaaatatttgaagaataagccagtaagagatctaactagtgatcaattcctgaaactcacattagcagaagaagagcaacttataaaaattaaaattagtgacacaattgaaggacatacaacaaattcatatgtcgatgaagtaaaacaactctatattagggacgaattcagtaagaatgttcaagaatggaacaaacttcgagcggagtgtgttgagcgtgctttgaccagatgcatatttccagacttgcaatcagaaattaaaagaattctactagcagaggcaaaggaatttgttctaagagcttgttgccgaaagttatataactggatcaagattgccccatatcaagttgaatttcctgaggaggatgaagatgaatgggatacagctaaaggtattagagttatgggcctggcttatgtcccagactattctcagtcagcttttacttgtatcgccgctccagatggtgatataacggactatcttcgtttaccgcacattttaaaaaggaagaacagttatcgccaagaagaaaaattgatgaaagaggccgatttgacggctctacgaaactttatctacacgaagaagcctcacgtcattgcaataggtggagaatccagggaagccctgatgatagcggacgacttgagaggaattataaatgatttagtcgaagcagaacagtttccaaccctgaaagtagagattgtggataatgagctggctaaagtctacgcgaattcaaacaaaggcacggctgattttagagattatcctgaacttttgagacaagctatttccattgctagaaaaatgcaagaccctttaattgaatactcccaattatgcaatggagatgaagaaattcttagcttacgttttcatcctttacaggaacaaattggcaaagaagaacttctggaagcgctttgtcttgagtttgtcaacagaacaaatgaagttggcgtagatgtaaatttggctgtacagcaagctcacaaaagccacttaatccaatttctatgtggtttggggccgagaaaaggacaagccctcttgaaagtgcttaagcaaacaaaccaaagattagagaacaggacccaacttgttacagcttgccatatgggtcctaaagttttcattaactgctcagggttcattaagattgataccaacagtttgggagatagtacagaagcgtacgtagaaattctagatggatctcgtgtgcatccagaaacgtacgaatgggcccgtaagatggccgttgacgctttggaatatgacgatgacgaaggagccaacccagctggtgctttagaagagatcctggagacgcctgaaagattgaaagatcttgacctcgacgcatttgctgaagaactggaacgtcaaggatttggaaacaagagcattactctatacgacataagagcggaattaaactctagatataaagatttaagaacaccttacagatccgcgaatccagaagagttatttgatatgttaactaaagaaacaccagaaacattttacatcgggaaattagtacaagcttcggtaataggaatcgctaggagaaaaccacaaggcgagcaactggattcagccaatccagtccgtaacgatgaaactggactgtggcaatgtccattctgtttaaagaatgattttccagaattatcggatgtatggaaccactttgatgctggttcttgcccagggcaagctactggggttaaattgagattagacaatggtatttctggctatatttatattaaaaatttaagcgacaaaaccgtttccaatccagaagaacgcgttggaattggacaacttatacactgtagaataatgaaaatagacgtagaacgattctccgtggattgtacatcaaaatcaagtgatttgttagataaaaatcacgaatggagacctcctagggatccatattatgaccaagaacaggaagacaaagataacagaactgaggcagagaagaagaaagacaaacaaaaacaaacttatattaagagagtaattgttcatccagcttttcacaatatatcctatgccgaagcggaaaaatgtatggtcaatatggatcaaggcgaagtgatagtaagaccgtcaagtaaaggtgttgatcatttgacaatcacttggaaagtggccgataacatttaccaacacattgatgtaaaagaagagggtaaagctaacgcattttcattaggtaaatctttgtggatagcaaatgaggagtttgaagacctggatgaaattatcgctagatatgttaacccaatggcatcctatgctcgagatttgctttattttaggtattataaagatacagaaggaggtttaaaagataaggcggaagagtttctgaaagaagagaaaaagaaaaatcctgccaagatacattatgtcataagcgcagcaaaaagttttccagggaaattcatgttatcttatttacctagaaacaaagtgagacacgaatatgttagcgttactccggaaggatttagatttagacaacaaatgtttgactctgttacgtcattatttaaatggtttaaagaacattttagagatccaatacctggcggtacacccagtactcctcgattgggatctggtagaactccatatcaaggaactgctacaacgccgtttaatggaatgaatcctgaggctatacagagggttgcacaaaacctaccaacccacatgttacaaagtttgtcggcagttgccaatcaaactcctcattacccacatacgcctggaggtgcttatggagcgaactatattaacacgccatacacacctagtggacagacaccttttatgactccatatacccaacaaacgccaaggtatggtcaagcaacaccatctcctgtacctgcaggaatggcgtctggaccatttttgcacccgggagctgtcactccttctcacagaactcccaatagttatcggaatctaccaagtcagtctcccatgataactgcaagtcctgtaccaagtccggcgtcacaaagttcatattctagccagagtcgaagaagcgcaccaaggagcggcccaataccgggatacggaactggagcgtatgccaattcagaacaaatggactggcaaaaagcagcagaagcttgggctgctagaagtagaactactccaaggagtgatagtggtaggatcactcctagaggttctactggtctaaggaccccaaaattcgacgatattcgagccgacttagaacgaaccaaaatgaagaacgtagggaaaagccctaagtccctacgttctacacccaggacaaatatgtccccccatagcatgtctctgggagatgctactcctctttacgatgagaacatttga

SEQ ID NO: 60 - DNA, 2487 bp, Sitophilus oryzae
  misc_feature (2198)..(2198): n is a, c, g, or t
gttaccaaagaaagaagtaagaaacgtgaaaatcggtctgaaaagggtaaaaaacgtagtagcaggtctcgttcatcatctcgagagagacgtagaaaggacaggaagagacgaaaagcagataattcggacgaagctgtaattttgcccagatattatggagatgaccgaagaaaggaaaacaacgataggtactggacaaagtatccaaaaaaagacgaaaacgtggttggaaaaaggtattatgacaccaaaagcattgacgaggataaagtcaaagaaaaagagccccaaaaagatgcttctgaggacaaatccattatcaaacctcgggaaaagaaaaccgttgacctccttacatctaagaccggtggagcttacataccccccgcgaaactacgcatgatgcaagctgaaataacggataaatcttcagcagcctttcagagaatagcctgggaagcattaaagaaatccatacacggttacatcaacaaagtgaatacctccaatatcggtattatagccagagaattactacacgaaaacattattcgtggtagagggctgctttgtaaatctataattcaagcccaagctgcctcacctacttttaccaacgtctatgctgctttagtcgccgttatcaactcaaagtttccaaatatcggagaattgttattgaagagattggtcctacagtttaaacgagggtttaaacagaacaataagactatatgtatttcagcagctacctttgtagcacatttagttaaccagtctgttgcgcatgaaattctggctctggaaattctaactttgttaatagaaacaccgacagatgattctgtcgaggtggctatagctttcttgaaggagtgtggacaaaaactaacagaagtgtctagcagaggtatcaatgcaatttttgaaatgttaagaaacattcttcatgagggacagcttgaaaaaagaatacaatatatgattgaagtaatgtttcaaatcagaaaagatggatttaaagaccatgctgccgtaattgaagaactagatgtggtggaagaagatgatcagtttacgcatctgataaagcttgatgacgtcaaacaagccgattcagacgaaattttaaatgtctttaagtttgacgatgactaccaattaaatgagggaaaatataagattctgagtaaagaaatcttacaaactgatagtgaatctggttccggatcagaagagggaggatcggatgatgaagaggatgatagtgatgacgaagaagaggaaggcgaagaagccaaagtcaaagacactattattgataatacggaaacgaatttgattgtgctgaggagaacgatatacttgactatacagtctagtttggactttgaggagtgtgctcacaagttgctcaagatggagttgaagcctggccaagagattgaactgtgtcatatgttcttggattgctgtgctgaacaaagaacctacgaaaaattctacggacttctcgctcagcgattctgtcaaatcaacaaaacttacgtggaaccgtttcaacaaatattcaaagatacttatgcaaccacccacagattggacgcgaataggttgagaaacgtgagcaaattctttgctcatttattattcaccgatgccatcggttgggaggtcttagaaataatgaagatgaacgaggaagacactaatagttccagtaggatttttatcaaaattctctttcaagaattggcagagtatatgggactgggaaaactgaacgccagactaaaggacccgactctccaaggccattttgctggactctttcccagagataacccgaaaaatactcggttttctatcaattttttcacgtccattggtctgggtggtctcactgatgaacttagggaacacttgaagaacatcccgaaaaatctgcctgttgtaacaaaagaagagagtgaagaaagcagcagtagcagttcgtccagttcagaatcttctgatcaagatagtagctcagaaagttcaagcgattcggaagaagatagaagaagaagaaagaaaaaagataaaaaacaaagcaataaaaaagaatctaaaaaaagtacgaaaaacgacagtaagtctaaagatgaaaaaaggaaagataataaaaacagaaaagaaagaaacaaagaagagtntaataaaaacagaaaagaaagaaacaaagaagagtcggaagacagtgatagtaacaagaaacatgaaagaaatgccagaaaaaaagattaccaatggatgaagagtcgctatgaagacaatatctcacaattgaagaacaagagaagagattttgagaggcccagatctagagataggaatagagtaaaggtggaaaaggagagaagatcgaggtcgcgtgagaggtaccacagagcggataataacgatcacagagagagaacgaaaagagacaggagaagaagttag

SEQ ID NO: 61 - DNA, 1791 bp, Sitophilus oryzae
atggctttgaagaaccaggttggacaaaaaattatgaatgaagtaatcaagtacagacctccgaaaaaaaatggaccgggtgctaaaatggaatggagagtattggtagttgacaaactggccatgagaatgatttcagcttgctgtaaaatgcacgatatatctgcagaagggattactttggttgaagacatattcaaaaccagagaacccctttcttctatggaggctgtctatctcataactccttcaaaagagtctgtagaagccctgatgcgagatttcgacgggatcaagcatataatgtataaaggtgcccacgttttctttacagaagcatgcccaccacctttgttcgatgatttgtgtcaacataaagtagctaaatatataaaaactctgaaagaaatcgatatggcttttataccaaatgaagcacaggtcttttctttggactgcaccgaaacatttcaatgctactacaacccggcgtattctcaaaagtatacagcgaatttggaaaggatggctgaacaaatagctaccctttgtgctactttaggagaatatccttcagtacgctacagaagtgattgggacaaaaacgtggagttggcacaactaatccagcaaaaactggatgcttacaaagctgatgaacccactatgggagaaggaccagaaaaagccagatctcaactacttattctggataggggttttgactgtgtctctcccctgttacatgaactcacatttcaagctatggcatatgatttgttgaacatccaaaacgacgtctatgagtatgaagcatctgcaggtgttaaaaaagaggtactgctagacgaaaacgacgacatgtgggtggaacttcgccatcagcacatcgctgtcgtttcacagagcgtcacgaaaaatctcaaaaaattcaccgattccaagaggatgaccgccagcgataagcagtccatgaaagacctttctacgatgattaaaaaaatgccacagtaccaaaaggaactgtccaaatacgcgactcatcttcagcttgccgaagactgcatgaagcaatatcagggatatgttgacaagctctgtaaagttgaacaggatttagctatgggaactgatgcagaaggtgagaaaatcaaagaccacatgaggaatattgttccgattttgttggaccccaaaatcaccgatcagtatgataaaatgaggattattgctttgtatgccatgacgaagaacgggattactgaggaaaatcttcaaaaacttgccactcacgcccagatcagtcagaaacagaccattgccaatttgcagtaccttggcgtcaatgtgatcaatgagggtggtataaggaaaaaaccctatactgtacctagaaaggaaaggatcaccgagcaaacttaccaaatgtcccgttggactcccgtggtaaaggacatcatggaagactgcatagaggacaaactggatcagaaacactttccatttttggccggacgagcccaaagcaccggctaccatcctccatcgagcgcccgctacggtcattggcacaaagaccgcagccagcaaacggtgaagaacgtgcctcgcctcatcgtgttcgtcgtcggaggcatctgcttctccgaggtgcgctgcgcctacgaggtgaccaacgccctcaagaactgggaggtcataatcggctcctcccacatcctcactcccaagaccttcctggagcagctcacggagctcactcccaactttttgtttcacccgaatttctga

SEQ ID NO: 62 - DNA, 1905 bp, Sitophilus oryzae
atgttttttcaagaaatctataacttattagaacaaaacaagcaatcaatggacaattttcaagaactagacagtaaaattaatattgttgccaccaaagtgctccatttaggtgatcaattggatagtgtaaatggccctagagctcgggtggtagatgcacaaaaattactctctcatctcagtgaattcctttcaaacggacctttaactagctctatatttaatgacccatacaggattgatgaagcagctgatgtaattcaaaagttatttttgatatctcaagatctaccatctccaaaatttgagagtgtcaaacgtaaaatagaaagaacatattccgatattgagaaagcattaattgaagaatttgtcagggctatgactaaagaagatttaactagaatgaggactatagcaaatgtattgtcgcaatttaaagggtacagtcagtgtgtcgatgcgtatattgatcaaagccaaacaggttgtctgcttggtaaagatgtatttgccaacttagtactcctttgtaaacataattatgacattataagggaggtttttaataattctgagcaagttatggctaagtttgtcttaaatttgtatcagctcaagctgtctgactatattgactcaaagttaagcgcgaaaatgggaagtcacggatacttacagatgctctatgagttatactcaaagacaaatcaattttctaacgagctcagtgtctataacttggggaatgacaagaactatttaacaaaattaacatctaacatatttacaaagcatattagtgaatatatccaaattgaacttaaatcattaaaagacagatgtgctacaaaccttcagaggtattacgatacaaaaaatcaccagaaaaagcagattcaaagtggaggatttcaagacttaagaagagacttacaagcggttataggtacaagagcaaatataaacatagcccaaatagagaattatggtggggaaacgtttctatctgaagaactagcgattatgatacttcaagacaccaaaaatgctttttctaggtgccaattattatcaaaacctgaagaaagagctggcaatgcttcaaaaattcttaacaccttggtaaatagccttctgatagagcatgtcgactatgctgttgaattagggctccacgctattcctgtggttgagggggctaaaaattcccctgttctttatttctttactgtagttcatcaaagtaacaacattacacatcttgcagaaagacaatttatggatttggtagtcccattagttcataataccccttaccacaatgattgcatccaaaaaaagaagtttgttcttgaagatatcgagcgcaagataaatttgggacttgacaggtgtttgaacgctgttactacgtgggttaaattatatttgcaatcggaacagaaaaaaagcgatttcaaacctgaaactgatgatttcgacacagtagcttcgccagcttgtaaacacgtgtctcaatacataaccagcatcaagaaagaaattcaaacaagtctcgatggaaataatgtaacggcagttttagaagaatttggtattcgtttacacagaactatctacgatcatatgttgcagtttcaatataacacagcaggtgccatgattgcgatatgcgatttgaatgaatacagatcctgtactaaatcactgggtccccttgtaactgaattatttgaaactttacacgcattatgtaatctacttttggtaaaaacagaaaatttgaaccaagtttgctcagaagactccttggtgaacttggacaagtctattctacataactttattcaactcaggagcgactataaggctcaaaaaccacccttttttaaagtttaa

SEQ ID NO: 63 - DNA, 873 bp, Sitophilus oryzae
  misc_feature (762)..(762): n is a, c, g, or t
atggattttcaaaatagacctggtggaaagactggcggaggaggtgtcgcatcatggtcggaatccaatcgagacagacgcgaaagattgaggcaattggctttagaaacaatagatttacaaaaagatccttattttatgaaaaaccatttaggctcttatgaatgtaaactatgtttaactttacataataatgaaggaagttatttagcccacactcagggtaaaaagcatcaggccaatttggcaaggagggcagcgaaggaagctaaggatgctccctcattacttcagccagagaagcctagagtagaacctaagaaatttgtaaaaattggtcgtccaggttacagggtgactaaacaaagagatccagaaacaggacaacaaagtttactatttcaaattgattatccagagattagtgaccatgttttaccaaggcataggtttatgtctgcgtacgagcagaaaattgaaccaccagatcgtaaatggcagtatctgctttttgctgcagaaccctatgaaactattgcatttaaggtgcctagcagagaagtggagaaaactgataataaattctggactcattggaacagggatacaaaacagttctttttgcagtttgctttcaaaactgaaaataagaagcagccaactattattaatagacaaacaatgatcactggagtaccaccgcctccaatgctaccagtaccaccaccaccaagacctcctatgttcaatcccatgccaccngctaccagtaccaccaccaccaagacctcctatgttcaatcccatgccaccaccacctcctatgatgagagcagtgatgcctgttcctccaccgcattaaactttaaataa

SEQ ID NO: 64 - DNA, 408 bp, Sitophilus oryzae
atgtctattggagttccaatcaaagtgctccatgaagccgaaggacatattgttacttgcgaaactattaccggtgaagtttatagagggaaactaatcgaagcggaagataacatgaattgccaaatgactcaaataactgtaacttacagagatggtagagttgcacaactagaaaacgtttatattagaggatcgaaaattagatttatgatacttccggatatgttaaagaatgcacctatgtttaaaaaacaaacaaaatcaggtactgcgggacgaggaaagtcgggcattcttcgagcccaagccagaggaaggggtagaggtggacctcctactagaggaggtagaggaggagcaccttggccaaatcagcaagttggtccaggaggaagaggacgataa

SEQ ID NO: 65 - DNA, 1320 bp, Sitophilus oryzae
atggcttcttcgatcaccaaaggacctttactccgtatagtaacggccagaggatattctcaagtggctccagttaatggtatcgccaattacgatttgaaaaccactactctcactaacaaactggtagttgtagcagcagaaaatgaatccgctttgaccagaatttccgtcacgttcagagctggatcgcgttacgaaaccagcgataatctcggtgctgtacacgttatccgtaccgccgctggattatccacaaaaaacgcatcccagtttgctattatccgtaacatacagcaagttggggctagcctaactgctacagcagaccgtgaaactatctcttatactttggaaggcaccagaaaagctgtagagcaagttttacctttcttgaaagaagtggctactgagcaagtattcaaaccctgggaactatccgaacttggagatcggttaaagattgacttggcagttcgaccattgcagttacgtgcacttgacttacttcacaaagctgcctacagaacagggttgggcaattcccagtttgttcccaaatttcaaataggtaaactttcctgcgaaacattgcaacactacgttgccaataccttcacttcaagcagagcggctgtagttggttttggaatagataattccagtctgacgcagttcgctcagtctttgaacttggagcccaatgaaggtgtctccaatcccagtccttacaagggcggagaaattaggtcggacaaagggggcgatttcgcttttgtggcgatcgctggcgagggggcagcggtgaacaaccccaaagaagccctagcggccgccgtcctacagaacgtcctcagtgccggaccccagttgaaatggagcaccaacgacaacggagtcattcccagggccctaggtggcaccgacggctattcagttaggggcatcaatgcaagctacaaagacacgggattggtcggaattttgctggccgtgcccgccaagtcggccaagaaaattgtaccgggagcagtgaatgctttcaaaagtgccagcgtcaccgatgcggacgttaacagaggtaaaaacttgctgaaaaccagtttgctgtcggaactggaaagcggatcgacagcggctcaagtatacggcgcgcaagccgctctaaccggcaccgctttgtccgcagaggaagtcgcctctgtagtcgattcagtatcggccagtgatgtgaacagcgttttacaaaaggcccgaaaaaacatctcaatcgcatcggtgggcaacttggccgatgttccttatgcggatgacctataa

SEQ ID NO: 66 - DNA, 333 bp, Sitophilus oryzae
atgagacgagcacacacaggaaattactatgaacccttaccacaagaaaacaatgaaatggaacaagaaaatgaacgtatggcacaggacctctcagacaaaatcggggtgcttaagtctttatcaatagatataggaaacgaagtaaagtatcaagacaggctactcagagatgttgatgatgatatggaacgtacaggaggttttcttggtcgaactatgcaacgagttgttaaactgtctagaggttcacaaaattatattgttttatatttatttcttttttcaattgccgtgttctttatattatatctagtactcaagttcaggtaa

SEQ ID NO: 67 - DNA, 1491 bp, Sitophilus oryzae
atgtcttacccctcgagtttatcggccaaacaggccaccagggaacacgtcctcgcagtgtccagagatttcgtatcgcagcccagattgacctacaagacggtgtccggtgtgaatggacccttggtcatcctcgaagatgtgaaatttcccaaattcaacgaaatcgtcgaactgaaattggccgatggaagtcttaggtccggtcaagttctggaagtcagcggttccaaggctgtcgttcaagtattcgaaggcacatcaggcattgacgctaaaaacacactatgtgagttcaccggagatattttgagaactcctgtatcagaagacatgttgggaagagtttttaacggctcaggaaagcctatcgacaaaggacctccaattttggctgaggacttcttggacattcagggacaacccattaacccttggtcgcgtatttacccagaagaaatgatccaaaccggtatctctgctattgatgtcatgaattctattgcccgtggtcagaaaatccccattttctccgctgctggtttacctcacaatgaaattgctgcccagatctgtagacaggctggtctagtaaaagtaccgggaaaatcagtactagacgaccatgaagacaactttgctattgtgtttgctgctatgggtgtcaacatggaaaccgccagattcttcaagcaagatttcgaagagaatggttctatggagaatgtatgcttgttcttgaacttggccaacgatccaactattgaaagaattattacaccgcgtttggctttgacagctgctgaatttttggcctatcaatgcgagaagcacgtactggttatattaactgacatgtcttcctatgctgaagctttgcgtgaagtatccgccgccagagaggaggtacccggacgtcgtggtttccccggttacatgtacaccgatttggccaccatctacgagcgtgctggccgtgtcgagggcaggaacggttccatcacccagattcccatcttgactatgcctaacgacgatattacccatcctattcccgatttgaccgggtatattaccgaaggtcaaatctacgtcgaccgtcagctgcacaacagacaaatctacccacctgtcaacgtgctgccatctctgtcccgtctgatgaagtccgctatcggggagggcatgaccaggaaagaccattctgacgtttctaaccagttgtacgcttgctacgccattggtaaggacgtgcaagccatgaaggccgtagtgggtgaggaggctttgactcccgacgatcttctctacctagagttcctgacgaagttcgagaagaacttcatctcgcagggcaactacgaaaacaggacggtgttcgagtcgctggatatcggctggcaattgctgcgtatcttccccaaagaaatgttgaaacgtataccagcggcaacactggcggagttctatcccagggactcgcgccactaa

SEQ ID NO: 68 - DNA, 327 bp, Sitophilus oryzae
atggaatatgacaaagaagaacccgatgacacagaagaaactgaagcaaaatcaataccagcaatattcaaggaccaggttctagagtttattatgaatattctactggatcatcccgaagacattatggaatacggccaaagctattttaaaaaagtagaagaaaacaggcgtaccaccatagtttatgatttagtcaaagttagcaatgaaaatttaactggaggtggtcaaagagatacagacaatgtagataatacgactcgtaatgcagagaatgattcagaaaagatagttagaagcattagtgcgaatttcagtttttga

SEQ ID NO: 69 - DNA, 2322 bp, Sitophilus oryzae
atgagttaccaaagccgatcaatgtcgtatcaaaacgcctccgacatgcccaagtccaactccaaagacccggctgtcatgtcctggcagcagaacaactacatgggcgattctggtatccattcaggcgcccaaacccaggtaccttccctgagcggaaaggaggacctttccgaggatctctttgacctggaccaaggaggttacccgggttttacccaggatcaggtcgacgagatgaacaaccagctgacgcagaccaggtcgcacagggtgagggctgccatgtttccagaaactcttgaagaaggtatcgaaataccatcaactcaatttgaccctcagacccaaacagcagtccaacgattggcggaacccagccaaatgctgagacatgccgtggtcaatctaattaactaccaagacgatgccgaactagccaccagagctatccccgagttgatcaaactcctaaacgacgaagaccaagtggtggtatcccaagcggccatgatggtccaccaattgtccaaaaaggaggcttccaggcatgctataatgaacagtcctcaaatggtagcagctttggttcgagctatatccaattcaaatgacttggagaccacgaagggtgcagttggtaccttgcataagttgtcccatcaccggcaagggttgctggctatattcaaaagcggtggtataccagctttggtgaagctactaagttcacccgtagaaagtgtgttattctatgcaataaccacattgcataacctcttgttgcaccaggaaggttccaagatggccgtgcgtctggctggagggttacagaagatggtggccttgttacagaggaacaacaccaagtttttggctattgtcaccgactgtttgcagattttggcgtttggcaatcaggaaagcaagctgattattctggcttcgcaaggacccattgagctggtcaggataatgaggtcttacaattacgagaagctgttgtggaccacttcaagagttttgaaggttttgtcagtttgctctagcaacaaaccagctatagttgaagcgggcggtatgcaagccctagccatgcacttgggcagtggaagtcagagattggtccaaaactgcctgtggactttaaggaatttgtctgacgctgctacaaaagtcaacggactggacactctcctgtcatccttggtacaagtcttgtcatcgccagatggcaatgtagtcacttgtgctgcaggaattttatcgaatctgacttgtaacaatcagtttaacaaagagactgtttgtcagtatgatggcatttccgcgttggtgaggaccatcgtgaacgctggagatcacgaagaaatcacagaacccgccatatgcgctctcagacatttgacatcgagacacgataaatcagaactcgcacaaaatcaagtcagagttgttggtggtattcccgtaatcgtaagattgctgaaccctccgtctcgctggcctttggtcaaggcagtcattggactgatcagaaacctagctttatgtcctgacaatttcttgcctcttcgtgaatcgtgcgccatcaattatttggtgcagttgctgatgagggcttaccaagatactcaaagacgagccagcttggccagcggaggcagccaacccccaggtacatacgccgacggtgtccgaatggaggagatcatagagggcaccgttggcgccttgcacatcctagcccgcgagtggaacaaccgcgaacagatccggcaacagcgcgtcatccccatcttcgtgcagctgctcttcaacgacatcgagaacatccagcgcgtggcggcgggcgtgttgtgcgaactggccgccgacaaggaaggagcggatatgatcgagcaagagggcgccactgctcctttgacggaattgttgcattcgaggaacgaaggcgtggctacttacgcggctgcagttttgttccgtatgtccgaggataagcctcaggaatacaagaaacgtctgtccatggaactgtccagctctctgttccgcgaagagaacctctggaaccctgatctgggtatgggtaccgatttccaggatatgttaagtcctgaacaggcttacgataatatgtacgcccaggacccgcctagcgttcacagtagtcatggcggaaggccatatcaacagcaacaagccctgtttagcgaactacaaataaatatggacatggacatggataccatggaagcgctcccagcgccgcccgagtctaacgaccaagtcgcggcttggtacgacaccgatctttaa

SEQ ID NO: 70 - DNA, 807 bp, Sitophilus oryzae
atggctcgaaatgcggagaaggctatgactacactggcccgttggagagctgcccaactgggagagaatgaaaaagttaaaaagcgacggccctatctcgcatcggaatgcaaaagcctctatgcctgcgagaaatggagactgcagattatcagagagattgcgaaaaaggtggcccagattcagaacgccggcctgggcgagttccgaattcgtgacttgaacgacgaaatcaacaaactgttaagagaaaagcgacattgggaggaccaaattaaggaattgggcggaccagactatcaaaaggtaggacctcgaatgttggaccacgaaggtaaagaggttccaggcaacaggggctacaaatactttggagcagcaaaggaactaccaggtgtaagagaattgttcgaacaagaacctccaccacctcccagaaaaacacgggcagaactgatgaaagatatcgatgcagattactatggttatatggatgacgatgatggcattttaatacctttagaaatcaaagctgaaaagatagctctgcaaaaggtggacgccgaatggaaatctaaaaaagaacaagcaatggaaacagataccccagaagaggaatacgaagaagagaatatctataaagtccatgattctgacgaagagcaagaaaaagaaattgttgatggttcccaacaaagattcgttgcacatgtcccagtgccatcacaacaagacatcgaacaagcccttttaaggagaaggaaacaagaattgatggaaaagtacggaataccctcggaacaataa

SEQ ID NO: 71 - DNA, 648 bp, Sitophilus oryzae
atggcagcagaacaagaaatgcccacatttaaatgtgttttggtaggagacggtggtacagggaagactacgtttgtgaaaaggcacttgactggtgaattcgagaaaaaatatgtagcaactttgggagtcgaagtccatccattggttttccatacgaacagggggcctattagatttaatgtatgggatacagcgggtcaagagaaattcggaggtctccgtgacggatactacatccagggacagtgtgctattgttatgttcgatgttacatctcgtgtaacctacaagaatgtaccgaattggcatagagatttagttagagtttgtgaaaacattcctatcgtattgtgtggaaacaaagtagatattaaggatagaaaagtcaaagccaagagcattgtatttcacagaaagaagaatttacagtattatgatatttctgccaaatcaaactataacttcgaaaaacctttcctatggttggcaagaaaactgattggtgatcctaatcttgaattcgtggccatgcctgctttggtgcccccagaaatccagatggatccccattggcagcaacaaatcgagaaggatcttaaagatgctcaggacactgccttgcctgaagacgatgaagatctataa

SEQ ID NO: 72 - DNA, 645 bp, Sitophilus oryzae
  misc_feature (389)..(389): n is a, c, g, or t
atggttttgaccacgattgcatctataattgtgaagatagttaaactggtattaaatttaataataattataatataccgggtgggattccaaggcgattttctgggagttggtggaacatggaacttgtacgaagacaaaaactcagatgtggaaatcattgcttcgggtgtattcgtgggatacatggtctacaacatcgtctctcttataagcatgtgttttgcagacagcgaaaacaaaagcacctttacggatattctcatgaacatcgttggtatatttttatgggtggctgtgggagcaacagcccttcactactggcatggttacctggctgaacacaaatatacatacgtcaattccgagagacaggttgggttggcatnaatatacatacgtcaattccgagagacaggttgggttggcattaggatctctatgtgtcctcaacggtgcagcttatctcgtggattcagtcttatcagttattttcattataaaggccaaaatgcaatagtaaacgaatacaaagtgttatacgaacaagttctagtgttaagtagatcatcatccttcaaatatttatgtttttttagaatcatatcaaaacgaactttgtggtacaaatttttatattattaa

SEQ ID NO: 73 - DNA, 2544 bp, Sitophilus oryzae
atgccgcgaattatgataaaaggcggagtgtggcggaacacagaagatgaaatccttaaggctgctgttatgaaatatggcaaaaatcagtggtcccgtattgcgtcgttgttacatagaaaatcagcgaaacaatgtaaggcacgttggtttgaatggttagatccaagtataaagaaaacagaatggtcaagggaagaagatgaaaagctattacatttagcaaagctaatgcctacgcagtggcgaacaatagccccaattattggccgtactgctgctcagtgtttagaaagatatgaatatttgttggatcaagcacaaaagaaagaagatggtgaagatactgctgatgacccaaggaaacttaagcctggcgaaattgatcccaatccggaaactaaacctgccagacctgatccaaaagatatggatgaagatgaacttgaaatgttatcagaagctcgtgctcgattggcaaatactcaaggaaagaaagcaaaacgtaaagctagagaaaaacaacttgaagaggccagacgtctggcagctttgcagaaaagaagagaacttcgagcagcaggaattgaagtcaatcctcgtcggcgaaaaaagcgtggtgttgattataatgcggaaataccttttgaaaaacgacctgctattggattttatgatacatcaaatgaggctcttgatcctatggcaccagacttttctaaaatgacccagcaggccttggatggcgaaataagaagtgaacaagaagaaaaagagaggaagaaagataaacagaaattgaaacaaaggaaagagaatgacataccacaggcaatgttacagaaccaagaacctgctaagaaaagatcaaaactggttttgcccgaaccacagatttccgaccaagaacttcatcaagttgttaaactgggaaaagcgagcgaagtggcgcgcgaagtagcttccgagagtggaattgacagtaccgacacgttgctgaatgattatactttaacccctcaagcagctgcaacgcctagaactcctgctcctgtcactgatagaattcttcaagaagctcaaaatgtcatggcccttacccatgtcgataccccactcaaaggaggcttaaatactcctctacataattcagattttagtggcgtagctcctcaagcacagacaatagctacaccaaacacagtaattgccacaccgtttaggtcagccagaagtgacggcggtattacaccagccagttcaggttttgcaacacctcgtagtggagcgttggttccggtaggacaagggagtagttttactccctcagttagggacaaacttaacattaatgcagaggagagtctagaggctgcagaaacgccagtacaacagcgcatatatcaaacctcccttaaagagcaactaaaaatgggtttaagtagtttaccccagccaaagaacgactacgaaatagttgttccagagcaagttgatcaggagatgccagaacaagctcaagagcacatgattgaagatcaagcagatattgacaagagatatcaagaggatttgaaagcaaaagcagcaaaagaattagcaatgagatctcaggttatacaaagagattttcccagaccattagatgtaaacctttccgttttgcgacctcctaatgaaaattattcattgactgaactgcaaaaggcggaagaattgataaaatgcgaaatggccactatgctacatttcgacaacttaaagaatcccatacccaatcaaagtaaacaatctaccaagtcgcaagcacaacagttagcatttttagaagagcatccgtatcaaaattttagaccagatgaactggaactgtcgaaaaaaatgttaaaaaaagaaatggaaattgtcaaaatgggaatgaatcatggtgaattgcccatagaagcgtacactcaagtgtgggaggagtgtttgggtcaagtgttgtttttaccaaatcaaaacagatatactagggccaatttagctaataaaaaagacagattggagtctgcggagaagcgtttggaacagaatcgatcgcatatggccaaagaagccaaacgggctgcaaaaatggagaagaaattgaaaattttaactggaggttatcaatctaaggcccaggtactcattaaacagctccaagatgcttacgagaatattgatcaagctaatttggaattgaacacttttaagtttttgcaagaacaagaaaagaatgctttgcctagaagggtcgagtcattaactgaagacgttgaccgacaaatggaacgagaaaaaggattacaaaagcggtataacgatcttcagaacgaaatcagggaattacaagagcaatacaagtatgtgcaacaggaagtgtacgaggagcaaagccaacaaaacgttgtgacagatgaaactgttgaaaatcatatatctgatgatcaaaatgtggttagcagttctacagtgaatggaatagatgagagccctgaagacgagtcgaatatgaattga

SEQ ID NO: 74 - DNA, 495 bp, Sitophilus oryzae
  misc_feature (456)..(456): n is a, c, g, or t
atgatgcaatttatgttgctgtttagccgacaaggcaagcttcgtttacaaaaatggtacgtcgcccatccagacaaattaaaaaagaaaatcacgagagagctgattaccacaatattagctcgaaaaccaaagatgtgcagttttcttgaatggagggacctcaaaattgtctataaaagatatgcaagtttgtatttctgttgtgcaatagaacaggatgataatgaactgttaactttggaagttatacatagatatgttgagttgcttgataagtattttggaagtgtgtgcgagttggatataatttttaactttgagaaggcctattttattttggatgaattaatgttaggtggggagattcaggaaaccagtaagaagaatgtattgaaagcaatagctgctcaggatctcttacaagaggaggagacaccacaaggattctttganaggagacaccacaaggattctttgatgaccatggactag

SEQ ID NO: 75 - DNA, 1260 bp, Sitophilus oryzae
atgcaccagttcagcaaatttatgtttacccaagttaccagatccactagagatgcaattcgacattattcaagagaacctcaaaggcgaccctccttcttatcaaggttgtatgataattttagggaagaattggcaaagaataaggaaatgaaagagtcactgaaaaagtttaaagaagaagccgaaagattggaacagagtgatgccttgaaagctgcacgccaaaagtttgaaactgtagaaaaggaagcaacaaaaagcagcgatatattaaaggaaaaacttactacaattaaagacaaagtgcagggtgttctagatgaaacgggcaaaacagaaattgcaaaaaaagcaggtaaactaagtgagggaataagcaagactgctcatacaataggggaaaaagcgcaggaaattgggaaaactggtgcgtttcaaagcatttctaaagcaacagaggctgtcaagagtgaaatagataccactagtatgcaaggaagggtttatgtcagccccacaaaacttaggaaaagaaaagaaaccacagctgtacagcatcaaaagtattatgagccaaatacagaagcttccggtgtagaattacataaagattcaaagttttaccagtcgtggcaagacttcaaagataacaacccttatgtacataaagttatggactggaaattgaagtatgacgagagtgagaatccactaattcgtgcatctagagctttaactgaaaaagtatcagatgtaatgggaggtttatttcaaaaaacagaactatctgaaactttaacagaaatctgtaaaattgacaatacatttgataccaagcggtttttaaaacagtgtgaaactgatattattcccaatgtacttgaagctatgacaagaggtgacttagaaatattgaaggattggtgccacgaagggccttataatgttttcgcaataccaattaaagaagcctacaaaaaaggttataaaattgagtcaaaaatattagatatagataacgtagatctagtcatgggaaaagttatggaccaaggaccagttttaatcatttcctttacctcgcagcaagttatggtcgtaaaggacttggaaggaaatgtggtggaaggagatgctgataaaatcatgagagtcaattatgtatgggtattatgtagagacgttacagaaactgatccaaggtcggcttggagacttctagatttatcagcaagcagtaatgaacaactagtttga

SEQ ID NO: 76 - DNA, 921 bp, Sitophilus oryzae
atggaatattcaagcgattcggaactaagtgatagcgataaggaactacaagaggcttttgcggaaggaaaactgaaaccagggctcaatactgtacacgaagcacccaaatcattcataaacaatgtgcaaggactaaaacataaattggacgaaataaaactaaatttaacttggctagaaagactggatagtgtaaacgatcaggcaccactagcacctgaattagcagcccaaatgttagcccacgaacataaacgtgaaaaccagttgaagaataacaagaaattgccacaattttcacccaccgaagatccagtgttgaatgatttcaaacgagagatgtgctttcatcgtcaggcacaggcaacaattttagaggctattcccaagcttacaaaattgggattacctactagaagaccagaagattactttgctgaaatggctaaaactgacgagcacatgcaaaaaatcagggaacacctaatgcaaaagcaacaacaacaacaaagaagtgaaagagtcaaacaactaagacaacaaaggaaagaaggaaaaatgctacagattcagacaaaactacaacgaatgcaagagaaaaaagaaatgttggaccaagttaaaaagtacaaaaagggtgtttcaaaggacttggacttcttagattccaaaaagaacaccagtagcaaagcaatttctagaaaatctttagagaaacggagacagaaaaataagaagttcgggtttggtggtaagaaaaagggcatgaagctgaacacaaaagacagtgctgctgatataagtgagtacaggaaaccttcaaagggtcctagcaaagggaagaagggtaaaggtcaaatgaagaacagcagaccagggaaaaataggaggataaaaaacaaaactaaaaggaaataa

SEQ ID NO: 77 - DNA, 615 bp, Sitophilus oryzae
atggatgaagtaaaaaaattggaatatctttctttagtgtccaaaatatgtacagaactagagaatcatttgggtatgaatgataaagatttggctgaatttataatatttctatcggagaaaaataatactgtggatacattcaagaaagccctgacagaaaatggagcagagttttcagattcattcgtctcaaatttgcttcgaattattcaacacatgaggcccaaaaccaaagatgcttccagcgaaataaacgatgaagataaaattgaaaaaagctttttagctcaaaaatttccgggccttgctcttccaaacgagccgcaaaaacctctaagtgatgatgaagtggaaaaagatgaagagactaataatgaagaaggtgatattgtagccgatcttatggcacaatttgaagcagatgctccttctgctgttaagaaaactaaatccaaagaaacagaaagggatagacacagatctaggtctcgccatagagataaatcaagatccagatcaagggatagaagaagagataggtcacgagaaaacagaagaaacagaatcagagatagatctagagatagagatagggacagagatcattacaag

SEQ ID NO: 78 - DNA, 1878 bp, Sitophilus oryzae
atgaatcaaggggcaccaaattaccccatggcgtcgttgtacgtcggggatttacattctgatattaccgaggccttgctttttgagaaattttccactgctggtcccgtactttcaatccgagtatgcagagatttgataacccgaagatctcttggatatgcatacgtaaattttcagcagcccgccgatgctgagagggctctagatactatgaattttgacttgatcaaagggagacccatcaggattatgtggtcccaacgtgatccttccttgagaaaatctggcgtgggaaatgtatttattaaaaacttggatcggtccattgacaataaggctatgtacgacaccttttctgcatttggtaatattcttagttgcaaagtagctcaagatgaaaatggggcaagcaagggctatggttttgtccattttgaaactgaagaagctgctaagaagtccatagaaaaggttaacggcatgttgttgaatggaaaaaaagtttacgttggacgtttcattccccgtaaagaaagagaaaaggaacttggagaaaaagccaaactctttactaacgtctatgtaaagaattttggagaagacttatctgaagaacaattgcgcaacatgtttgagaagtttggaaaaattactagttacaagatcatgagcaaagatgatgggaaatctaagggatttggatttgttgcatttgagagccctgaagcagcagaagcggctgtggaaaatttgaatggtaaggaaatggtagaaggaaaatctctttatgtaggccgcgctcaaaagaaggctgaacgtcaacaagaactgaagcgtcgctttgaagcactgaaaatagaaagattgaaccgttaccaaggagtcaatctctatgtcaaaaacttggatgacactatcgacgatgaacgtctacgcaaggagttttctccatttggaacgatcacttccgccaaggtgatgatggaggagggtcgtagcaaaggatttggatttgtttgtttttcttcccccgaagaggccactaaggcagtcacggaaatgaacggccgcatcgtcggttccaagccactttatgtcgccttagctcagaggaaggaggacaggaaggctcacttaacctctcagtacatgcagcgtatggcaaacatgcgtatgcatcaaatggggccgttcatccagcctggaggctctagttacttcgttccgacactgccggcccagagattctatggtgcggcccagataccccaaatgaggaccagtcccagatggccggcccaaaaccctgtcagaccaggaggtcaagcaggaccaacagcttatgccaatatgcccaccacttaccgagccacagcacgaccacccaatcaaaccgcggccatgcgtagtaacatcaacgttcccaggcccatcactggccaacagccacccaacatccaaggacgcccattggctggtcaaagcgtggtcgctgccggtggaagtcgcacgcccaacttcaaatacacgtctaacatgcgcaacccgccgccttccatgggcaccatgcctgccgcaccagtgcaacaagcggtccacatccaggggcaggaaccactcactgctactatgctggctgccgctcccccaccggaccagaaacagatgctgggagaacgtttgttccctcttatccaacgcatgtatccagacttggccggtaagattacgggaatgttgttggagattgacaacactgagttgctgcacatgttggaacacaacgagtcgctcaagaataaggtcgaagaagcagtggctgtattgcaggcccatcaagccaaacaggctgcaactcagatcaaaaaagattaa

SEQ ID NO: 79 - DNA, 2775 bp, Sitophilus oryzae
atgaccgattcaaaatattttaccactactaaaaagggagaaattttcgagttaaaatccgagctaaataatgataagaaggagaaaaagaaggaggctgtaaaaaaggtaatagcatcgatgactgttggtaaagatgtttcagctttattccccgatgttgtaaattgtatgcaaaccgacaatttggagcttaaaaaactggtttacttatatttaatgaattatgctaaatctcaacctgatatggctattatggcagtgaatacatttgttaaggattgcgaggaccctaacccactcattagggctttagcagtgaggaccatgggttgtattcgtgtagataaaataacggaatatttatgtgaacctttgaggaaatgtttaaaagatgaagatccttatgttcgtaagactgctgcggtttgcgtggcaaagttatatgatatttcatcagctcaaaacacaaatttaggcctagtcgaagaccaagggttcttggaacagttaaaagaattgttaagcgattcaaacccgatggttgttgccaatgcagtagctgctttatcggaaattaatgagagtagtcccacaggtcaaccgttagttgagttaagtacatcaacaattaataagttgcttactgctctaaacgaatgcactgaatggggtcaagtgttcattttggattctctatcaaattacactcccagagatgagagggaggctcaaagcatttgcgagagaattacaccaagattagctcatgctaatgcggccgtagtgctttcggctgtcaaagtcttgatcaaaatgatggaaattttacaaggtgatgtagagttttgtaatacgctcagtaagaagttggctcctccattagtaactttgttgagttccgaacctgaggttcagtacgtagcactcagaaacatcaatctaattgtccaaaagaaacctgatattttaaaacatgaaatgaaggtattttttgtgaagtataacgatccaatctatgtaaaactagagaaattggatatcatgattcgtctggcttcgcagagtaatatttcgcaagtcctcagcgaattgaaagaatatgctacagaagttgatgtcgattttgtcagaaaagccgtgagggctattggacggtgtgctattaaagtcgaaccatctgcagagaaatgtgtctccacattattggatctcatccaaaccaaggtcaattacgtcgttcaagaagctatcgtggttattaaggatatttttaggaaataccctaacaaatatgagagtatcatcagtacactctgcgagaatctcgacacactcgacgaacccgaagccagagcttccatggtttggattatcggcgagtacgctgaaagaattgataatgctgatgaacttctagatagtttcttggaaggttttgctgacgaaaatgcgcaggttcaattgcaattactgacggcggtggtgaaattgtttttgaaacgtcctcagcatactcaaggactagttcagcacgtgcttagtttggccactcaagattcggacaacccagatctaagagacagaggattcatttactggagattattaagtacggatccagctgcagcaaaagaggtagtcttagctgacaagcctctcatatcagaagaaaccgatcttctcgaaccaacgttgcttgatgaacttatttgccacatttcttctttggccagtgtttaccacaaaccacccactgcttttgtcgaaggcagaagcgcaggtatcagaaagacccttcctgttcgccaagggtcagacgaagctccggctcaggaagctacagtcatacccaatcaggagagccttattggagacttgttatccatggatcttggtgcacctacaattccatccggtcccgcacctaccacagctccgataagtaatgtggatctacttggaggcggattagatgtattgtatggaggcacggaacttagtggtgctcctacagctgctgctccttcaactacagggcttttaggagatatatttggtatcaccacaacaccaactatgtatactccaccaaaaacattatggttaccagctgataaaggtaaaggtttggaaatacggggaactttttcaagaaaatctggacaagtacacatggaaatgacccttactaataaagctatgcaggtcatgagtgggttcgctattcagttcaataaaaacagttttggtttagcacctttagttcccatgaacgtcacaggtttgcagcctgggcaaagcctcgaatatagcttagctttaagcacaacagggccagtacaaagaatggagccccttactactttacaggtggccattaagaataatgtggacgtgttctattatgcctgtcaaataccaattcagattctattcctagaggacggcacactagataaacgagtctttttaactacttggagagacattccatctgcaaatgaggttcaatacactctaaatgatatcaaaggttctgcagacgctatttcaagcaagatgactatgagcaatatctttaccatagcaaaacgtaacgtggaagggcaagacatgctctaccaatcactgaagttgacaaataatatatgggttcttcttgaactaaaattaactcctggttcaaccactgcaactttaagcttgaaatcaagatctgtggaggtggcaccatatgtatttcaggcttatgagatgatttgcaaaaattag

SEQ ID NO: 80 - DNA, 498 bp, Sitophilus oryzae
atgcctccaaaattcgatccgaacgaagtaaaatacgtttatttgagatgtgttggaggagaagtaggtgctacctcttcgttggccccaaaaatcggtcctttaggtctgtctcctaaaaaagtaggtgacgatattgcaaaaggcacagctgactggaaaggtcttaaaatcactgtacagttgaaaatccaaaatcgtcaagccagcatttcagtagtaccctctgcagcttccctgatcattaaagctcttaaagaaccaccaagggatagaaagaagcagaaaaatattaaacacagtggcaacatttcctttgatgatgttttggctattgcaagacaaatgagaccgcgatccatggctaaagcactgtcaggaacagtaaaagaagttttaggtagtgctcagtctgttggttgtacaattgatggaaaagcgccccatgatgttatagatgaagtaaatgacggcagtatcgaagtccctgacgagtaa

SEQ ID NO: 81 - DNA, 1155 bp, Sitophilus oryzae
  misc_feature (784)..(784): n is a, c, g, or t
atgggtgaaagtggaatgagagcacttattcttgttgggggctatgggacgagattgaggcctctaactttgagtcgtccaaaaccgcttgttgaatttgctaataaacctatactattacatcaggtcgaggctttagttaaggttggcgtgtccgaagttattttagctgtatcttatcgagcagagcaaatggaaaaagaattggttttagaagcaaaaaaattaggcgttaaaatggtgttttcccacgaaacccaaccattgggaacagctggaccgatagctttagcagcagagcatttgacaaaagataacaaaccattctttgtattaaactccgacattatttgcgactttccttttaaaaaactaatggacttccacaaagctcacggtaaagaaggtacaatagtagtgacaaaggtagaagaaccttcaaaatatggtgtggtagtgtacgatgaaacaaagtgtatagaaagtttcgttgaaaaaccacaggaattcatttccaataaaattaatgccggtttatacattttaaatcctagtgttattaatcgtatagaattgaaaccaacctctattgagaaagaagtatttccaaatatggcagctgaaaaagaactgtatgctttcgaattacaaggcttttggatggacgttggacagcctaaagatttcttgatagggatgtgtctttacctcaaacatttaagaactacagatccggagagattatacagtggtcctggagttgttggaaatgtcttggtacatnctacagatccggagagattatacagtggtcctggagttgttggaaatgtcttggtacattccactgccaaaattggaaaaagttgtcaaataggacccaatgtcgttattgggcccggtgtagttatcgaggatggtgtatgtataaaaaggagtacaatactggaagatgctactatccgttcaaattcgtggttagaaagctgtattattggatggagatgtatagttggacaatgggttagaatggagggcataaccgtattaggggaagatgtcattgtaaaagatgagacttatattaatggaggtcaggtgcttccccataaaaatataggagattcggtacgcacaccacaaattataatgtaa

SEQ ID NO: 82 - DNA, 858 bp, Sitophilus oryzae
accgacggcgaagaaattcctgatcaggaaaaagtgcgaatagtttctgattttatccttcgttcgccccccggcgagtttaatgaagtgttcaacgatgtccggaagctcctggacgacgacgacctgctcaaagagggggccagcggggccttcgcccagtacaacaaagatcagctcacgccagtgaggatagataacgccgatcatttagttttgatcaccgaatacaacgatttaggcaataacagattttttgattcccgttccaaacaaagctttcggtacgaccatttaagaaaagaggcttcagactatcaacctttcacgcccgacgcaacagcagagccctggagatcggcacttgacgcggaatttattcagtacacgcgtaatcactataaagacggagtcagtttggtggtaggccgtagtgagggaaacacgataactttagctgcctgtattgaggaccatcagttccaacctaagaatttctggaatggtagatggcgtagtcaatggtatatttcactaaatggtacctctacagctgagttaaggggcgttttaaaggtgcaggtgcactattacgaagagggtaacgtccagctagttagtactaaggaaattaaggaaactataactgtttcgtcggaaacgcagactgcaaaggaaattgtgtgggctatcgagaatgcggaggactcctatcaaactgctatttcggtgaattatcagaatatgtctgataccacgtttaaggctctcagaaggttacttccggtgacccgtaccaaaatcgattggagcaaaatcgtatcttacagtattggaaaggaactaaagacgcaatga

SEQ ID NO: 83 - DNA, 4158 bp, Sitophilus oryzae
atgaagcctaaatgggtcctggtggccctggtgctttgcctttgtactataagtttcggtcaagatgttaatccggacgctgaagcggtgcccggagttgaaagtgacggaaacacggatcaggatggccaacctgtgccagccgaagaacaaccggaagagggagctaatggggatgtaccatcaacggcttacgaagaaccttccgtagacaattcccctcctaatcccgaagatagcaacgctccatcgtcagatgttgaatccatggatgggtcggataccacaggtctgaaaactggtcaaaagatctttaaatctggaaagtacatcacgtattacggggctgattatgatcctatgaattcaagaatcgctcctccggataccgaccaaaggggtggtgctggaacaccttacactctcaccgatcagcgtttgtcaacgattagacagatctttatgtatcccttttacgatcagggtggtaacgccgacaacgaaggagattaccaaaaggaaattcagtcctcatcaccacaggttcacaaaaacttgaatttccaactgccatttttcggattcagattcaactacactagagtttccttgaatggttatttggagttcagcgatccacccccaaattacgactaccccctagtattccctacgagagattggcccaaaaagaacgatccatcttttattggagtatttttcagcaagtgcagaataggtgacttgagagatggtgatattgacccacgaaaaccaggagtctattttagaatggaaagagatttgagacaacgaaacgatcagatgggagtggaaatcagagaaagattgaaatgggatatcagagaaggtgtgattggttctgagacgtttgatcctaaacatgccatcattataacctggaagaacgtgtcattcaatggcggatttgccaatgctaaatataggacaaacacctttcaagctgttcttgctaccgacgaagtctacacatacgccatgtttaattaccttaacctcgcctggactagtcacactgaagctggtggagatacaataactggagaaggaggtgttccagcttacattggattcaatgccggtaacggaactagaaattgggagtacagtccatacagtcaagcgtcagttttgagagatcttacagccacaggttttgcaaatggttttccaggaagacacttatttaggattgatgaaaacattcttgtgggaacttgtaacaaggatatagatggagcaaatttacctctaatgtttgctcccgagtctggaaacatgttgggaggaactgtagtcaacatcactggaccatgtttcaatccttccgatcaggttctttgcaagtttgatgtggctgacgtggtttatggtgtagtagtcagtagaaacagagctatttgcattcagccacctttaatggtagaaggttacgttaggctggaaattgctattggacctggaacttataaatggaaagggagatactatgttgaaaatcctgctagtgcagcccagaaaatttacttcaaagatatgaaggtccatgacaaatcacctgcagaaatcaaaataacatgggaaaagtacaatttaactaccaacgataacgcaaatattaggatatcattatggggttacagagaaacaactattcgtcctgcatttttgtatattacagatattgcaagcaacgtccagaatacaggagagtataccattgtgccatcacaatatagaaatagagaaaacactttcctaacagacatcaagttcggtttcattcaaataaatttgacagatactatcccagtacagtctgattataacagcgctgcacaatcggtagaaataaatccagtagtatggagtagacccatccctcttggttggtacttcggctggcaatgggaaagactttacggaacaaactggccagaatatttgtgcaacgattggctgcgaactgacagatacttgaagaacttcgcacacgaactaccccagtgtccgtgtactttagaacaagccctagcagacaaaggcaaatacatgcctgattgggattgtgacaaagattccaaccccacttgctattacaacaaccaagctgtgcattgcgttaaaactggatcaccaacattggaaggttctgagcagcaatgttgctacgacaaaaaccactaccttatgctttcttacgatcagcagtggggttcaagtccaaggcgttgccacaatttaggtctcatgccttaccaagaagcaaccaaggtacccacgctatctcaatggtttaacgatgttgttcccaagtacctgtgctgtttatggcaagatgaacaagccgtgggatgcgaaacattgagatttgaaaggagacctactcaggattgcgtagcatatcaagcaccaggcgttgctggtgtttatggtgatccccacattgtaaccttcgacgatttggagtacacgtttaatggaaaaggagaatttgttttgataaagtccaacgccagactagataacattgaagttcagggccgatttgaacagatggatcctaacctatatggtgaagttagagcgactcaactgacatctgtagtagcaagaggcaattcttctactgtggtagaagttaggagaagaccagaatacgcaagatggagatacagactagatgttataacagatggaaaaagggtttactttgacagaccgtccttaaaattccaacattttcctggtgtgaccgtttatactccgacctacattttgaatcagtctgaagtgattatgatgtttgacaatggagttggagtggaggtcttggacaatcaaggttatatgacagccagagtatatctgccatggtcattcattaacaaaaccgccggtctacttggaaattggagttttaataaagaagacgattttactttacccgatggctctagagtaagcgtagtttcaaatatcaacgacatgcagagagtatacaccgattttggatcaaaatggatgatagatgatgtattagattcacagaaaggcagagcactattccttcgagaaaatggcttgacttcctcaaactacaacaatcgttccttcgtgccggtgtttgttatgactccagaagaaattataccggcaaacagatccgaacaaattacgcgaacctacgacgtgtgcagcacaaagatgtacgaatgttactacgattacgcaatgactctgaacagagacctggcccactacacccaaaactacaaggctacgatatatcagcttaaggaggtttctagaaccaaggtggtgtcttgtggcatcttagagacgcctaggttcggaagaaagagcacattcttgtttgttcccggcaccaaagtgacctacgagtgtaaccaagacttcgttcttgtgggcgatccaaggagaacgtgtttagctacaggccaatgggacacgcccgaatatggttacacttactgtctacgtcaacaagaatattctcaacgcaacgcagccataacctcaggaataatttttgcagtactcatacccttagtcttagtcatagtgtttatcgcctttaaggtatatcaaaagtacatgaactcggacgatagttcctggcaatacgcccagaaacccgcgctggcagcaagaagcttcagtcccaccgagtccaacaagagtccactgagtgacacttcgacaagtagcgtatttaaaccgcgcataatgtacgataagagctatcgcactcacgagccccttgttggactccctgaaaccgagtttgagtcgaaacaggtcgatcctaacgatgtgggttacgaaatcgacaggaagtcgctgagtagtccgaatattcctgtcagtcctactcccagttctgtttcatacaccatgccgtaccaacaaaagcccgatatagtaaattatggtagcaaaccaaagttagattatggttctgatgattatgcccaaccttataaacccactagtagttcctctgatccagcaagtcctactactggaaaattgtcacccatcacttatagagacagggttgctagtagaagcagtgtaattactgatgtttaa

SEQ ID NO: 84 - DNA, 375 bp, Sitophilus oryzae
ccagctggtggtggtggagctgctccagctgcagctgcaagatcggcagagcgtcgtgtagggacagagtgtggatctcggggttcgccggatcattgcgacattgaaaaaattcttggctcggtaggaattgaagctgatggagaaaaactgaaaagggttatttcagaactaaatggaaaatctattgacgaattaattgcacaaggtcgggagaaactgagctcaattccagctggtggtggtggagctgctccagctgcagctgcaggaggtgctgcaccagctgctgaagaaaagaaagatgccaagaaagaggaagccaaagaagaatcagagtcagatgaagacatgggctttactcttttcgactag

SEQ ID NO: 85 - DNA, 2733 bp, Sitophilus oryzae
atgacaacaactgatcactttgggctgaaatgggacccgaagaatttagagataaggacaatgtctgtcgagaagactttggagcctttggtgcttcaagttacaacactagtcaatacaaacggcccatcaaagaagaagaaaggcaagtccaaacgtgcgaatgcattggtaagcacagtggaaaaagccactgaaaacttcatcgaaaaaggagagcagattgcttatgaaaatcctgatattactgaggaaatgcttgcagctgttgatgaagtaagaaagacaggtacacaaatgagtagagatgctagggagttttcagaagatccctgttcttcattgaagcgcagcaatatggttcgggcagccagaaatttattgtcagctgttacacggctacttattttggcagacatggttgatgtccatttactactaaaatcccttcatatagtagaaaatgatttggagaaactgaaaaatgcatcaagcaatggagaactgctggataatatagaaacattcaggcagaatgcaaatgaattaatgaaccaggctgctaagaggcagcaggaactaaaagaccctcagcttagggatgatttagctgcagcaagagctgttttaaagaaacattctactatgttgttaacagcttcaaaagtgtatgtacgtcatccagagcttgcagcagctaaagcaaatagagactatgttctcaaacaggtttgtgaagctgtgaacactattagtgatgttgctcaaggtagaacacctccagtagcaggcccgtatgatggtccaggtgaacttgctgctgccttagatgattttgatgaaaatatagtaatagagcctttggcatataatgaggttcacactaggccatcattagaggaacgtttagaaagcattataagtggtgcagcactcatggcagattcaagctgcactcgcgatgatagacgagaacgcattgttgctgaatgtaacgctgtccgtcaagcactgcaagatcttttgtcggaatatatgtcaaatatgggtaacaaagataaatctgagagcctagcaaatgctataaataatatgaaagggaagacaaaagatttgaggagacagctaaggaaagctgttgtggaccacatatctgatagcttcatggagactagcattcctctactgattctcatcaaggcagctgaaaacggagatgagaaacaagtagaggagaatgcctacgtttttactgaacattcaaataagctcgttgaggtcgcaaatttagtttgcagtatgtccagccttgaggatggagttaaaatggtgcgctatgcggccgcccaaattgattcactttgccctgaagtaattaatgcagctagaattctagcagccagatccaggagcaaagttgctcaagaaaacatggatgccttcaaatataattgggagaatcaagtcagaattttaacagaggccatcgatgatataacaacagtagatgactttttggctgtctctgaaaatcacattttggaagatgtgaacaagtgtgtcctagctcttcaggagaatgaagcagacacattggaacgtaccgcagcggcaatcagaggccgtactgggcgtattgctgttgtggtcgcggcggaaatggataattatgagccttgtatttacacgaaacgagttttggaggcagtgaaggtgctgaatgatcaggtgatgcctaaattcacacagagggtccaggtggcagttcaaacaattttgagtggccagcaaggacaacctgcgaaagaactggatgaaaacgaatttattgacgcttcccgtctggtctacgatggtgtgcgtgaaattcgtcgtgccgtacttatgaatcgggccgacgaagacttagaccctgaagatgtggagcttgatgaaaattacacattagaaaccaagagcaaatcaagtgcccatacaggagaacataacgtggatgaatatccggagataagcggtataacgacagctcgcgaagccatgggcaagatgcctgaggaagataaacagaagatcctccaacaggtggaatatttcaggagcgagaagctgaagtttgacagggaagtggccaagtgggacgacacgggcaacgacatcatcgttctggcgaaacacatgtgcgtcatcatgatggagatgaccgacttcaccagaggtcgcggcccgttaaaaaccacaatggatgtcatcaacgcggcgaaaaagatatccgaagccggcacaaagctggataaactcacccggcaaatcgcagaccagtgtccagaaagctcaacgaagaaagatttgttggcgtatttgcaacgtatagcgctttactgtcatcaaatgaacatcacctccaaggtgaaagctgatgtgcaaaatatcagtggtgagctaattgtttcaggcttagatagtgccacatcattaattcaagctgctaaaaatctgatgaacgctgtcgttttgacagttaaagcgtcgtatgttgcctcaacaaaatacccaagacaacaaggaaccgttgcctctccaattgttgtatggaagatgaaggctcccgagaagaagcctttagtgaggcctgagaagcctgaggaagttcgtgccaaagtcaggaaagggtcacagaaaaaggttcagaacccgatccacgcattatcggaattccaaacagaatctgtttaa

SEQ ID NO: 86 - DNA, 1221 bp, Sitophilus oryzae
atgtatagcgtttattgttttaaggagatcccaaataattattgctacaaaacaatgtcgttttcgtttggtgccccacctaaaactacgacagcttttgctttaccgacatctacaaccgttacaaaagcagccactacaagtgctcctactttacaatttagcttcggaggagcaacaccatcgcctattacttcaacaggaccctcgacaggtcttcagtttaattttgggggtgcgtcaacaactcctgcaaatgctaatacatctttgacaaccagttttactccaattttagctccagccagtgcagctactaatacaggtattacattcggtacaccagcagcaacagttggtgcttctacagctacatttggtgcaccaacaacgacatttggtgcaccaacaacgacatttggtgcgccaaccactacatttggtgctccaacaacaacatttggtgcaccaacaacgacatttggtgtcccaacaacaacaacaactgcagtagttttgggtcaaactacatcagtagctcctgttacaacttctgctcctagttttcctagtagatctatagcagcatctaatgtagccccgacagtaactacaaccacgacaacatcaattccagcaacaggatctttaacttttgttcaactggaagatctaatcaataaatggacgattgatttagaagagcaaggaaagtattttgttaatcaggctaaacagttaaatgcctgggacactttgttgatttccaatggtgaaaaaattttaaacttaaacagcagcattgaaagagttaaacagcagcaatcgcagctagatcaagagcttgattttattttagctcaacaaaaagaacttgaggagctcattgtccctttagagaaagaattggttgatgttccagtgacggatattgatagaaatcaaatgtaccagtttgctgaaataattgattcacaattgaagcaaatctctgatgatttgaaggaaataattgagaatattaatgaaactaacaaagatgaggaggtgtccaatcctataacacaaatcagtaaaattctgaacgctcatatgaactcactgcagtggattgatagaaacactgccgaaattagcagaaacttggaagaaatttcgaaaattgaagatgcaaacaggaggaatttgagtctgaacagttctctcaatttatttcagtag

SEQ ID NO: 87 - DNA, 636 bp, Sitophilus oryzae
  misc_feature (566)..(566): n is a, c, g, or t
atgtttatttgggactggtttacaggcgttttaggatatttaggtttgtggaagaaatctggcaagctcctgttcttgggcttggacaatgcaggcaaaaccactttattgcatatgctgaaggatgatcgacttgctgtacatcttcccacacttcatcccacatccgaagaactctcaattggcaacatgaggtttaccacatttgatttaggtggacacgttcaagcaagaagagtatggaaagattacttcccagctgttgatgccatagtattcctagttgatgcaagcgatagaatgaggttcgacgagagtagacaagaactaatatccttgctgacagatgaaagtttggcaaactgccctgtattgattttgggtaacaagattgatttgccagttgcagcttctgaagacgaactcagaaatgtatttgcattgtttggccaaacaacaggaaagggtaaagtaccaaggtccgatttacccggtcgtcccctagaattgttcatgtgctccatcctccagagacagggatacggagaaggttttcgctggttggntgttcatgtgctccatcctccagagacagggatacggagaaggttttcgctggttggcgcagtacattga

SEQ ID NO: 88 - DNA, 624 bp, Sitophilus oryzae
agctttggaactgcaaatcaattttttattttctttttcttaaaactaagcacaaaaaattcagatatggatgccgttgacttattagagaaacgtatagaagctttggaactgcaaatattgccaaaagacaaatcagttctcagtaacaaatctcaaaccattgccgatcttttaactgaaacccaaacaatgatatcttcagctcttagctgcagagaatcggttacatcgctcttacaacatatgcacacaatcaatgagtatctcgacccatcgagtggtgaatatgatttagaagctgatataaaaaagcagtatttgttgcagatatatccagagttaaaggcaagagttgaactcattaaaacgttcaacaatctcattcagtttactaattcggaaagtcttcaaaaagttactgaattatcaggtaaattacaaactttggctggttcaaacgtggaaatttatgaagaatgtaaagaggttaacgaaaatgtcctcaaagccttacaggagtacaataatataagtaacactattaaagtattgtttactcaaatggataaagacatatctcagtttgagtatacccaaaatattaaaatttccacagaataa

SEQ ID NO: 89 - DNA, 1746 bp, Sitophilus oryzae
atgtctaattccgatgtatacaacgacctaactttgtacattactcctgagaaattttatatagaaccaaaaactagtgatgaattgttagtaattgatcgtggatcggaagctgtaactgtacatcgaaacacgggtcaaattccggcagctaatagtaacaaagacttttgcgggcttctcggatctattaatttgttggctggaagatatttaattatagcaacacagagagatttgattgggtatataggtggtcatccaatatggaagctagttaaaactgaactgataccatattgtcgcagtatgcttcatttgaccaatgaaaagttagctgacaacaatacttatgtgaatatggtagaaaatgtgttagcaactccaagtttttatttcagctatagttatgatattactcattccattcagaggttgcatgatcttacacctgatttttggcaacaatccatgttacaaagggctgataataggtttgtttggaacagatatcttttagaacaatttaaggagacaaatgctaaaaggttttcccttcctttattacatggatttgtttcaattaaccaatgtgtcataaatggtcgtaattttacttgggcaattatatctaggagaagtatttatagagctggaacaagatggtttagaagaggcatagataaggatgggaatgtagctaattttgttgagacagaacaaattgttgagtctagtgaaggtgatagagctagttttgtacagataagaggttcaataccactcttttggtatcaaaagccagatttgcggtacaaaccaagcataactttggacttgggagtggatgttcaagatcaacaagctgcttgcttaagacatctagaaaccacagcaggtatatatggcagacaggtcatgatagatttggttgatcaagtgggctctgaaggtcgattggagaaggcatttaaggacaccataagctatttatctcatccgtcagttcgttacgaaccatttgacttccacgccgaatgtcgaaaaatgaaatggcacagactatccatattgacagatagagttgctttagatcaggatgatatgagttatttcctaattctttctgatggaacattttcttctttgcaagaaggggtgttccgaacaaattgcattgactgtttggatagaaccaatgttgttcagagcatgttggctcataggaacttagagattgtattgaggaaatttacgatcttgagctatgatcagaagttagaagattatcggacttttgagtcattgtttaagaacgtatgggctgatcatgctgatttgattagtatacagtattcaggcactggggctttaaaaacggattttaccagaaccggtaaaaggacgaaatcgggcatgatccaagatggtatcaactcgctgatccggtattacaagaacaactttaacgacggctccagacaagactctatagatttgtttctgggtaatggaaaggtggtatctcctttggccccaccccctggttggagatacattaccttcccttctgttttgctagtggccacagcaatgtttgtcgcttctgtcatattccccgccgagtactccagtgagtgcctgttgtacctaatgttttggggcggcatgatggcttccacaacttactatatattccaatatggcgtcgaatttgttgacaggcctaagttgacgcctacgtaa

SEQ ID NO: 90 - DNA, 1725 bp, Sitophilus oryzae
  misc_feature (1393)..(1393): n is a, c, g, or t
atgcctcctacaatacagaacgggtcaaatcccgttgaaaaacgccctgaaaggccgacgaaacctgttgaaaaaaggtcggatttaatatgcaaagtaaagtactgtaacactcttccggatataccctttgatctaaagtttatttcctacccttttgagtcgtccaggtttattcagtacaatcctacatctttagaaagaaactaccgctatgaagtgttaacagaacatgatctaggcgttagtatcgacttaatcaataaagatatatatgccgtcgatcacggggctactttagacccggcagatgagaaattactggaagaagacatcctgacgccacaggattcgaaaagatcccggcaccatgcaaaatctgtgtcctggttgcgtagaactgaatatatttcgacggaacagaccaggttccagcctcaaactatggacaaagtcgaggcaaaggttggatttagtattaagaagtcatttaatagtgaaacactttatatggaccgtgattctcaaatcgaagctatcgagaaaacattttccgatacaaaggtgcctattgaaaagcattatagtaagccaaatgttacgcctgttgaagttttgcctctgtatcctgactttaacttgtggaaatatccttgtgctcaggtcatatttgattctgatcctgctccagtaggaaagcaggttccagctcagattgaagaaatgtcacaagcaatgattcgaggtgtgatggatgaaagcggtgaacaattcgttgcatacttcttaccaactgaggaaacattgactaaacgtagagaagactttgctaataatgtaacgtatcgggatgatgaagaatacgaatataaaatggctagagaatacaactggaatgtcaaaagcaaagctagtaaaggctatgaagagaattatttctttgtggtgagacaagatggtatctattacaatgagttagagactcgagtaagactgagtaagagaaggcaaaaggttggtcaaggtcccagtaacaccaggctggttgttaaacatagaccgatgaatgaaatggaattcaagatgaagcggtacagagaaaagcagttagaaccgccaggcgaagatgacgaagaaatggaattggaagagcaacaagacgaacaagaacagcaacaaggcgacgacagtcatgcagagtccgatcaagagcaggaagagacaaaagatagtggaaatgagagcaacgaagagcaaaatgacaaagaaaatggcgtcagagaatcgagagcctcctcgagatcctcgagaaaatcaaaatcggcatctagatccagatcgcgatcagccagtggatcgagatcacattcaaaatccaagtccagatcaaggngatcgcgatcagccagtggatcgagatcacgctcaagatcaaaatccaagtccagatcaagatccaaatcaagatcaaggtccaaatcagcttccaagtcaccctctagatcaaggtctggatctcgctcctccaaatccccttcaagatcaagatctgcgtccaaatcccgttcaagatcaagatccagatctaagagtaaatctaagagcaggtcgccctctgggtcaaagtctaggtctgtctcaaggtccaggtcccgatctaggtctaaatctggctctagatccaggtctgggtcagaatcgcgttcaggatcagaaagtgaataa

SEQ ID NO: 91 - DNA, 1170 bp, Sitophilus oryzae
atgcctatcgaaaacctggaagaccaagggttggagaagaaccccgatttggaattggctcatttcaaattcttgcttacattgccagaataccgaaacgacaaaacagtccatgcaaaaatcaccgaagctataaaaaaagatgatatggctccttggtatgagttaatttgtcaagaaattggctggaaattggacgagaaattgttgaaaaccatcaaagcgaagaacgatgaacaagtgaagaaactaaacgaagctattgaggatgcagagaaaaatcttggcgaaatggaagtaagagaagcttatttaagaaaagcagagtattacagtagaatcggcgacaaagaaaacgctttaagcaccttcagacaaacatacgacaaaacagtctctctaggacatcgtttagacattattttccatttaatcagaatcgggttgttttttatggatcatgatgttatcacaaggaatattgataaagcaaaaactcttattgaggaaggaggcgattgggacagaaggaatcggttaaaagtatatcaaggagcttactgtatggctgtaagagattttaaaaccgcctcaaacttgttcttagatactgtcagtacttttacttcgtatgaacttatggattataaagcatttgttaggtacactgtgtatacttcgattataagtttacctcgtaatcagttaagggataaggttgtaaaaggctcagaaatattggaagttctacattctgaaccatttgtgaaagattatttgttctcactgtataattgtcaatatgcagagttttttggaaatctcgcaaaagttgaagaagttcttaggaaagattattttctaaatccccactatcggtattatgttagggaaatgaaaattttagcttatacacaacttctggagtcatatagaagtcttaccttgcagtacatggctgaagcatttggtgtatcaactgagtttattgatgatgaattatctacgtttatagcaacaggaaggcttcattgtaaaatcgatcgtgtgggtgggatcgtggaaacaaacaggccggatttaaagaacgcacaattcaattcggttgtgaagcaaggagatctattgcttcagcgcgttcagaagttatctcgcgtcattaacatttaa

SEQ ID NO: 92 - DNA, 909 bp, Sitophilus oryzae
gacgatgacaacactgaagatttgaaagatgttttggctttgtccggcgatctgttggaccctgatctggtgaacagtattattaatgaggaagatgacgacttaactaaaaacacggagttggaaacgttgggagatgagggagaattgtcacaaaccctgggaagcacggaaagctccaaagatgccaaagatgaacttagtgatattttaggacctcactttagcttggagtccatacaaaacattaacagcaaagacgttgaagacattttcaagggcgttttaactgacgagtcgcaagaatcgcaactgtcccaagaaactaacatatttcctcctatacaatcaagtacgcaggcgatgttcgccggaagcatgtcgcagccttcgcccgtttcgattccgcaaatgccacaaattacgtctggcgctgtgcgtccaaccgctttaccgggtgtacaacacgccagttttcctccatctccatatcactctgagtatagcaatagtccacaatttagtccagccttttccgaaccgcctagtccttgggtgagcatgagcgagggtgttgaaattgacagtaccagtgttggagtagcatccacgtataatcaacggtcgtcggagaaaatgaaagccgacgaagctctaggtagtggagccaccatatcagcggtactctacgccaacatgaatcatcccgaatggaagactgaatatcctgcgtggtctgacagatataaacaattaattaaaaaatggcgtactctaagtcaagaacaaaaggcaccttatcttcagcaagccagagacaatcgaagccagttgagaatgaaaaaacagcaacagtcacagaccgccaaggactcctccgcctcgagccccgtaccgggcccgaagccc

SEQ ID NO: 93 - DNA, 441 bp, Sitophilus oryzae
aagggtccctgctggttagatgttcgtaatcctgaactaaacaataacccactgagttggtgcaagtttgaagtaaattgtgtagtaaaaaatattgttaaagtcgatgaacagttagaaagaccgccattagttgtgtccgctttaaactttcgtcattatcgaaatcctagaacgcaccagaatgagattttgatgatatcttgtattactcaaactaaatattctgtggataagcaacaacctaagccaccttttaatgaacatttttgtgtttttacatctccagccaaacagccccttccaatgaacatttacgagtgcctaaaaacttataaaggaaccaaagtacaaaaaatggactccgaaaaagcgttactcaactattttgttactcagttccttaaaatcgatcctgatatgatcgtaggctttgatatg

SEQ ID NO: 94 - DNA, 1440 bp, Sitophilus oryzae
  misc_feature (149)..(149): n is a, c, g, or t
atggcggttgcagctgcagccaagattgccgaagtccgtgagacaacacgggtagagagaataggagcacattcacacattcgtggtttaggattagacgacagtcttgaggccagacatgtgtctcaaggaatggtaggccaagtatncagtcttgaggccagacatgtgtctcaaggaatggtaggccaagtatcggcaaggcgagcggttggaatagtgttacaaatggttcgagatggtcgaatagctggcagagctgttttattagctggacaacctggtactggcaaaactgcaatagccaccgcattagcagctgccttaggatatgacacaccatttacaagtatggctggctcagaaatatattctttggagatgagtaaaaccgaggctctcactcaagccattagaaaaagtattggagtaagaattaaagaagaaagtgaaattattgaaggtgaagtagtagaagttcaaattgaaagaccagctacaggtgtaggtaccaaagttggaaaattgatcctaaaaacgactgacatggagacagtatatgatcttggtggaaaaatgattgacagtattttgaaagaaaaagttcagtctggtgatgtaataactattgataaagccacaggcaaaatcacccgcctgggaagatcatttgcgagagctcgtgattatgatgcaacaggacagcaaacaagatttgtgcagtgtccagagggtgagcttcaaaaaaggagagaggttgtacatactgttactttacatgaaattgatgtaattaatagtagaactcatggtttcttggctctattttctggtgatacaggagaaattaaaccagaggttagagagcagattaatggcaaagtggctgaatggagggaagagggaaaagcagaaattataccaggtgttttatttatagatgaggttcatatgttagacattgaatgtttttctttcctaaacagagcgttagagaatgaaatggcgcctatagtaataatggctacaaatcgtggtattactaaaatcagaggaactaattacaaatcgcctcatggtattccattggatctgcttgatagaactataatagtccctaccacaccttatgatgagaaagaacttaaagaaattcttagtattcgttgtgaggaagaggattgccaaatgtcagataatgcattaacagtacttactaggatttctaaagagacatctttgcgatatggtatgcaacttattatgacttcaagtttgattgcaagaaagagaaaagctcatgaagttgatgtagaagatataaaaagagcatatcagttgttttttgatgaaggtagatcagtacagtttcttaaggagtatcaacaagaatttatgttcaatgaaatggagggggaagacaagatggatgtaaattag

SEQ ID NO: 95 - DNA, 1170 bp, Sitophilus oryzae
  misc_feature (1087)..(1087): n is a, c, g, or t
atgagtcttcgaacttatggtgataaaccaatcagtttccaactggaagaaaatggagaatattactgtgtcggatccgaagttggaaactacctaagactctttaggggttctctttataaacgataccctggaatgtttagaagggctataacaaatgaagaaaggaaaaagttaattgacttaggactctcacagcattgtcttgcaagtagtgtctctttacttagagctacagaagtagaggatattatagaagggaacgatgacaaatataaggctgtttcggttcataccagtgatcctcctctaccacgcgaaggtaagagcaaaaagaatttgcaatgggttccatccttaccaaattcaagtcatttggatgcagttcctcaagcgacacctattaaccgtaatagagttgctgccaaaaaagtaagaacatttccgctatgctttgatgatacagatccacagctaaatcaagagaatggttgtcagcacgaattgcttgttccaattcgacttgatatggaaattgaaggtcaaaaactaagagatacttttacgtggaataaaaatgaaagtctcataacaccagaacaatttgctgagattttgtgtgatgatttagatctgaatcctcttacttttgtgccagcgatagctcaagctatccgtcaacaactggaagcttttcctaacgaacctcctagtattatagaagagaattctgatcaaagagttattgtgaaattaaatatccatgttgggaatacatcattagttgatcaagttgaatgggatatgagtgagaaacaaaacaatcctgaagattttgctctgaaattatgttcagaattaggtctaggaggtgaatttgttacagctattgcatattctataagggggcaactaagctggcatcaaagaacttacgcttttagtgaagcgcctctacctacagttgaagttccatttagaactccttctgaatctgatcagtgggctccatttttggaaacattaacggatgctgaaatggagaagaaaataagagatcaagacagaaataccagaagaatacganataagagatcaagacagaaataccagaagaatacgacgattggccaatactacccccggttggtaaaaaatattattatttaa

SEQ ID NO: 96 - DNA, 702 bp, Sitophilus oryzae
atgttctgttgctgggccccgcaagaggacttcggaaaaggtccgatggctgccatacgaaagaaattggtgatcgtgggcgacggtgcatgcgggaaaacttgcctgctgattgtttttagcaaggaccaatttccagaagtgtacgtgccaaccgttttcgagaactatgtggccgatatcgaagtcgacggaaaacaagtcgaattggccctatgggatacagcaggacaggaagactacgaccgtctgcgtcccttatcctatccagataccgacgtgatccttatgtgcttctctgtggattctccagactcgcttgaaaatatcccggacttatcctatccagataccgacgtgatccttatgtgcttctctgtggattctccagactcgcttgaaaatatcccggaaaaatggactccggaagtgaaacatttctgtccgaacgtccctatcattctggtaggtaataagaaagatttacgtaacgaccccacaactataaacgagctaagaaagatgaaacaggagcctgtcaagcctcaggacggtcgttcgatggcagagaaaattaacgcctttgcttatctcgagtgctcagctaaaagtaaggaaggtgtgagggaagtgtttgaaaacgccactcgcgccgctcttcaggtgaaaaagaagaagaagcatcgttgcattttgttctga

SEQ ID NO: 97 - DNA, 3846 bp, Sitophilus oryzae
atgcctttggcgttaagtaatttaactcaaattaaaacaataaataatgttccgctaccgccagaaattgtagaccattttagtcatgtacagtgccattgtatgatgggaatatttccagacataaatcgtgcttggctaacagtagacagtgatatctacatttggacttacgaagaaaatactgatttagcctattttgatggcataaatgaaacaattttatgtgttgggttaataaagccaaagcctggcgtatttcatgcttttattaagtacttattggttttaacaactgcagttgatattgttgtgctgggtgttacttttactgaaggtagtactagtggcttggaagagattcagttaatatctgaccctgtttttacactcccaactgatggaaatactattactactattgctgcaactgcaaatggcaggctatttgttggaagcaaggaaggatcgttatttgaaatatcttatcaggctgaaagtggttggtttggaaaacgctgtaaaatgattaatctttccacaagtgcattatcatttttggtaccttcatttttgaatgctgctcttagcgaagaagacagtatcgttcaaattgctattgatgacagcagaaatataatgtatactttaacagaaaagggatcaattgaagtatgtgatttaggagagaaatgcaacactttctcaaggattagtaaaatgacacagaacactttagttactcaagcaatgaatactgtcaagacattagatagtcaaaattttagaccaatcattagtatttctccgattgagtcttatgaatctgcaaacctaaatcttgtagctgtcactcaaacaggtgttagattttatctatcagttgtaggattatctaatcaacagcctaatcagaggccttatacattaactttagctcatgttagattgccaccaggttattcagccaatgttactgttaggccaagaagtgttcatatgagtcactacagagacagaaacttgattttaatatccaatgtaaaagataaggatgttttgtggtgtttaagttctgacttatttcccttcagtcagtctttaatggaagcttatactacagttaatttagatggcccagctctagctttagcagaggtgcgacacaataattatttgcaaataagcccagatcaacaagaagctccacctttagtagtaagacaacatggggaagctcctaaaaaatatgtagtgctaacgtcacatagtgtacaaatatttataaaactaagacctgtagatttgcttcgacaaattttaagagatagtcacggccaagacacagaagctcttagagcattttttatgattcaaaaagaaagccaggcgtgtgccacaagcttaattttggcttccttggaaagtgaagagaatgccgaaattgctgaattggccactagggcattttttatgtttggaggtgaaccaaaaatttcaccccttaatcagactaatgttttctcaggtaccacaatgttttcacctaatataatatctactcccgcacctccacaatatcagcaaagtggcttcttacctcagtcgcctggtggagcctattctcaatcaggatatttacaaggtagtttttctcaaagtattccgcagcagacattcgatcctgcaaacttgattagttattcaaataaacacaatggtctgtatttgtatttgggtcgaatattgagaccagtctggaataggagatgtgtagagagaatctgtccagatgggaaaactgttctgaaccaaagtactattactgttgaagattgtgtccagattcttaacaatttgacagcacttcacaattttctgtccttaaatacacaactttcaacaacatataatgcatctactcaatataattcaacaattaaggctaactctctaacgacatctcatatgaatcctactcctcaggatatacaggtagaagagaggcattcgttagatgctttaaaaacttttgtttgtcattgttgtcaaataatcggtctatggaggatactttgtgatcatcaatttcacgaattagttggatctttacctgaaaaccaacaacagattcttcagagtataacttttaaagaattatttttatacaggcaagatatttgtagtgttttgattaccacccttgtgaatagttatctcggagataatgcttctgttgattcaataagtaacaaattgattgaagtatgttctcatttatacaatacagaaaatgctgaaatttcaaaggctagcgaattattaaaaaccactaggacaatacaaaatacagatgagaaggaagaaatgctagtatctgcattacagttatgtaaaaatatagctcctaatgtaaatctacctgaagtttgtaagcaatttacaacattgaaagcttacaaggctgttatagaattgtgtgctttttgtgcacataaattagatccagataatattggtggaaacttttataatagtgatgacaacgctggagatcaagaaggttttagttactatcagagaaggatggaaatatatagagaaatagtagtaatgttggagacactttacaatgaacaagagccaattgtcaagcagaattttgaaccagattattcaaatagcaaatctgttcttttagaaggaatgggagaaactaagttagatactactttacatcaaataatagatgaaatcttgttttatgatgatgaattaatgcatatagctctttatgagtggatggttagtaaacagatgaccaacgatctgattaaaatcggtaaaccttcattggaaaattacctcaaacgtacatctattcagacgccagataatatcgctgtaatggatcttttatggaaattttatgaaagcaataataaccatgcggcagctgccaaaatattaaacaatttagcctcgagaaccggacatagtgtgaccctaaaagaacggatagtgtatttagcgcgagccatcatgtgtatgcgtagtgacaaagtcggttatgcaccatatttaggagttttcttaagagatttagaggataaaatggaggtggccaaagtacaagaacttattttagaccaaataactaatatgcgagatcagattcctaactcaaaagaagcaattgctgcattaaatagtggattatatgaaatatctcagctttatgagaactttgcggaaccattcagtcttttagaatgccagttagctattattgattgtgcaggatatactgaaagtgataatgctttagtaaaatcaatatggcaacaaattctagctaatgaactgagaaagtcttcaggtagtggcactgataggatgagtcaggttctaagtaaagtaaaacatttagcaagacaatacattaactcaaataattgttttccacttgcttatatagtgggagaattagaaatggttaatgcaaaacttaaaggagataaacatttggtatcaactatgttagcatccgtgaatattccatttgaaaggttaattcaagtatacaaccatttaattactttgtcagtaaatttggatttctggcaaagtgaagaaaatgaatttcatttgtctgaagcaacggctgcattaataacgtgttttttaaataaccacgattcatttaatagtgtggaaaagcgaaaaattactgccatttgccaagatacagtagcagcattattatcaaatctttacagtaaagcgaatagcgatcacgttgttaaccgcatcagatcaattcaagcaaaactgtcccgaatttga

SEQ ID NO: 98 - DNA, 384 bp, Sitophilus oryzae
atgtctgaattcacactgagttatcgagaagtgacccccgatcaagccctgtacgaaaaatggatcgaaataacattacacacagggggcacccagagcacattgcaggacataaaaatcaccgaacgagctaatgggtacagttacttagattccacaagacattatacaagaaatcggtttatatattggcgaattagctcggataccttggagctaattgagcagagtttagatataaaccttacgggaaacactgtgaggtacaggtttatggatagtccgataattgatggtatttcagtacaagaaactgaagaaaacgtaattattttggttcctacagtttgtagcgtgcatatgttaagatttcctcatccttca

SEQ ID NO: 99 - DNA, 2967 bp, Sitophilus oryzae
  misc_feature (2026)..(2026): n is a, c, g, or t
atggaaatttcagacgaaaatctacgcaccttgggcaaatacttatttgaaacattaaatgccgatgttaccgtccgtagaacagcggaaaaatttctagaaggtgtcgaagttaatcaaaattatcctcttttattgcttcatcttgttcatcaaccagaaacagatatgctgatcagaacagccggtgccatagcttttaaaaattatatcaagcgaaattggactgttgttgaagatcaggcagatcgtattcacgaatctgatagaacttcgataaagaatctaatagtaactattatgcttacggcccctgataatatacaaaagcaattgagtgatgctataagtataattgggaagactgattttcctacaaaatggccacaattgataacagaaatggttgaaaaatttgctataggtgattttaagataataaatgggatattacgtacggcacattccttatttaaaaaatataggtatgaatttaaatcaaacgagctatggactgagataaaatacgtcttggaaaaattagcaaaacctctaaccgatcttcttgtggcaacagcaggtgttatttctgcaaatgcatctgatattgtagcatcacaattaattttcagctcgctagtgttaatagccaaaatcttttattctttgaatttccaagaccttccagagttctttgaggataacatggaagtttggatgaatcatttccatgctttactgaatattgaacaggatactttggaaacacccggaatagatgaaccaggtgttttgcaaatgcttaaatcccaaatttgcgataatgtggcactttatgctcagaaatatgatgaagaatttcaaaaatatttaccacagtttgttgaagatgtttggagtttgttgagcaagactggattgcaaccaaaatatgatttgctggtttccaatgcattgcaattcttatcaacagtagcagaaagaactcattataggaatttatttgaaaatcctagtgttctaagcagtttatgtgagaaggttgttattcctaacatggaatttagggtgacggacgaagaacttttcgaagacaacccggaagaatacacgagaagagacatcgaaggttccgacgtggacacgcgcaggcgcgccgcttgcgatcttctcaacaccctaagcatccagttcgagccgaaaatcatggagatctgcgggcagtacctccaggtgatgttatccaagtacgtggagaatccgaaaaccaactggcgcaacaaggacacggccttgtacttggtcatatcgctggtcagtaggggatcgacgcagaaacacggcgtcactcagacgagtcagctggtgaacatcagccagttttgtcagcagcagatattgccagagctggagaggcctgatgtgaatgaattaccagtacttaaggctgacgccatcaagtacataatgacgtttaggtcagtattaccgaacgaggttgtggtttccaccctgcctcaactcatcagacacttgcagagcgaaagcgcagtcgttcatacttacgcggcttgcgccattgagaaaattctaattatgaaagacagcaacaatcaagctatagtttcaggaggtcatattcaaccgtttgccaaggatttgattagtcaattattggaggtgttggagagacctgtatcagaggaaaatgaatatattatgaaagctttaatgaggacattttcgactctacaagaactggttataccctacttgggcgtggcattaccgaaacttactgaaatacttaaagctgttacgaagaacccatctcggccacatttcaatcattacttgtttgaaacgttctccctttcagtcagaatcgtatgtaaatctaatcaggctgctgtaaaatcgtttgaggacattttgtttccgattttccaaggaatcttgcaacaagatgtacaagagttcatcccctacgtcttccaagtattatcaatgctattggattacaccntacaagagttcatcccctacgtcttccaagtattatcaatgctattggattacaccccttcaggatcgttatctgatgcatacatgcaacttttaccatgtttgttggcccctgtactttgggaacgacctgctaacatcagcccgttagtacgattgttacggtcgttggtaagccaggcggcccaacagattattgctcaggataaattgcctggctttttgggcgtgtttcaaaaactgatagcttcaaagaccaatgaccatgaaggattttacttaatgcaggcacttattttacattgtcctaaggaatgtttgcaaccatacttgaaacaaatatttttccttctattccaaaggctgtcgtccagtaaaaccacgaaatatgtgataaatgtaatcgttttcttctcgttatttattatcaaatactcggcaagtgatttaatcactatgatcgatggaatccaagatcaaatgtttggtatggttttggaaaaactgttcatcgcagagacacaaaaagttactggtcaaattgaaagaaaaattgtttcttgcggaataacaaaactgttgtgtgaaagtcccgagatgtacacaggaaaatatgcaaaatattggaatcagcttttacaggcacttttgatgttctttgaactacctccagatgaaagcaccttcccggacgatcattttatcgaagtagacgacacacccacttatcaaacgtcaaatgccaagctaaatttcgcaaacgccgacaaagaagatcccgtagctggtttaggagaaccaagacaattcttagtccaaagtctagcaacgctaggtgcgtcacaaccaggtcgtttgcccactctcatcagtaacacagctccacaatcgcaaactgttctacagacatatttggcaaaattcggcgtccagctcgtttaa

SEQ ID NO: 100 - DNA, 636 bp, Sitophilus oryzae
atggcaaaagttcagctatgtaatattactgttatggataatcctagtccttttcttaatccatttcagttcgaaattacatttgaatgcattgaggaacttaaagaagatttggagtggaaaatgatttatgttggatctgctgaatctgaagaatacgatcaaattttggattcggtatttgttggacctataccagagggcaagcacatgtttgtttttcaagctgatccaccaaatgtctcaagaataccagaaaatgatgccttaggagttacagttgtattactaacatgttcataccgtgctcaagtactaacatgttcataccgtgctcaagaatttatacgagttggttactttataaacaatgagtataatgatccagagttacgagaaaatttgccaagtccacctcaatttgataaagttacgagaaatattctggcatctgaacctagagtgacaaggtttaaaattaactgggaggagcctaatgcacaagaagttgtgtcaaatttagagaatacagaaaatagttcgattacgactgaacaaagtaataatgcaactcaatcccaaattcctagttttaatgataattcaaactcatgggcaacaatggaatgttcttaa

SEQ ID NO: 101 - DNA, 978 bp, Sitophilus oryzae
  misc_feature (828)..(828): n is a, c, g, or t
atggatcaaatgctaccgagtcccgggtttagcatccctagtattggaactccactacaccaacctgaggaagaccaacagattttaccaaatgcattacaacagcaacaacagtcccaacctgccaccagtcaagtaccatctttagctccgatgggaggtctaacgcccacattaggcctgggcatgggaaatgccatgtccatgccacacacaaaatacgttacagcttatcaaatgcctatgtccactatgcatagtggaatgacccctcaaacaccacagcacactatgatgtcacctatggtaaacttgggtggttcggggggtagtggtgccactccaaatgttggcggccctgctactccttctcctatgactccgatgactccacattccgcagacccaggaattgtaccacaattacaaaatattgtatcaactgtaaacttaaactgtaaattagacttaaaaaaaattgcgttgcatgctaggaatgcagagtacaatccgaaacgttttgccgcagtcattatgagaattagggagcctagaactacagcactgatatttagttcgggcaagatggtgtgtacaggggcgaaaagtgaagaggattctagattggcggctagaaagtatgctagaataatacaaaagcttggattcccagcgaaatttctggattttaaaatacagaacatggtaggcagttgtgacgtcaagtttcccatccgtctagagggcttggtattgacgcacagttctttcagttcctacgagccggaactttttcccggtttgatctatcgtatggtgaaacccagnggtttgatctatcgtatggtgaaacccaggatcgttctgttaatattcgtgtctggaaaggtggtcctaacgggagctaaggttaggcaagagatttacgaggcgttcgataacatctatcccattttgaagagtttcaaaaaacagtga

SEQ ID NO: 102 - DNA, 477 bp, Sitophilus oryzae
atggccgccatcagatcaatgtcccgtcttcttacaagcagatcccttagctcaacagcaaaaagatgttattcggaagaaatgaactttacttttgcctcaggaaatcaaatattttatgatggaaaaagcgttaaacaagtagatgtcccttcgttttctggtagttttggtatcctacccaaacatgttccaactttggcagttttaagaccaggagtcgtgtctgtatatgaaaacgaaggagctgttaagaagatctttgtatccagtgggactgtcacaattaatgatgattcctctgtacaaattatcgcagaggaagctcatcctgttgaaaatatagatctatcagctgccagagatcttttaagtaaagctcagagtcaattgtcttcagcagccaatgatcaggctaaggctgaagctgaaatagccatcgaagtgggagaggcgttagtaaaggctgctgagtaa

SEQ ID NO: 103 - DNA, 990 bp, Sitophilus oryzae
atgagcggtgacggtaacaaaacggaccagtttgataccctgttcctcagtattgcacaacaccatccagaaggggcccatcagcttttagacacatttgttggatttctcggtcgaaaaactgatttcttcaccgggggaaatgaaggggattgggaaaaacttgtcatgaatacatttaaaaaacacgaaaagatcagccgttctcggcacgacgctgaagtaaaggagcgtaaagatagagaagccgctaaaaaagcgaaaaaggctgaagcggaagctgtaaaaccagcagaaattactgaattgacagatgaagaagctgaccgtcttcagaaagagattgataagaaaaagggaattgatgctgtcccttctgtgataaacaacgaagaatctaatccttccacgtctgcaagttctgcagagaaaattgaagaggacgaagatgagtccgagaagggaaaattaaaacctaataaaggaaatgggtgtgatttggagaggtataaatggacacagactctgcaggatattgagctccgagtgcccctagaaatcaactttagagcgaaacaaaaagatctggtagtcaatcttgccaagaaacacttgacgtgcggcgtcaagggtcagccaccaatcatagacgacgacttacaacacgagatcaagctggaagagtccacgtgggtcatcgaggatggaaaggttttattatttaatttagaaaaggtaaacaaaatgaattggtggggaaaactggtacagtccgatccagaaattagcacgaagaaaatcaatcctgaaccttcgaaactgagcgatttggatggtgaaacccggggtatggtagagaaaatgatgtacgatcagcgacagaaagagatgggactacccactagcgatgagcagaagaaacaagatgtacttaagaagtttatggaacaacacccagaaatggatttctcaaaatgcaagtttaattaa

SEQ ID NO: 104 - DNA, 459 bp, Sitophilus oryzae
atggccacatattccggagcccctcctgtattacagtggagtccagacaagaaattcagcgaccgagagaggtggatttgtatctatcccgcttacataaacagcaaaaaatccatcgccgagggtaggaggattgcaaaaagtagggcagttgaaaatccaacttatcaggagatacgagatgttttagttgcttcaggattaaatgttggcgtggaaaacaagcaatatagtcgcgaacgcagcaaagaacttctatgcaggggtagaatcagggtacagttaaaacacgacgatggttcactctacaactcctcatttcctaccagagacagtgtattgttgcatttgggtgacatgataccgaaactgaagacccgacttagtaaaccttctggtgaacagcaaccgcagagcagtcagggtaaaggtaaaggcaagggaaaaggcaggagataa

SEQ ID NO: 105 - DNA, 2133 bp, Sitophilus oryzae
  misc_feature (1201)..(1201): n is a, c, g, or t
atggaaggcaaagcccaaaagatgcccaaagtggcgaaagttaagaataaggctcccgcggaaatccaaattacagcagaacaacttttaagggaggccaaagagagggatttagaaatattaccaccacctccgaaacaaaaaatatcagatccagctgaattagccgattatcagttgagaagacgtaaacaatttgaggataatattcgcaaaaatcggactgttatttccaattggataaagtatgctcagtgggaggaatctcaaaaagaaatacaaagggcacgttcagtgtgggaaagggctctagatgtagaccacaggaatatcacaatatggctaaaatatacagaaatggaaatgcgaaatcgccaagtcaatcacgcaagaaatttatgggacagggctgtaacaattcttccgagagttaatcagttttggtataaatatacatacatggaggaaatgttagagaatgtgcctggagctagggctgttttcgaaagatggatggaatggcaacctgatgaacaagcttggcagacatacattaattttgaactgagatataaagaaattgatagggcaagatcaatttacgaaagatttgtggtaactcatcctgctgtaaaaaattggatcaaatatgcacgttttgaggaaaaccatggctttattcatacatccagacagatttttgagagggccgttcagttttttggtgatgatcatatggatgagagattgtatattgcttttgcaaaatttgaagaaggacaaaaggagcacgatagggcaagagttatttataaatatgcattagataatattccaaaggatcaaactaaagagctctataaagcttatacaattcatgaaaagaaatatggtgatagaagtggaattgaagaagttattgtttctaaaagaaaatttcaatatgaacaagaaattactgagaatcccacaaattatgatgcttggtttgattacataagactggttgaaggggaaggagatgtagaaataattagagaaacatatgaaaaagcgatagcaaatatgccacctacaagaaacaaagactactggcgaagatacatatacttatggataaattatgcatttttcgaagaattagaagcacaagattatgaaagaactcgacaagtgtataaggcctgtttggagctactanactggcgaagatacatatacttatggataaattatgcatttttcgaagaattagaagcacaagattatgaaagaactcgacaagtgtataaggcctgtttggagctactcccccataaaatatttactttttctaaaatctggttgttattcgcaaagtttgaaataagacagaaaaatttaacagcagctcgaaaaatattgggcacttccattggattgtgtcctagagataaactgtttcggggatatattgatttagaaatacaacttcgagaatttgatcgcagtagaaaactttatgaaaaatttttagaatttggaccagagaactgcgtgacttggatgaaattcgccgaacttgaaactcttttgggtgatattgacagagccagagcgatttacgaactggcagtaaatcaacctaggttagatatgccagaacttttatggaaagcatttatcgattttgaaatatcccaagatgaatcagataatgccagacaattgtatgaaagacttctagagaggaccactcatgtcaaggtgtggctatcatatgctaaatttgaattaaatcaacaaacggatgatggtttaaatattaggcttgctcgaagaatttttgaaagaggcaatgacaatctgaaaaattcagtagagaaagaaagcagagctcttttactggaaaactggaaggaatttgagctcaaccatggcgatgagtcttcccaagcaacaataaatagtaaattgcctaagagaattaagcgtagacaaaaagttgtcgatgaggatggtaatgaacaaggttgggaagagatatttgattatatatttcctgaagatgaatcaagcaaaccgaatcttaaacttctcgctgctgcaaaaagttggaaaaaatctgctgcagttcaagacgaagcagtttag

SEQ ID NO: 106 - DNA, 1431 bp, Sitophilus oryzae
atggggataaaatttctagaggttattaaacctttttgtagtattcttccagaaataggcaagccagaaaggaagattcaattcagagaaaaagtactatggaccgctattacattatttattttcttagtatgttgtcagattcctttattcggaatcatgagttcagattcagcagatccattttactggatccgtgttatcctggcttctaacagaggaacgcttatggagcttggtatttcccccattgtaacttccggattgattatgcagcttttagctggagcaaagattattgaagttggtgacacccctaaagaccgagccttgtttaatggtgcccaaaaattattcggcatggttatcactgtcggtcaggcaatagtctatgtaatgactggaatgtatggagaccctgcagaaatcggtgctggagtgtgcctgttgattattatccagctttttgtagctggtttaatagtgcttctccttgatgaacttctccaaaaaggatacggtctgggatctggaatttctctgttcattgccacaaatatttgcgaaacaattatatggaaggccttctcaccagcaactgtgaacacaggaagaggcacagaattcgaaggtgctgtaatagcattgttccacctcctcacaacaagacaggacaaaattagggctcttagagaagctttctaccgacaaaatttaccaaacttgatgaaccttcttgctacagttttggtgttcgctatagtgatatacttccaaggatttagggtggatttgccaatcaaaagcgctagatacagggggcagtattctagctaccctatcaagctgttttatacatcaaatattccgattattcttcagtctgcgttggtgtcgaacttgtacgtaatttcacagatgttggctgttaaatttcaaggaaatatcctcattaatttgttgggagtttgggccgatgttgggggtggtgggccagctagatcttaccctataggaggtctgtgttattatctatcacctcctgagagtgtaggacatatactggaggaccctcttcatgctttgttatatattattttcatgctgggatcttgtgcgttcttctcaaaaacctggattgaagtatcaggaagttcagctaaagacgtagccaaacagctgaaggaacagcaaatggttatgcgaggacaccgagataactcaatgattcacgaattaaacagatacatccctactgcagcggcgtttggggggttgtgtatcggagccctgtcggtcttagctgactttttgggtgctatagggtctgggacgggtattttactggctgtcacgatcatataccagtattttgagatatttgtcaaggaacaaagcgagatgggtggtatgggagctcttctgttttag

SEQ ID NO: 107 - DNA, 519 bp, Sitophilus oryzae
  misc_feature (41)..(41): n is a, c, g, or t
atggcaacaaatacttccccgtccatcgatttgagttcttnaacaaatacttccccgtccatcgatttgagttcttaccgtgatcaacatttcaaaggtacacgagctgagcaggacaaattattaaggctctccactacactctatgtagggaacttatcgttctttacaaccgaagaacaaatttatgaactattttcaaagtgtggagatataagaaggattattatgggtttggataaatataaaaaaactccttgtggtttttgttttgtagaatattacactaggcctgatgctgaaaattgtttaaggtatgtaaatgggacacgtcttgatgatagaattgttaggacagattgggatgctggatttattgaaggacgtcaatatggtagaggaaaaactggtggacaagtaagggatgaatacagaacagactatgatgcaggaagaggaggatatggaaaaattattcaacaaaaaatcggtacagaggtaccagcctttttaagatga

SEQ ID NO: 108 - DNA, 942 bp, Sitophilus oryzae
atggctgccacagttggacgagtctgcggtgctggacttttaaaatcgaaaacagggccttgtttgagtcagataagctcctattccacgacgagagaatggtcgagaggcaaaaaagcacttttgggaagtttaggtgtaattgctgggggagccggagccttaatcatagctctggataagtcagtacgagcttcagaactcatactgcatcctcccaagaatccatggagtcataacggctggttcaatggtttagatcatgcgagtgtgagacgtggttatgaagtttataaacaagtatgtgctgcgtgtcactctttacgttatgttgcttaccgtgacttggttggtgttacacacactgaagaagaggctaaagctgaagctgaggaacagttagtgacagatggcccagatgaggcaggaaatatgttccaaaggccaggaaagttgtcagactacttccctagtccttatcctaatgaagaagcagccagggcagccaataacggtgcttttcccccagatttgtcttacattgtacctgccagacatggaggtgaagattatatatttgctctacttactggatattatgatgctccagcgggtgttgttttgagagaaggtcaatactacaatccctatttccctggcccctatttccctggcggtgctatttctatggcacaagctttatacaatgaagttatagaatatgctgatggtactccagccactgccagtcaactagctaaggacataggaacgttcttaaaatggaccgccgagcctgaattagaagaccgaaaaataatgacgattcgggccattggtatattctccatattgattgttctgagttactacgccaagcgattcaagttcgcttcattgaaaacgagaaagatcgagttcaaacctaaagagaaaaaataa

SEQ ID NO: 109 - DNA, 1725 bp, Sitophilus oryzae
atgttatcactgcaagcttataatagtagtagtgatgaagaatctgatcaaacagcagttcaagaaaaatcaaatggaacgccttacgaaactctaccgccggaactccaaaagttttcatctaaaaaagatcttcaggtttgtgcaacccccgtagtcttaccccccgctatagatgaagataaaattcatattcaccctgatacatcagagctccagtataacccaaaatatgatgaactatttgcaccagtcgtagggccagtaaatccttttaagacgcaacaacaagcaatcgaaagaaatatactatcagggcatattgagcctgcacatgtcagtgaatttcagtttgagaatcaaaggcgaacgtttgctagtttcggttatgcattggatccttcagtaagtactaccgaaaaggaattacataaagtaattggaggatcagaagaaacacctgattcagatatgaaaaccgtttttgaaaatactaaattgagaccattagataaaagaaaaagaaagaaaaatgatgatccaagtgatgtagaaggatttttaggtccatggggtggatttgttggagaacaaagagtaatgaaaccaacagaagaagagcaagccgagcttcaagaactggtttctaaaagaaataggcgagggaaagaagtggaagaaaaacaatttgaagaaaaatctgttctgcatattaaagatgcagttgattatcaaggaagatcattcttgcacgctccccaagatgttggtgttaatcttaagtcagacactccaccagaaaaatgtttcttgccaaaagctcacattcatacctggtctggacatacaaaaggtgtatctgcaattcgatggtttccaaaaacagcacatctatttttatcttgtagtatggattccaaaatcaaactctgggaagtttacaacgaaaggcgatgtatcaggacttattatggccacagacaagcagttagagatattaacttcaataatagtggacatcatttcctatcagctggttacgatagatatatcaagttatgggacactgaaactggacgtgttatatcgcgatttactagtagaaaaataccttactgcgtaaaattcaatcccgatcataataagcagcatctgtttgtagctggtacgtctgacaagaaaattatttgttgggatacaagatcaggcgatattgttcaagaatatgataggcatttgggcgctgtaaataccataacttttgttgacgaaaacagacgttttgttactacttccgatgacaaatcattaagagtgtgggaatggaatataccagttgatatgaaatatattgctgatccgactatgcacagtatgccagctgtaactccaagtccaaatggtaaatggttagcatgtcagagtatggacaataaaattgtgattttttctgcattaaatagatttaaactaaacaggaaaaaaacatttacaggtcatatggtagcaggatatgcctgccaattagatttctcacctgatctttcgtatttggtctcaggagatgctgacggaaaatgttttatatgggactggaaaaccaccaaattgtacaaaaaatggaaggcacatgatggtgtgtgtattggttctctttggcatccccacgaaccaagtaaagtgatgacagctggttgggatggtttaattaagtattgggattaa

SEQ ID NO: 110 - DNA, 828 bp, Sitophilus oryzae
atggtgcagaaaaaaccgaagaagaaggtcggtaagaaggttgccgcggcccccctggttgttaagaaggttgagcccaaaaaggaggtaaaccctctttttgaaaagagaccaaggaactttggaattggtcaggatattcaaccatctcgcgatctctccagatttgtaaaatggcccaagtacatcagaattcagagacagaaagcagtgcttcagaaaagattaaaggttcctccaccaatcaaccagttcacacagaccttagataagcaaacagcaacacagttgtttaaaatattggaaaaatacagaccagaaagcattattcaaaggaatgaaaggtttaaagctatagtcgactcgaggaaacaggataaggaatatgttcctagcaagcgcttgtttgtacgttttggcacaaacaccgtaacaaaactggttgaacagaaaaaggcacaactggtagtcattgcgcatgacgtcgacccaattgagttggtcctgttccttccagccctctgcagaaagatgggagtaccatactgtatagtaaagggaaaagctcgtttaggcgtgctggtcaggcgcaagacctgctcgaccgtcgctctgacccaggtggattccggcgaccggtcctccttcaacaaggtggtggaggcgatcaagaccaacttcaacgaccgcggcgacgagatcagaaggcactggggcggcggtttgctcggctccaagtcgtcggcgcgcgtggccaagctggagagggccaaggccaaggaactggctcagaagcagggtggaggcgatcaagaccaactgcaacga

SEQ ID NO: 111 - DNA, 1005 bp, Sitophilus oryzae
  misc_feature (165)..(165): n is a, c, g, or t
atggcgctgttacttaaagatataaaactaggagataatattgtaaaaaaagttttgtttgagaaacacatagattttataaacgattacggtcaagatgaaaacaactatgattacggtatgaccgactatctgcgagtgtcaggcatgtattggggcttaacnttaactgctttggagttgatgaacagtgaaccagtacaaggaaaagataaaattgttgaatatataaaacaatgtcaggatccacaaagtggaggaattagtgcatgcattgggcatgaccctcatatacttcataccttaagcgcaattcaaattttagtcatgtacgatagactagctgcaatagatattgaaggcgtagtccggtatattcaaggacttcaacaagctgatggtagttttgctggagataaatggggtgaaatagataccagattttcattctgtgctgttaatgcactgtctttactgaagaaaatggatgtaatagatattgaaaaggctgttgaatttgtagcaagttgtaaaaactttgatggtggttttggatcaagacccttatctgaaagtcatgctggtttaatatattgctgtgtaggatttttatctattactaatagattagatataatagatcaagatacattagcttggtggttatgtgaaagacaattaccatcagggggattaaatggcagacctgaaaaattaccagatgtctgttattcatggtgggttctttcttcgttagctatattaggcagattacattggatagacactgaagctttaaaaacctttatatttgcatgtcaggatacagaaacaggaggctttgcagatcgaccaggtgatgtagcagacccctttcatacattatttggattggcaggcttatcattattaggctatgatagtatacaaaaagttaatcctacatattgtatgccacaacatgtaattgacaaacaggaattaaaaccacaacgcttgaactaa

SEQ ID NO: 112 - DNA, 2682 bp, Sitophilus oryzae
atgcaccaagaagctattcaacttatacaagtattagaaaagaccatatcaccggataaaaatgaattggaacaagcttcaacattccttgaacaagcagcagcaacaaatgtgttaggttttattaaaacattgtcggatattttgagacatggaggtaatagccctgtcgcccgaatggctgcaggtctgcagcttaaaaatcatcttacatccaaagatccaaatattaaagtgcaatatcaacaaagatggttgtcttttcctgaagacatcagatcatacattaagaagaatgtggtcggtgcattaggaacagaaacaaatcgtccttcttcagcggctcaatgtgttgcatatatagcagttactgaattgcctcagagacaatggccagatcttattagtacattagttaataatatactgaatgcaacatctgaaatgcagaaagaagcaacattggaaactatcggatatatttgtcaagaaattgactgtgatgtactggtatctcaatcaaatgatattctaactgctatagtacatggaatgagagtgacagaaactagtagtcatgtgcgattagctgctacacaagctctcctcaattcgttggaatttactaaagcaaattttgaacaacccactgagaggaactatatcatggaagttgtttgtgaagccacacaatcagctgatactcaaattaaagtcgctgctctacaatgtttagtaaaaattatgtcactctactaccaacacatggagacatatatggcacctgctttatttcccataactttggaagctatgaaatcagaaaatgatgctgttgctttacaaggaatagaattttggtcgaacgtaagtgatgaggaagttgacttagcaattgaagatactgaagctcaggaagctggcaggccaccttctagagtctcgcgtcattatgcaaaaggagctttacagtttattgtgccgattttattacaaaaattaacaaaacaggaagaacttgatgatgaggacgattggaatcctagtaaagcagctggagtatgtttaatgcttttagctacatgttgcgaggatgagattgttccccatgttttgccattcattaaagataatatcaagtcagataattggagatttagagatgcctctttaatggcgtttgggtcaatccttggcggactagaaagtaatactctaaaaccactggttgaacaagctgtacccactctaattgagcttatgtatgatagcagcgtaatggtccgcgatactgcagcgtggacattcggtcgtatatgtgaaatcatacctgatgtggcaataaacgaaacattcttgaaaccactcttggaaagtttaattacaggactgaaagctgaaccccgagtagctgccaatgtttgctgggctttctcaggtctggcggaggcggcgtatgaagcggcaacctgcgatctagttggagaagaaaccactcccgaaacatactgtttgtcaccattcttcgaatttattgttcagagattattagaagctactgataggcctgacggagctcaagccaatctccgacctgctgcatacgaagctttaatggaaatgattaaaaattcgcctagggattgctatgtaactgtacaaaaaactactatggttattttggatagactgcagcaggtacttcagatggaatcacaaatcagtagtcacagcgaccgttcgcagttcaacgatttgcaatccttgctatgtggtactttgcagtcagttttgagaaaggttacaccagaggacgctcctcaaatttcagatgcggtcatgacagctcttttgaccatgttcaattctcataaaactggaggtgttcaagaagatgctattatggctgtttctactttaacagaggttttaggagatggtttcttaaaatacatggacgctttcaagccgattttatatcttggcctgaaaaatcaccaagagtatcaagtttgtggcactgcagtgggtcttactggtgacatcttcagggcgttaaaaattaaggccttgccttattgcgatgagatcatgacacttttgttagaaaatcttggggagcctaccgttcatcggagtgtaaagccacagatcctctcagtttttggtgatattgctctgagcataggaaccgaatttaaaaaatatttagacatagttttagctactctagcccaagcatcccaagcgcaggtaaaggttgatcgtaccgactacgatatgattgactacctaaatgaattgagagagggcgttctagatgcttacactgggctcattcaaggtttaaaaggcgacagtaacactccttctggcgacatttccctcttagaaccccacataccgttcattatccagtttatcacagttgttgctcaagattctgagcattctgatggcaccatggccgtagctgcaggcattattggtgatttatgtgtatgttttggagcacccatgctccctctgctagatttggaaccgatcaatgagatgttgtctcaaggtagaagatcgagggttcaacgcacaaaaggcctgtgtaattgggcaactaaagaactgaggaagttgaagagtcagcagggtggccagaccacggctcctgcggctagttggtaa

SEQ ID NO: 113 - DNA, 1503 bp, Sitophilus oryzae
atggaaacgatattagaacaacagcgacgttatcatgaagagaaagagcgtcttgtcgatacaatgaccaaggaaatgcttcaaaagaaaatcagttacagagaacaaataaattcggatcatcgcatgaaatacctcctggacaggtacatgacttcgacgaatcgtcttatcgacctgtacgaagataaagatggtcaaagaaaagctgaagtggccgctctcactgggcccaatgaattcaatgagttttacagcaggttgaagcaaattaaggatttttataggaaacatcccaacgagattagtgttcccatgtcggtggagtttgatgaactgacaaaagccagagagaacccatctgaagaaatgtcaaatttggttgagtttactgatgaagaagggtatgggaagtttttagatttgcatgagtgttatgaaaagtatattaatttaaaaggcattgagaaagtagactatataacgtacttgggcatgtttgatcagttatatgacataccaaaagagcgtaaatcaggtgaatatcggaaatatttgctctgccttatcgaatatctttcctggttcgtgcaaagaataaaaccactcaccgatctggatgctatactggaagaggaagttaataatactctaccacagtgggagaatggaaattgtccaggatggccaaaagaaacagggtcagctttagctaatgtcggtgctcatctggacctatctgctttctccagttgggaggagttagcttctctgggtttggacaggttgaagtcagccttgttggccttgggacttaaatgtggagggacactggaagaaagggctcaaagattattctctactaaagggcagagttctttggatccatctctaatgacaaaatcaactaaaggaaaagctagtaaggacaaggaacttttgcgtcatagagagttggctatgttagaagcccagatctataagttagctgatattgtcagtcctcaaagaggggcaaccaaagagaacgtgcaacgcaaacaagcaagaaccgacggagaaagagacgacagcgaaaacgaagagtccgaagatgacagtcccgatgaaaatgacgatgacgtcccttacaatcccaaaaaccttcctttgggttgggacggaaaacctataccatactggttatacaaattgcatggtctaaacataagttacaactgtgaaatttgcggaaattacgtgtacaagggtcccaaagcgttccagaggcattttgctgagtggagacacgcccacgggatgaggtgtctggggataccaaacaccgcccattttgctaatgtcacgcaaatcgaagatgctcttgcactgtgggaaaaactgaaagttcaaaaacaggcggaaaggtggcagcctgaaactgaagaagagtacgaagactcgcaaggaaacgtcgtgaacaggaaaacatacgaagatcttaaaagacaaggcctactttaa

SEQ ID NO: 114 - DNA, 633 bp, Sitophilus oryzae
atgacgatcggcaaaaacaataagatgatccagcacatcaactaccgcgttcgaattacgcttcaggactctcggacgtttatcggtactttcaaagccttcgacaaacacatgaacatgattttgggagattgcgaggagtttcgcaaagtaaaaccgaaaaattccaaagtagaacgggaagagaagagagtactagggttcgtacttcttcgaggggaaagcattgtttccttgaccgttgaaggcccacctccacccgaggaaggtttgccaagagtaccgattcctggagcaactcctggaccaggaatggggagagcagccggccgtggtatgcctgcaggcatgagcggagtccctgtagggcttcaagggcctgttaggggtgtcggtggaccctcgcagcaagtaatgactccgggaggaagaggtcaagtatcagcgccacctcaaatgaatcacggcccacctagaatgggtattccaccacccggcatgatggggggtcccccaccaggcatgatgccacctaacgctatgggtatgggcagggggggtccaccaccaatgggaatgagaggtcccccacctggtatgatgagagggggaccaccacccagaggatactaa

SEQ ID NO: 115 - DNA, 996 bp, Sitophilus oryzae
atgtctgtgagaagctttgatgaactttatggccttctgcgcgaagacttacagaaaaataataccaacatgcgggttgcgattggtccaattgaaagacttgtaattccattaaggtatcttgcaacgggagcagattttgcagctttggaatatgtatttcaggtttcgaaaagtacaatcagactaattgttcggcaaacttgtgtggcagtatggaataaaatgcagccgttggaaatgccacagcccgatgcggaattgtggacgaaaatagcagaagaattttacagaaaaagtaattttcccaattgtttgggagccatcgacggcaagcatatcagacttgtttgccctccgaatacagggacgcagtattttaactacaaaaaatatttctcgattgttttattggcagtaagcgatgcagattattgctttaccgcaattgacgtgggagcttacggcagagaagcagatagtaatattttcaaatcttcagttttcggtcgaaggttggcacaaaagaatcttgatctaccaggaaacagaccgcttccaaacaccccaaatatttcactccctcatgtttttgtagctgatgaagcatttggtttaggtgaaaacgtgatgagaccttatgcacggaataatctgtcaattgaaaagagagtatttaattatcgattaactcgagctcgcagatatgttgaatgtacttttggtatactcgccaacaagtggagagtatttcacacaaatatactggtttcggaagattttgccactgacgtaacaaaagctgcttgtttgttacacaattttgtacgaagaagagatggagttgaatcaaacgacgaatcgagttgcctgatggaaaacattccagctattggcacaggagggccgtctgccggtattgcgattagggaaaaatttaaagattattttgtaagccgagaaggagaacttttgtatcagtatgacaaagtgtaa

SEQ ID NO: 116 - DNA, 576 bp, Sitophilus oryzae
atgcagggtcgtacaaaaaaatacaacatacttaatatcacagattctgcggaatcgccagatcaagatgcaactaccgaaccttctacggagcccgaagacgaagagctgacacaaccttttgaagaatctgaagtagttgttatagatcaacctgttaagtcaccagaggagcaaatatcaacaaaagaggactttgaagaattaatagacgaaggttcgaggaaagaaaaactaatgaaacctgatcctaaacaaattgcagattttcacaaatacgcagcaccgacaaacgtgttcagttttccacctaaagcgcaggccacaattagacccgctaatgttattggaccgaatacgaaaatgcctcagaaaatttcgctcattactaccccgatcatacagaattttacaaatagatctgacggttcgaagccaactttggaaacccaacaattaattttaacacctacaacaaaaataaacaccacagcagcatcaaaattgtcatctcaccacatcattctcactcataatccagtaagaagtaacataattagtgtcgggcccaaaatc

SEQ ID NO: 117 - DNA, 2067 bp, Diabrotica virgifera
atggaacgtagtcgaaaacaaagagatcagtcaatttcaaatagttccgaggatagtaataaaaaaaagcaatattccaaacattcaaaaggaaaagaaaaatatcgagacacacgggatagaagtagcgataaaagcaaagaaaaacgtaagaaatcaaagaaaaagaaaaaaagatccaggagcagttctgaggaatccagctcgaacagcgacagctctgataattcagtaaaattgctggaaaagctcacaaaagaaagaattagacttggagaagaaaggaagaagcaaaaagaactaatcaaagctactgaaacagcagaggagaagagaatgaggcggctcgtaaagaaggagaacaaagagagatccaggaaagagagaatgggctgggataacgagtatttacattatacaaacagtgacaatcctttcggggatggaaacttgttgtctacatttgtgtggtccaagaagttaaacaaagaaggattgaaaggtgttagtcaagaagaaatcgaagcaataaacaggatgaaacaagaagaaaacaaaagagaactggaaaaagtaaaaaagagacgtctagaaagggaattagaaagacagaagagggacgaagaaacccagatgctccaaagaagcaaggaagcagcacaatttgaagagtgggagaggcaagaagataagttccatctggaacaagcaagactgagatcacatataagaatccaagatggcagagccaaacccatagatttgttagccaaatatataagtgcggaagaagaggtagatgctgttgaaatgcatgaaccttacacatacctaaacggtttacatatcaaagatttagaagatctagtagaggatattaaggtctataaagagttagaaagggggaaaaatttggattattggaatgatataactgtaatagtggaagatgagttgcagaagcttaggaagctggaaaaacagaatgattttgatttaggtttgaatagaagagaaggtatacatcagtcagtagctggagatgttacttctgtatttaaaggtaaaacggctgtccagttagcagctttggaaaagcaaatagagggaaaaattagcggcaaagctgatggtattgatataggttactgggaatctctgttatcacaacttaaagcgcacatggctagagcaagactacgagatagacatcaagaaagtttgaggagaaaacttcaagtcttgaaagctgaacaagccatcattgtaacagctccaagtgaaagtcattccagtggaggcgaggaagctccaacgaaagatgtgcaagaaccaaagcctgggccttctcaggaacctggtgataaggaaaataatgaggaggaacctgcagatgaggaagcagctaattcatggctgaatgagtgttttgatgcctatgaagctggtggatatagtcccaagtttcttactcctgacgaaatagaaccaggaactattgttgttatagaagaagatgatctgaaaagattggaatttgcaagaattcaggttgtcggtaaaggtaagactgtggaaaatgttataacgaaggaggagttgatgctacaaaaagaggctcgtaaaggcatggatggagacgaggcacagttctctgtagagcaagctttggacagccaagtctatctttggtccgacaaataccgtcctaggaaacccaggtactttaatagagtacacactggattcgaatggaacaaatacaatcaaacacattatgatatggacaatcctcctcctaaaatcgtgcagggatacaagttcaacatattctatcctgatttaatagacaaaagtagtaccccagagtattttctcactccttgcccagaaaataaagagtttgccatattgaggtttcatgctgggcctccgtatgaagatattgctttcaagattgtcaatagagagtgggagtattcgtataaaagagggttcaggtgccagtttcacaataacatcttccaactgtggttccactttaaaagatatagatataggagataa

SEQ ID NO: 118 - DNA, 1263 bp, Diabrotica virgifera
atggacaacttagaaaccaatattatggataagtcgatgagatcagtcttcgtggggaatattccatatgaagcaactgaggaaaaattgaaagatatatttggcgaagttggacaagtactatcttttaagctcgtgtttgatcgtgaaactggaaaacccaagggatatggtttctgtgaatatagagatcaagaaaccgccttgagcgcaatgaggaatttaaacggttacgaaataggcggaagaaatttaagagtggacaatgcttgtactgaaaaatctagaatggaaatgcaaaatctcctcaaccaacctccagtagagaatccctatggagaggcagttcaagctgaaaaagctcctgaggctataagtaaggctgttgcatctctacctcctgaacaaatgtttgaattgatgaagcaaatgaagacaactattcagaataatccaacagaagcaagacagatgcttttacagaatccgcagcttgcctatgctcttttacaagctcaagttgtaatgaaaattattgacgcagctactgcagttagtttacttcatcccgtgaaccaagtgccagcgacacttatgcctggagacaagaatgttcctgtccaagtaccagttaataatcagtacagggagcctccagcacctgttcaaccgcctgtccatccaagacaagacttccaacctgttcctcctcctgttatgcatccatctcaaaatcaagtatttccaagtcaagatatagatctgagatccattggtggtgtgccagatctaagaaacctaagacccatgggtgaccaggatatgagacaaatgccatctgctattcaaaatcccttaccaccaactatcggagaaagctttattcgagatcctagagcagcgcaggcgtttgcaggagatccaagacaagcacgcatggatccacgtcagaaacccatggtgcctcctcctcaaagccaaatgcccataccacctccaatcgcaagaccacctgtaatgccgcctcagcctcaagttcctgtgacgagagcagcacctccacctcaaccgtctccagctcctactcctgcaacggccagtccaaatgttgcaaatgctggggcttcggatcaagaaaaggccgcactcattatgcaagtattgcagctgtcagatgaacagatctctatgcttccgcctgaacagaggaatagtattttggtattaaaggaacaaattgcaaaaagtgcacacacacgttaa

SEQ ID NO: 119 - DNA, 1179 bp, Diabrotica virgifera
atgacccaaatggaccccgaacgtgaaaaaagccttcaagagtacaggaaaaaattattagaacacaaagaagttgaatctagattaaaagagatgcgagagcagctaaaagatcttacaaaacaatatgataaatcagaaaatgatcttaaggctttacagagcatgggccaaatagttggagaagtactcaaacaactcactgaagaaaaatttatagttaaagctaccaatggtccccgttatgtggtaggatgtcgtcgtcaactagacaaggcaaagttaaaagcaggaactagagtagcattggatatgactacattaactattatgagatatttgccaagagaagtggacccattggtgtataatatgagtcacgaagatcccggagatgttacttattctgctattggtggtttatctgaacagattagagaacttcgagaggttattgaactgcctttgttgaatccagaattgtttatgagagttggaatcactccacctaaaggttgtttgttgtatggtcctccaggtactggcaaaactctactagctagagctgtagcatctcagttagatgcaaacttcctcaaagtcgtctccagtgctattgttgataaatatattggagaatctgcaagactgatcagagaaatgtttaactatgctaaagaccatcaaccttgcattattttcatggatgaaattgatgctattggtggtagaagattttctgaaggtacttcagctgatagagaaatccaaaggactcttatggaactgcttaaccaaatggatggttttgattcattaggacaggtaaaaatgattatggcaaccaacagacccgatactctagatcctgctctgctccgtccaggtcgtttggacagaaaaatcgagatacctcttccaaacgagcaagcccgtcttgaaattttgaagatccatgccctcccgatcgctaaacatggagaaatcgattatgaagccatcgtaaaattatctgacacattcaatggagctgatttaagaaatgtatgcacagaagctggactttttgctataagagctgaacgagagtatgtaatccaagaagactttatgaaagccgtgagaaaagtggctgataacaagaaacttgaaagtaaattagattataaacctgtataa

SEQ ID NO: 120 - DNA, 777 bp, Diabrotica virgifera
atggctcgtcgatatgataccagaaccacaatattctctcctgaagggaggttgtatcaggtggagtatgccatggaggctatttctcatgcaggtacttgtctgggcattttagcaaatgatggaattttgttggctgctgagaggcgtaacactaacaaattattagatgaagtttttatttcagaaaaaatatacaaactaaatgatgatatggtttgtagtgtggctggaataacatcagatgctaatgttttaacaaatgaattgagacttataggtcaaagatatttatttcagtatgccgaatctattccttgcgaacagttagtttcctggctttgtgatgtcaagcaggcatacactcagtatggaggtaaacgtccatttggtgtttcaatattatatatgggatgggataaacattatggataccagctatatcagtcagatcccagtggcaactattctggttggaaagctacctgcataggcaacaacagttcagcagcaatttcaagtttgaaacaagaatataaagaaggtcaaatgactttgaaggatgcaaagacgttagcagtaaaggttctggcaaaaacattggatatggcaaaactaacttcagaaaaagtggaaatggctacacttacccgcaaaaatgataaaaccatgattaaaattttaagcggcaaggaagtagaagaactgatttcagagtatgaaaaaagtgaagctgccgcagaagctagcaaaaaagagcagaaggcatcagcttaa

SEQ ID NO: 121 - DNA, 2670 bp, Diabrotica virgifera
atgggcgatacaaaggtagaacctacaaaggtggataaaacaaaggggactgaggacaaaaacaaaaatgaactgtcggaagaagacaaacagcttcaagatgaattaaatttgtgtgttgagaaactccaggataacgatgaaaagagatacctacttgctttgcaagctttatcaaatcatattcaagcctcaactacttcgatgacttctgttcctaagccgttaaaatttatgaggccccattacgaaaccatgaagacagtacatgaaaaaattactgatcctgatactaaaaaagtctgtgcagatattatatctgttttagctatgacaatgggagaaggcagagaatgtttgaaataccgtcttctttctaatttggataaaattggcgaatggggacatgaatatgttaggcatttggcaggagagattgcaggagaatgggccgagactgattttatagtgaacactgaaattagggaaaaacttatcttactaacaaaacaaattgtgccatataatatggcacacaatgcagaagcagaagcatgtgacttgcttatggaaattgaaaggcttgatctactagaacagtatgttgatgaaaacatctaccatagagtgtgcttatatctcaccagctgtgtaccctatgtggcagatcctgagaatactactctactgcagactgctcttttactgtttagaaagtttgatcagtatccccaggcactgagattagcaatgcagttaaatgactttggattaattgaagaaatttttgtcaactgcccagattcggacgtacaaaaacaactggcatttatgctaggacgacaacagatatatgttgaaattcctgagcatacgcctgaatacgaagatctaatcgagataatggcaaactgtcatcttaataaccacttcttgaacctcgctcgcgagttggacattatggatcctaaaacccccgaagacgtttacaaatcccatttagaaaatagtcgtcctccatttggtggaaaccaagttgattcagccagacaaaacttagctgccagctttgttaacggttttgttaatgctgcttttggtcaagataagctcttaatggaagatgggaataaatggctttacaaaaacaaagaacatggaatgcttagtgctactgcttctttgggactaattcttttatgggatgtagacggtggtcttactcctatcgataaatacttgtactcttctgaagaccatatcaagtctggcgctttattagcttgtggcattgtaaactgcggtgtcaggaatgaatgtgatcccgcacttgcacttttaagtgattatgttcttcacaacacaaacataatgagaataggagctattgtaggtctaggtttagcgtatgttggttcaaatagggaagcagtattatctctaatcacgcctgtgctatctgaccctaaatcaaatatggaggtcattggaatggcggctctagcatgcggaatgatttctgcaggatctggtaactcacatgtgacaacatcaataatgcaagttcttatggaaaagtccgaaatagaattaaaggacacttacgccagatttttgcctctgggtcttggattgtgtcatttaggtaaacaagaaagcattgacacaattatagcagcattagaagttatacctgaccctttcagatccatggcgactactatggtcgatatttgcgcttatgcaggcacaggaaatgttttaaaagtacaacatttgttacatatatgttcagaacattacgatgctcctgaaactcctgacaaaacttcaaaggacaaagataaaaaagaagcagagaaagaaaaagataaggatctttcagctagacaagctattgcggttttgggtatagctttaattagcatgggagaagacattggtagcgagatggctttccggacatttggtcatttactaagatactgcgaaccagcgatcagacgtgctgttcccttagccctaggcttaatctcagtttcaaatccaaaattaagtattctcgatactttgagtaaattttcacatgatagcgatgctgaagtggctcataatgccatctttgcgatgggtctggtgggagctggtactaacaatgcaaggttagcagctatgctaagacagttagcacagtaccatgccaaagatcccaataatttatttatggttcgcatcgcccagggtctcactcatcttggcaaaggaactttaactctcagtccattccacagtgataggcagctgatgagtccagtagctgtagctggtctaatggcgacactcatcggcttcttggatgttaaaaacattatattggggaagtcacactacttactgtacaccttagcagctgcaatgcaaccaaggatgttagtcacatttgacgatgagctaaatcctctaccagtgcctgtcagagttggattggcagtggatgttgttggccaagcaggaaaaccaaagactataacaggtttccaaacccataccactcctgtgcttctggcttatggtgagcgcgctgagctcgcaactgaagaatacattgcattgacgccaattatggaaggatttgttattttacgaaaaaatcctgaatttaattcataa

SEQ ID NO: 122 - DNA, 1557 bp, Diabrotica virgifera
atgactgataacgagatggactcgaaggacgagcagaagccttcacctgaagaagttaaaccaaaaatagatacttcagacacagactctcaaccacctcagatttccgttacttctggcggaggtgtgatacgaagaaattttataactacagctggaaccatagtcgaaacaaacgaagaacagccgccagaacccaccaccgaagagattgttaacacagaaaattcaactccacaggaacaaagtcctgtggaacataaaattgagccaacagagacaacaacttatcaagatctgcgcatggaaacgcatcaaagggaacagtttacggaaccaaaacagtacacagtagaaatgccagcagaaagcttctcaggacaaaacttttcacaggatatcggttacaccagtaatatagctactgttaatatagaaggtaatgaggtgcctataacgatatcttcggaaatagatcaacccggaggtgattatacaagtctgcagacagcccaatacaataacggttataccgacggtccacagtatttacaacaacatcagtatcaaaatttatacgttgacagaggcagtgttgaaaattcacctccagcaactttattgtttaaagacgatcccaatttagcaacagctagatatccgacaaactacgacgtatctagcagtcaatcgcagctgaatcttcttccaaatgacacctacttcaccacaacagccaattgggcttcaacgagcaccggatcctaccaacaacaatacagcaataccatcaacatccttcaccaagcggacagtacgcagtcatatggaggaggtccctacgtgaatacagcatggtcatccagtccgatggaggatggacgtccaccaagccaagaggtactagtcaaagagtgcgtgaattgtggtgctagtgttacacccctttggcgtagagacggtaccgggcattatctatgtaacgcgtgcgggttataccacaaaattaatggggttcacagacctccgattaggccttcgaaaaaaccacaggcgacaggaaacagaagaaatggtgtttcatgtgcaaattgcaaaacaaacaacacaacactttggcgaagaaacaatcaaggggaaccagtttgcaacgcttgcggtctctattttaaattgcacggggttaaccgaccgatgagtatgaaaaaggatggcatccaaacacgtaagagaagacccaaaaactccggtggaaatcctggcccatctggtcaagtcaggcttggtaacatctaccaatatcaacatgctccagaacttgaaatacaacaggacacctaccagttgcctattaatgtatatccttcacccactcaaggaccttacagacaatacgctgctgagaatcttcgaggcttaaatgctcagccattgcaaccaattattaccacagatgacgaacagacaagcgtcataacatctacctcacaacaagcacggtttcgagtcgatacagaagaggacgatggtagtaacaacccacctgccaatgcttag

SEQ ID NO: 123 - DNA, 4908 bp, Diabrotica virgifera
atggcacttccagggaacgggatatttgtcgtcaaaggagaaatctccaacatgatggcggctatgaaaagaggaacaaggtggtcgtctcattcttatcaggacgatgatgtagattcattactaagaaactttcaagaactaagagatattctagacaatgtagacgacttaagattcgtagaacccaacacatttttggccccctttttgaatgtcataaggtccgaagaaaccactgggcccgtgaccagtctcgccctatcagctgttaataagttcttgtcctatggattactggatcccttgcatgcatctatccctcaaaccatccacagtatagcagatgcagtcacccatgcccgtttcgttggaacagaccagtcgtcagatggagtagttctcataagaatattgcaagtcctaagaactctaacattatctccagaaggtaccgccttaactaatgaaagcctctgtgagataatgctgtcatgttttcgaatatgctttgaaacaaggcttgtcgacctattgagaaaaactgccgaacattatttaaaagaaatggtgcaattaatttttatgaggttgccgcagtttagtgaggatctcaaagtttcttacattaaacagttaaagatgaaacctggagctttagatcaaacacgtactaagaggaaaaagcagtattcttcacttaaaaaagataagagtgacactgacattaagtctccccaaaccccacaaggtaatcttgcagcagtagcacaaagtagtatagtagatatgcaaggttccttgcaaaatcctgaaaacgctaaccctgtaacctcaaatgctagtccaaaagaaaacttcaagtgtgatgtagatatcattgttgatagtcctgttagtaataatgaagatctaaaaaatatcgattctatatcgtctggtgtagaagaggcagcaacagaacctaaatcacttactgaagaagaaattacagaagaacagagtccgagtactcaagattacataaatcagagaggcataaggtttactccacaattgcagcaagaagctaacttatcaccctatggtttggcatgtgtaagagaattactgagatttttaataagcctttgtaaccctcttgataaacaaaatacagaaatcatgatccatttaggtttaacccttttaacagttgcatttgaaataagtgctgataatattggtaaatataacactttgctagctttagtaaaggatgatttatgcaggaacctattttctcttatgaataccgaaaggctagcaatattttcattggatttacaggtgtcttttttattatttgaatcattgaggacacatcttaagtatcaattagaacactacctaaagaaattaatagaaatcatcctcagcgattctcccaaagtaacctacgaacacaaggaaatagcattagataatttacttcagctgtggcgaataccagggtttcataccgaactatatattaattacgactgcgatatgtactgtgcgaatctgtacgaggaattaactaaattgttagctaaacattcaatatcttctaatactggagtgtaccatacacatttgttatctttggatgcacttatgataatcactgaagggattgaaaaccggtgttgtgaagaaaaagataggttagacgcaggaaatagcgaattggttcaacaatcaaatgacattagcttctatgtcggaaaaaattctagaactaaagtttctccaatcatgccaaagaaggaggaattagctcaaaagaaaagtattaagaagtggctaccgcaaggtaccgaatacttcaacaaaaagccaaaaaagggcatagaatttcttcaagaacacggagtattaaagcaggatatcgatttggatgaaatcgcaagatttttaagggaaaatccagttctgaacaaggctatgattggtgaatatataagtaatcgaagtaatttgaaaattctgcaatccttcgtcgatacttttaattttgtcggagtgcgtatcgatgaagctttgagagcttttctagagacttttaggttaccaggtgaggcacccacaatctccctgatcttagaacatttcgcagaaacctggcataaagccaacaacgaacctttcgcagatgtggattcggccttcactttagcctatgcgataatcatgctcaacgtcgaccaacataacgaaaatgccaaaaaacaaacgactcccatgtcggctaatgctttcaagaaaaatttgaaaggcgttaacggaggtaacgactttgacgaagaaatgttagatgatatatatacaacaataaaaaacgaagaaatagttatgcccgccgaacaagccgggttagttagggaaaattatttctggaagatcttgctgagaaagggacagacgaaagatggcatctacatccatgataatagtggtacttatgattctgagcttttccagattgtttatggacctatagtagcagctctgtcttctgtttacgagaaggctgaaaacgaaagtgtacataaaaaagttatgcaaggattcgaaagatgcgcctttattgctgcaaatctcaatatatctacaaatttggatatgcttattctaggcatttgtaaattcactgtgttctacaatcaacagaaacagaacaacattgtggtgcaatttggaatgaacagcaaggctcagttggcacttaggacggtattttctctaattcatcaacacggaaacaccatgagggagggatggaaacatttatttgatctcttgttagcgctctatagcaacggactgttgtcaaaaacgtttgtagaggtagaagactttattgaaccaagtggcaaattaatgctagtctacaaggaagcaccatctgcggcgaagcaggataccggtttactgagttctctttactcatacatggtttccgcggaaaatctatcaaaaataccgactccagaagagcaaaactgtatagatgctgctaaagaatgtataaaagactgtaatctagagcaaatgataaccgactccaagtttctccacgaagaagctctgtttgaactcgtaaaaaccttaatagagttatctagagggccggatgtacacgaaagtgtggcttatgactacaatgataacgttaccgtgttcttcttggagttattgatcaaagttgttatacaaaatagagatagagtgatgacagtgtggcagaatgtgagggatcatatatacactttggttatgaatgcatctgttttcgatttccagttcttgttggagagatctgttattggtctattacgtattgctatccgtctgatgagaaatgaagaaatgagtcatatagttcttcagtctttaagaatgctactgcttttaaaaagcagtaccctttctaggatatcccggcaaatatcatttggtttatacgaacttctgaaaacttccgcacaaaacattcacaccaacactgactggactattattttcacgcttttggaatgtgtgggagcaggggctcaaccacctaagcctgttagttcagccgaagatacagaactgaaaagtaaatctgacggtgaaacttccgataaccacgaggaagagggcaccctttcagattcagaaggaaggaagagtccgaaagataatacccagagatcacaaagtcctgtgagtgttgtaacttcgcctgttggaactccaaatacaggtggatggattttggtaggcaacgaaggtgaaattcaacccgtcatgggccgcaccgtccctccaacacaatacggcctagctttagagaagaaccttggaagccatgaccccagaagtatgatgaagtgctgcgaaagtctcgcgtttctagtaagagatgtcgcccacattacaccgtacaattttgacgtttgtgttcattgtataaggacttttgtagaagctagcttacatggttctaatttcaaaaggttgagagattctaggtctagaaagaaaactttagataggactagaactagaaaaagtccgacaagtagtcccgatgaggaagatagtgacgacgaaaacattccaagtggttatcaccaaatatcaatacaattattagatttaatgcatactttacatacacgaacggctcagatattcaaatggtgggctgaagaaggtggtgaaatatcgcaagaaacttctctttggacgcaaggctggtgccctcttctgcaaggtatagcaagactgtgctgtgatacgagaaggcctgtaaggatgagtgctataacgtacctacagagagcgctacttgtccatgatttacaaactttgagtgggtcagaatgggagcaatgtttccaaagagtattatttcctttacttagttacctgttacagtcaataaatcctaaagatgccatatcgatggaagaaactaggataagggtagcaactgtgttgtcgaaagtgtttctacatcaccttactcctctattagcacttcccagtttctttaatctatggctggtggttttggactttatggataaatatatgcatgcagataaaagtgaacttctttacgaagccattccagaaagtttaaaaaatatgcttctggtgatggattctgctaaagtttttgacggtcccgatggaaagaacattctatggaatgccacttgggaaaggatagggaaatttctacctaacatgaaagacgacttatttaaggaaatagaagaccaaaatagaaaaaacgaagaagttagtaacatagagataatagtgaataaagaagaaaaagatgtaaatacagagaaattgactactaacgataaccttattacgtgttag

SEQ ID NO: 124 - DNA, 618 bp, Diabrotica virgifera
atgtccattctagcttacaatggtggtgctatggtggcgatgaagggagaaaactgtgtagcaattgcagcagataggcggtttggtattcaagcccaaacagtagctacaaatttccaaaaaatctttgaaatgggaccacatttatatgtgggtcttccaggattagccacagatacccaaacagttatggaaaaactccgtttccgaaaaaacttgtacgaacttaaggaaaatcgaaaaatatctccaaaagtatttgcctctatgatatcaaatatgttgtatgaaaaaagatttgggccattttttgtagaacctgtagtagctggacttctacctaatacttatgaaccctttatctgtaatatggatttaattggttgtataaaccaaccttcagactttgttgttggtggaacagcgtcagcacagttgtatggtatgtgtgaagcactttgggagcctaacctaggacctgaggatctttttgaaaccatctctcaagctctcatcaatgcctttgacagagatgccatttctggttggggagctacagtgtacatcatagaaaaaaataaggtgactgtaaaaaatttgaagacacgtatggactag

SEQ ID NO: 125 - DNA, 2808 bp, Diabrotica virgifera
atggatcagaaaccagatttagatctggtgatatcggcagtttcagcgttgtacaataaccctaacagcagtgagaaggaaagggcttctaaatggcttttggaactccaaaaatccgtccatgcctggactgtagcagacgaattattacatttaaaaagggacttggaatcatgttactttgctgctcaaactatgaggacgaaaatccaccagtctttccacgaacttcctctagaagtgcacacgtcattaagagattcattacttgaacatattggccaaattaacgaagcaactaacactgttatagtgacacaattgtgtgttgctttggcagatttagccctacaaatgccatcctggcagaatcctacgttagacctaatcaatagattctcccaaactaatatatggccattgctagaaattttgactgtgttacctgaagaattggaaagtagatctgtcaggctaggtgaaaacagaagaatagatgtgttagaagagatgaaaatttctgctccaacagtgaatgaatttttaaaacattgttctaaactctacgaaactaattggcaagagcatgttcagttcaatgtaaaagtattacgctgctttacgtcctggatctcagtaggagctattagtctgaatgatctttctgatagtattgttattaacagagcattcgagatactcaacttcaagcctcaaaatgataaacataccatatcagctgccttccatgaggctgccactgactgcatttgtactcttttactaagtcttgaaaacaacaataaccaactcggtttggaaaattacctcttcaataatattatcaacctagatgtaccttatcacctttctgttgcgaatgaggatcaaggaaaatctatggactactgtagactgtttacagaactggcagaatcatttttagaaaaaattatagctaatagtaatacaaaacagatgcactatgctattaaaattttagatctagttttaatgtgtgttggacaccatgactatgaggtagcagaaatcacttttaacctttggtatgttttaagtgaagaattataccaaaaaaataacaaagaaaagacagaactattccgaccctatgtagaacgattaataacagcactatgtaggcattgtcaaatggagccagatagcgaagggttgttagaagatggagatgaatttaaagattttagattgaaggtagcagaattaatacgagatgtagttttcatagtgggcagtagtgcctgtttcaaacaaatgtttattaatatacaaggtccaggagttatgtgggattccaccgaggcagctctgtttgtaatgcaagctgttgcaaaaaacgtaatacctggtgaaagtgaagtggtacctcaggtcgtagaagcaatattaaatgttccagaaaatacacatgtagccgtaaaatacacgtcggtgcttttgctaggagaactttgtgaatggatagagaggcatccaaacacgctggatccagttttgaactttttagtgtgttgtttgcctcaacctggagtaggagctgctgcggctgtggcccttcaaaacatctgtgccagttgtaacgatcatatgccaagacacgtcccaatactcttacagcttcttcaccaagctgattccttcgccatcaccaacacagcaaccttgggtcttctgcgaggagtggcttcgataataggtcgaatgccgcacgaggagttgacgacggctttacgggaattatgttctatgcagcttaatccgatatgtcaaataatagaacaggatgttcatccggtgaaaggagcccaaacggatccagtaatgtggctagatagacttagtgcggtgcttagatatgttaatgtacatattccggaaggtgtggaaaacccttgtaaaccggtaattctcgaagtgtggccggtattgtctcgcacgttcgataaattccaaagtgacattaggataatggagagatgttgtcgtgccgtgcgtttcatgctgcggtgcgtcgcgcaagaagtgcgtgaactcttagaaagcctagttggacaaatagtgaggatctatacgttataccaacattcgtgttttctctatgtcggtagtatactcgtggacgaatacgcaatagatccgatatgcgtgccaggtctgctggatatgctgcaagcgtttctggaacctaccttccacgtgttgcaggaggagaacgggctgaagaatcatcccgatacagtggatgacttttttaggttgtgtgcaagatttatgcagagggcgcctttagcatttttaaaatgttcttccttggtccacatcttacagtgtgcccttttggcttcttccctggaccaccgagaagcgaatatgtctgtgatgaaattcttttacgatttgataaaccagggccagagtgggagagctgatcccgaattcaatcaacgacagatgttagttaaaagcatcctcgacgagtatggccaacaactagtctcaaatctaatccattcttgtgtcttctacctccattcctacatgctcagcgaagtcggcgacgtattcgtgcagctgctcgatttcgacagagagatcacctgcaaatgggtagcggctggtcttgacgtgttaccgaagaacagtaccggcggcatcatggccgccacacctcaacagttgacggatatacataccactattagcaggtcgaatacttccaagtccgtaacacatgctctcaaggatctagccaggttataccgttaa

SEQ ID NO: 126 - DNA, 1506 bp, Diabrotica virgifera
atggctcagcggtttcccggccctgtgccaaatcaaagtccaggaggaccgcctcctcagagatatcaacaacagccccctaatcaaggaattcggcagtatgcacaacaaaatttccctcaaagacctggatacaatcctccaccaccaaatataccatctagtggcggtacgatgattcaaagacctgctggtgctccctattcaccaatgagaggtggaattattccgccacagcaaggaaataaaaggcctgcagacaataggactcaaatgcaacagaaaagtaatgaatacagccatagtacaagtaagaagaagaaaaagctggcggataaaatcctgccacagaaagtcagagatttggttccagaaagtcaagcttacatggatctattagcatttgaaagaaagctagactctactattatgagaaaaagattggacatccaagaagctcttaagcgtccgatgaagcaaaaaaggaagttgagaatatttatttccaataccttctatcctgccaaggaacctcagcctgaaggacccgatggaccatgtcaggaaggcactgttgcatcttgggaattaagagtagaaggtcgtcttttagaagatccaaagaacgatccaaataaagttaaacgcaagttttcttctttctttaaatctctggttatcgaattggataaggagctgtatggaccggacaatcatttagttgaatggcacagaaccctaaccacccaagaaacagatggttttcaggtaaaacgccctggtgacaagaatgtgagatgtactattttgttgcttcttgattatcaacctctgcagtttaagcttgatcctagactagctagacttttgggagttcacactcaaactagaccggtcattatttcagctttgtggcagtacataaaaactcatcgcttgcaagatgcccatgaacgcgagtttatcgtttgtgacaagtatttggaacaaattttcaactgtacccgtatgaaatttgccgagattcctcagcgtctgaatccactattgcatcctccagatccaatcgtcatcaatcacgtgatctccgtagaaggaggggccgagagcaaacaaactgcttgttatgatattgatgtagaggttgatgatacattaaaaacccagatgaacaatttcctattgagtacagctagccagcaagagattcaaggacttgatgctaagattcacgaaaccgttgataccattaatcagcttaaaacaaatagagaatttttcctgagcttcgctaaggatccacaacagttcattcataagtggattgtgtcacagactcgtgatctaaagacgatgactgacgtggtcggaaatccagaagaagagaggcgctccgacttcttctatcagccttgggcacaagaagcagtttgtagatatttctatactaaggtgcagcagaagagagcagagctggagcaagctcttggtattcgtaataattag

SEQ ID NO: 127 - DNA, 435 bp, Diabrotica virgifera
atgccaaaagtacgacgaagtaagaaacctccacctgagggttgggaactgatagaacccacattagacgagttagaacaaaaaatgagagaagttgaaacacagtcacatgagggtaaaaggaaaaatgaatcattgtggccaattttcaaaatccatcatcaaaaatccagatatatatttgatcttttttatagaagaaaagcaatcagcagggaactatatgactattgtcttggtgaaaacattgcagataaaaatttaatagcgaagtggaagaagcaaggatacgagagtctttgttgtctaagatgtattcaaacgagagacaccaactttggaacaaactgtatttgtcgtgtacctaaatctaagttagaagaagggagaattgttgaatgtgtgcactgtgggtgcagaggttgttccggatag

SEQ ID NO: 128 - DNA, 885 bp, Diabrotica virgifera
atgccagcagctactctaggtagcataccacatcctaataatgaagactgtggcattagggatgtttgggcccataacctggaggatgaattcagaaccatcagacaaatagtacaaaaatatcagtatgttgctatggacacagaatttcctggtgtagttgcgaggcctattggagaatttagaagttctgcagattaccaataccaaatgctgaggtgcaatgtcgatttattgaggataatacagcttgggctcacatttcttgatgataacggaaaaactccagggggtgcctatactacatggcaattcaacttcaaattcaaccttcaggaagacatgtatgcacaggatagtatagacctcctgcaaaattctggcattcagtttaagaaacatgaggatgaaggtattgaacctcttgaatttgcggaattgctgatgtcatctggtattgtcctggtggaaaatataaaatggctgtccttccattctggttatgattttggctacctgataaaactgttaacggacaacaacttacctcaagacgaaacagaattcttcgatttgttaaaattatattttcctaccatatatgatgtaaagtaccttatgaaatcatgcaaaaatcttaaagggggattacaagaagtggcagaacagctagaacttgaaaggattggaccacaacatcaagcaggttctgattctcttctgacaggaatggcatttttcaagatgaaagagatgttcttcgaagacaccatagacgactccaaattctcgggccatctctacggtctcggcacctctttcgcagtgaacggaactgccaacaactactcgaacgacaacggagataccacaaactcttcatga

SEQ ID NO: 129 - DNA, 1209 bp, Diabrotica virgifera
atggcagttccaaaaagaggtgcctcagtttttgaggacttatcaaatgtagagtttgaaactagtgaagatgtcgaagttatcgagaagtttaaaaacatgaaccttaaagaagaacttcttcgtggtatcttcgcatatggcttcgaaaaaccctcagccattcaacagagagcaataaagcctattatgaaaggaagagatgtaatagctcaggcacaatctggtactggtaaaacagctaccttttccatttcgattttacaagctttagatttgacaatgcgagaaacgcaagttttatgcttgtctcctactagagaattggctgtacagattcaaaaagttattctagctttaggtgacttcatgaatgttcaatgtcatgcttgtattggaggcacaaatcttggggaagatattagaaaacttgattatggacagcatgtcgttagtggaacacctggaagagtttatgatatgatcagaagaagagctctaagaacaagatctgtaaaaatgttggttttagatgaggctgatgaaatgttaaataaaggattcaaagaacaaatttatgatgtctacagattccttcccccatcaacacaagttgtactcatttcagctacactgcctcacgaaattttggaaattacttccaaatttatgacagatcctattaggattttggtaaaacgtgatgaattgacattggagggtataaaacagttctttgtggctgtggaaagggaagaatggaaatttgacaccctctgtgacctctacgatacattaaccattacacaggctgttattttctgcaacacaaagaggaaggtagactggctgacggagaaaatgagggaaaacaattttacagttagttcaatgcacggagatatgccacaaaaggaacgtgacaatattatgaaagagtttaggtcaggacagagtagggtcctaatcacaactgatgtttgggctagaggtatcgacgtacaacaagtcagtttggttatcaattatgacttgccgaacaatcgtgaattgtacatccatcgtatcggtagatctggtaggttcggccgaaagggtgtagccatcaatttcgtaaaatcagacgatatcagaattctaagagatatcgaacaatattactcgacccaaattgacgaaatgccaatgaacgttgcggacttaatttaa

SEQ ID NO: 130 - DNA, 1605 bp, Diabrotica virgifera
atgactgcccctacagccggtggtgatacaaatagaggaagaaccgttgcatataaggacaaaagtaaacccgctgatgtcaggaccagtaatattaacgccgcaaaagctgtttgcgatgctatccgtacaagtcttggccctagaggaatggataaaatgatccaggctggaaatggtgaagtgacaattaccaatgatggagctacaatcttgaaacaaataaacctcattcaccctgctgctaaaatgttggtagaattatcaagggcccaagacattgaagcaggagacggtaccacatctgttgttgtaattgcaggagctttgttggatgctgcagaaaagttattacaaaggggaattcaccctacagcaatatctgaatctttccaaagagcagcccagttggcagttgatattttgtcagacatttctactccaattgaaattactaatagagaattgttaattaaaagtgcatccacttccctaaactcaaaagttgtttcccaacactcaagctttttgggtccacttgctgtcgatgcagttcttaaaattgttgaacctggtagagaacaagcttgtaatttatctgatatcaaagttattaagcaacttggaggtacagtagaagataccgaattagtagaaggaatttgtttccctcaaagatctgcaaatgtctctggaccaaaaaggattgagaaagctaaaattggtttcatccagttctgtatttcacctccaaaaacagatatggaccacaatgtcattgtttctgattacgctgctatggatagagtattaaaagaagagagagcatatattttgaatattgtcaagcagataaagaaagctggatgtaatgtacttttggttcaaaaatcaattttgagggatgcagtttcagatcttgccttacactttttggataaaatcaagtgtatggttattaaggatattgaaagagaagatgtcgaatttgtatgtaaatctttaggatgccgccctattgcatctttggatcattttgttgctgaaaacttggttactgctgatttagttgaagaggttggattggcaggaaatagaatggtcaaaattacaggtgcacaaaatgcaggcaggacagtaactctgctggttagaggatccaacaaattagttcttgaagaggctgatagatctcttcatgatgctctctgtgtaattcgttgtcttgttcgcaagaaggcacttattgccggaggaggagcgcccgaggttgaggtggctcttaaactagcggctatggccaacaaactggaaggcattgatgccatttgcacacgcgcatatgcgaatgccttagagattataccatttaccttgtctgagaatgcaggattaaatcccatacagaccgttactgaactaagaaacagacacgccaaaggagagacatctgctggaataaacgttcgtaaaggagctattacagatattctcgaagaaaatgttgttcaaccacttttagttagcacttcagcattgagtttagctacagaaactgtgagatccatcttgaaaatcgatgatattgttaacacattcacataa

SEQ ID NO: 131 - DNA, 1230 bp, Diabrotica virgifera
atggaggctatggatattgttataccagaaaaagaagaaggtagtccttcggaagtaaaacaagtgctgcaggatgtggatactgaagatttgtacactaaatataaaaaacttcaacaacagttggagttcttggaggttcaagaagagtacattaaagatgagcaaaggaatctcaaaaaggagtatttacatgctcaggaagaagtgaagcgtatccagtctgtcccgcttgttattggacagtttttagaagctgtagatcaaaacactggcattgttggctcaactacaggttcaaattattatgttagaatcttatcaacaattgatagagaactcttaaaaccttctgctagtgttgctcttcataaacacagcaatgccttagtagatgtcctaccaccagaggcagattcttcaataagcatgctccaggctgatgaaaaaccagatgttcaatacagtgacattggaggtatggatatgcagaaacaagaaattagggaagctgtagagttacctttgactcacttcgaattgtataaacagattggtattgatccccccagaggtgtgttgatgtatggacctcctggatgcgggaagactatgttggccaaagctgttgctcatcatactacagctgcctttattcgtgtagtcggatcagaattcgtacagaaatatcttggtgaaggtcctcgaatggttagagacgtgttccgtctagcaaaagaaaattctccagcaatcatctttattgatgaaattgatgcaatcgctaccaaacgttttgatgcccagacaggtgctgatcgtgaagtccagagaattttattggaactgcttaaccagatggatggttttgatcagacaacaaatgttaaggttatcatggcaactaacagagctgatacattagatcctgcacttctgagacctggtcgtctggacagaaaaatcgaatttcctttaccagatagaagacaaaagcgtttgattttcagcactatcacatctaaaatgaatttgtcagaggaggtcgacttggaggactatgtagctagaccagacagaatatcaggagcagacataaacgccatctgccaggaagccggtatgcatgccgtccgagaaaaccgttacatcgttttacctaaagatttcgagaagggttataagaataacattaagaaggatgagagcgagcacgagttttacaaatag

SEQ ID NO: 132 - DNA, 489 bp, Diabrotica virgifera
atgccaaatataaaattgcagtcgtctgatggcgagaccttcgaaattgatgttgaaattgctaaatgctccgtcactatcaaaactatgttagaagacttgggaatggacgaagaagaagaagaagtggttcctttaccaaacgtaaattccgccatactcaggaaagtcatccaatgggcgacttaccacaaagatgatccaccaccaccagaagatgacgataacaaagaaaaaagaacagatgatatttcctcatgggacgcagacttccttaaagtcgaccaaggaaccctcttcgagttgattttggctgctaactatctggatatcaaggggctcttagatgtcacatgtaagactgttgctaatatgatcaaaggtaaagctcctgaagaaatcagaaagactttcaacatcaagaatgacttcacggcatctgaagaagaacaagtgagaaaagagaatgagtggtgcgaggaaaagtaa

SEQ ID NO: 133 - DNA, 930 bp, Diabrotica virgifera
atggacgataaggcgtcgtgtaaggagctggatggatggatagaacagttaaatgaatgcaagcaattaacggaaaatcaagttaaaacactatgtgataaggctaaagaaatattgtcaaaagaatcaaatgtacaagaagtgaaatgcccagtaacagtatgtggagatgtccatggacagttccacgatctgatggaactgtttaggataggaggtaggagcccagacactaattacctgttcatgggagattatgtagatcgtggatactattctgttgagactgtcaccttattggtagcactgaaagtcaggtacaaagagagaattacaattttgagaggcaaccacgaatcaagacaaatcacacaagtttacggattttacgatgaatgtctaaggaaatacggaaacgcgaatgtatggaaattcttcaccgatctgttcgattatttgcccctaacagcgctcgtcgatagtcaaattttctgtctgcacggcggattgagtcctagcatcgacaccttggatcacattagggcgcttgatcgtttacaagaggtacctcatgaaggccccatgtgcgaccttctctggtcagaccctgacgaccgcgggggctggggcatctccccccgtggagccggctacaccttcggacaggacatttcagaaacgttcaaccataccaacggtctgtctttagtatctagggcgcatcaactcgtcatggagggttacaattggtgtcacgaaagaaacgtagtgaccattttcagcgcccccaattattgctaccgatgcggtaaccaggcggccattatggaattagatgatgccctgaaatattcattcttacagtttgatccagcaccaagacgtggcgaacctcatgttacgcgtagaactccagactatttcctttaa

SEQ ID NO: 134 - DNA, 2433 bp, Diabrotica virgifera
atgcagatctttgtgaaaaccttgactggtaaaaccatcaccttggaagtagagccttccgacaccattgaaaatgtgaaagccaagatccaagacaaggaaggtatcccaccagatcaacagagattgatcttcgctggtaaacaacttgaagatggtagaactctatctgactacaacatccagaaggaatctacccttcatttggtccttagattgagaggaggcatgcagatctttgtcaaaaccttgactggcaagaccatcaccttggaagtagaaccttctgacaccattgaaaatgtgaaagccaagatccaagacaaggaaggtatcccaccagatcaacagagattgatcttcgctggtaaacaacttgaagatggtagaactctatctgactacaacatccagaaggaatctacccttcatttggtccttagattgagaggaggcatgcagatctttgtcaaaaccttgacaggcaagaccatcaccctggaagttgagccatccgatactattgaaaatggtagaactctatctgactacaacatccagaaggaatctacccttcatttggtccttagattgagaggaggcatgcagatctttgtcaaaaccttgacaggcaagaccatcaccctggaagttgagccatccgatactattgaaaatgttaaagctaagatccaggataaggagggtatcccaccagatcagcaaagattgatctttgccggtaaacaattggaagatggaagaactttgtctgattataacatccagaaagagtctactcttcatttggtacttagattgagaggaggtatgcagatcttcgtcaagacactaactggaaagaccatcactttggaagttgaaccatctgataccattgaaaacgtgaaagctaaaatccaagataaagaaggtatcccaccagatcagcaaagattgatttttgcaggaaaacagctagaagatggtagaaccttgtctgactataacatccagaaagagtccactcttcacttggtactgagattgagaggaggtatgcagatcttcgtcaagacactaactggaaagaccatcactttggaagtagaaccatctgataccattgagaatgtgaaagccaagatccaagataaggaaggtatcccaccagatcagcaaagattgatctttgcaggtaaacagctagaagatggtagaactttgtctgattataacatccagaaagagtccactcttcacttggtacttagattgagaggaggtatgcagatttttgtcaagacattgactggtaaaactatcacattagaagttgaaccatctgatactattgagaatgtgaaagctaagatccaagataaggaaggtatcccaccagaccagcaaagattgatctttgcaggaaaacagctagaagatggtagaaccttgtctgactataacatccagaaagagtccactcttcacttggtactgagattgagaggaggtatgcagatcttcgtcaagacactaactggaaagaccatcactttggaagttgaaccatctgataccattgagaatgtcaaagctaaaatccaagataaagaaggtatcccaccagaccagcaaagattgatctttgcaggaaaacagctagaagatggtagaaccttgtctgactataacattcagaaagagtccactcttcacttggtactgaggttgagaggaggtatgcagatcttcgtcaagacactaactggaaagacaatcactttggaagtagaaccatctgataccattgagaatgtcaaagctaaaatccaagataaagaaggtatcccaccagaccagcaaagattgatatttgcaggaaaacagcttgaagatggtagaaccttgtctgactataacatccagaaagagtccactcttcacttggtactgagattgagaggaggtatgcagatcttcgtcaagacactaactggaaagaccatcactttggaagtagaaccatctgataccattgagaatgtgaaagctaagatccaagataaggaaggtatcccaccagaccagcaaagattgatctttgcaggaaaacagctagaagatggtagaaccttgtctgactataacatccagaaagagtccactcttcacttggtacttagattgagaggaggtatgcagattttcgtcaagacattgactggtaaaaccatcacattagaagttgaaccatctgacactattgagaatgtaaaagcaaagatccaagacaaagaaggtatccccccagatcaacaacgtttaatatttgctggtaaacaattagaagatggaagaaccttgtcagattataacatccaaaaggaatctactctccacttggtactaaggttgagaggaggcaattaa

SEQ ID NO: 135 - DNA, 1623 bp, Diabrotica virgifera
atgatgcaaccacagatattactcttaaaagagggaactgactcatcccaaggaaaacctcaattaatctcaaacataaatgcctgccagaatgtgacggatgctgtaagaacaacattggggcccaggggtatggacaagctcatagtacagaggcaaggacatgctactatatcaaacgacggggcaactattttgaaattattggatatcgttcaccctgctgcgaaaactttggtagatattgctaagtcacaagatgcagaggtcggggacggtacgacaagtgtagtattactagcaggagagtttttaaaacaaataaagccttacgttgatgagggtgttcacccgagaataataatcaaagcagtcagaagatcgttccaaatttgccttgagaaaataagtgaaatagctgttaaaatcaataaatcaaatgctgacgaattcagatctctattggaaaagtgtgctgccacagcgatgagctcgaaattaattaatcaacaaagatctttcttttctaaaatggttgtagatgctgttctgttactagacgatttactacctctcaatatgatcggtatcaaaaaggtacaaggtggagccctagaagagtcacttttggtagccggagtagcatttaagaaaactttttcttatgccggatttgaaatgcaacccaaggtatacaaagattgtaaaatagctctgctaaacattgaattggaacttaaagctgagagggataacgcagaagtaagagtagataatgtaaaagaatatcagaaaattgttgatgcagaatggactatcttgtacaataaacttcaaaaaatttatgagtctggagctaatgttgttttgtcaaaattacccattggagatgttgctacccaatactttgctgatagggatatgttctgtgctggtcgtgttcaagaagatgatatgaaacgtaccctgaaagcatgtggaggtgctgtaatgaccactgttaatgacatcagcgattctgtactcggtaaatgtgagctgtttgaagaaaaacaaataggaggagaaagatttaatttctttaaaggctgcccaaatgcaaaaacgtgtactttaattttacgtggaggagcagaacaatttttagaagaaactgaaagatcacttcatgatgccatcatgattgttagaaggactattaaaaatgacgcagttgtagctgggggtggtgctatagagatggaattatcaaaaattttacgggatcattctcgcacaattgccggcaaagaacagcttctgattggtgcaatagctaaggcattagagatcatccccagacaattatgcgataacgcaggatttgacgccaccaacatcctcaacaaacttcgacagaaacacgcgcagggtcactgctggtacggtgtggacataaacaaagaagacatcagtgataacttcgaagcctgcgtatgggaaccggccatcgtcaaaatcaacgccctgactgcagccacagaagcaacatgtttgattctgtctgttgatgaaacgataaaaaatcaaaaatctgaggcgccacctcaaatggggggccgtggtatgggaaggcctatgtaa

SEQ ID NO: 136 - DNA, 13950 bp, Diabrotica virgifera
atgggggactctttagaatccacggaagccagccacgaaacgcaaaatgtggctctagttgattttacagcattttcgaattttattttaaaagcgaccactgttcttttgccggaggatgacggccaagccgaaccggcaaacttagtggcagctatagatgataaagcaaatcaggaatgtataaggaaattcataagtgatccgcaaattgcaactttgtacatacagaggaactcttccaaagatgatgacagcgttcaaccgccagagggcgaggaagaaaaagagccagttacatattatgtcagcaatgaagtccattataccaactcaaaaatgtcaagtttagtatgcattaagagaggcccagtgatcgaagccgataaaagtattagagcccaagtccggctgatgaatttcagcgatggctcaccatatgaaatattacacgattatgtcagtagaacagttgcaccgttttttaaatcctatgtcaaagaatctggcagagctgatcgtgatggtgacaaaatggctccggcagtcgaaaaaaccatcgctgaacttgaaatgggtcttttgcatctgcagcaaaatattgatattcccgaaataaccctacaagtacacccgtacgtggcaagcctaatcaaacaatgtgcagatgaaggcagaaaaccaaaagtagctgattttagtgacaaagtagatgattccaactttttgaaccagttgcaacatggtgtaaacaggtggatcaaggaaatccaaaaggttacaaaattggatagagatccagcctccggaacagctttacaagaaatcagcttttggttgaatctagaaagagctcttcaccgcattcaggagaaacgtgaaagtatggaagttgcactaactttggacatcctcaaacatggaaaaagattccatgcaactgtttcgtttgatacagacactggtcttaaacaagctatagctaccgtcaacgactacaatcccctaatgaaagactttcccatcaacgatttattagctgctacagaactggaaagaatcagagccgcagtccaactgattttcgcccatttgagaaaagtgagatcaacgaagtatcccattcagagatgtttgaggctcgttgaagctatttcaagagacttgggtgcccaattactcaaagttttgggcacgagaagactgatgcacattccgttcgacgaattcgagaaagttatgactcaatgttttgaggtgttttccatatgggaagatgaatatgagaagctgcaagctctattaagagatatcatgaagaagaaacgtgacgaacacatgaaaatggtctggcgtatctcaccgcaacacaagaaactccaaagcaggatggatcagatgcgtaagttccgaagacaacatgaacaattaagaactgtcatcgttcgagtgttaaggcccagcatcaaaggaagcgctgtgccgattgaaggaggcgacatcgaaccaccgaagccgactttctcccttgatgcagccgatgctaatgctatagaggaagtgaatttggcatacgaaaatgtgaaagaagtagattgtctagatatctcaaaggagggacaagatgcttgggatgccgctgtacaaagatatgaagaacgcattgacagagtcgaaaccagaatcacagctcatcttcgtgatcaactcggtactgctaagaatgccaacgagatgttcagaatcttctctcgtttcaatgctctcttcgttagacctcacatcagaggagctattagggaataccagactcatcttatacaaagggtaaaagatgacatcgaagctcttcatgaaaagtttaaggtgcaatacccacagagtaatagcgctaaaataagcaaagtgagagacattccgcctgttgctggttccataatgtgggcgaaacaaattgatcaccaactcaccacatatttgagacgcgtagaggatgtcttaggtaaaggatgggaaaaccatatagaaggccaaaaacttaaagccgatggagacagcttccgtctcaaacttaacacccaagaaatattcgacgattgggctcgaaacgttcaacaacgcaacttaggagtctccggaagaatatttaccatcgaagcagtccgttcaagaagcggtagaggcaacgtgttgaaactgaaagtgaatttcctaccagaaatcataactttggccaaagaagttagaaatctgaaatgtctaggattcagagtgccattggccattgtcaacaaggcgcatcaggctaaccagctgtacccatttgctatttcgctcatcgagagtgttaggacatacgagatgacgcttgagaagattgaagacaaagccagcattatacctcttgtagcaggaatgcgaaaagaggttcagcaggttattgcggagggcatacaactcgtctgggagagttacaagctggatccttatgtccaacgtttctcagacctcgtcgtaagtttccaagagagagtagaagaattggtgctagtaggtgaacagttagaagtcgacgtaagatctttggagacctgtccatattctgctaacacatttgctgacatcctgtcgaagattcaacatgctgtcgatgatctgtctttgaaacagtactcgaacttacatatctgggtcagcagattggacgaagaggttgaaaagaatttggcaagacgtctgcaagctggagtggaagcctggaccgatgcactgagcggccacaagaaggaaatcgatcacagcatggacaccgacgctcccgctcagccgacacacaaaccaggaggagatccgcagatccaaaccatggttcatgaagttagaataacaaaccaaaccatgtatctgtacccaagcatcgaagaagccagatttttgatcatgcaacagttgtttgcatggcaagctatcgtcacatcccagcagaggttgcaaagtagcaggtatcaagttggcgtcgataaacctgttacagaaacctacaggaacatattaacgaagttgccgggtggagctcaacctctaaactcggcttacagtgcaattgcttccaaaattaaagaggttcaaaactacgtgaacgaatggttgacctatcaatcgctttgggacttgcaagctgataatctgtacggaaaactaggagaagatattggcaaatggatggaatgtttaaatgatatcaaaaaaacccgtacgacatttgacacttcagacacccgtcgtgaattcggtcccattattatcgacttcgccaaagtccaaagcaaagtctctctaaaatacgattcatggcacaaagacactttaggcaaattcggtggtctacttagtaacgaaatgacatctttccacgccaatgtatccaagtcaagatcagacttggaactccaaagcatcgaggccgccagcacctcagacgccgttagcttcattacttacgttcaacagttgaaacgaagcatgaaggcttgggagaaacaagttgatatttacaaggagggtcaaaggattttggaacgacagagattccagttcccaacaaattggttacacgtggagaacttggaaggagaatggggcgctttcaacgaaatcatcaaacgtaaagattctagcattcaaacccaagtagccagtctccagcagaagatcgtatccgaagacaaggcagtggagagtcgcactaatgacttcttaaatgattgggaaaagagcaagcctgtcgaagggcatctcagaccagacgacgccttgtcacaactgcaactgtttgaaagcaaattttccagactcaaagaggaaagggacaatgttgccaaggctaaagaagctctcgagcttcaagatcctggcggtataagcaccagcgaagacagaatgcaagtcgtctatgaagaactccaagacctcagaggtgtttggtccgaattgtcaagaatatggcaacaaatagatgaaactagggaaaaaccatggctttcaattcaaccaaggaagctcagacagcagttggacgctctaagtacacaattaaaggaactaccagcaagattgaggcaatatgcttcgtatgagtacgtcaagaaaactttacagacatataccaaagttaacatgctcatagttgagcttaaatctgatgctctaaaagaacgccattggaagcaattgatgaaacaattacgagtaaactggatcttgtcagatttaacactaggacaggtttgggacgtaaacctacaaaagaacgaagccatcgtaaaagatatcattctagtggcacaaggagaaatggctttagaagaattcttgaaacaagttcgtgagtcctggcagaactacgaactggacctcatcaactatcaaaacaagtgcaaactaatcagaggatgggacgatttgttcaataaagtcaaagaacacatcaattcagtagcagctatgaagctctcaccttattacaaagtttttgaagaagaagcattgacctgggaagaaaaattgaatcgtattaatgctttgtttgatgtctggatcgatgtacagagaagatgggtttacctcgaaggaattttctcaggtagtgccgatattaaaactcttctaccagtggaaacctcgagattccaaagcatcagttcagaatttctgggattgatgaaaaaggttagcaaaagtcccatggtaatggacgtattaaatattccaggagtgcaacgagctttagaaagattagctgatttattgggcaaaatacaaaaagctttaggagaatatctagaaagagagcgtacttcattccctagattttatttcgttggtgatgaggatttattggaaattataggaaacagcaagaacatcgctagacttcagaaacactttaaaaaaatgtttgctggagttgcttctatacttttaaatgaaaacaacaccataattacaggtatagcttcaagggaaggtgaagaagttcacttcaacaacccagtctcgactgtagatcatccaaagataaacgaatggctcacaatggtagagaaggagatgcgtgtaactttagcttcaaatttaacccaagctgtacaagatatcaagcaatttaaagacggcattgattcaaagagttacatgcaatgggtcgacaaataccaggcgcagatagtggtcctcgctgctcaaatcttgtggagcgaagatgtagaagctgctcttgtcaagatgaacagcgaacctcaaaaaggtcctctagaaaaagtacttcaacaggtagaaaatacactcaatgtacttgccgactcggttcttcaagagcaacctcaactcagaaggaagaagctggagcatctcataaacgaattcgtacacaaaagaactgtgactagaagactgatcgcaaacggagtttgtagcaacaaagcattcgaatggttgtgtgaaatgaggttctattttgatccaaggcagactgaagttttgaaacaattaacgatacatatggcaaatgcgaggttctactatggatttgagtatttaggagttcaagataggctagttcaaacaccgttgacagatagatgttatttgaccatgactcaagctttggaagctcgtttgggaggttcgcctttcggtccggctggtaccggtaaaactgaatcagtcaaagctctcggcaatcagctgggacgtttcgttttggtattcaattgtgacgaaaccttcgatttccaggctatgggaagaatatttgtgggtctctgtcaggtaggagcatggggatgtttcgacgagttcaatcgattggaagaaagaatgttgtctgccgtttcacaacagattcagactattcaggaagctttgaagtcgcagaaagaagctgctgctgaaggtgttactacaggcagtattagtgtagaattggtaggaaaacaagtgaaagtgtcgccagatatggctatcttcataacgatgaatccaggttatgcaggaagatcgaatttacctgataatttaaagaaattgttcagatctttggctatgacaacgccagacagacaattaattgccgaggttatgttgttctctcaaggattcaggcaagctgaaaaattggcttcgaagattgttcctttcttcaggttatgcgacgaacaactatccaatcaatcccactacgacttcggtttgagagccctaaaatccgtacttatatctgccggtaatgtcaagagagaccgaattcagcggattaaggaaggaatgacccaacgtggcgaaaccaacatcgatgaagccagcatcgctgagaatttgccagagcaggaaatcttgatccaatcagtgtgcgaaaccatggtacccaagttggtggctgaagatataccacttctcttcagtttgttgaatgatgtattccctaatgttcagtacacaagagcagaaatgaaaggtcttaaggatgaaatcagaaaagtatgttctgaagagtatttggtatgtggagaaggagacgaacgaggatcagcttggatggagaaggtacttcaactttaccaaatatcaaatttgaatcacggtttgatgatggtcggcccaagcggttccggtaagagttcggcatggagagttcttcttaaagctcttgaaagattcgaaggcgttgaaggagttgcacatgtcatcgatccaaaagctattagcaaggaagcactgtatggtgttttggatcccaataccagggaatggacggacggtctcttcactcacatattaaggaaaattattgacaacgtcaggggagaaattaacaaacgtcaatggatcatcttcgacggtgacgtagatcctgagtgggtagaaaacttgaattcagtacttgatgacaacaaattgttgactctgcccaacggtgaacgtctttccctacctccaaacgttagggttatgttcgaggttcaagacttgaaatatgcgacactagccacggtttctcgttgcggtatggtctggttctctgaagatgtcttgtcaactgacatgattttcgaaaactatattcttcgtttgaggaatatccctctggaagaaagcgaagatagcggctttggcaagaaaaacgacaaagacgatatgctttctcccactcttcaactacaagtcgacgttgtcaatctactacaaccatacttatcacccgatggtctagtcgtacgttgtctggaatatgcgatggaacaagaacatattatggacttcacacgtcttagagcactcagctcgttattctctatgttaaatcaagccgtaagaaacgttctccaatataaccacatgcatcccgactttccattaaccaatgatgtcttagacaaatatattccaaaatgtttgatatattccatcctttggagtttcgctggtgacgccaaactgaagattcgttctgatctgggagattttatcagatctgtaacaacggtaccgcttcctccagacaacaacatgcctataatcgactacgaggtcaccatcgagggagaatggtcgctgtggtccaataaagtgccacaaattgagattgagacgcacaaggttgcttcacctgatgttgtagtgcccactttggatacagtaagacatgaatccttgctttatacttggttagccgaacataaaccattagtattatgcggtccacctggatctggtaaaacgatgactctattctccgctttaagggcgttacctgatatggaagtggttggcttgaacttttcatctgctacaactcctgaattgctgctgaagacattcgaccactactgtgaatacagaaaaacgcctaatggtgtagttttgtccccaatacagttgggcaaatggttagttctcttctgtgacgaaataaatttaccagacatggacaactacggcacacaacgtgttataatgttcttgcgtcaaatcgtggaacagaaaggtttttacagagcctcggaccaatcctgggtctcactagaacgtatccaatttgtcggtgcctgtaatcctccaactgatcccggcagaaagcctctatcccaccgattcttgcgacacgttcccgtcatttatgtagattatcccggagagacatctttgaaacagatctacggtactttcaccagggctatgttaagattggcgcctggtctgaaaggttatgccgaaccattgactaatgctatggtggaattttatttggcatctcaagatagatttactcaagatatgcaaccacattatgtttattctccaagagaaatgaccagatgggtaagaggaatttgtgaagcaataaggcctcttgataatcttgctgtggagggtttggtaaggctttgggctcatgaagctctccgtctcttccaagacagattagtcgaagacacagaaagacgttggactaacgaaaacattgatgctgtagctttaaaacacttcccatcagctaactgcgagaaagctttggaaagacccattctttacagcaattggttatccaaggattatgtacctgttggaagggaacaactaagagaatatgtaaaggccagactgaaggtgttctatgaggaagaacttgatgttcctttggtgttgttcgatgaggtgttggaccatgttttaaggattgacagaatattcagacaacctcaaggtcacttactactgatcggagtttctggtgccggaaaaacaactctgtccagatttgtagcctggatgaatggtttatctatattccaaattaaagtacacaacaaatacacagcggaagatttcgatgaagatctaagatctgttttgagaaggagtggatgcaaacatgaaaagattgctttcattttggacgagtccaatatgttagattccagtttcttggaaagaatgaacactctactagctaatggtgaagttcctggactttttgaaggagatgaatatactactcttatgactcagtgtaaggaaggagctcaaagggaaggtttaatgttggattcaaatgacgaattatacaaatggtttacacagcaagtaatgcgtaatctgcatgttgtcttcaccatgaatccctctaccgatggtctgaaagatagggctgccacttctccagctctgttcaacagatgcgtcttaaactggttcggtgactggtcagatggagctctcttccaggttggtaaagaattcacgaatcgtttggatcttgaaaaacaaagctggagatgtccagacttcttcccggctgcttgccatcacatctcagcgtctcctactcatagagaagctgtcatcaatgcctgtgtgtatgtacatcagactcttcataaagcaaacagtagattggttaagagaggaagccgtaccatggcgatcactccaagacattacttagattttattcatcatctcgttaaactgtacaatgagaaacggtcagatctggaggagcaacagttgcatttgaacgttggtctgaataagatcgccgaaactgtagaacaggttgaagaaatgcagaagagtttggccgtcaaatctcaggagctacaggccaaaaatgaagctgccaacgctaaactcaggcagatggtgaaagatcaacaagaagctgaaaagaagaaggtacagagtcaagagattcagcagcagttggctgaacaaacgattcacattgaacagaaacggtcagaagtaatggctgatctagaacaggtcgaccctgccgttattgaagcccaattagctgtaaaatccatcaaaaaacaacagttggtagaaatccgtactatggctaacccaccagctcttgtgaagttggctttggaatccatttgtttactgctcggtgaaaatgctagcgactggaagtcgattcgtgctgtaattatgagagataacttcatcaacaccgtggttaacaacttcaacactgaagatattagtgatgatgtaagggaaaaaatgaagaaccgctaccttagcaatccagattacaacattgataagatctaccacgccagtaacgcttgcggtccacttgtcaaatgggcttgtgcgcaagttcaatacgcagacatgctcaaaaaggtcgagcctctccgtgaagagctcaaatctctagaacaacaagctgaaaccaaccaaaagagaggcgaagatgttaaagcactcattagccaattggaacagagtatcgctgcttataaagaagaatatgcacaacttatagctcaggcgcaggctataaagactgatttggaaaatgtacaagctaaagtagacaggtcaatagctcttctgaaatctctggtcatcgaaagggaaagatgggaagccagcagtgagactttcagatcccaaatgtctaccatcatcggtgacgttcttctatcggctgcatttatagcatacggcggttactttgatcagcattaccgtcaaaatctgtttagcacttggtgtcagcatttaactcaggccagcatccaatatcgagcagatatcgctagaacggaatatctttctaatccagatgaaagacttagatggcaagctaatgctttaccaacggatgatttgtgtactgagaacgcaattatgttgaagaggttcaacagatatcctcttattatcgatccttcgggtcaagctactgaatttataatgaacgaatttaaggataagaagattaccaagactagtttcttggatgactctttcaggaagaatttggaatctgctttgcgttttggtaatcctcttcttgtccaagacgttgaaaattatgatgctattcttaatccagtactcaacagagaattgaggagaactggaggtcgtgtcttgatcactttaggtgaccaagatatcgatttgtcaccatcgtttgttatcttcttatcaactagagatcctactgtagaattcccgcctgatatatgctctagagttacgtttgttaatttcacagttactagaagttccctccagagccagtgcttgaaccaagtgcttaaagctgaaagaccagacattgatgctaagcgttcagatttattaaaactacaaggagaattccacttaagattaagacagctagaaaagtctctgttacaagctttgaacgatgcaaagggtaaaatcttggacgatgacagtgttatcacaactctagaaaccctgaaacaagaagcagcagaaattggtcagaaagtcgaagaaaccgataaggttatttctgaaattgaaacggtatctcaacaatatctaccgttatcacaggcttgcagtaatacctacttcaccatggacagtcttaaccaagttcatttcttgtatcaatattcactcaagatgttcttggatgtttttgccactgttttgcataataactctcagctggatggaatcagcgattaccaagctagattgaacctcatcacatcaaatttattctctgttgtatatgaaagagtggcaagaggtatgctccacaacgatcgacttacatttgcaatactactctgtagaatccacttgaaaggacagctaaccgaaccgaatttggatcaagaattcaacttcttccttagaggcaaagaaggtgttttcagtaacaccggtgcattcgctaccgatggattgaacagcgatcaacaagaagctgtcgttagattatcgacaaaattaccaacatttaagaaattagcgaaccaaataaaggaaatgcctgaatttggagcttggttgcaacaaggaagtcctgagcaagcagttccacaattgtggattgaggaaaaacaactcagtgcagtgggtagagcaatgtaccaactgctggttatccaagccttcagacctgatagagtaatagctgctgctcataacttcgtatcggtcgttctgggagcggacttcatgtacttggcagaaaaagaacttgaatttgccgcatgcgtcgaaaaagagattagatctaacgttccagcacttttatgctcggttcccggtttcgacgcttctggtcgtgtcgatgatcttgcagccgaacttaacaagcaaatatccagcattgctatcggatcagccgaaggattcaaccaggctgatagagctataaatatggcctgcaagactggaagatgggtcatgctgaagaacgtacacttggctcctcaatggttagtccagctggagaagaagcttcattcacttcaacctcacgccaactttagactattcctcaccatggaaattaatccgaaactaccagttaatcttcttagagcaggaagaatatttgtattcgaacctccaccgggtattagagctaacctcttgagaacattcagcacagttccagccagtaggatgatgaaagcaccaaacgaaagagcaagactttacttcttattggcgtggttccacgcgattgtccaggagaggttgagatattgccctctaggttgggcaaaacattatgaatttagtgaatcagatttaagagttgcctgtgatactttggatacttggattgatacaacggctatgggaaggacgaatttgccgccagagaaagtcccatgggacgccctagtcactttgctctcgcaatccatctatggtggtaaaatcgataacgatttcgatcaacgactgttacattccttcctgaataaactttttactcccaagagctttgagagcgactttgctttagtggcgaacatcgacaacggacctggtggaaatagacacattacaatgccagatggtactagaagagatcacttcttgaagtggatcgagagttttgctgatagacaaactccagcttggttgggattaccaaataatgctgaaaaggtcctattaacaactagaggtaccgatttaatagccaaactattgaaaatgcaacagctggaagacgacgacgaattagcttactctattgatgacagctcgcctacagatcatgctgaaattgacggtagaccgtcttggatgaagactcttcataacagcgctcatacttgggttaacttgttaccaacttctcttcagaccttacgaagaactgtcgaaaatattaaagatcccctttatagatatttcgagagggaagtcaactctgcttccaaacttctcattgatgtattacacgatcttaatgatgtacttttgatttgtcaaggggacaaaaagcaaacgaattatcaccgactgatgttggctgagctagtgagaggtattattcccaagaattggcacagatacaccataccgaaaggatgtaccgtcatgcaatggattaccgatttcagtcagagggttaagcaattgcaaaaggtgtctcaagtagtttcttcttcaggagctaaagagttacagagtctccctgtatggttgggtggattactaaatccagaagcctacataaccgccacaagacaatgcgttgcccaggcgaacagctggccattggaagaactccatctagacgtaacaatcacggatagtaccgacaaagattctattcctcacgattgttttgctgtcattggtattaaactacaaggtgctcaatgtcgcaacagtcaacttttactcacctccagcatcatgatagaactaccaatcactcttttccgatgggtccgaatggcgactggcgacgagaaactcaaagagggaaaactgtctcttcctctttatctaaactccacaagaacggaattgttgtatacagtagaactgaatatagcagctggacaggacccacacagcttctatgaacgtggcgtagctttacttacatccacttctttgaactaa

SEQ ID NO: 137 - DNA, 2673 bp, Diabrotica virgifera
atggatcgaccaagtacaagtaagcgaaatgtctttgactccgattcagatagtgtcgacagcactgaagaagctcgccgaagagatctgaaggaaagagatgaattcgcaaataggctcaaaaaacgcgatgaagaacgtactagaaacgttgccagtacttctgataagcgcgcttatgaagaggctgctaaaagacttaaattggacaatgcagaaaaagagaaacttattcctgcactcagagttgcttccaggaggaagtatttggagaagagaaaggaggacaaactacaagaattggaagctgatattgccgatgatgagtacctttttgaggaagatgttttgactgaaagagagaaaaaagatcgtgtacacaagaaagagctgttaaaattggcgcaggaacatgaaaaggccagggaacttgagcgggttcaaaggtatcacatgcccagagatttgggcaaggactccactgctgattacattgaagttgatgacttggagaaggtaccacaatctgaacagaagaaatgggaaaaagatcagatggcctcggcagtgtttaagtttggagcaaaagatgggattaaaaaagaagagtatgagttagtgttagaagatcaaattcagtttatacaagcactacaaatgccaggagtgtctgataagaaagaacccgaactaacggaaacagaaaagaaaaaacttactatagaagaaacaaagaaaagccttccgatatacccttttaaagacgacttaatacaggccattagggaacaccaagttttgattatcgaaggtgaaaccggctctggcaaaaccacacaaattccacagtatttatacgaagctggtttctgtgaagatgggaagaagattggttgtactcagccacgaagagtagcagccatgtcagtagctgctagagtagcacaagaaatgagtgttaaattaggtaacgaagtaggatatgccatcagatttgaggattgcacctctgaaaggacagttattaaatacatgacagatggtaccttacacagagagttcctatcagaaccagatttagcgtcttatagtgttatgattattgacgaagctcatgaaaggactttacacactgacatattgtttggtttagttaaagatatagctagatttagaccagacttaaagctcttaatatccagtgcaacacttgacgtaacaaaattttctgatttttttgacgatgctcctgtttaccaaataccaggaagaaggtttccagttgacatttattacacgaaagctcctgaagccgactacgtcgatgcttgtgtagtatcagtacttcagattcatgtgacacaacccttgggcgacatactagtatttttgactggacaagacgaaatagaaacgtgccaagaacttttacaagataaagttcgtaggctagggtcaaaagttaaagaattacttatattgccactatatgcaaatttacccagcgatatgcaaggtaaaatttttgaaccgacgcctccaggtgctagaaaagttgttttggccacaaatatagctgaaacgtctttaacaatagacaatattatatacgttatagatcctgggtttgcgaaacaaaatcatttcaattcgagaacagggatggagagtttgatggtagtaccaatatccaaagcttctgcaaaccagagagctggcagagctggtagagtagcagctggaaaatgttttaggctatacactgcttggtcttataaacatgagctagaggacaatactataccggaaatccagcggataaatttaggaaacgccgtactcatgttgaaggcgctaggaataaatgatttggtacattttgattttttggatccacctcctcatgagactttggtgttagcattagaacaattatacgctttgggggctttaaatcatcacggagaattgaccaaattgggcagaagaatggccgagttaccggtggatcccatgatggccaagatgatattagcttcggaaaaatacaaatgctctgaagaaatagtcaccataggagccatgttatcagtaaatggtgccatattttaccgaccaaaggataaaataattcacgctgatactgctcgaaaaaatttcagtcacttagcaggagatcatctaagtcttctaaatgtttataatcaatggagggattctgattactccctacagtggtgttacgaaaatttcatacaatacagatcaatgaagcgagcccgagacgtcagggaacagctggttaatttgatgacaagagtagaaatagaaatcgtttccaacgtttctgaaaccgtggacatccgcaaggctatcacctccggttatttctaccacatagctagattttccaaagggggaagttacaagacggtgaagcacaaccaaagtgtcaccatccaccccaacagtgcacttttcgaatcattacctaggtgggttctctaccacgaattagtttttacttcaaaggagttcatgaggcaagtgatagagatcgagagtaaatggttattggaggtagctccacattattataagcaaaaggaattagaagatccgacgaataaaaagatgccgaaaacggtaggcaggagtaccagaactgattag

SEQ ID NO: 138 - DNA, 1371 bp, Diabrotica virgifera
atgaaggtagaggaggtgaaaagtactgtaaagacacaaagaataagtgctcatagtcatattaaaggtttaggtttggatgaagcaggttttgcaattccatcagctgccggcttggttggacaagaacaggcaagggaggctgccggcatagtagtggacatgataaaaagtaaaaaaatggctggaagggctgtgcttctagctggtccaccaggtactggtaaaacagcaattgcacttgcaatagcccaagagttgggaaataaagtacctttttgcccgatggtaggatctgaagtctacagttctgaaataaaaaagactgaagttcttatggagaactttcgaagagcaattggtttgaggattagggaaaccaaagaagtttatgagggggaagtcagtgaattgacaccagtagaaacggaaaaccctgctggaggttatggaaaaactgtaagtcatgttatcattggtctaagaactgcaaagggaagtaaacaactcaaactggatcccggtatatatgaagcactccagaaagagaaagttgaagtaggagacgtcatttatattgaagccacaagtggtgcagttaaaagacaaggaagatctgatgcttatgccaccgaatttgacttagaagctgaagaatatgtgccattaccaaaaggagatgtacataaaaagaaagaagttattcaggacgttacattacacgatctagatgccgctaatgctaaacctcaaggtggacaagacgttttgtcaatgatgggccaacttctaaaaccaaagaaaacagaaatcacagataaacttagaaaagaaatcaacaaaatagtagataaatatattgatcaaggtattgcagaattggttcctggtgtactatttatcgatgaagtgcacatgttagatatagaaacattcacttatctacacagagctttagaaagtgccatagctcccattgttatttttgcaacgaatagaggtcgttgtctaattagaggaacagacgatgtttatgctccacatggtattcctttagatctgttagataggctgttgattattcggacaattccttacggtagaagtgacatggaacaaatactgaaactgagagctaccactgaaggtttagaaattgatcatgaagcaatcgcatcgttaggcgaagttggggcaaaagcaactttaagatatgcagttcagttattaacgccagcacatctaacggcaaaaattaacggaagaaacaatatacttcaaagtgacattgaagaagttggttccctatttttagatgctaaagcttcagcgaaagttttatctgaaaataaggagaagtttatgacgtaa

SEQ ID NO: 139 - DNA, 2199 bp, Diabrotica virgifera
atgacttcaattataaaactgcaagctttgtcaggagccaaagatgaatctcccccatgctatattcttcaaattgacgaagtgcgaatacttttagactgtggatgggacgaaaaatttgacatggaatttattaaggaaataaaaaggcatgttcatactatagacgcagtgttactgtcttatccagacatatatcatttgggagcccttccctatgtagttggaaaactgggtttaaattgcccaatttatgcaactatacctgtatacaaaatgggacagatgtttatgtatgatttatatcaatctcagtacaatatgaaagagttttgcattttttcactggatgatgttgatactacatttgaaaaaattattcaattaaaatataatcaaaatgtaccattgaaaggtaaaggttatggtttaacaattacacccttaccagctggtcatatgattggaggtacaatatggaaaataatgaaaatggaagaagatataatatattgtaatgatttcaatcataagaaagagcgacatttaaatggttgtgagctcgatagactgcaaaaaccttccttacttattactgatgcgtttaatgctacttatcaacaagccagaagaagggctagagatgaaaaactaatgaccaatattcttcaaactcttcggaacaatggtaacgtacttatagcagtagacacggcaggcagggttctggagttggctcacatgttggatcagctatggcgtaacaaagaatctggcctattggcctactctttagcgtttttaaacaacgtcagttataacgttatagaatttgccaaatcccagatagaatggatgagtgataagttaatgagaagttttgaaggcgccagaaataatccctttcaatttaaacacttgcagtggtgtcacagtttagcagaattaagtaaagttcctagtccaaaggttgttcttgcaagttcacccgatttggaaagtgggttctccagagagttgttcctgcagtggtgttctaattccaataacagtattatattaacaacaagaacatcccctggtactttagctagagacttaattgacaacggagcagaaagaaatatagatttaacggtagaaaggcgagtaaaactcgaaggcgtagagcttgaagaatatgaaaaacgacaacgagcgcgaggtcaaaatgtagaaaaggaagatgcagattcggactctgattctgacatagaaatgtctgttatcaccaaaggtagacatgacatagttattaaacaagagggaaaaataaatgccggtttctttaaggtcacgaaaaaaatgtatcccatgtatcccttccacgaagaaaaaattaagagcgatgaatatggagaaattataaaacctgaaaattacaaattggcagatgtggctgtagaaggagaggacaataaagaaaatgtattgataaaaaaggaagtggaggaagaaatcactgaaatacatgaacagccaacaaaatgcatagtacttcagagaactgtacaagttaattgtcaggtacattatatcgattttgaaggtcgctcagatggagaatcccttatgaaaattttgtcgcagctcaaacctagaagagtaatagtcgttagaggtgacgaggaaaatacatcggtcatagcaaaacattgcgaaggtataaaagccagagtttttacgccatctcgaggggaaattgttgatgctacgagcgaaacacatatttaccaagttagattaacagatgcactagtatcacagttaagctttcaaaaagccaaagaagcagaggtagcttggattacagcgaacgtagttcttaaagagagtcaagcagacgctaagcgtgtttatgtggatgatgaaccaatggaagtcgaagatgtggacacaaggattttgacgctggaacctgtactagaaggagattgtcatgatccagtttttataaacgaattaaaattatctgaatttaaacaagttttaggaaggcacaacattacttcggaattttcaggtggtgtcttatggtgttccaatggaacaatagctgtgaggagggtggagtctggaaagattatgctagagggctgtatatctgaagattattatagagttaaggatttattgtatgagcagtatgctatattgtaa

SEQ ID NO: 140 - DNA, 2283 bp, Diabrotica virgifera
atggctcctttagagtcaactaataacaacaacaatgaggaacctggcccaataaatccaattgtgggaattatttatccaccaccagaggtgagaaatattgtcgacaaaactgcaagttttgttgctagaaatggtccagaatttgaagctcgtattagacaaaatgagttaggaaaccctaagtttaattttttaaacagtggggatccttaccattcctactatcaacataaagttaaagactttagggaaggaaaaggacaagatcctacccctggattaactcaagccgtctcaaaactttctgtcactgcatcagctcaacagaaacagcaagaaattttaaagcaagtagaacagccctttatacccaaggaaacaccttcagaatttgaatttatagctgatcccccatcaatttcagctctagatttagatattgttaagcttacagctcagttcgtagctagaaatggtagagcttttctgacacaattgatgaatagagaacagagaaatctgcagtttgattttttgagacctcaacactctttatttcaatacttcaccaaattactggagcaatatacaaaggttcttattcccccaaaaagtatgcatgaaagcctgcgaaacgaggctaatagtccgaagaatgtgttagagcaagtcaaatatcgtgcagaatggttgaagtatcaagagcaacaaaaagctaaggaagaggagcttttagaacgagaaagggttgcgtatgcacaaattgactggcatgagtttgtagtcgtcgaaactgttgactaccaacccttcgaaattggaaattttccggctccaactacccctgaagaagtcggagcccgtattttaattcaagagaggatagaagaaggggaagatatcgaaatgcaattagagagtgatgaggaagaaccaccagttatggaagctggtttaagcagcatgcaggacaaaaccaatcggaagacacgcgacgataccagaattcaagatatggaagaagaaagctccgatgaagaaaaagaagaagaagaggaattagctttacctccaccaccaccatctattcaaccaccgttacctcctattcctgataaagttgtcgtgaaaaaatatgatcccaaacaagctgtcaatgttagtcggccaacaattggagatgactttctcgtctcacccattactggagagaaaatacctgcgaacaaagtccaggaacatatgcgtattggtctgttggatccgcgttgggtagagcagcgcgacaaacaaataacggacaaaatgaaccaagaaacagtatatgctgctggtagtgccatcgatgcttcattgaaactgctcgccgagagacgtactgatatttttggagttggagatgaagaaacagctattggtaagaagattggtgaagaagatgttagaaaagacgagaaggtaacttgggatgggcatacgagtagcgttgaagccgctacaagagctgccagagccaatatcaccttggaggaacaaattcatcaaatacacaaggtaaagggtttgcttcctgatgaagaaaaggagaaaatcggtccaaagaatattggttcaaaatctggtaaaatcaacattcaaagcgtaattactacgaagccgcctacttcacttcaacccaaaccgccagtctctttaattcaaacccaagcaactgcgtcgctaatatcggtaccaccacaacctatgttaccacctcaacctcccattatgatgatgtcagctacatctatgcctcccattagaccacctccaataatgatgacaggacctcctccaataccgggttttcctgtagcaccaatgtcctcacctatgggtccacctatgaatctgtccccaatgaaacatcaggctgaagcacctcacgaagatgaaccgagtaacaaaaaaatgagaaacgaagattcgcttataccggaaaaactatttttagcaagacatcaaagccaagtagctatcaagatttcgattccacatatgccagaaaaatcagaatggaaactgacgggtaagatgatttcgtggactgtaccacttgccgaatctgtagcgaatttgaaggcgaaactgcaagaagaaactaacatgcctccagctaaacagaagctcttttttgatggtatgttctttaaggattccaacagtttagcatactacaacgtgactactggttcaatcattcagctacagattaaagagagaggaggaaggaaaaaataa

SEQ ID NO: 141 - DNA, 969 bp, Diabrotica virgifera
atgccgagtcaagaattaacaactaataaagtaatagtccaccctttggttcttctaagtgtggtggaccattttaatcgcatgggcaaaatcggcaatcaaaagcgtgttgttggtgttcttcttggctgttggcgtgctaaaggagtcttagatgtttctaacagttttgcagttccttttgacgaagatgacaaggataagtctgtgtggttcttggaccatgattacttagaaaacatgtatggaatgttcaaaaaagttaatgccagggaacgagtagtaggttggtaccacaccggccccaaacttcatcaaaatgatattgccattaatgagttaatcagaaggtattgtccaaattccgttctagttatcatagacgctaaaccaaaagatttaggtttaccaactgaagcttatcaagctgtagaagaagtacacgatgacggttcacctacatctaaaacatttgagcatgttcctagtgaaatcggagctgaggaagctgaagaagttggtgttgaacacttattgagagatattaaagacacaactgttggtactttgtcacagagaataacgaatcagcttttagggttaaaaggtctccattcacagttacgtgatattagggactatttggtacaagtgtgtggtaaccagcttccaatcaatcaccaaatcatctaccaattacaagacatatttaatcttttgcccgatataaatcaggatgcatttaatacatcgttttacgtgaaaaataacgatcaaatgttagtcgtttatctagcagctttagttagatctattgtcgctctacacaatcttattaacaacaaactaacaaatagagacgcggaagaaggaaaaaaggaggatagtaagaaagaaagcaaagataaggacaaggataaagagaaggaaaaggataaagatgctaagaaggacgagaagaaaaagtaa

SEQ ID NO: 142 - DNA, 1656 bp, Diabrotica virgifera
atgtttggtggaggacgtgcccctattttggtgttaagtcaaaataccaaacgagaatccggtcgaaaagttcagctggaaaacatcaatgccggaaagcaaatcgcggatgtgataaggacatgccttggtcctcaagctatgttaaaaatgcttatggatccaatgggaggtattgtgatgactaatgatggcaatgctattttacgtgaaattacagtacagcatccagctgcaaaaagtatgattgaaattgcaagaacacaagacgaagaagttggagatggtaccacctcagtaattgtcttagcaggagaaatgttagtggcagctgaacagtttttggaacaacatattcatccgacaatcataattcgccagtacagacaagcactcgaagatatgattcagttattggaaggtccattaagtataccagtcgatagaaacgataaaaatgctcttgcccaagtcgtgaaaggctgcattggcacaaaattcataagtaaatggtcagatttggcagtaaatattgctttagatgcagtaaatacagtattattagaagaaaatggcagaactgaagttgatatcaagaggtatgccaaagtcgagaagattcctggaggatccattgaagaatctaaaattttaagaggtgttatgcttaataaagatgtaacccatcccaaaatgaaaagatatatacagaatccgagaataatacttttggattgtgcattagaatataaaaaaggggaatctcaaacaaacgtagaaatttcagcagaaacagacttcaccaaactattagaactggaagaggagcatgtcaagcgtcaatgtgatgagattattgcactcaaacctgacgtcgtcttcacagaaaaaggagtatcagatttggcccaacactttttactgaaagctggtattaccgctatcaggcgtgttcgaaaatctgataataacagaattgccagagcctgtggagccacgattgttaaccgaacagaagaattacaagaaagcgatgttggcttaggagctggactcttcgaaatcaagaaaattggtgatgagtatttctgctttgtggtcgaatgcaaaaatccaaaggcctgtacaattttactcagaggtgccagtaaagacattctcaacgaaactgaaaggaatctacaagacgccctacaagtcgccagaaatattgtcctatctccccgtttagtgcctggaggtggtgccatagaaatggccgtagcccagcgtctgatgcagaaggctacgcacggaccttatagagctcttgcacacgctttagaaattattccaaaaactcttactcagaactgcggagcaaacacaatcagaacattaactgctttgagggcgaaacacgccaaccacacggacgttaacaaaccatgcctttggggtattgatggcgaaactggagagctcgtagagatggacaagaaagaactgtgggaacctctagctgtcaaactccaaacatacaaaaccgctatagaaactgccattctcttacttcgcattgacgacattgtatctggctccaaaaagaagggaggcaacgaaccaccaactcctagccaaatgcaacagcaagaagctagaggagaagctgaataa

SEQ ID NO: 143 - DNA, 702 bp, Diabrotica virgifera
atgatgcaaacagctaataatgcatattatcccgattattccactgctccaatgcaacgtcaaattaacccctatgcagataatggagggagtgtagtagcaatagcaggtgaagactttgtaataattggtgcagatacacgtttgagtactggattttccatttataccagagaacaaaacaaacttttcccactatcaggcactactgttttgggttgtgcaggatgttggtgtgacactctaacattaaccagaatccttaaatctcgcatgcagatgtaccaacaagagcataacaaaacaatgtctacaactgcatgtgcccagatgttgtcaaccatgctctactacaagagattctttccttattatatatcaaacattctagtaggtttagataatgaaggaaagggctgtgtttacagctatgatcctattggacattgtgaaaaagctacgtatagagcaggtggttcagctggagctcttcttcagcctctgttggacaatcaaattggacagaagaacatgcttaaaacatctggggaacctcttagtcaggagaaagctttgtctacccttaaagatgtatttatttctgctgctgaaagagacatctacactggagatagcgtacttataaatattattactaaagatggagtaaaggaagagtccttccagttgagacgggattag

SEQ ID NO: 144 - DNA, 897 bp, Diabrotica virgifera
atgtttcaatttggattcaacatgtttcctgaggtccccaggccttttaatatgacttataagtgctactcagtggctatgtttcctggcaatgaacgagaagacgttgaaaggggtggaaaaattattatgcccccatcagctttggaacaattgactaggttaaatataaactatcccatgttgtttaaacttgtgaataaaaagacacatcgcacaactcattgtggagttttagaatttgttgctgatgaaggaaaagtttatttgccactttggatgatgaacaacttagtactgactgaaggagatttggttcaaatggaaagtgtttcccttccagttggcacattttcaaaattccaacctcttaatccagacttcttggacattactaatcctaaagcagtcttagaaaatggtttgagatcttttgcctgccttacaacaggagatgtcattgcagtaaagtacaatcaaaaggcttatgagttgtgtgttctagaaaccaaacccggagatgccattagtatcattgaatgtgacatgaatgtggaatttgctgctcctgttggatacaaagaacccgaacaagtcaaaaaggaagaagaagaaatggctatagatcctgcagatttaatgccagaaccttctggatttgtagcattcagaggtgcaggaaatcgacttgatggcaaaaagcgtaaagatacttcaggaactgatagttcagtggccaaaccaacttatgtcagaggaattccagattatgattaccaaataggcaacttaaaatttatcaggagaatgatcaagcagaaatctaacgattatgcagaggacagcgaattcaaagcatttagtggagcaggatttagtttaaaatcgagaacgtaa

SEQ ID NO: 145 - DNA, 1623 bp, Diabrotica virgifera
atgagtgctataccaggaagtattgcatttgatgaatatggacgacccttcataattcttagagaccaagataagcaaaagaggttgaccgggatagatgcacttaagtcacatattttggcagcgagacaaatcgctcaaactataagcacttctttgggtcccaaaggtttagacaagatgatggtgtcacctgacggtgaagtaacagtcactaatgatggtgctactattttgaaaatgatggatgttgaacatgaagtcgctaaattgctagtacagctatcacagtcccaagatgatgaaattggtgatggtaccacaggtgttgtagttttggctggtgccctgttagagcaagcaggatctttattagacagaggtattcatcccataaggattgctgatggttttgagctagcttgtcaaacagctgtagctcatttggaaaaaattgcagaactatttccagtatcagcagaaaacactgaaccattaataaaagttgcaatgaccactctgggatctaaaatcattaacaagtgtcataaacagatggcagaaatagctgttaatgcagtcttagctgttgcagatttagaacagaaagatgttaattttgaacttattaaagttgaaggcaaggttggtggaaaattggaagacacaacattagttaaaggtgtagttattgacaaaacaatgtcccatccacaaatgcccaaagaactaaaagatgtaaaattggctattctcacctgcccgttcgaaccaccaaaaccaaagaccaaacataagttggatgtcagcagtgtggaagattataaggaactaagacagtatgaacaagaaaagttcaaagaaatcgttggtttggtaaagaaagctggagctacattagcaatttgtcaatggggcttcgatgatgaagccaatcacttattgttacaacaagaattaccagctgtaagatgggttggaggtccagaaattgaacttatagcaatagctactgggggtaggatagttccccgttttgaagagcttactcctgaaaaacttggtcatgctggtttggtacgagaaattgcatttggcaccactaaggatagaatgttggttattgaagaatgttcaaattcacgggcagttacgattcttgtcagaggaggtaatcaaatgttagtagctgaagccaagagaagtctccatgatgcattatgtgttgtcaggagtttagttcaagaaccaagagtagtgtatggtggtggagcagcagaaattgcctgctgtttggcagtcgcggctcaagcagatcaactagcttccttggaacagtacgcctatcgtgcatttgctgaagccttagaaagtataccacttgctttggctgataacagtgggctatctgcgatccatacgctaggagaagtcaaggctaaacaagcagctacaggagatccagctctcggtatcgattgtatgaatactggaaacctcaacatgagagaacaacatgttatcgaatcactcagatcaaaaagacaacaatttttgttggccacccagttggttaaaatgatattgaaaattgacgatgtacgccaacctgcatcgggataa

SEQ ID NO: 146 - DNA, 342 bp, Diabrotica virgifera
atggcttctgctatggacgttgatgccgaagaagtagaattgcccacttccagtagctcaaaaggagaaaagaaacgttttgaagtaaaaaagtggaatgctgtagctttgtgggcctgggacattgttgtggataactgtgccatttgccgaaatcatattatggatctatgtattgaatgccaggcaaaccaggcgtcagccaccagtgaagaatgtactgtagcttggggtgtttgtaatcatgcctttcacttccactgcatatctagatggttaaaaactagacaagtatgtcccttagataatagagaatgggagttccagaagtatggacattag

SEQ ID NO: 147 - DNA, 1605 bp, Diabrotica virgifera
atggtatccctaaatcccgtaagaattctcaagcaagaagccgaggaagaaagggcagagattgcccgactcagtagttttgtaggtgctatagctataggagatttggttagaagcaccttgggaccaaaaggaatggataaaattttagtatccagtggtagatctgcaggatcagttgaagttactaacgacggagcaactatcctaaaatcggtgggtgttgataatcctgctgctaaaattttggtggatatgtcaaaagtccaggatgatgaagtaggagatggcaccacatcagtgacagtattagcatctgaactacttaaagaagcagaaaaacttgtagaacagaaaattcacccacaaacaatcattgccggttggaggaaagcagtagatattgccagaaaagctcttctagaaactgccaaagacaacagctctgattcagaaaagttcagagaagatctgatgaacattgccagaactacactcagctcaaagattctttcacaacataaagaatattttgccaaactggcagtagatgctgtgctgagattgaaaggtacaggtgatttacaatccatccagctgattaagaaaactggtggtactttggaagattcctttttggatgaaggttttttattggacaaaaaacctggtgtacatcaaccaaagagagtagaaaatgcaaaaatcctgatagccaacactcctatggacacagataaaatcaaagtatttggttctcacattaaggtagattcaatggctaaaattgcagagctggaatctgcagaaaaggaaaaaatgaaagataaagtgaacaaaattcttaaacataatgctaatgtatttattaatagacagttgatttacaattatcctgaacaattgtttgctgatgcaggagttatggctattgaacatgcagattttgatggaattgaaaggctagcacttgtcacaggaggagagattgtctcaacatttgaccatccagaattggtaaaacttggaacttgtaagcttattgaacaaatcatgattggagaagatatcctgctccgtttcagtggtgttgctcttggggaagcttgcacaattgttatcagaggtgctacacaacagatcattgatgaagctgaccgttcccttcatgatgctttgtgtgtattagcagccacagtcaaagagagtcgaattgtgtatggaggaggttgcagtgaaaccctaatgtccacagcggtatcaagagctgctgctaacactccaggaaaagaagctgtagcaatggaagcgtttgccagagctttgttgcagttgcccacaattattgcagacaatgcaggttacgactctgcccaattggtcagtgagcttaaggcagcacataacagtggccagagcaccatgggacttaacatggaaaagggtgaattgggggatatgaaaaccttgggaatcacagaatcttttgttgttaaaagacaagtattagtctcggcatctgaagcagctgaaatgatcttgcgtgttgataatatcatcaaggctgcaccaaggaggagaacagaagacaggggaatgtgctag

SEQ ID NO: 148 - DNA, 852 bp, Diabrotica virgifera
atgtttcgaaaccaatacgatagtgatgtgacagtgtggagcccccagggccgtctgcatcaggtagaatatgccatggaagcagttaacctaggttcagccacagtgggactgaaaagtaaaactcatgctgtacttatcgctttgaagagggcttcttcagaactgtctgcctaccagaagaaaattatcaacatagacgatcacattggtatcaccatctcgggacttacagctgatgctaggatccttagtagatatatgcgaaacgaatgcttgaattataagtactctttggatacttatatgccattgaataggcttatcagtattttaggtaacaaaatgcagacatgtacccaaagatacgaccgcagaccattcggtgtaggtcttctagtagctggttatgacgaatctggttctcatatctaccaaacgtgcccttctgctaatttctacgattgcaaagctatgtccattggagctcgatcccagagtgccaggacatacttagaaaaacatctggatgaattgccatctagttctttagaagaacttatcaaacatggattgagggctcttagagatactctacctccagaggttgacctcacaactaaaaatgtctccataggctacactggaaaaggccagaccttcaaaatccttgaagaagaagaaacttccccctacttgtcccttattgagggtgaagaacgtagaggaggaggagctgcagctgctgcaattgaggaccttcctgcagatccattgagagatgatgcgggggacgagcccagggatgcagtcccagctgtggaaacttctgccatggataccacagaatag

SEQ ID NO: 149 - DNA, 2547 bp, Diabrotica virgifera
atgccgataaagcctggggatgaaacggaaaatatggaaataacctttagtgatgaagatctcccatatgaagaagaaattttaagaaacccttattcagttaaacactggctaagatatatagaccacaaaaagacagcaccaaataatggcgtcaatataatctttgaaagagccctgaaggaattaccaggatcctacaaattatggtataattatttaagaactagaagaaatcaaataaaaagtaaatgtataacagacccaggttatgaagaagtgaataatgcatttgaaagatcattagtgtttatgcacaagatgcctagaatatggatggattattgcacatttttgacagatcagtgcaaaatcactaggtcaagaaaagtatttgacagggctttgagggcattgccagttacccagcacaacagaatttggcctctgtatttaaaatttgttcaaaaacatgatataccagaaactgcagtaagagtttttcgaagatatatgaaattatgtccagaaaatgcagaagaatttatagattacctcacaggtattgaaaggctagatgaagcagctcagctgatggcaaagattgtgaatgatgagggttttgtttctcaacaaggaaaatcaaaacatcagttgtggaatgaactgtgtgaattgatctcaaagaatccagaaaaggtacattctcttaatgtggatgccattattaggggtggtttgaggagatatactgatcaactaggccacctatggaattctctagccaattactatgttcgaagtggtttatttgaaagagctcgtgacatatatgaagaagctattcaaacagtgaccactgttagggacttcacccaagtctttgatgcttatgcccaatttgaggaactgagtttaagcaaaagaatggaagaagttgctaataagtctagtcctactgaagatgatgatactgaattagaattgagacttggaaggtatgcatatttgatggagagaagattgttgctgctgaattctgttttgttgaggcagaatccacataatgtgcaggaatggcacaaaagagtacagctttatgaaggaaaaccagtagatataatcaacacctacacagaagctgttcaaactgtagatccaaaactggctgtaggaaaacttcataccttatgggtggactttgccaaattctacgaaaccaatggtcaaatagaagattcacgcctcatctttgaaaaagcatcccaagtttcttacgtcaaagtagacgatttggcaacagtgtggtgtgaatgggccgaaatggaaataaggaacgagaattatgatgaagctttaagactcatgcataaagcaactgttatgcctagtcgaaaagtagcatatcatgatgacactgaaacagttcaaagtcgactatataagtctctcaaagtttggtccatgtacgcagatttagaagaaagtttcggcacctttaaatcctgtaaagctatttacgacaaaataatagatttgaaaattgcaacacctcaaattattataaactatgggatatttctagaagaaaataattattttgaagaggcattcagagcgtatgaaaaaggaatatctctatttaaatggcccaatgtatacgacatatggaacacctatttgacgaaattcctgactcgttatgggggatcaaaactagaacgtgccagagatctgttcgaacaatgcttggatggatgcccacaacagtttgccaaacatctttacctgctctacgcgaaactagaagaagaacatggaatggctagacacgctatggctgtatatgaaagatcaaccaaagctgttccagagcaagaaatgttcgacgtttttaatatatatatcaaacgagccgccgaaatctatgggattcccaaaacgaggcagatctacgaaaaggctatcgaggtacttccagaggacaaaactagagaaatgtgtcttagattttctgatatggaaacaaaactgggtgaaattgatagagccagagctatatatgctcactgtagccaaatttgtgatccgaggataacggcagagttttggcagatatggaaagagttcgaagttcgtcatggtaatgaagataccatgagagaaatgttaagaataaaacgtagcgtacaagctgtttacaacacgcaggtgaatatgatgtcagcacagatgttgagttcggcgggcagcatgagcggtacagtagcggatttggcgccgggagttaaagacggtatgagactcttggaagccaaagccgttgaaatggctggaacttcacaagtcgccaaacctggaggtattatgtttgttaggggagaaactcaaggagctaataaagataaggttgttaatccagacgaaattgacatagacagtgaagaatcggaagcggaagaagaagtaccagtcgaaaagcagaacgtaccgtcagaagtttttggaagtcttaagaaacaaggacagggagacgatgacgattag

SEQ ID NO: 150 - DNA, 1176 bp, Diabrotica virgifera
atggccaacggaccgatagcagaaagaaatcgagatgccactatttatgtgggaggcctagatgataaagtttcggagtccttattgtgggagctctttgtacaagcagggcctttagtcaatgtacatatgccaaaagatcgagtaacgaccatgcaccagggctatgggtttgtagaatttatgggagaggaggatgcagattatgctattaaaattatgaatatgataaaattgtatgggaagcctataagagtaaacaaagcttcggctcatcagaaaaacttagacgtaggagctaacatttttattggaaatttagacccagaagtagacgaaaaattactctatgatactttttccgcatttggagtaatattacaaacacctaagattatgagagatcctgatactggcaactccaaagggttcgctttcatcaattttgcaagcttcgaagcatcagatgcctccatcgaagccatgaatggccaatatttgtgcaatagacccatatcagtgtcttatgctttcaagaaagactcaaaaggagagagacatggatctgcagctgaacgtcttcttgctgctcagaatccattatcacaggctgataggcctcatcaactgtttgctgatgcacctccaataggtttgatgcccatgtccatggccccacctcctccaccagtcataatgacaggaatgatgcccccaccgcctccaacactatcaaacttgccacctcctcctccacctgtaccaccaccaggaatgggaagttccttcccagcaggaataccacctcctccattacctccctcccaaccacccttaccacctggtgcaccaccaacgatgccaactgcggcaggagcccaagccagaccccctttaccaccgcctccagtggcacctcatggactgatacctccacctccaacgtggacaggtgcagctcctgggagcttgcccattcctccaggtccaccgactcctgcaggaggtgcttcatttggtggaatgttcccgcctcccccaccacccggaggaagaccaccaccgcctaactggaggcctcctccaccaccaccaccaggttttgccggaggtagaccagctttccctgtaaggggacctccaccacccccacctacttttgatactaaaatttga

SEQ ID NO: 151 - DNA, 774 bp, Diabrotica virgifera
atgggtcgtgtaattcgtgcacaacgtaaaggtgcgggatctgtattcaaatcccacacaaaaaagaggaaaggagcacccaaactacgttatttagatttctcagaaagacatggttacattaagggtgttgtaaaagatatcatacatgaccctggccgtggtgctccattggcagtagtacatttcagagatccctacaagttccaaactaggaaggaattgtttattgcccccgaaggaatgtacactggacaatttttgtactgtggaaagaaagctaaccttcaaattggaaatgtattgcctgtaggaactatgcctgaaggtaccattgtatgcaacttagaagaaaaaactggtgaccgtggtcggctagctcgtgcatctggaaactatgctaccgtaattgcccataatcacgacacaaagaaaaccagagttaagttaccttctggagccaagaaagttattccatcaaacaacagggccatggtgggtatcgttgctggaggtggtcgtattgacaaaccaatcttgaaagcaggtcgtgcttaccacaaatacaaagttaaacgtaactgctggcctaaggtacgtggtgttgctatgaaccctgttgaacatcctcacggaggtggtaaccatcaacacattggtaaagcatccacagttaagagaggaacatctgctggtcgtaaagtcggtcttatcgctgccaggagaactggtaggattaggggaggcaaagttgatgccaagaaagaggattag

SEQ ID NO: 152 - DNA, 417 bp, Diabrotica virgifera
ggaataatggcacgtacaaagcaaacagcccgaaaatccactggtggtaaagcaccacgcaaacagttggcaactaaagctgctcgcaagagtgcacctgctactggaggagtcaaaaaacctcatcgttacaggccaggtaccgtagcccttcgtgaaattagacgttaccagaaaagtactgagctacttatcagaaaactacctttccaacgtcttgtccgtgaaatagctcaagattttaagacagacttacgttttcagagttcggcagttatggctttacaggaagcgagtgaagcatatttggtaggtttattcgaagataccaacttatgcgctattcatgctaagagagtgactattatgcctaaagacattcagttggccagaagaatcagaggagaaagggcataa

SEQ ID NO: 153 - DNA, 1593 bp, Diabrotica virgifera
atggctatcagtttgttaaatccaaaagctgaagtggctagagctgcacaagccctagccgttaatatatcagcggcaaaaggcattcaagatgtaatgaagtcaaaccttggtcccaaaggaacagtgaaaatgttggtatctggtgccggcgatataaaaataaccaaagatggaaacgttctattgcacgaaatgcaaattcaacaccccacggcttcccttattgctcgagcctcaactgcccaagatgatatgaccggcgacggcactacatcgactgtgttagtcataggtgaactattaaaacaagcagatatttacatagcagaaggtctccaccctagattgttaacagatggctttgataaggctaggacaaaagcgttggaagtactggagaaaatgaagatttcaattgaagcgaacaaagaaactttaacagatatttgcaggacgagtttaagaacaaagctgcatcaaaaactggctgatgttttgacagacgtttgtgtggatgccgttctagctataaagaaagatgacaaacctgttgatcttcatatggttgaattaatggaaatgcagcacaaaacagaaacagatactcagttaattaagggtttagtcctggaccatggctcccgtcatccagatatgcctaaaagtctcaacaactgctacattttaacatgtaatgtcagcatggaatatgaaaaaagtgaagtcaattcaggattcttctacaaaactgcagaagagagagaaaaattagtgactgcagagcgtgaattcattgagcagagagttaagaaagtcattgaactgaaaaggtcactctgtaatggaactgataagacttttgttgttattaaccaaaaaggtattgaccccatgagcctggatatgcttgccaaagaaggaataatagctctcagaagagctaagagacgtaacatggagcgtctatcattggcttgtggtggagtagctatgaacagctttgatgatctgcaagaatctcaacttggtagagccggacatgtatatgaacatgtgttgggagaaaataagtatacatttgtggaagattgcaaaattcctcaatcagttactattttaatgaaagggcccaataaacatactttgactcagattaaagatgcagttagagatggattaagggctatcaataatgccattgacgataaagcagttattccaggtgctggtgcatttgaagtcacagccaataaagaattgctagcatttaaagacactgttaagggtaaagctcgtctaggagttgccgcttatgcagaagctttactggtagttcccaagactttggctgttaactctggatttgatgcacaggacaccattctaaaactacaagaagaatcccgtttgaatccagacccaatcggtttagatctaacctctggggaacccatcaatcctaaagatgctggcatctatgacaactatattgttaaaaaacaaataatcaattcctgttcggtcattgccagcaacctcttattggttgatgaaattatgagggctggaatgagcagcttaaagggataa

SEQ ID NO: 154 - DNA, 3120 bp, Diabrotica virgifera
atgtctagtggtagtttagcagacaactccatcgatcctccagccaaaaagcggaagcttgaatcaaagattgctaccctcgaaatggcgaacaatgaagcttcaggatcctccaccagtgatattgatgagggactttactcaagacaactgtacgttttggggcacgaagctatgcgccgcatggcaaatagtgatgttctaatatcaggtttaggtggtttgggtgtagaagtagctaaaaatgtaattcttggtggtgttaaatctgttacccttcacgatgaggctctttgtactattaaagacctgtcatcccaattttatttaacagagggggacattggtaaaaaccgcgcagaagcctgctgtaagcagttatctgaactcaacacttatgtccccacaaagtcttacacagggccccttgatgaagctttcatcttaaagttcagtgctgttgtcttaaccacaagcaatcgtgaagagcaactaagaatcagcgagataacacatgaaaacaacattgcattaattatagcagacacgaaaggcctttttgcacaagtattttgtgatttcggaaaatcctttactgttgtagatgtaaacggagaacctttagtctctgcgatgatagcagacatttcgaatgatgtcgaaagtgtagtcacttgcattgacgatacaaggcatggtatggaggatggagactatgttaccttctcagaagttcagggaatgactgaattaaataactgtgaaccaatcaaaatcaaagtattaggaccatacacttttagtattggtgataccaccaagttttctaaatacacccgaggtggtattgtaagtcaagttaaaatgccaaaacatctggaattcaaatcatttaaagattctcttgaaaatcctgagataccgattactgattattcaaaaatggattttcctacgcagcttcatctagcttttaccaccttacataagtttgtagaaaagtctgcaaggctacctaaaccatggaacaatgaagatgcaacagaatttgttaatttagctaaatcgttagctgcaaagggtgattctgaaggagaagttaatgtagacctcttagacacatttgccaaggtatcggctggagatttaaatcctataaatgctactattggtggtattgtagcccaagaagtaatgaaggcatgttctggaaaattccatcccattttccaatggttctactatgatgccatagaatgcctaccacaagataaatcagaaatcactgaagaactagctgcacccactggtagcagatatgatggccaagttgctgtttttggaaaagaattccaaaagaagttagcatcactgaaatattttattgttggtgctggagctattggttgtgaattgttgaagaactttgctatgatgggtgtaggaacacaaggagaagttacagtaactgatatggatttaattgaaaaatctaatttgaacaggcagttccttttcagaccacataacgtccaacaaccaaaatctgccacagctgcaaaggtcattaaaaagatgaatcctgatatcaatgttgttgcacatgaaaatcgtgttggacccgaaactgaaagtgtctacaatgacgatttctttgaaaagcttgatggagttgctaatgcactggataatgtagatgctagaatttatatggatagaagatgtgtctactaccgcaagcctcttctagagtctggaaccctaggaactaagggaaatactcaagtggtggcacctttcctctctgaatcatacagttcttctcaagatcctccagagaaaagcattccaatctgtactttaaagaatttccccaatgctatcgaacatactctacaatgggcaagggatatgtttgaaggattgtttaaacaaaatgccgaaaatgcttcgttgtacataacagaccctgatttcctcgataggactgttaagctacctggtgtacaacctttagaggtattggaatccgtaaaggctgccttaattgatgagagacctaaagatttaaatgattgcatcgcttgggcacgtaatcattggcaagaacagtattccaaccaaattaggcagttgttgttcaactttcctcctgatcaattaaccagtacggggcagttgttctggtcgggaccgaagagatgtccagaagcgcttacttttgacgtaaatgatcccctgcacttggattatgttattgctgcagctaatttgaaggctgaagtttatggtataccaactagtagaaatagagaacaaatcgcagaagtggttatgcaagtcaatgttccagaattcatccctaaatctggcgtaaagatagcagttacggattctcaaatggctatgaatggtaataatgtggatttggatcgtgtttcccaaattaaagaagaattaccttcagtagcagaactaggtggactacgtcttactcctttagaatttgaaaaggacgatgacaccaatttccacatggactttatagttgctgcttcaaatcttcgtgcagctaattacaaaataccgcctgctgatagacataaatcaaaacttattgctggtaagattattcccgccatagcaacaacaacctcagtagttgctggaatggtttgcttggaactctacaaactcaccagaagttatacatccctaactccattcaaaaataatttcattaacctcgctctgcctttcttcagttgctcagaaccaatcgcagcccaacaaatggaatactgtggtaacaaatggacactatgggaccgcttcgacgttcagggagagatgacgcttagtgaatttttggaatacttcaaggaaaaacacggtcttgaaattacgatgttgtcccagggcgtctgcatgctgtattcgttcttcatggcaaaagctaaagctcaagaacgtttcggtctttcgatgtcagaagtcgtcagacgggtgtcaaagaagaaaatcgaacctcacgtaaaagcattggtattcgaactgtgttgcaacgattccactggtgaagacgtggaagttccatatgttaaatacaatttatgttga

SEQ ID NO: 155 - DNA, 789 bp, Diabrotica virgifera
atggcagacgctgatgatctattagattatgaagatgaggaacagacagaacaaaccgcaactgaaacggcaactacagaggtacagaaaaagggtgtcaagggcacatatgtatcaatacacagttctgggtttagagattttctgttaaaaccagcaattctcagagctatagtggactgcgggttcgaacatccttcagaagttcaacatgaatgtattcctcaagctgtcattggcatggatattctgtgccaagctaaatccggtatgggaaaaacggctgtttttgtattagctacactccaagtaatagatcctacagaaaatgttgtatatgttctcgtcatgtgccataccagagagttagccttccagataagcaaagagtacgaacgtttcagtaaatatatgcccaatattaaagtaggggtcttctttggtggcttgcctatccagaaagatgaggaaacgttaaaaaataattgcccgcatatcgttgtgggtactccaggaagaattttagcattggtcagatcgaaaaaacttaatctcaaacatctaaagcattttattttggatgaatgtgataaaatgttggagttattagacatgagacgtgatgttcaagaaatatatcgtaacactccccacgaaaaacaagtcatgatgttcagtgccaccttaagtaaagaaattagaccagtttgcaagaaatttatgcaagatgtaattcaaaattcttataatacacaattttgtaatgacgcacccactcgcaatgtttga

SEQ ID NO: 156 - DNA, 1470 bp, Diabrotica virgifera
atggtaactctcgaagacgttgaaatgaaaaatgcagacagtcctccaggattagaagctggtgatacaaagaaagataccgacctacaaagtgtaatagaaattcgtgaacatgcaagacaaatagaaaaatcagtcacaagtaaagaaaaccgtttcatcttacgagttttacgttgcttgcccaacactagaaggaagcttaatggactggtgctgagaagcctcattactcaaatatatcctgtagctgaacgtgatgccctccttagtttcgtcgaggaagcttctggagaactcgacgccacccagtcacgagcaagatcagctgttaagtcacctgttcccgaggtagatacatatataaatcttttaatactagtacgtttaattgataccaataagttagttgaagcagagcgctgttctcaagctcttatgaataaaataactaaccaaaacagacgtactatagatcatattgctgccaagtgttatttctatcactcaagagttgctgaattgaccaacaaattggattcaattagagggtttttacattctcgtctacgtaccgctacactcaggaacgactttgaaggtcaagctgtgcttataaattgcctgttgagaaattatttgcattattcgttgtatgatcaagctgacaaactagtgagtaaatgcgtatttcctgaaactgcaagtaacaatgaatgggccagattcttatactacttgggcagaattaaggcggcaagattagaatacagtgtagcacataaacatcttgtgcaggccatgagaaaagcaccccagaatgctgccattggtttcagacaggttgttcaaaagcttactgttgtagttgaactactgctaggagatataccagaacgacagatttttagacaatctagtatgaggcactcccttgccccatactttcaactaacacaagcagttagaatgggcaatttgcaaagatttggtgaggtgttagagaacttcggcccacaatttagacaagatcatacatttacactaattttgagactgcgccacaatgttattaaaacagctataagatccataggattatcatactccagaatatctccccaagacatagctaagaaactggggctggattcagctgaagatgcagaatttatagtagcaaaagcaatcagagatggggtgatagaagctacacttgatccacagggaggttacatgaggagcaaagaaagtactgacatctactgcacaaaggaacctcaactggcgtttcatcaaagaatatcgttttgcttagatttgcacaatcaaagtgtcaaagctatgagatatccccccaaggcgtatggcaaagaacttgaatcagcagaagagagaagggaaagagaacagcaggatttggagttggccaaggaaatggctgaagaagatgatgatggttttccttaa

SEQ ID NO: 157 - DNA, 1668 bp, Diabrotica virgifera
atggctaccaatcaccaaaaccttccaatttcgagtatccttaaatcaaaaagtgaagttgatgatgaaccaaagaagaaatcaagagaagattggcgtaaagccaaggagcttgaagaagccagaaaagctggtacagctccggctgcagtcgatgaagaaggaaaagatatcaacccccacattccacagtacatttctaatgcaccttggtattatggcacatctggacctacccttaaacatcaaaggccccaagaagagaaacagaaggagtactcaaacatcgacgaatggtacaagcggggtgttgacacttcaaaaatagttactaaatatcgtaaaggtgcatgtgaaaattgtggagctatgactcataaaaagaaagattgtatggaaagacctcgcaaagttggagccaaattttccggggcaaatattgcaccagatgaatttgcccagaaaaacttagcgttgagctttgatggaaaaagagatcgatggagtggatatgacccatctgagcacaaagcagtaatagaagagttccagaaagttgaggaagctaaaagacaactgaaggctgataagttaaatgcaaacgaatcttctgacgatgaagaaaaagatgaggacaaatatgtagatgaagttgatatgcctggtactaaagtagacagcaaacagagaattactgtaagaaatttgaggataagagaagacactgcaaaatacttgaggaatcttgatttaggttctgcttattatgatcccaagacaagatctatgagggaaaaccctaatcctgaaaaagatgctacgtacagtggagagaatttcgttcgttttacaggcgataccaccaatcatgcgaaggctcagttatttgcttgggaagcgtatgaaaagggtgtggatgttcatcttttagccgaaccaacaaaactagaactgctcaaaaaagaatacgagaaaaagaaggaacaggtcaaatcaacaattcaaggcagtgtgctcgataagtatggaggacaggaacatttagaagcaccaccaaaaagcttgttgttggctcaatcagaagtttatgtggaatattcgagatctggtagggttattactggagcggaaaaagaagttattagatccaaatatgaagaagatgtgtacataaacaaccacacatcagtgtggggatcgtattggagaggaggacaatggggatacaaatgttgtcactccttcataaagaattcctattgcctaggcgaggcaggaaaaacggttaacgctcctgtaacccaagatattccaaaagatcaagacgttggtgaagcaagcagtacaaaggaagctgggatatcagacggtgagagcgaagatagtagttccagtaattcatcagaaggcgagaaactgaagaagaaacagagaagattaaagaaaaaggaaaagaaggcaaagaaaaaggagaaaaaagcaaaagaaaaattaaagaaaaaacaggaaaaagaaaaggccccagaaatagacgaggaaataatgttggacgatagaaaaaggccgtacaacagtatgtttgacgctaaaaaacccacagaggaagaaatggaggaatattataaaaagagaaagagggatgaagatcctatgaacaactttatgtaa

SEQ ID NO: 158 - DNA, 627 bp, Diabrotica virgifera
atgggtattagtagagaccattggcataaacgaaggtccacaggaggcaagaggaagcctctccgtaagaagaggaagttcgaattaggacgtccagccgcaaataccaaacttggagcacgtagaattcactatgtccgtacacgaggaggtaacttgaagtaccgtgcattgaggattgaaaaaggaaatttcgcatggggcagcgaaggtactgctcgtaaaacacgtattattgatgtcgtttacaatgccagtaataacgaattggtacgtaccaaaacattggtaaagaatgccatcgttgttattgacgcaacccctttcagacaatggtacgaaagccactatattttacctttaggacgcaagaagggggcaaaattgacagcggaagatgaagaaatgttcaataagaaacgtagcaaaaaagtacagaaaaaatatgaaactaggcaaaaaacagctaaagtagaacctgcattagaagaacaattctcaactggaaggttattagcttgcttagcgtcaaggccaggacaatgtggtagagctgatggttacgtcttagagggtaaagaactggaattctacattcgtaagattaagtctaagaaagctaaataa

SEQ ID NO: 159 - DNA, 936 bp, Diabrotica virgifera
atggatagacttcttcgactaggaggtggaatgccaggtttaactcaggcaccgccgccttctgatgctcctgttgtggatactgccgaacaagtatacatatcctccttagcactattaaaaatgttgaagcacggccgagctggagtacccatggaagtaatgggtcttatgttaggagaattcgtagatgactataccgttcgtgtaatcgatgtatttgctatgcctcagactggtaccggtgtcagtgtagaagctgttgatccagtgtttcaagcaaaaatgcttgacatgttaagacagactggtaggccagaaatggttgtggggtggtatcattcccatccaggtttcggatgttggttgtctggagtggatatcaacacccagcaaagttttgaggctctctcggaaagagctgtagcagtagtagttgatccaatccagtcagtgaaaggcaaagtcgttattgatgcctttaggttaataaatccgaatatgatggtattgggccaagaacctcgccaaactacatccaacttaggacatctacagaaaccatcagtccaggctttgattcatggtctaaatcggcattactactccatcagtattaattacagaaagaatgaattggaacaaaaaatgctactaaatctccataaaaaatcctggatggatggtctaactttagcagattactctgaaaattgtagtgtgaatgaaaagactgtagctgatatgttagaactagccaagaattacaacaaggcattagaagaggaggagaaaatgactccagaacagctcgctattaaaaatgttggcaaacaagatcctaagaggcatttagaagaaaaggttgatattttgatgaccaataatatcgtccagtgcttgggagctatgctagatacagttgtttttaagtaa

SEQ ID NO: 160 - DNA, 1215 bp, Diabrotica virgifera
atgacggtaattaacaagatggaggtggacggaggtccgaagggagaaggttttcggtcatattatattacaaagattgaagaattgcagcttatagtggccgaaaagagtcaaaatcttagacgtttgcaagctcagagaaatgaactcaatgccaaagttcgtatgttgagagaagaactgatgttacttcaagagcaaggaagctatgtcggagaagttgtaaagcccatggataagaaaaaagtccttgtgaaagttcatccagaaggaaaatttgtagttgacattgacaaaaacatagacataaatgatgttactccaaattgtcgagtagccctcagaaatgaatcttacacattgcacaaaatacttccaaacaaggttgatcctttagtttccttgatgatggtggagaaagtccctgattcaacttatgaaatggtaggaggacttgacaagcaaattaaagaaatcaaagaagtaattgaacttccagttaaacatccagaactttttgatgctcttggtattgcacaacctaagggtgtgttgttatatggaccaccaggcactggaaaaactcttctggcacgtgctgtagctcatcacacagagtgtacatttattagagtatctggttcagaattggtacagaaattcataggagaaggatcccgtatggtaagagaactcttcgtaatggccagagaacatgctccttcaattattttcatggatgaaattgattccattggatcttcccgtattgaatcaggatctggtggtgattctgaagtccaaagaaccatgttggaacttctaaatcaattggatggttttgaagctaccaaaaacatcaaagtaattatggctaccaacagaattgatattttggatcccgctttactcagaccaggaagaattgacagaaaaattgaattccccccaccgaacgaagaagctagattggacatcttaaagattcactccagaaaaatgaacctcacaagaggaataaatctgagaaaaatagctgagttgatgccaggtgctagtggagctgaagttaagggtgtgtgtacggaagctggtatgtatgcactaagagaacgaagggtgcatgttactcaagaagattttgaaatggccgtcgccaaagttatgcagaaggattctgagaagaatatgtccatcaagaagttgtggaaataa

SEQ ID NO: 161 - DNA, 600 bp, Diabrotica virgifera
atggtgaaaatatattgtctcagtgttttatacaaaggaccaacaactgcaacctggttgaaatcagccttcgaacttcaaagcttcagctttttccaaagagggtcaattcaggagttcatgtcattcttttgcaaaaccatagtggaaagaacaataccagcctcaaggcagagtgttaaagaaggagaatatttgtgtcatgtatatgtacgagctgataacttagctggtgttatcataactgatcatgaatacccatcaagggtttctcacacactaataacaaaaatactagacgaatttggtgccaaaattcctgcagctaactggcccagccttgaggagagagatgtaccatttccacaattaaatacctacttagcgaaatatcaaaatcctagagaagcagatgctattacaaaaattcaagaagatcttgatgaaacgaagattattttgcataataccatacaagcagttttggaacgaggcgagaaactagacgacttagtgagcaagtcggaaggtttaagcatacagtccaaggcattctacaagacagcgagaaaaacgaatagttgttgtagttttacatag

SEQ ID NO: 162 - DNA, 729 bp, Diabrotica virgifera
atgtttcttacaagaagtgaatacgataggggagtcaataccttttcacccgaaggaagattatttcaagtagaatatgccatagaagctattaagttaggatctaccgctattggaatatgcaccagtggtggagtagtgcttgctgtagaaaaacgcattacttccccattaatggaacctactacgattgagaaaattgtagaagttgacaaacatattggatgtgcggtttcaggacttatggcagattcaaggactatgatagatagagctcgtgtggaatgtcagaatcattggtttgtctacaatgaaaatataagtgtagaatcctgtgcacaaggtgtatcaaatttggctattcagttcggagattctgatgaagatggtgcagccatgtctagaccttttggagtagcaattttgtttgctggtatagatgaaaaaggacctcagttgtaccatatggatccatcaggaacatttgttcagtttgacgcaaaggcgataggatcaggatccgagggtgcacagcaaagtttacaggaggcatatcatcgcagtatgaccctggaagaagctaccacaactgctttaacaattctaaaacaagttatggaagaaaagttgaattcttcaaatgttgaggttatgactatgactccaaaagatatgttccacatgttcacaaaggaacaagtggaagaggtaattgctaaattgtcttaa

SEQ ID NO: 163 - DNA, 1674 bp, Diabrotica virgifera
atgtcgattttagcaagtccactgtctgtagccggctccagaacaacgggagcttcggttcgcactcaaaatgttatggcagcctctactatcgcaaatgttgtaaagagttcattgggaccagttggtctagataaaatgttggttgatgacattggagatgtgacagtaactaatgacggagctaccattttacgtcttttagaagttgaacatcctgccgccagagtattagtagaattggctcagttacaggatgaagaagtaggagatggtacaacttcagttgttatcatagctgcagaattactaaagaatgctgatgaactcgtgaaacaaaagatacatccaacttcaattataagtggatacagattagcatgcaaagaggcttgtaggtacattcaggatcatttgactattccagtcgaagaattgggaaaggagtgcatcataaatgttgccaaaacctcgatgagctcaaaaattattggagctgatgctgatcttttttcacaaatcgttgtcgatgccgccaatgctgttaaagtgacagattcaagaggaaatagcatgtatcccataaaggctgtcaatgtcttgaaagcacatggtaaaagcgccagagagagcttccttgtaccaggttatgcattaaactgcaccgttgccagccaagcgatgcccaaaaaaattgttaacgccaaaatcgcatgtttagatttttcattgcagaaggctaaaatgaagatgggtgttcaggttttgattactgatccaaatcaactggaagcaatccgcacaagagagctcgacatcaccaaagaacgcatccagaaaatcctctctaccggtgttaatgttattcttgcgagtggtggtatcgatgatctttgcctaaaatacttcgttgaaaatggagcgatgggtgtaagaagagtaaagaaagctgacttaaaacgcattgccaaagcaactggtgccactttcctaacttctcttagtaacatggagggagatgaaagttttgattctagcatggtaggagaggcagcggaagttgttcaagaaagaatttctgacgatgaattgataattattaaaggaccaaaagcacgtacagcagcctctatcatcttgcggggacccaacgatttctattgtgatgaaatggaaagatctgttcacgacgccttgtccgttgtaaaacgcgtactcgaatcgaaaagcgtcgtagtcggtggaggcagtgtcgaagcagcgctttcgatatatttggaaaacttcgcaaccacgctaagctccagagaacaattggctatcgccgaattcgccaggagtttactggttattcctaaaacgttggcagttaatgcagcgcaggacgctacagatttagtagctaagttgagggcataccagaattccagtcaaacgaaaaaggatcatgcgcatttgaaatatgtaggattagatctcatggaaggtaccgttcgagataaccgaaaagccggagttttggaacccaccatgtccaaaataaaatcccttaagtttgcgacagaagctgccattaccatcttgagaatagacgatatgatcaaattggattccgaacaaagaggcggaaagagctaccagcaagccatggagagtggagaattatatgattaa

SEQ ID NO: 164 - DNA, 756 bp, Diabrotica virgifera
atgtttaattctgctgctcctcctttgtggcataacggccccgtacctggagaattttacaattttcccggcaaacagaccagctattccaaccctataacacatacacagtctcccgttacaacatcaacttctgtattagctattacttacgataaaggagtattgatagccggagatctggttgcttcatacggatctttagctaggtacagaaattgcccgagggttattaaagtcaatcagaatatcatcttgggagccggaggagactatgctgatttccaatacgtcaagagtttcattgagcaaaaaataattgatgaagaatgcattgatgatggactaaaaatgaaaccaaaatcattgtactgctggcttactagagtaatgtaccaacgcaggagtaaattagaccctttttggaataatctggttataggaggaatccaggatggagtcccctttcttggaaccgtagataaattgggaactgcatatacagacaaagttatatgtacaggttatggagcccacatagccttgcctcttctgagagactctttagataaaaatggagctcttaacttggccgatgccaaaactctgattcacaaatgcatggaagtattgttctatagagatgccagaagttttcctaaatatcagcttggtgttattgataaagatgatggtgttagtattgaggggcctatttcagtcgaagagaactggagcattgcccatatgacataa

SEQ ID NO: 165 - DNA, 2112 bp, Diabrotica virgifera
tttaaaaatatggaattttcaaaagaaccgaattttcaattattaagtgctagggattttactccagaaaaatatgttaaaaacttatcacaaagttatgtgggtggatctgagttacaaaaccttaggaggaaacttcaatccctttcggaagagactagcaataatttgaagaaaaacgtgtatgaaaactatgttcaatttattgagactgccaaagaaatatctcatttggaaagtgaaatgtaccagttgtcccatttactatcagaacaaaaatcattattaagtgctctgtcaacaacatctattttagaagacactcaacacttgaatattgaaagagagaataagagtaatgacaaggacatagaagaggaaaataagcaaaaacttgcagccattttagaaaaagtggaaggatgcaaggaattgctagaagtaccgggaagaaaatttctatatgaaggagatttgttagaaattgatccaacagaaaatacgtctttgaaaactgttcatgtgtatttatttacagatggatttatgataacaaatagaaattccaatagtcgaggtttgatgaagtacatttatgaaataatgtacgatttaagtagtctagcagtggttaacgtcagagatttaggaaatgttaagcatgcatttaaattgttaatttttccggacacgagagtttttcaatgttcttctaattccaacaagaaagagtggttggacaagtttgaccaagcaaagaagactagattagcccaagagcaacataagagggagtcaatttcggaaaaatcaccctcacgatcagcttcgatagagtctcctagttataacccttttgacgaagttgaagacgatgtaggaaccgttcagccagaatggtttttggacattccagaggaacttgatgtgtgtgtagctcaaagacacttcgaagaggctctttcattgttgcaaaaagctaaggaatatattagccaaatgacggctggtaatgagaaacacgatcatgtgttcctcgatattcaaagaaaggttgaacaacgacaaaatagtcttaccgaagttttaatgaaagaactggaagttaatcctgataaatctttgcaaggtggattgagggctgctagaagagcagtaaggttattaaatcaattaggaagagaaaatcaatcatgtaacttattcctgaaattgtgtagcagtatgttgaggacacagtgtaagcgtgttaaaagagaaggatccaccacaacatacatacgtaatttggcgagtgtagtattcactaacatgtgtcatatgtcagatgagtttctaagggcttttcccgactcaccaacttgtgcttcagcgtatgttgtttgggccagcaacgagttacttctttttactggacattttataaaacaagtatttatgccccagacttcgctgtcaactgtgacagaatgcatagtattagtccgaacgcaatgtgaaaggttatacagttatggtctggatttatgttaccaattggatggtgctttacgatcttccttagtcaaagctttaaaagacgcaagagataaacttatagattcgatcaaacttagagccctagaagataaatggatcccaattaacttgcattccaagtccgctttgggaagatttctacacgaacattcgcaaatgggattaaatttggagagctatgtttcaggtgacacttggattcaactgacagcaagtactttatcgtttacaaaaatgtttttccaattgttaaatgactgtatgaagttaaaaacgactgaattggtatacaccatagacgaaactttgtataatgtgttcgacgctcaattgaaacacaatgaaaatgctcttcgcaatgagttaaatcaggaccaaagaagcttcctaactaaaaatgctgaatttttactggtcaatgtagtcgaagtatcgcagaaaatatatagtcaaaatgtgggctatgagtgtgcaacacttaaaaaactacaaggcgaatatgtggctttaaaaaagggcgtttctccaacaaccagaagtactaaaacaaaatactcatctgaatttttgtaa

SEQ ID NO: 166 - DNA, 3717 bp, Diabrotica virgifera
atggatgaattacagaaattggaatatctttccttggtttctaaggtttgtactgagttagaaaaccatctcggtatgaatgataaagatttggccgaatttattattcatctttccgagaagaatggtacatttgaatctttcaaaaaggcacttatagaaaatggagccgagttttcagattccttcatctcaaatttgctaagaatcattcaacatatgaaaccgaagaaaaataaatcgaaagttgaagctgatgtgtatcaaaaagaaactctcgctaccaaatttcctggtttagctttaccaaacgaaaaacaaaaacctttgtttatagatgaagaagcacctgctgaaaaaaatgaagatgatgacattgtagccgacctaatgaaacagtttgaagcggacgctccctcaaacagtcaaatccaaacaacaactaaatctggaagtgcaagtcctatagaaagaaaaagatcgtcaagaagtaggtctagatctaaaccaagaaaaagacggaaatctagatcaagggacagggactctagaaaggacaaaagacgaagtagatccagagaccagaagaaaaacagaagagatagaagtggttctaggaacaaaagaaataaagaaagaagtaggtctaggaataggagaagcagatcaagggatagaagaagtagatcgagagacaggagaaacagatctaaggatcgaaaatacaaaaattattctagagataaagataggagagaaagaagcaattctagggatataaaacgggatagaagtactgagaagaagttcaaaagtgaaaaagataatccagagtttgaagatgatcctaccccaggaaaaatatataatggaaaagtatcaaatattgtaccttttggatgctttgtccagctggagggacttaaaaggagatgggaaggcttggttcatatttcacagcttagagcagaaggcagagttactaatgtatctgaagtaacatctagaggagctagagtaaaggtcaaagtattgacggtaacaggtcagaaggtgtcattatctatgaaagatgtctgtcagattactggtaaagaccttaacccacattcccatgctccgactgaaagagaagatagagatagaaatcctgacaggcctgtaaacagcagtacgtctgtattgagactgccagtaaacatagatgaaggagaagaagactcccggaaacgagtaacaaggatttcaagtcccgagagatgggaaataaaacagatgatttcatcaggatgtattgctaaaagtgagttgcctgattttgatgaagaaactggattgttacccaaggatgaagatggagaggctgatattgaaattgaattggtcgaagatgaagctccatttttgcaaggtcacggtagggccttacatgatcttagtcctgtaagaatagtcaaaaatccagacgggtcattagctcaagctgccatgatgcaatccgctttggctaaagaaagacgggaacagaaaatgattcagcgggaacaggaagtcgattcccagccttccggtaagaataagagttggatagatcctcttccagaagacgaatcaagaatgatgggcagaggaataggattacaagttcaagatttaccagaatggaaaaaacatgtaataggtggcaaaaagtcatcattcggcaaaaagaccaacttaacaataatagagcaacgtcaatccttaccaatatataagctcaaagaagaattacgaaaagccgtaacagacaatcaaattcttatagttattggtgaaactggttcaggaaaaacaacgcaaataacacagtacttagctgaagccggatttacgtcgagaggaaagattggttgcacccaaccaagaagagtagcagctatgtccgtagctaaaagagttgctgaagaattcggatgtcgtttgggacaagaggttggttacaccattcgtttcgaagattgtactagtcccgaaactatgataaaatacatgacagatggtatgttactaagagaatgcctcatggaccttgacctcaaacaatactcagtaataatgttggatgaagctcacgaacgaactatacatacagatgttctctttggattactaaaacaagcagtcatgaaacgagaagaactgaaactgatagtaacctcagctacgttagatgctgtaaaattttcgcagtatttcttcaaagcgcccatatttactatacccggtaggactttccccgttgaggttctatatacaaaagagccagaaactgattatttagatgctagtttgataacggtgatgcagatacatttgagagagccgccaggagatattttactttttttgactggtcaggaagagattgacactgcttgtgaaattttgtatgagagaatgaaatctttaggtccagatgtacctgaacttataattcttcctgtatattccgcgttgccttccgagatgcagacaagaatcttcgaaccagcgccacctgggagcagaaaagttgtgatagctacaaatatagcagaaacgtctttgacgatagatggtatctactacgtagttgatccaggctttgtgaaacaaaaagtctataactccaaaactggaatggattcattggtagttacaccgatttcacaggctcaagcaaaacaacgagcaggtcgtgctggtagaacgggacctggtaaatgttacagactatacacagagagggcatacagggatgaaatgcttccgacgccagtacctgaaattcaacgtaccaaccttgcaacaacagtcctgcagcttaaaactatgggtatcaacgacctgcttcatttcgatttcatggacgctccgccggtggagtcgttaattatggctttggaacagttacattccttgtcagctcttgatgatgaagggttattgacacgattaggaagaaggatggcagaatttcccttggaaccaaatctttcaaagatgttgataatgtcagttgccctacaatgctcagacgaaattcttacaatagtcagcatgttatcagttcaaaatgtattttaccggccaaaggataaacaagcattggcagaccagaaaaaagcaaaattcaatcaacccgaaggtgaccacttgacgcttttggcggtatataatagttggaaaaacaataaattttctaacgcttggtgttacgagaactttgtacaaatcaggacattaaagagggctcaagatgtgaggaaacaactgctaggaattatggacagacataaattggacgtagtatccgctgaaaggaacaccgttagagtacagaaggccatttgttctggatttttcaggaacgctggaaaaaaggatccccaggaaggttatagagctctagtagatagtcaggttgtttacatacatccttcaagtgccttatttaataggcagccagaatgggtaatttaccacgaactggtccaaacaactaaagagtacatgagagaagttacaaccatagatccaaaatggttggtcgagttcgctcctgccttcttcaagttctccgatccgacaaaactcagtaaattcaagaagaaccagaggttggaaccattgtataataaatatgaagagccgaatgcgtggaggatatcgcgagtacgaaggagaagaaattaa

SEQ ID NO: 167 - DNA, 1245 bp, Diabrotica virgifera
atgtcgtcgaaaagaaaaagtaaagaaagcataattgctagggtgaatttcccactatatactcttcagatgttaacgtcaaggcatgtaatcgttggtggtggaggagggacatccaaaactggtgtacacaatggttttgaaatatttgagatttttcatgacggcacacgctttgcagcaaaagaagtaaccagacacgaaactggaggcaatgttgttatgaactgttctgtttacagtgatagaaaatattctcttttggtagctggacaagaaagtgagtgtcaattgtacaaactgaatcctaaactagtcgaggaagtggaaaatatcggtaataatactcatctcaggcaacggaatacaaaaaacaaagaagttacagatgacaacaaaaacgtgacaaaagagttatattttgatgttaatgcaatagaaaatgttcaaactgactttaatgggagtgaaccattatcgagggtggtaaaaattaatcatgatggtacattattagctacaggtggtacagatggagatgtacgaatatggaagtttcctagtatgcaacctctatttattcttaaggcacatacaaaagaaatagacgatatagattttagtaggtttgacaattatgtgattaccatagccaaagatggtttagcagtattgtgggattgtatgacaggaaaagaaagaacaaaactaacatggaagcagccaggatcaaaatatttatataaacggtgtagatttggcgtaatagaaggactagacaagaaatgtgcactatatacaatatccaatccaataggagtagctaaaaaacaaaaatcctatctccagcaatggatacctgaggaaaacatcttaagaaggtgtatagaatttgatgaaagtttggcagctttagctgttcgtgatgatggtagatttgttgcggttggtacaatgttcagtggatcagtgtccattcttgtagcatttaatttacagaaaattctaaccattgttggagcacattccatgttcgtcactgggcttgagtttctgcccacccagaacttgaaccattccattagtagtgtagtagaagccgcagtcttgtcaatttctgtagataaccaactatgcatacataccgtgccatacagaaaaaccatacctctgtggattgctatcgcacttttagttttaactttatttttgactttctcactatgttcatacttaggtttgtga

SEQ ID NO: 168 - DNA, 1242 bp, Diabrotica virgifera
atggccggagcaatgttatttgaaagagccccgtctgtttcttctcaacacgagaagcttttaaaattatccagggattcagatgatgaagatcaaaatattgtcaataaagaacaagacatccttaatcttggtgagaaatataaaaaggagggcaaggcaaaggaactcgcagagcttataaaggccaccaggccttttttgagtttaataagcaaagcaaaagctgctaaattggtaaggtctctagttgactacttcctagatttagaagctggtattggtatcgaagtacaactctgcaaagaatgtatagaatgggcaaaggaagagagaagaacttttctacgtcagtcccttgaagccaggctgattgctctttattttgacactggaatgtacagcgaagcgctacaactggaatcgaccttactgaaagagttaaaaaagttggatgacaaaaatttgttggtggaagtacaactacttgaaagcaaaacatatcatgctttaagtaatttaccgaaggctagagctgcactaacttcagcacgaaccacagctaacgctatctattgccctccaaagatgcaggcagctttagatttacaatccggagtattacacgctgcagatgagaaggatttcaaaacagcttattcttatttttatgaagcttttgaaggttttgatagtgttgaatccccaaaagccctcacagcccttaaatacatgcttttgtcaaaaatcatgataaacagtccggaagacgtccaacaaatcgttagtggtaaattggcctttaaatacgctggtcaagatatagaggctatgaaatcagttgcacaggctgcacacaaaagatcactagcagatttccaacaagctgtaaaacagtttaaacatgaattagaagatgatgttattgttagagcacatttaggaacgttgtatgacaatatgttggagcagaacctttgcagaattatcgaaccatattctagggtacaagtagagtatgtagcaaaaaccataaaactcccagtactacaagtagagaagaaattgtcacagatgattttagatgccaagtttcatggaattttggaccaaggcgaaggtgtcctcatagtattcgaagaaagtgcagtagacaaaacatatgaaatggccctagaaacgatccagagtatgagcaaagtagtagatactctttatcaaaaagcaaagaaattgtcatag

SEQ ID NO: 169 - DNA, 1767 bp, Diabrotica virgifera
atggcatcgaaatcaaaaaaagggtcaacaccgttagcttcacagcggccggcgagccccttaagtcctaccagacattctagattacaggagaagcatgaacttcagaatcttaacgaccgtttggcgggatatatagatcgagtaaggtatttagaaggtgaaaacaacagattaacgagggaaatacaaagtacccaggaaacagtaacaagggaagtttcaaacattaaatctatgtatgaccatgaattatcagatgctagaaaactattagacgagacccaccgtgaaaaagcacgtttagagatagatgttaaacgtcttttagaagagaatgacgaactcaagtctgagttagcaaagaagaacaaggatttggctctagctgagaattctgccaggatatacgagaccagatgtaacgagttacagctcaaagcaaatcaagcggctgctgatgctaagaaagctattgcagatgctaaggaacttgagaaagaacgtgataagctacgcaaacttcttgataatcatcgtaaacagttagaagaagaatcattagcgagagtggaagtcgaaaatgccaaccaaagtcttcgagaagagctgtcctttaaggatcagatccatcaacaacagttgacagaaactcgtactcgtcgtcaagtagaaatcagcgaaatcgacggtcgcctggcagaaaaatatgaggctaagcttcaagaggctctacaagaactcagagatcaatatgaaagtcaaatggccaacaaccgtggcgaaatcgagttgctttacgaacagaagattaagaacttgcaatcagctaatgacagacatgctgcctctgcctccggtgctcttgacgaattgagacaagttagaaccagaatcgatactttgaattctcgaattagcgatttagagaaccagaacgctggcttagcagctcgtgctagagatttggagaagttgttagagaatgagcgcatgcgccatgtggaagacctcgcaatgttagaaagagaattgcatagactccgagaagaaatggctaatcaacttcaagaataccaggatcttatggacattaaggtttctcttgatttagagatagctgcttatcggaaactgctcgaatctgaagaagctcgtcttaatattaccccaacaggtagtgaagttcatgaagtaactcacagtaggagccaacgcagctcgtcgcaacgtcgcactccagtcagattgggagccaaaagaaagcgaacactactcgaagaaagccaagagtcaagcatgaatgactatacggtgaacagctcctcaaaaggtgacattgaagtcgctgatgtcgatccagaaggacactatgttaagttgcacaataaaagtaatcaagaagtcgcacttggaggatggcaagtcattagacgtgttggtgaggaggaaactacattcaaatttcacaggtcactaaagcttgaaggtaatggatttgtaacaatatggagctctgacctcaacaaagatcatgaacctccaactaatttagttatgaagagtcagaaatgggttgtaggtgataacatggtcaccacattattgaataataacggagatgaagtagctgtctccgaaagagttaaaaggcaattaacaagctcccatctaagacacagagaactagcagctggctacctctcagaagaactccaccatcaacagggtgatccacaagtagatgaaagatgtaggcttatgtaa

SEQ ID NO: 170 - DNA, 2412 bp, Diabrotica virgifera
atggccgaaaacaaaaatccagaggatttggccaccgcaattctccgtaagaaagatcgtccaaatagacttttggtagaagaagcagttaacgatgataactccgtggttgctttgtcacaagcaaaaatggatgaactacaacttttcagaggagacacagtcctactgaagggcaagcgaaggaaagaaactgtttgtatagtattatctgatgatacatgtagcgatgaaaaaattcgtatgaatagaaatgttagaaataatttaagagttaggctttcagatgtagtttctatccaagcttgccctgatgtaaaatatggcaagagaatacatgtacttcccatagatgatacagtggaaggactcacaggaaatctcttcgaagtatacctgaaaccctacttcctggaggcctatcgaccaatacacaaagatgacgtattcgttgtacgtggaggaatgagagctgttgaattcaaagtcgtcgagaccgatcccgctccgtactgtatagtggctccagacaccgtcattcattgtgatggagatccaatcaagcgcgaagaggaagaagaagctcttaacgcagttggatacgacgacatcggaggttgtagaaaacagctcgctcaaatcaaagaaatggtagagttaccactgagacatcctagtcttttcaaggctattggagttaaaccaccaagaggtatcttactttacggtccaccgggtactggtaagacactcattgcacgtgcagtagctaacgaaactggagcgttcttcttcttgattaacggtcctgagattatgagcaaattggccggtgaatccgaaagcaatcttcgtaaagctttcgaggaagccgacaagaattccccagctattattttcattgatgaattggatgccatcgctcccaagagagagaaaacacacggagaggtggaacgccgtatagtatcccaacttctaactttgatggacggtatgaagaagagttcccacgttatcgttatggccgctactaacagaccaaactcaatcgatccagctttacgtagattcggaagattcgacagggaaatcgatatcggaatacctgatgcaactggcagacttgaagttttacgtattcacaccaagaacatgaaattggccgatgatgtcgacttagaacagatcgctgcagaaactcatggtcacgtaggtgccgatttagcttcactatgttcggaagcagcccttcaacaaatcagagaaaaaatggacctcatcgacctcgaagacgaccaaattgacgcagaagtcctaaactcactggcagttaccatggagaacttccgttacgccatgacgaagagcagcccaagtgctttacgtgagaccatagtagaagtaccaaacgtcacttgggacgatatcggtggcttggctaatgtcaagaaagagttgcaagaattggtgcaatatccagtcgaacatccagataagttccttaagttcggtatgcaaccctccagaggagtgttgttctatgggccgcctggttgcggtaaaacgttattagctaaggctattgcgaatgaatgccaagccaactttatctcagttaaaggaccagagttgcttactatgtggtttggtgaatcagaagcaaatgtcagagatatcttcgacaaggctcgatctgcggcaccttgtgttctattctttgacgaattagattcaattgccaaatcgcgtggtggaaatgtaggtgatgccggtggtgcagccgacagagttattaatcaaattctaacagaaatggacggtatgggagccaaaaagaacgtgtttattatcggtgctacaaacagaccagatatcatcgatcctgcaatattgcgtccaggtcgtctcgatcagttgatctacatccctctacccgacgagaaatctagggaagccatcttcaaagccaacttgaggaaatcgcctgtagctaaagacgtagatcttgtatacattgctaaagtaactcatggattttctggtgccgatttgactgaaatctgccagagagcttgcaaactggccatcaggcaaagcatcgaaacagaaattaggagagaaagagaaagggctttgaaccccaatgttgctatggatttggacgatgacgatccagtcccagaaatcaccagggcccacttcgaagaggccatgcgtttcgccagacgttccgtttcagacaacgacatcagaaaatacgagatgttcgcccagaccttacagcaatctcgcggattcggtaccaacttccgtttcccgacagcagctggtggacctgctgctccaggaggtaccggaggagaccaggccaacttccaggacgatcctgaagacgatctgtatagttaa

SEQ ID NO: 171 - DNA, 825 bp, Diabrotica virgifera
atgggagaccagtttgattgtgctttggacttaatgaggagattacctcctcaacaaattgaaaaaaacttaagtgatcttattgatttagttcccagtctatgtgaagatctattatcatctgtggatcagcctttaaaaatcgcaaaagataaagaaactggaaaagattatcttctttgtgactataatagagatggagattcctacaggtcaccatggtccaatacatactacccgcccctagaagatggttcaatgccatctgaaaagttaagaaaactagaactagacgccaatcttgcatttgatcaatacagggaaatgtattttgaaggaggtgtatcttctgtttatttttgggacttagaccatggatttgcaggagtcattctaattaaaaagactggagatggtagtaaaaagattaaagggtgttgggattccttacatgtcgtagaagtacaagagaagagttcgggaagaaactcccattataaaatgacttcaactgctatgttatggcttcaaactaataaacagggatctggaactatgaacttgggtggaagtctgactcggcagatcgaacaagatgcagctgtaaacgatatcaaccctcacatagccaacattggaagaatggtagaagatatggaaaacaaaattcgcaatacattgaacgaaatttacttcagcaaaacgaaggacatcgtcaacagtctgcgatcagttcaaccactgaccgaaagccgggcacagcaggcacttaagcaagacctcgcggcggcccttcaacgtagacaaaacaaaactgagaactga

SEQ ID NO: 172 - DNA, 4167 bp, Diabrotica virgifera
atggaacgcccaccccgaaacgaacccactgtggacccagtgaatggagtggtccaaccactagtccagccacctccagagagtccgggccgcgtcaccaatcaacttcagtttttacagaaaactgtgttaaaggctgtctggaagcaccaattcgcttggcccttccagcaacccgtcgatgctagaaaactcaacttgcccgactatcataggataattaaacagccaatggacctgggaacaattaagaaaagactagacaacaattactactggtcgggcaaagagtgcatccaagacttcaacacgatgtttacaaactgctatgtctacaacaagcctggagaggatgttgttgtcatggctcaaacgttagaaaaggtatttttgacaaaagtggcggatatgccaaaggaggaatttgttgttgaatcgcccggtaaagcgggagcggcaaaaggaaagaaggggcggaccagtacagcgggcgctgtcagtgcacccccaacaccaactacagccaccgctggttcgggaggcaggggtaggcctcccgccactgtctcttctacaagcgccactccagttgctaccactacaggatcttcagggttacctttaggcactcaagcaccggctacagtacctggcagcaccgcaactaccaccatagcggcggccagcaccaacaacagctctctgtcgaatcagcaactgaactcttcttccagttccattcacggaagcggctccagtttaggaaattccttagattccagcagcgtcatgcctgccaacgttatacctccggcacaaccagccaaggtaaaaaagggcgtgaaaagaaaggccgatactacgacgcctgctacagcctacgattatccgccaactttggagtcgaagtctgcaaagatatcgacgcgccgagagtccggtaggcaaatcaaaaagcccaccaggccagaactggacggtcatccgccacaaccccctccacttaaaccaaaagaaaaactaccagaatcactgaaagcctgcaatgaaatcctcctagaattgttctctaagaaacattctagttacgcctggcctttttatcaacccgtagacgcagaattactcggtctgcacgactaccacgacatcataaagaaaccgatggattttagtactgtaaaaaataaaatggaaaaccgagagtatcgcactcctcaagactttgccgccgacgttagactgatttttagtaattgttacaagtacaacccttctgaccacgatgtggttgctatggcgaggaagttgcaggatgtgtttgaagtgaaatatgcaaagattcccgatgaacctgtcaatagggtaggagcccctgccgttaataatatacctgccaaatcagaaacgagtacatccggttccagttcggattcttctagcgacacggaagattcggaggaagaaaggcgaaacaaacaactgaagctgctagaaaaagagttgacggcaatgcaagaaaaaatgcgtaaattggtagacgagagctcgaaaaagaaaaaagaaaagaaaaaggacaaagtgaaaaagaaaccgacatcaggtgggtctctggcgaacgcctcactatcaactctaccgaacagcagcagcgcgggcttgggtaagccgggtgccggtggtcacggggctctaaacaagtcaaacaacaacaactcaatagcggcggacagcgttgacgacagcatcgccagtgttgtgtcgggggccgatctaaagatggccgagtcgcaccatccgcaaactggaacaggcgctcaccatccgccggcaggcaaatccctgaacatgcatcacaacatgacggctaacgctggcgccaacgcttccgcgcaggctaaaacacctaaaagtaaaggactccgcggcaataaacccgctgcagctaccaacgcggctcccaacaagagggtcaaagccaacaacaaagctggtgcgggtaggaagaagaacgcagcacaaccaccacctatgcagttcgattctgaggacgaagacaacgccaaaccgatgtcttacgacgagaaacggcagttgtctttggatattaataaattaccaggtgacaaattgggtagagttgtacatataatccaatccagggaaccgtcgttgagggattccaatcctgacgaaatcgagatcgatttcgaaacgctgaaaccctcaacactcagagaattagagagttacgttgcgtcgtgtcttcgcaaaaagccacataaaaaagtagcgggcaaatctaaggacgaacaaatagcggagaagaagcaagagttagagaaaagactaatagacgtaaacgataaaatcggcaactccaagaaggcccccaaaaaagatgaagccaacaaggtagacccaacgggcgcgggaggtccctcaggccgcctatcctctagttccagcagttcggactccgacagcagtagtagcagtttgtcctctagttctagcgactccagtgacagtgaagcaggtgggacggcgaaccggcaggccaaaaagaaagcgaataaaaaatcacccaatccttctctaggcagttccaccaccactacgactataaaagtgccgccgcctcaaacgacggcaacacctgcaccgccgtcacaagccgcaccagctatcacgacagcagcaaccgctaatttaaccacaactgtaaccgtaccaccacttactaccacaacgacaaatacgatagctccaccaattcaaccggcgccagttccaaacgtcgcagttcccgcgcaaacgacgccagccgcacccgccttcacgccgagcataaccatcaaaccatcactacaggccgcccctatcgctccgacggtgccgcctcttatcaagtcaatcgagaaactgcctgtcacaactctcttacctcctaccgttcctacgataacgcctccaacagtacctcaagctcccaaatcggtagcgctaccgactccttctcctgataaacctaaacctaacattatttctcccattggtacctttaccgaccctatcgaacaatcattggctagtcttgaacacgatattaagcagaatgatcctatggacgtcattacggcgtctactatgatgcaaatgcctactacactaaccaatcctatcgtgtcacatccacatcctaacttaaacttaaatcccaccattaaccatcctattttacagcctagcacacttagtatggacttgaaagcgcctattatgggcactatggcgccgagcaataccatgttgcatcacggattgcaacaagcaatggaaacggatatcagtatacctccaccccccaccaacatgctgcatggacagaacaacggttttggcatgaaacacaattttgatctgactacaaacaacaacggtctttcctcgatgggtctgcccatggaaatgtcgatatcgtcaatgtttgatccaattccacaaaatattaatcccatgatgaagaacgattcccaactcaagatggacgatcgcatggataccttaggtggacttttgaacgacaagaagtccaatctcctcatacaaaagccgatgtcgcagtcgtttggtttcaagaatgacaaaccagatcataacgtcaaaaacgctagttcctggtcgagtttggccaaaggaaaatcaccacaaaacaatattccgggcggcagcagtaaacaacaagttatggatagttttaaggcattccaaaataaagctaaagaaaaggccgatagagagaaacaaaggctggagaacttagaaatgaagcggcaacagagggaacaagcggagagggagaggttacgggcggaaaacgaaaggcgaagggaacgggaagaagaagatgcgctcgagaaagcaaggaaggctgtagcggagcagcaacagcctatagcaagccaaagggtggaagaactgaggtcgtcgcctggtgaaggaagtacatctccaggttccttaagttctggttccgaaaggatatcggagcgagaaaggcagaggttgcaggagcaggaaaggcgaagaagagaagtgatggccaataagatagatatgaacatgcagagtgatctaatggctgctttcgaaggttcgttatga

SEQ ID NO: 173 - DNA, 1224 bp, Diabrotica virgifera
atgtcgttatccaccgctcgcccattagtgagcgtatacaatgagaagtccgaggaagtaaagggttcaaatatttcacttccagcagttttcaaggctccaatcagacccgatgtagtcaatttcgttcaccaacaggtttctatgaaccatcgtcaaccctacagcgttagtgacaaagctggacatcaaacatctgctgaatcatggggtaccggacgtgctgttgctcgtattccccgtgtaagaggaggtggtacccaccgttctggtcagggagctttcggtaacatgtgtagaggtgggcgcatgtttgcaccaaccaagccatggcgtcgctggcacagacgtgtaaacatcaatcaacgtcgttatgctttggcatccgctgtagctgctagtggtgtgccagccttagttatgagcaaaggacatgtcatcgaccaaatccctgaattgccattggttgtcagtgacaaggtacaagaaatgagcaaaactaaacaggctgtccagttcttgaggagaatcaaggcatgggctgacattcaaaaggtttacaagagtcaacgtttccgtgctggtaagggaaaaatgcgtaataggagacgcatccaacgtaaaggaccattggttgtttactacaaagatcaaggtcttcgtcgtgctttccgtaacatcccaggcattgacctcattagcgtacagaagttaaatttgttgaaacttgctcctggtggtcatgtaggtcgctttgttatttggactgaatcagctttccaacgtttagataaattgttcggcacatggaaaacagcatcattggaaaagaagggttacaatctaccccagcctaaaatggccaacactgatctatctagattgttgaaggctgatgaaatcaaagctgtattacgtgctcctcaaaagaaggttgtacgtcgtgtacgtcgtctcaatccattgaccaacgctaaggccatgcttaagttgaatccatatgctgctgtactcaaacgtgaagccattttgaagaatcaaaagagacagttaaacagggaagaacttttggccaagaaacgtggtattaccgtgagtgccgacaacgtcgtgattagatccagaaaattgcaagaaaggagaagggcacaaatcttgaaagataagaaatcaaagcctaagaaggccaagaaggctccagccaaggccgcaggaaagaaataa

SEQ ID NO: 174 - DNA, 5472 bp, Diabrotica virgifera
atggcagacttcatagattctgaagcagaagaaagtagtgaggaggaggaattagatcatagggatcgtaaaaaagcccaaaaagccaaagttgtagatagttcagatgaagatgatgaagatgatgacgaaagactgagagaggaattaaaggatttgattgatgataatcctattgaagaaagtgatgctgagtctgatgcttcaggaagggaaaaacgtaagaaatctgacgacgaggatttggatgatcgactggaagatgaagattatgatttgcttgaagaaaatttgggtgttaaagttgaaagaaggaaattcaagcgactgcggcgttttgaagatgaagaaagtgaaggagaagaagaacatgatcctgaacaagatagggaacaaattgctatggatatattttcagatgatgacgatgaaagacgatcagaacgaagtcacagacctgccgtcgaacaagaaacttatggtgtaggcgaggaagaagaggaaggggagtactcggatgccgatgattttatagttgacgatgacggtagaccgatagctgaaaagaagaagaagaaaaaaccaatatttactgatgccgctctccaagaggctcaagaaaccttcggtgtcgattttgattatgatgaatttagtaaatacgatgaagatgattacgaagatgaagaggaggaggatgacgaatacgaggaagatgatgtagagaaaaggaaacggcctaaaaagacttcaaagaaaaaaccgacgaagaaatccatttttgaagtgtatgaacctagtgaacttaaaagagggttctttaccgatctcgataatgaaatccgaaacactgatattcccgaaagaatgcaacttcgtgatgttccaatcaccgctgttccggatgactcaactgaacttgatgatgaagcagaatggatttacaggcaagcgttttgtaacagaactgtttccaatgtggattctcatttatcatcagaggcaagagagaaattaaagaagactcatcatgccatcggaaaaatcagaaaagcattagattttataagaaatcaacaattagaagtaccgtttattgctttttatagaaaggagtatgttcaaccggaacttaatattaacgatttgtggaaagtatataaatacgatgcaaagtggtgccaattgaaaacacgcaaagaaaacctcttgaagctttttgaaaaaatgaggtcatatcaaactgaccacataatgaaagatccagatgcaccaattccagacaaccttcgtattatgactgagtccgacattgagcgattgaaaaatgttcaaaccgccgaagagttaaatgacgttcacaatcatttcattttatattatgctgcagatttgccagccatgcatgccgcgtggagagtcaaagaaagagaaaggagaagacaggaaagaaaggaggctagacttaagctcatcgctgaaagtgaagaaggtgctgaaattcctgaagagcctgaggaaattgacgatgatgaaccagaagctgaaaccttaaaatacgccaatagatcaggcagctatgcactatgtaataaaggaggtttgggtcctctagcgaagaaatttggtttaacgcctgaagaatttgccgaaaacctgagagataattatcagaggcacgaagtagatcaagaacatatagaacctgtagaagtcgctaaagaattcgtatcgccgaaatttcctacagtggaagaagtgttgcaagctactaaacacatggtagctttacaaatagcaagagaaccattagtaaggaaatgcgtaagagaaattttctttgaacgagctagattaaacgtttatccaaccaaaaagggtgtgaaagttatagatgaagctcataattgctatagtatgaagtatgtaaaaaataaaccagtaagagatcttgcaggcgaccaatttttaaaattatgtttagccgaagaggagaacctccttactattaccatcaatgaccatattcaaggaaacactactaacaattacattgatgaagtcaaacaattatatataaaggatgaattcagcaaacacgttcaggattggaatgcgctaagaatggaatcggtagaaagggctttaacgaaaagtgtcttaccagatttaagatctgaattaaaacgaacgttgctcacagaggctaaagaattcgtattaaaagcttgctgtagaaaattatataattggataaagattgctccatacgcaataacttttcccgatgaagacgaagatgattgggatacatccaaaggtgttagaactatgggtgtagcatacgtaccagagcacacagtatcagcttttacctgtatttcagcaccagacggagatataactgattatctcagattaccaaatattctaaaaagaaaaaatagctttcgaactgaagaaaaacttatgaaggaagctgatcttcaagcactgaaaaatttcatattccttaaaaagcctcatgtgatagcagtagggggtgagtccagagaagccttaatgatcgctgatgatatcagaggagtaataagtgaactaatagaatccgaccaattcccacagattagggttgaaattattgataatgaattagccaaagtgtacgcaaattccattaaaggttcaactgatttcagagattatccagagttgttaaggcaagctatttcattagctcgaagaatgcaagatcctttggttgaattttcccaattatgtaatagcgatgaggaaattttgagtctgaggtttcatcccttgcaggaacaagtccagaaagaagaactactagaagctctctgtttagaatttgtcaacagaacaaatgaagtaggtgtagatataaatcttgccgttcagcagattcataaaagtagtttagttcaattcatatgcggtctaggaccgcgtaaaggtcaagcgttacttaaagttctgaaacaaactaatcagaggcttgaaaacagaacccaattggttacattttgtcatatgggtccaaaagtttttattaattgttctggattcataaagattgataccaatagtttaggagacagtactgaggcatatgttgaaatattggatggctctcgagttcatcccgaaacttatgaatgggcacgaaaaatggctgtggatgctttagaatatgacgatgatgagggagctaatccggcgggagctttagaggaaattctcgaggcgccagagaggttaaaagatcttgacttggatgcatttgcggaggaattggaaagacaaggatttggtaacaagagtataacattgtatgacattagagcagaactgaactcgcgatataaagatttgagacaaccttttcgttctgcaaatcctgaagaactattcgatatgcttactaaagaaactcccgaaacattttatattggaaaaatggttacatctaccgtgtttggcattgcaaggagaaaaccaaagtcagaccagctcgatcaagctaatccggtccgtaatgacgaaactggtttgtggcagtgccccttctgtttgaaaaatgattttcctgaattatctgatgtatggaatcattttgatgcaggagcatgtcctggtcaagctactggagttaaactaagactggataatggtatattaggttatatttatataaaaaatataagcgacaaaccagttgctaatccggaagaaagagtaggcataggacaattaattcactgtagaataataaaaattgacgtagagaagtttagtgttgattgtacatcgaaatctagcgatcttgctgataaaaatcatgaatggagacctcaacgagatcctcattatgatcaagaacgtgaagacaaagacaatcgattagaagccgagaagaagaaagagaaacagcgtatgacgtacatcaagagggttatcgttcatccggcgttccataacatatcctatgccgaagccgaaaaatgtatggttaatatggaccagggtgaagttatcattaggccttcgagtaagggtgcggatcatttgaccattacttggaaggttacggatggaatctatcaacacattgatattaaggaacaagggaaagttaacgctttttctttaggaaaatcattatggattggaaatgaagaatttgaagatcttgatgaaataatagctaggcacgttacaccaatggcggcgcatgctagagatttactgtattttaggtattacaaagatttccaaggtggtcataaagataaggctgaggaatatctaaaagatgaaaaaaagaaaaatgcttctaaaattcattatgtagttagtgctgctaagaatatacctggtaaatttcttctttcgtaccttccacgcaacaaagttagacacgaatatgtaacagttactccagaaggctttcggtttagacaacaaatgtttgattccgtttcttcgttatttaaatggttcaaagaacatttccgggagcctccaccaggcggtgcaacaccaggtagcacgccaaggatggcttcaagcagaactggatatggaagtgccacacccgcgtatagtatgaataatgaagctattcaaagagttgctcaaaatttaccaagtcatgtagttcaagcgttatctgctgccaccaaccaaactccacattatccccacacccctggttatggaggcaattatattaatacgccttacactccaagtggtcaaactccatacatgactccgtacgctacaccccatacgcagcaaactccccgctatggtcatcaaacaccttcccaacacatggcgagctcagcaccacaaggtctcaacaatccctttttacatcctggcgcggtgactccctcccaacgaactcctatttatcgcaaccatcctgcacaatctccagtaatgcttcctacaagccctgtaccaagtccaggttcccagagttcatacagtagtcatttaagtcataatcagcgaagtggaagttatgctgaatccttaagattccaacctcccgaatcgccgagaagctcagtgagtaatagaagctttcaaactgatagatacggcggtgataggtatggtaaaggaggaagtcatagatatggtggaagctcaaacgaagatagatatggtaagggaggaggaggaaatgaaaatacggattggcagaaagctgcagaagcatgggctcgatctagatctactccgagaagtgatggccgtaatactccaagatctgtaggtcaacgaactcctagatacgacaacgacgccgaacgttctagaatgaaacacctcagcaagagcccgaggtctgttaggtctactcctcgaaccaatacatctccacattctatgtccctaggtgatgctacccctctgtatgacgaaagtatctaa

SEQ ID NO: 175 - DNA, 2463 bp, Diabrotica virgifera
atgccagataccaaggataccaataccaaggatgctaatttgagttctcctgaacgtaaaagacgaagaaagagtagatctaaatctccagaacgaaaagagaaaaagtcttccaaaaagaaagcccacaatagtagagacagagattcatcagaggaaggttacaaccctaaagattatcagagatactatggggaagatcgcccaaacagtgacaaatattggaataaatatccaaggaaagatactaccaaagttggccaaagatactatgatgcggctcccgaagaatctggcaagaaggggccagatagaaattcagaggagaaggagttaccaaagccaatggagtctgttcctgataaatcagtcatcaaaccaagagaaagaaaaactgtagatatgttaacatcgaggactggtggtgcttatattcccccagctaagctacgattgttacaagccagtattacagacaaaacatcagcagcctatcagcgtatagcatgggaagccttaaagaaatccgttcatggttacattaataaaattaacacctcgaatattggcatcatcgccagagaattattgcatgaaaatatagtaagaggtagaggtttgctgtgcaagtcaataatacaagcacaagcagcatctcctacttttacaaacgtttacgcagccttagtagctgttattaattcgaagtttccaagtataggagagcttttattgaagaggttggttttgcagttcaaaagagggtttaaacaaaataataagtctatttgcatatcggctactactttcgtagctcatttagtaaatcagagagtggcacatgaaattttggctttggagatacttacattgttggtggagactcctacagatgattctgtggaggtggccatttcatttttgaaggaatgtggacaaaaactgacagaagtttcaagtagaggtattactgctatatttgagatgttaagaaacattttacatgaaggccagctagaaaaaagaattcagtacatgattgaagttatgtttcaaataaggaaagacggatttaaggatcatgctgctgtcgtagaagaattagatttagtagaagaggaagatcaattcactcatcttattatgttagatgatgttaaagaggctgatgcagaggatatattgaatgtgttcaaatttgatgagagttatgaagaaaatgaagataaatacaaaacccttagtaaagaaatcttaggcagtgatggtgagtctgaatcaggttccgaaggttcagaagaggaatctgataatgaaaatgaggacgaagtcaaggaccagggaacaattattgacaatactgaaacgaatttaatttctcttagaagaaccatatatttgactattcagtctagtttagattttgaagaatgtgcacataagctactgaagatggagttgaaacctggacaagaaatagaattgtgtcacatgtttcttgactgctgcgcagaacaaagaacctacgaaaagttttatggtcttttggctcaaagattttgtcaaatcaacaaagtgtatatcgagcctttccaacaaatttttaaagatacctattctaccactcacagactagatgctaacaggttaagaaacgtcagcaaattttttgcgcatttactttttacggatgccattggatgggaagtccttgacatcatgaaattgaatgaagaggataccaatagttctagtaggattttcataaaaatcttgtttcaagaattggctgaatatatgggactaggaaaattaaacgcaaggctaaaggatgagaccctgcaggcttatttttcaggactgtttcctagagataacccaaagaataccagattttctattaatttttttacctctatcggtttgggaggattaactgatgaactcagagaacatttaaaaaatattccaaaaatgatggaaatgaagttagccactaaagaaaaggaaagcagtggtagtagtagttcagaaagtagttctgaggaagatagtagtgacgacagctctgaagattcatcaagttctgaagacgatagaggcaaaaagaagaaaaaaaccaaaaagctagaagaaaaaaattcgaaagtaaattctaagtctagacctagatcaaaagagaaagaacacgcagacaaacctagagacaaacatagaaaggaagatagacataaatctgacaaaaatcccgatagatcctcgtccaaaaaatattctaaagaagataacaagaggaagaaagactacgaatggatgaagagcagatatgaagatgatattaagcaattaaaaaacgataaaagggtatttgaaaagtcttccaaacgacgatcaagatctagagacagggtaaaagtcaaggaagagcgtagacgtagaagcagagaaagaagaaggagctaa

SEQ ID NO: 176 - DNA, 1494 bp, Diabrotica virgifera
atgaatgactttgaaccaccaagacagatgtacagaggggcacacgtgttttttacagaagtatgcccggaggaactgttcaatgagctctgcaagtcttgtgcggccagaaaaattaagactctcaaggaaatcaacattgcgttcttgccgtatgagtctcaggtgttctcattggattcaccagacacgttccagtgtagctacgatccatcattttccgctgctagaaacgccaacatggaaagaatggcagaacaaattgcgacactctgtgcgactctaggggaatacccacacgtcagatatagaactgattgggaaagaaatgttgagctggctcaactaattcagcagaaattggacgcctataaagccgacgaacctaccatgggagaggggccggaaaaggcgagatcacaattaattatcctcgaccgaggtttcgactgtgtatctccccttcttcacgaacttactttccaagcaatggcctatgacttactacccatagaaaatgatgtatataagtacgaagcatcggctggtgttatgaaagaagtccttctagacgaaaacgacgagctttgggtcgatctacgccaccaacacatcgcggtggtgtctcagagcgtcaccaagaatctgaagaaattcaccgactccaaacgcatgacccagagcgacaagcagtcgatgaaggatctctcaaccatgatcaaaaagatgccgcaatatcagaaagaattgtccaagtatgctacgcatcttcatctcgctgaagactgcatgaaggcctatcaggggtatatagacaagttgtgtaaagttgagcaggatttggcaatgggaactgatgccgaaggcgagaaaatcaaggatcacatgcgcaacatcgtccccatcttgctagatcccaaaatcaccaatgaatacgataagatgcgtattatagcattgtacgccatgacgaaaaacggcatcacagatgaaaatctctccaaattggctacccatgcccaaatcaaggacaaacagaccatcgccaaccttcagttacttggagtcaacgttattaatgatggaggaccaagaaaaaaacaatatacagtaccgcgcaaagaaagaattacagaacaaacgtaccaaatgtcaagatggacacctatcattaaggatataatggaggattgcatagacgacaaactggatcagaaacactacccgtatttgagcggacgagcacagtctacgggataccatgcagcgccctctagtgcccgttatggccagtggcacaaagacagaggtcaacaagccgtgaagaacgttcctcgactgctcgtcttcgtcgtgggtggaatcagtttttcagagatcaggtgcgcctacgaagtgaccaacgcgcagaagaactgggaagtcatcatcggctcgtcgcacatactcactcccgaggacttcctaagcaatctggcaacgttggccggctag

SEQ ID NO: 177 - DNA, 2139 bp, Diabrotica virgifera
atgatgcaacaatatatgaaagaattagagcaggaaccatttgatgctgaagagtttgtagaacgtttagcttggaggactttagctgaatctaaaggagatggagaggaacatgagattaaccctgctcttttacatgagtcttttgtacaagctataaaagatcttaatttacttcatgaacggcaacaaaagaaatgtgaaaaattagaagttgtggttagggaagatgaagcaacctttttccaagaaatatataatttacttgaacaaaataagcaagccatggatacttttcaagaattagatggcaaaataaatcatgtagcaacaaaagtactgcatttaggagaccagttggacagtgtcaatgggcctagatctagagtagtagatgccttaaagttaatgatacatttaacagagttcttgtctgatgaatcagtattatcacctatctttacaaggccagaattgatagatgatgctgctgatgtgatccaaaaattataccttatatctcaagatttgcctcccaaatttgatgttgctaagagaaaaattgaaagaaaatactcggatatagaaaaatctttaatagaggaattcgttctagctatggataacgaaaatttaaatagaatgaaagaaatagctaccgttttatctcagtttaaaggctattcccagtgcgtagatgcttatattgatcatagtcaaatgggatgtctgtcgagcaaggacgtatttgctaactttttaacgctttgtaaatacaatcatgaaataattgtcaaggtatttaataacccagaacaagtgatggcaaaatttgtactgaacatatttcaactcaaactcgtcgaatacatcgatcaaagattgaattccaagttaggaacctatggctatttacaagtattatatgagttatattataagactaatcagttatctaatgatttgagcatatttaacatgggaaatgacaagaactttttatcgaagttaacgacaaatatttttaacaaatatattagtgattatatcacgatggaattaaaaggtctgaaagataggtgttctgcaaatttacaaaaatattatgaatccaaaggtcatcagaagaagcagattcagtcaggaggtttccaagaccttcgaagagaccttcaagctgttataggaactcgagcgaatattaacattgctcagatcgaaaattatggtggagaaacctttttatctgaagaattagctattacgatattacaagatacaaaacacgctttccagagatgccagttgttatccaaacccacagacagagcctcaaacgcaactcaaattttggatcgactgataaacagcttattagtagagcatgtcgactatgcagtagaattgggcttacaagctgttcctgttgtagaagggaccaaaactcctccagcgctatattttttcagtgtcgtccaccacagtaataatattatacatcttgttgagaaacaattcatggatttattggttccattagttgaaaacaccccgaggcataatgattgtgtacagaagaaaaagtttgtgctggaagatatagaacggaagattaatacaggactagataggtgtctcaatgccatttcgagctgggttaaactgtatcttcaaacagaacagaaaaaatctgacttcaaacctgaatctgacgatttcgacacagtggcgtcaaacgcttgtaaaaacgtcattaactacgtgaatagtattgtaaaagaaataaaagcgaacctggatggtaacaatgtcacagccatattgcaagaacttggcataagattacatcgagtagtgtatgatcacatgttgcagttccagtataacacagcaggtgcgatggtggccatctgcgatttaaacgattatcgccattgtacaaaagccctcggcccattagtgattgaactttttgatacactgcatgcgctctgcaatcttttgcttgtcaagcctgaaaatttacagcaagtgtgttctgaggattctctagtaaaactggatagaacaatccttcacaattttatccaacttagaagtgactttaaggtacaaaaacaaatgattctaaaagtgtaa

SEQ ID NO: 178 - DNA, 813 bp, Diabrotica virgifera
atggatttccaaaacagacctggaggaaagaccggtggaggcggggtcgcctcttggtcggaaactaacagggatcgtagagaaaggcttcgacaactagctttagaaactatagatctacaaaaagatccctattttatgaaaaaccacttgggctcatacgagtgtaaactttgtttgacgttgcacaacaacgaaggaagttacttagcccatactcagggtaaaaaacatcaggcaaatttagctagaagagcagccaaagaggctaaggatgctcctacgcttttgcaaccagagaaacccagagtagaacctaagaagtttgtgaagattggtcgacctggttatagagtaacgaaacaaagagatgccgaaagtggacaacagagtcttctgttccagattgattatccagaaataagtgatatgattctaccccgtcaccgttttatgtcagcttatgaacaaaaaatcgaaccaccagatcgtaaatggcagtatcttctatttgcagcagaaccgtacgaaacaattgccttcaaagtaccaagcagagaagtagagaaaaccgacagcaaattttggactcattggaacaaggatactaagcaattcttcctacaatttgcatttaaaaatgacaataagagaactgttaatacagtggtccaaagacatacgattgttggtgcagcaccaccacccccaatgctacctgttccaccaccaccaagaccaccgatgttcaatcctattcctcctccacctccaataatgagagctgtattaccagtgcctcctccacattaa

SEQ ID NO: 179 - DNA, 405 bp, Diabrotica virgifera
atgtctattggtgtacctattaaagttctccatgaagcagaaggtcatgtaataacctgcgaaacaattaccggcgaagtatacagagggaaactgatagaagccgaagataatatgaattgccaaatgactcaaattactgtaacttacagagatggaagagtcgctcaattggaaaatgtttatattagaggatcgaaaattagattcctggtattgccagatatgttgaaaaatgctcctatgttcaaaaaacaaactaaagcgggaacggcaggccgaggaaaatctgctatactgcgagcccaagctcgggggagaggtagggggcaacaacaaccgatgcgaggtagaggtaattggcaacagaaccaacaacaagcacctgcaggaaggggaagataa

SEQ ID NO: 180 - DNA, 1467 bp, Diabrotica virgifera
aaaaagttgacggttgtgctgtcacttctgtcagtttgtgctgtcacttctgtcagattatgctgtcaggtaataaattctgaaaattttgggaagaaagatatttgttttataagttttcacacaccttcattgagaagtatggcttctactcttacaagaactccaatcttgcgagcaatttccgcaagaagctattctcaagccctgccagtatcaggtaatccaagtgctgaactcagaactagtactcttcccaacaaactagttgttgcagcagtagataatgacgccagtcttacaagagtttcaattgtattcagagctggaagccgtaatgaaaaagccgataatttaggtgccactcatattgtacgaacagcagcaggcttgtccactaaaaatgcatcccagtttgccataatccgaaacattcaacaagttggtgcaaatcttacagccacatctgatagagaaaccatctcctataccttagaaggaacaagaagtgccgttgaaaaggctctaccatatttagcagaagtagctacccaccaagaatttagaccttgggaagtgtcagagctctccaacagattaattttggatattttaaccagacctttacagttaagagccatcgatttgcttcacaatgctgcctaccgtagcaaaggtttaggtaactcactcttcattccaaaatcccaagtaggtaaagtttcatcagaaacgttacaacattacgtagccagcaactttgtagctggccgtgctgcagttgttggtacaggtgtaagcgagagtttgttgaatcaattcgctgctagtttgggaattgcaaatggcgaaggcagcaccaatccatctccttacaagggtggtgaactcagatcaaacaaaggtggaccacttgcttttgttgcagtaggaggagaaggagctccattgaagaacaccaaagaagctcttgcgtttgcagttctacagaaagctgtatgtgctggccctcagatcaaatatggcgtacttgataatggagtctacagcaaagctcttggtggctcatcagatgtatctgcgtgcgctgttaatgtgagctattcagacagcggtttgtttggtattttgctcgctgcacctgctggatctgtaggcaaagcagttcaatcagctgttaatgtcttgaaatcaggctccgttacagatgctgatgttcaacgaggcaaaaatcaattgaagacagccatccttcttaacgctgaaagtggagctgacgttgtaagggaacttggaacccaagcagttttggctggtgctccacaaagcgccaatgctttagccgctgccgtagactccgtcagcaccagtgatgtacaaagtgctctaaggaaagcaggaggaaaattaaccttagcagcaattggtaacattaacgatgtaccatatttagatgaattgaaataa

SEQ ID NO: 181 - DNA, 432 bp, Diabrotica virgifera
cgtcaatcaatcttcatacaaaagacaaagttttgtaaatacatattttctccatttttcaaagttataaagccatatttaaccgtggcagcctacaagatgaggagagcccacgcaggtaactattatgaaccattaccacaagcttccaacgaaatcgaagatgaaaacgatagaatgactaatgatctgcaagaaaagattggcgtcttaaaatcgttgactatagacattggaaatgaagttaaataccaggacagaatgctcagagatgtggacgacgatctagataagactggaggcttcttgggcaccaccatgtcaagagtactgagattatcgaaaggatctcataattacctcatcctgtatttatttgtgttttctgtagtggtgttttttattctgtatctagttattaagtttaggtag

SEQ ID NO: 182 - DNA, 1485 bp, Diabrotica virgifera
atggcttcgacgatatcggcaagacaggctaacagagaacatgttttggccgtatccagagacttcatatcccaaccaagactcacttacaaaactgtatctggtgtcaacggtccactagtaatcctcgaagatgtcaaatttcctaagttcaacgaaattgtccaactcagattatctgacggaagtttaagatcaggtcaagtacttgaagtcagcggttccaaggctgtagtacaagtattcgaaggtacatcaggtatcgatgccaaacacactgtctgtgagttcacaggagatattctcagaactccagtctctgaggatatgttgggaagagtattcaacggctctggaaaacctattgacaaaggtcccccaattctggctgaagactacctagatattcaaggacaacccatcaacccatggtcccgtatctacccagaggaaatgatccaaactggtatcactgccatcgatgtgatgaactcgattgcccgtggtcagaagattccctttttctcagctgctggtctgccacataacgatattgctgcccaaatttgtaggcaagccggtcttgtcaaaatcccaggcaaatcagttttggatgaccacgaagacaactttgccatcgtgttcgctgctatgggtgttaacatggagactgctagattcttcaaacaagatttcgaagaaaatggttctatggaaaacgtatgtttgttcttgaacttggctaacgatccaaccatcgaaagaatcatcaccccacgtcttgctctaacagccgctgaattcttggcttaccagtgcgaaaaacacgtgttagtcattttaactgacatgtcttcatacgctgaagctttgcgtgaggtatctgccgccagagaggaagtacccggtcgtcgtggtttccccggttacatgtacaccgatttggccaccatctacgaacgtgccggtcgtgtcgaaggccgtaacggttccatcactcaaatccccatcttgactatgcctaacgacgatattactcaccctattcccgatttgacaggttatattaccgaaggacagatctacgtcgaccgtcaattgcacaacaggcagatctacccaccaattaacgtactgccatctctctcacgtttgatgaagtctgctatcggcgaaggtatgaccaggaaggaccactctgacgtttctaaccaattgtatgcttgttatgctatcggtaaggacgtccaggccatgaaagccgtagtaggtgaagaagctctaacacccgacgatcttctctacctcgagttcctaacgaaattcgaaaagaacttcatcacccaaggaaactacgaaaaccgcaccgtcttcgagtctttggacatcggctggcaactactccgtatcttccctaaggaaatgttgaaacgtatccctgcaagcacattggcggaattctatccaagagactctcgtcactag

SEQ ID NO: 183 - DNA, 1173 bp, Diabrotica virgifera
atgagtcgcggacacgcaggaccccgtattcacgttccagacgaattaagagaagtactcctcgaatttacaattagttatttactggaacaacctggagatgttattagttacgccgccgaatattttacgcgcttgagggaaacccgggtgacatccagagtgtatgatgaagctgctgcctcgcaggaggaattggtatcacctgacgaatccgtaatgtccaaagatgaagaaccttcaatccggtttgctggtaggcgtaaatcagtgttcgcagaaacttacgatccagaagaggacgacgacgatgatgatggcgccaagttggtgtatccaaaatctgatgagcaacgtcagagattggccactgctgttaaaaacatattgctgttcagatctctggataaagatcaaatgaacgatgtcttggatgcaatgttcgaaagagtggtcaaaaaggatgaattggtaatcaaacaaggagatgacggcgataatttttatgtaattcaaagtggaactttccatgtgtttgtcgcaccagatccatcgaaagaacccaatcatattcacacttacgaaaatagtggcagcttcggagagttggcgttgctctacaacatgccccgtgcagctacggtcaaagcaaatagcgaaggttccctttgggctatggataggcagaccttcagaagaatcgttctcaagtctgcgttcaaaaagaggaagatgtacgaagcgttgatagaaagtgttccgatgcttaaaactcttcagccttacgaacgtatgaatcttgctgatgcattggtacctagagtcttctacgatggagataggattatcaaacagggcgatgcagcggacggtatgtacttcgtagaacaaggtgaagtggccattagtgttttagacgatagcggtaaagaggtagagatcaatcgtattagtaaaggaggttactttggagagctggcattggttacacatcgtcctagagctgcttctgcttattgcgatggagaagttagatgtgcatttttggacgtggaagcatttgaacgtttgttgggtccttgcatggagatcatgaagcgcaacattactgactacgaagaacaaatgctcaaaatattcggctcaaagcaaaacattagggacatccgatga

SEQ ID NO: 184 - DNA, 2421 bp, Diabrotica virgifera
atgagttacatgcagtctaaccaaaatagaccaatgtctcaaagctaccatcagggtcctaatgacctgcccatgcagtcttctaaagaacagactttactatggcagcagaattcatacatgggagactctggcattcagtctggggctgctacacaggttccatcactgacaggtaaagaggaggaagaaatggatctgtttgatttggatcaaccctaccagggttttacacaagagcaagttgatgacatgaataatcaactgaatcatactaggtcccaaagagttagagctgccatgtttcctgaaactttggatgaaggtattgaaatcccttccacacagtttgatcctaatcatcaaacagcagttcaacgtctggcagaacctagtcaaatgctcaagcatgctgtagttaatcttattaactatcaagatgatgctgaccttgcaaccagggccataccagaattgatcaagctccttaatgatgaagaccaagtagtagtatcccaggcagctatgatggtccaccaactatctaagaaggaagcatctagacatgctattatgaacagtcctcaaatggtagctgccttagtgagagctatatcaaactctaatgacttagagactaccaaaggagctgttggtaccctacacaagttatcacaccacagacaaggtttacttgctatttttaaaagcggaggtattccagcacttgtaaagttgctcagttctcctgtagaaagtgttcttgtctatgctataaccacccttcacaaccttttattacatcaagatggatcaaagatggctgttagacttgcaggtggtttgcaaaagatggttgcactactccaaagaaaccatgtcaaatttttgtcaattgtaactgattgcttacaaattttggcttatggtaaccaggagagcaagttgatcattttggcaagtcaaggacctattgaattggtcagaatcatgagatcttacgattatgagaagttgttgtggactacttctagagttctgaaagttctttcagtttgtgccagtaacaaacctgctatagttgaagcaggaggaatgcaagctttggcaatgcacttgggaaatccaagcacaagattggttcaaaattgtctatggacattgcgaaatctatcagatgctgctacaaaagttgatggtctagaaagcttattgcaatctttggtacaagtattagcatcttctgatgtcaatgtagtgacatgtgctgctggtatcctttccaatctgacttgtaacaatcagcgcaataaagtaactgtgtgccaagtgggaggggttgatgcacttgtgcgcactatagtcagtgcaggagatagagaagaaatcacggaaccagctgtttgtgcactgcgtcatttgacatccagacatgtggaatcagaaatggcacagaatgctgttagactcaactacggcatgcagattatagtaaaactgttgaacccaccttcccgttggccattggtgaaagcagtgattggtttgatcagaaatttggctttatgtcctgccaatcatgccccattgagagaacatggtgccatacatcatcttgtacagctgttgatgagagctttccaagatacacagagacaaagagcaagtgttgcgagtggcggcagccaacctcctggcacatacgcagatggtgtgagaatggaagaaattgtggagggtacagtgggagctcttcacattctgtcaagagagtcccataatcgtgccataataagacagcagatggttgtaccgatatttgtgcagctactctttaatgatattgaaaacatccaacgtgttgcagcaggagtgctttgtgaattagcagctgataaagaaggagctgagatgatagaacaagaaggagccactgcacccttgactgagcttttacattcaagaaatgaaggtgttgctacatatgcagcagctgttttattcagaatgagtgaagataaaccgcaggactataagaaacgactgtctatggagttaacgaactccttgtttagagaagagaacctctggaatccagacctagggatgggccctgatttacaggatatattgagtccagatcaagcttacgacaatatgtatgcacaaggtccccccagtgttcatagcagccacggcggtaggccttaccagcaacaagggtatgaccagatacccatagatatgcaaggtctagatattggctcccatggaggcggaaatgggtcgacctatagcgcaatcgacgccatggatgttaccagcggggatccggatcttaacttcgatactattgatcaacttcccacccctcctcaagataataaccacgccgcagcttggtacgatacagacctgtaa

SEQ ID NO: 185 - DNA, 819 bp, Diabrotica virgifera
atggcccgaaacgccgaaaaagcgatgacaacattagctcgatggagagcagcccaactaggagaaatagataagcacaaaaaacgaaggccctatcttgcatcagaatgtaaaaatttacatgcttgtgaaaaatggaggatgcagatcataagagaaattgccaagaaagtagctcaaattcaaaatgctggccttggagaatttaggataagagacttaaatgatgaaataaataaactactgagggagaagaggcattgggaggatcaaataaaggaattgggcgggcctgactatcagagagttggacccaggatgttagatcatgaaggcaaagaagtacctggaaatagggggtataaatactttggagcagctaaggaattaccaggtgttcgagaactttttgagcaggagccgcctcctcctccaaggaaaagtagagcagaactaatgaaagacattgatgcggactactatggatacatggacgacgatgacggaattttgattccattggaagttaaagctgaaaaaacagccgttcaaaatacagtagctgagtgggttagtaaaaaagaacaaaatttggagaacgcagagaaccaaacagaagaagaaagtatatatgcagttcaggagtctgacgatgaagaaagtaaggaaactgtacaacagttagtagatggatcacagcaaagatttgttgcacatgtacctgtaccatctcaacaagatatcgaacaggccctgctgaggcgaagaaaacttgaacttatggaaaaatatggtgtagaagaggaaccgaaatcgtag

SEQ ID NO: 186 - DNA, 648 bp, Diabrotica virgifera
atggctggcgaacaagatatgcccaccttcaaatgcgtcttggtcggagatggaggtactggcaaaactacctttgtaaaaagacacatgactggtgaattcgaaaagaaatatgtagcaaccttaggagtagaagttcaccctttagttttccacacaaatagaggacaaattcgttttaacgtatgggacacagcaggccaagaaaagtttggtggtctgcgtgatggatactacatccaaggacaatgtgccataattatgtttgatgttacatctagagtcacttacaaaaatgttccaaactggcacagagatcttgttagagtttgtgaaaatatcccaattgtattgtgtggtaacaaagttgacatcaaagataggaaagttaaggcaaagagcattgtcttccataggaagaagaatttacaatactatgacatctctgcaaaatccaactacaactttgaaaaacccttcttgtggttggctaggaaactcattggagatcccaacttagaattcgtagctgcacctgccttgcttcctccagaagtccagatggatccccaatggcagcaacaaatcgaaaaggatcttaaagaagcctcagaaactgcactgcccgatgatgacgaagatttataa

SEQ ID NO: 187 - DNA, 2511 bp, Diabrotica virgifera
atgcctagaataatgataaaaggtggtgtttggagaaacaccgaggatgaaattctcaaagctgctgttatgaaatatggcaaaaaccagtggtctaggatagcttcgctacttcacagaaagtctgcaaaacagtgtaaagcccgttggttcgagtggttagatcccagcattaaaaaaactgaatggtctagagaggaagatgaaaaactgttacatttggctaaacttatgcccacacagtggagaacaattgctcccattattggaagaaccgcagcacagtgtttggaaagatatgaatatttattggatcaagcgcaaaagaaagaagaaggtgaggatgcagtggatgatcccaggaagctgaaacctggagagattgatccaaatccagagacaaaacctgcaaggcctgatcccaaagatatggatgaagatgaattagagatgttatctgaagctagagctagattagctaatactcaaggcaaaaaggctaagaggaaggctcgtgagaaacaattggaagaggctagaagattggctgctcttcagaaacgcagagaactgagagctgccggaatagaagttacatctcgtagaaagaaaaaacgaggagtagactacaatgctgaagtaccgttcgaaaagaggccagcgattggattttatgacacgtctaatgaagtattagatcctatggctcccgatttttcaaaaatgaggcagcaacacttggatggggagctgagaagtgaacaagaggagagagaacgtaagaaagataaacagaaactaaagcagcgcaaggaaaacgacattcctcaagctatgttacaaaaccaggaaccagctaagaaacgatccaagttagtgcttccggaaccacaaatttcagaccaggaaatgcaccaagtggtgaagttgggcaaagcgagtgaagcagctagggaaatagttacagaaagcggtgttgaaaccactgacactttgttgaatgattatactttcaatcctcaagcggctgctacaccaaggactccggcgccccagactgataggattttgcaagaagctcagaacatgatggcgctcacacacgtagatacgcccctcaaaggcggcattaacactccgttacacaattcagatttcagcggggtcctgccccaagctcagaccgtcagcaccccgaataccgtgcttgctacgcccttcagatccagtaggagtgacggagctggcactcctggcagtagcgttggatttatgacgcctagaagtggcgctttggtgcctgtggggaagacgccggtaggaatgacgccttcggttagggataagcttagtattaatccagaggaagcaatggacgtaggaagcacaccagctgagcacagaatgtaccagatgtcgatgaaagatcaattaaaaatggggttgagcagtctaccacaaccgaaaaacgactatgaaatcgtggtgcccgaaaatgaagaccaggaagaacccgagcaagctcagtcacaaatgatcgaagatcaagctgatgtagatgcacggaaacaagaagagctcaaggcgaaagccgccagggagctggcgctacgttctcaagtcatccaacgtgatttaccgagacctcaagaagtgaacatgaccgtccttcgaccgtcccacgagagctattccttatccgatctgcagcgagccgaagaactcatcaaacgcgagatggtgactatgttacatttcgataaccttaaaaatccggttccgacgcagagtaagagatccaacatgtcgcaggcccatcaattggcgtttttggagcagcatccatatgagtcgttcaggaaagaagatttaggggtggccaaggggatattgaagagggaaatggaggtggttaggaatggtatgaatcacggggagttgcctatcgaagtctacactcaggtgtgggaagaatgcttaagccaagttctgttcctcccgaaccaaacgagatacactcgagccaacttagcgagtaaaaaagacagactggaatcggcggaaaaaagactcgaacagaacagatctcacatggcgaaagaagctaaacgagctgccaaaatggagaaaaaattgaagattttaacaggcgggtaccagtccagagcgcaggtgttgatcaaacaattacaagattgttatgagaacctagattcgactaatttagaattgaatacgttcaagtttctgcaagaacaagaaaaatctgctctaccaagaagaatacagtctctcactgaagacgtcagccgacaaacagagcgagaacgaggcttgcaaaagaaatacggcgatcttcaagcagaaataaaatacttacaagagtcataccttagtcagcttcaaaaagagcagcgaaaggaagcggataatacagctaatgaggtttcttccactaccaatggagaactcaacgcagaaacagtcgatgatgatgaagagatgcagtga

SEQ ID NO: 188 - DNA, 474 bp, Diabrotica virgifera
atgatgcaattcatgttattattcagtagacaaggtaaactaaggttacaaaaatggtatgtggctcatccagacaagctcaagaaaaaaattacaagagaattaatcacaactattttagctagaaaacctaaaatgtgtagttttctggagtggagagacttaaaaattgtttacaaaagatatgcaagtttgtatttttgctgtgcaattgaacaatgtgacaatgaactcctaaccctggaaattatacaccgttatgtagagctccttgataaatattttggaagtgtttgtgagttagacataatcttcaactttgagaaagcctactttatattggatgagttgatgttggggggtgaagttcaggagacaagtaaaaagaatgttttaaaagccattgctgcccaggatctattacaagaggaggaaactccgcagggatttttcgacgaccatggtcttggttag

SEQ ID NO: 189 - DNA, 1251 bp, Diabrotica virgifera
atgtatggattacagagaatttcataccgaatctatattcgcaatgggtttcgacattattcccaacaacctgcaaagaggaattcctttatcggccggctctttgaaaattttaaagatgagatggccaagaacaaagaaatgaaagaatccctgaaaaaatttcgagaggaagctcaaaaattagaacaaagtgatgcactgaaagcagctagacagaaatttgaaagtgtagaaaaagaagctagtaaaggtagcgaagtttttaaagaaagtttaggttctgttaaggaaaggcttaaaggagttatagatgaagctagcaagtcagatttagcaaagaaggctggcaaattcacagaagaagttggtaaaactacacataaaattagtgaaacagctcaagaaattagtaaaactggagcgtttcaaagtatatctcaagctactaaggctgttaaacaagaaatagacaatactagtatagaaggtagagtatatgttagtcctaaaatactacgcaagagaacagaaacaagtgcagttgtccatcaaaaatattatgaaccaaacacagatgctacaggcgttgaactacacaaagattctaagttttatgaatcttggcaaaatttcaaagataacaatccatatgtacataaagttatggactggaaattaaaatacgatgaaagtgaaaatcctgtcatccgtgcttccagagctctaacagaaaaagttggtgatatcatgggtggtttatttcagaaaactgaactatctgaaacacttacagaaatctgtaagatagatcctgcgttcgataccaaaagatttctgaaacaatgtgagacagatattattcccaatattctcgaagccatgacgagaggagagttagaagttcttaaagattggtgccatgaaggtccatttaatctttttgctgttcctataaaagaagcctataaaaagggatacaagattgaatcaaaaattttagatatcgatcatgtggatttagtcttaggcaaagtgatggaccaagggccagttttgataatatcttttacatcccagcaagttatggctgtccgagatgcctcaggtggagttgtcgagggagatcctgacaaagtaatgagagttaactatgtatgggtactatgcagagatgtcacagaacctgatcctagggcggcatggagactgcttgatctttcagccagcagcaatgaacaactggtttaa

SEQ ID NO: 190 - DNA, 930 bp, Diabrotica virgifera
atgagttctgattcagaactaagtgatagcgacattgagctccaacaagcatttgcagatggtaagcttcaacctggcttaaatactgtggaagaaggaccaaaacagttcacaaataatgtgagtggtttaaaacaaaaattagaagaaatcaaactcaagttaccatggatagaacgactggactgtgtaaatgcacaagcccctttagcacctgaattagcagctcaaatgttgacccacgaggaaaaaagaagtaatgagcttaaaaataataaaaagctcacacagtttactccaagtgaagacccggttttaaacgactttaaaagagaaatgatgttccacagacaagcccaggctgccattctagattctataccaaagctaaaagatatgggaatactaactaaaaggcctgacgattactttgctgaaatggcgaaaacggatgcccatatgcagaagattagggaacatcttatgaagaaacaggagcaacagaagagaagcgaacgagtcaaacaacttagacagcaacgaaaagaaggtaaaatgttacaagttcagacaaaacttcaaagacaacaagaaaagaaagatatgcttgctcaggttaaaaaagtaagaaagggaatgtccaaagatcttgacttccttgacggaaaaaataaatctgctgccaaaaaaatggcagaaaaacggaaaatgaaagacaaaaagttcggtttcggtggaaagaaaaagggaatgaaaagaaacacaagagatagtgctgcagatataagtgaatttaaaaatccgggtaaacctggaaaaaaatttaacaatagtggaaaaggggtaaaaggtggtaaaatgggccaaggggcgaaacaaagaatgggtaaaagtaaaaggattaaaatgagatctaaaggaaggaagtga

SEQ ID NO: 191 - DNA, 3717 bp, Diabrotica virgifera; identical to SEQ ID NO: 166

SEQ ID NO: 192 - DNA, 1866 bp, Diabrotica virgifera
atgaatccggctgccccaaattatcctatggcgtctttatacgtcggcgatttacattctgatattactgaggccatgctttttgagaaattttcaaccgcgggtcctgtgctttcgattcgcgtgtgtagagacttgattacacgtcgatccttgggttatgcatatgtgaacttccaacaacctgcagatgctgagcgtgctttggataccatgaattttgacttgataaaaggtaggcctatccgcatcatgtggtctcaacgtgatccatcattgagaaaatctggcgttggaaatgtttttatcaagaatttagatcgttccattgacaacaaggccatgtacgatactttctcagcttttggtaacattcttagttgtaaggtagcccaagatgaaaacagctctagtaaaggttatgggtttgtccattttgaaaccgaagaagctgcaaataagtctattgaaaaggtaaatggtatgttgttgaacggaaaaaaagtatatgtaggtcgctttattccacacaaagaaagagaaaaggaactgggagaaaaagccaagctgttcacaaatgtttatgttaaaaattttggtgaagattttgctgaggaacagttaaaggttatgtttgaaaagtatggtaaaattaccagctacaagataatgagtaaagaagatggtaaatcaaaaggatttggttttgtagcctttgaaagttcagaggcagcagaagcggcagttgaagctttaaatggaaaagagttggttgaaggaaaacctttgtatgttggaagagcccaaaagagagctgagcgtcaacaagaactaaaacgtcgctttgaagccttaaaaatggaaagacttaatcgctatcagggtgtaaatctctatgttaaaaatctagatgatacaatagatgatgaacgtctccgtaaagagtttactccttttggaaccataacatctgccaaagtgatgttggaagaaggtagaagcaagggttttggttttgtatgtttttcctctccagaagaagctacaaaggcggtaacagaaatgaatggcagaattgttggttctaagcctttatatgttgccttagctcagcgtaaagaagatcgtaaagcacatttaacttctcagtacatgcagcgtatggcaaatatgagaatgcaccagatgggtcagttcatacaaccaggtgcatctagcggttattttgttcctaccattcctgccgcacaaagattctatggaccagcacagatgactcaaattcgtgctagtaccagatgggccgcccaaacaactgtaagacagggtgctcaaggaggaactactgtataccccggtatgcaaaacacttacagagctactgcccgcccaccaaatcagtcaacaaccatgcgtagcaacatgagtgtacctaggcaaattactggacaacaaccacaaaatgcaattgtacctgctgctgttaacagaacagccaacttcaaatacacttcaaacatgagaaatccaccacaacctttgggaggtttaccaggtgctgctgctccagtacagcaggctgtacacattcaaggtcaggaaccattgacagcaaccatgttggctgctgctccaccacaggagcaaaaacagatgttgggtgaaagattgtttccacttatccaacgcatgtatccagacatggcaggtaaaatcactggtatgttattggagattgacaacactgagctgctacacatgttggaacaacaggagtcccttaagaacaaagtggaagaagcagttgctgttttacaagcccatcaagccaagcaagctgctactactcagattaagaaagagtag

SEQ ID NO: 193 - DNA, 2742 bp, Diabrotica virgifera
atgactgactcaaaatattttactactaccaaaaagggagaaatatttgaattaaagtcagagctaaataatgataaaaaggagaagaaaaaagaagctgttaaaaaggttattgcctctatgacagtaggcaaagatgtttcagctttatttccagatgtcgtaaactgcatgcagactgataatttggagctcaaaaagctagtttatttatatttaatgaactatgctaaatctcaacctgacatggctattatggcagtaaatacttttgtaaaggactgcgaagatcccaatcctctaataagagcacttgctgttagaacaatgggttgtattagagtagataaaatcactgaatatctttgtgagccactgaggaaatgtctaaaagatgaagatccttatgtaagaaaaacagcagctgtttgtgttgccaaattatatgacatttcgtcaggtttggtagaggatcaaggctttttagaacagctaaaagaattgttgagtgattccaaccctatggtagttgctaacgctgtcgcagctttgtccgagataaatgaaagcagtcctactggtcaacctctagttgaactcagtacaaacactattaataaacttcttaccgctctaaacgaatgtaccgaatggggccaagtgttcatcctcgattcactttcaaattacacccctcgtgatgagcgcgaggcccaaagtatttgtgaacgtattactccgagattggcgcatgctaatgctgctgtggttttgtctgctgttaaagttttgatcaaaatgatggagattctagctggagatactgatttctgcaatactttaagcaagaaactagctcctccattggtaacgttgcttagttctgaaccagaagtgcagtacgtggcattaaggaatatcaacttaattgttcagaagaagcccgacatacttaaacatgagatgaaagtatttttcgtcaaatacaacgatccaatctacgttaaattggaaaagttggacataatgatccgtctagcatctcaagtcaacattgctcaagtcctcagtgaattaaaggagtatgctactgaagttgatgtagatttcgtcaggaaggcagttagagctattggtagatgtgccatcaaagttgaaccttcggcagaaagatgtgtggctacacttttggaccttattcaaacaaaagtcaactacgttgttcaagaagctattgttgttatcaaggatatatttagaaaatatcccaataagtatgaaagtattatcagtacactttgcgaaaatttggatactcttgatgagcccgaagctagagccagtatggtatggattattggagaatatgcagaaagaattgacaatgctgatgagctattggacagtttcctggaaggtttcggagatgaaaatgctcaagtacagttgcaattactgacagctgtggtcaaactgtttttgaaacgcccccaacatacgcaaggcttagttcagcatgtactaagtttagctacacaggattccgataacccagatctaagagaccgtggttttatctattggaggttgttgagtactgatcctgcagcagccaaagaagtagttctcgcagacaaacctctgatttctgaagaaactgatctactagaacctacacttcttgacgaactgatctgccatatatcttccctagccagtgtttatcacaaacccccaactgccttcgtcgaaggaagatctgcaggtatccgcaagtctttgccagctagacaaggatctgctgaagacactagtagcgctccagaaccaaccgttattcctaatcaagagagtcttatcggtgacttgctctcaatggatcttaacgctccagctcctgcggccgcacaagcagctgtaccagccagtaatgtagatctcttaggtggaggattggattctttgttggatattggtaccactcccgcacctcctacatctacgggacttcttggtgacatttttggaataccaactgctccaaccatgtataccccacccaaaactatatggttaccggctgaaaaaggaaaaggattggaaatacatggggcgttttcaagaagagccggacagatgtcaatggatttgacgttcaccaacaaagccatgcaggcgatgtctgcattcgctatccaattcaacaaaaacagcttcggcatagttcccggctcaccactcaccgtgcctgcgctccagcccggacagagcttggaatacaatttagcgttggctactaccggaccagtccaacgtatggatccactcaccactctccaagtggccatcaaaaacaacgtcgatatcttctattacgcctgccaaattcccattcagattctgttcaccgaagacggtactttggataagagggtgttccttaccacttggagagacattccggcagctaatgaggtccaatacactgttaatgatgtcaaaggaaacacagatggagtttctagcaaaatgacactgaataacatctttaccatagccaaacgcaatgtggaaggccaagacatgttataccaatcactgaagctgacgaataatatctgggttttactcgaactgaaacttcaaccgggattaaccacagctacacttagtttgaaatctagatctgtagaagtcgcaccttacgttttccaagcttatgattcaattttgaagaattag

SEQ ID NO: 194 - DNA, 498 bp, Diabrotica virgifera
atgccacccaagttcgatcccaccgaaattaaatatgtttacatgagatgtgtcggaggagaagttggagctacctcttctttggctcctaaaattggtcctctaggtttgtctcccaaaaaagttggtgacgatattgccaaaggtactgctgattggaaaggtcttaaaatcacagttcaattgaaaatccaaaatcgtcaagctaccatttctgtagtcccatctgcttcctccctgatcattagggctcttaaagaaccaccacgcgataggaagaagcaaaagaacattaaacacactggtaacattactttcgatgaaatcatcgctattgccagacagatgaggcccaggtcgatggccaaacagttatccggaactgtaaaagaggttttaggaacagcccaatcagttggatgtacaattgatggtaaagcagcacatgatgttattgacgaggttaatgaaggaaccatagaagtaccagatgaataa

SEQ ID NO: 195 - DNA, 1095 bp, Diabrotica virgifera
atgccagaagaaggaaaaagggcattaattttggttggaggttatggtaccagattgagacctttaactttgagtagacccaaacctcttgtagaatttgcaaataaacccattctccttcatcaaatagaagcacttgtagatgctggagttactgaagttatattagcagtatcatatcgtgctaagcaaatggaagaagagttgacagtggaagccaaaaaactgggaattaatataatattttcccatgaaacagaacctttaggtacagcgggaccaattgcattagccagggatcatctttctaaaagcactaaaccattctttgtgttaaattccgatattatttgcgacttcccatttaaagcattggctgaattccataaaaaccacggaaaggaaggtacaatagtggttactaaagtggaagaaccgtcaaaatatggtgtagtagtatatgataaagacaacagcatccaaagttttgtagaaaaacctcaagaattcatttctaataaaattaatgctggtttgtacattctaaatccaagcgtcattaataggatagaattaaaaccaacttctattgagaaagaagtatttccttacatggctgctgataaacagttgtatgcatttgaattggaaggtttttggatggatgttggtcaaccaaaagattttctgacaggaatgtgtttatatctcaaacatttaaggcagacaaatgaagacaaactttataaaggaccaggtgtcgttggcaatgtattagtagatcctactgctaaaattggaaacaattgtcaaatcgggcctaatgttacaataggaccaggtgttgttatagaagatggggtatgtataaaaagatctacaattcttaaagatgctaccattagttcaaattcttggttagaaagctgtattgttggatggaagtgttgtgttgggagatgggtaagaatggagggttccacagtactaggagaagatgttatagttaaagatgaaacatacattaatggaggtcaagtgttgcctcataaaaatatcgctacttcagttccagaacctcagattattatgtga

SEQ ID NO: 196 - DNA, 876 bp, Diabrotica virgifera
aacctaaacatggcgtcagacggggacgacgttattagtgaccaagaaaaagtgaaaatagtatcggattttattctccattcgccacccggtgaatttaatgaggtatttaatgatgttagaaaacttttaaacgacgatgacctcttaaaagaaggtgccagcggggcattcgcccagtataacaaagatcaactgacccccgttaaaatagaaaacgccgatcatttagtgcttattacggaatacaacgatttagggaataatagattcttcgaccccagaagtaagcagagttttacctatgatcacctgagaaaagaagccttagactaccaagtctatacccccgatagtgcttctgagccttggcgggcagccttagactccgagttcattcagtacactaggaaccattacaaagatggagtatgtagtgtggtaggccgcaaccagagcggggttgttaacttaacagcttgtatcgaagaccaccagttctctccgaagaactactggaatgggagatggagatctcagtggtccattagtctaactgatgattccactgctgaggtgagaggggtactcaaagtacaggtccattattatgaagagggtaatgtacaattagtaagtactaaagaaataaaagaaactgttcctgtttcatctgaggcacaaactgccaaagaaatcatccaagtaatagaagccgctgaggatctctatcagacggcaatttcagaaaactaccagaacatgtcagatacaaccttcaaggccctacgaagacttcttcctgtcaccaggacaaaaatggattggaataaaatcgtatcctatagcattggcaaagaactcaaaacgcaatga

SEQ ID NO: 197 - DNA, 4071 bp, Diabrotica virgifera
atgtggttcaagtactttgttatttttgttttgtttagtgttagcgttaaaggactagatggtgatcttccaccagatgtcgaaactatcgatgtggacactaccaatgtaagcaacgcggatccagacgcagggaaacctatcccggtggaagatacgcctaatggagcccctccagtgaatacaaactatgaagtagataaaaccttagttaatgtaaccaatagtttggtaaatgtgactaaaaatcccagacggacttatcagacagttaataaaatgggcaaatattcgacattttatgctgcagattacgatcctatgacctcagacacagctccaccagacactgaccaacgaggaggaggaggaactccatacactatatcagaaccgagactggcagaaataaggaaacattttatgtacccatttttcgataaaggaggcagtgataataacttgggagatttccaaaaggacattcaatcttccattcctcaggtgcacaagaatttaaacttccagttgcctttctttggattcaggtataattacacaagagtttcagtgaatgggtatctggaattcagcgatccacctccaaattatgactatccattagtatttccaattaaagaatggcccaaaaagaatgatcctgcctttattggcattttcttcagcagatgcagaatcggtaatctacgtgatggagacattgatcaaagaacacccggggtctattttagaatggaaagagatttaagaacgaggcaagacagaatgggtgtagaaattagagaaagacttaagtgggacatcagaacaggagtcattggatcagaaacattcgatcctaagcacgccgttattgtcacttggaaaaatgttactttcactggaggattcgctaatgctaaatacaagacaaacaccttccaaatggttcttgcaactgacgaagtcttcacttacgcgatgttcaactacctcaacttggactggacctcccacactgaagcgggtggtgattcccaaaacggagaaggtggtgtcagtgcctatgttggttttaacgctggaaacggtaccagaagctacgaatacaatccttacagtcaagcttccgtcattcgagatctcacatcagttggatttggaaatggttttaagggaagacatattttccgtatagacgaagacattttgcttggatcatgcaacaaagatatagatggtgccaaccttcccctgaaattcgctcctgaaagtggtaacatgttgggtggaacagtggtaaatataactggtccatgcttcaatttgaatgataggattcgatgcaagtttgacgtatcaaatgaagtatttgggtatgttgttgataaaaacagagctatctgtgtacaacctcaactttatgccgaaggatgggtgaatcttcaaattgctgttaattccgaagcattcaagtggaaggggaagtattatgtagaatcacctgctagtgcgactcaaaaaatcttctttaaggacatgaaattacacgaaaaatctccgagcgaattaaaaatcacttgggagaagcagaatttgaccacaaacgacaacgctaacatccgaatttctctctggggttacagagaaacgactatgaaaccagtgtttgtttatatcaccgatatcgctgataatgttcaaaacattggagaacacacgattgttccttctcagtttagaactagagtcaatcaatatctgactgatattaagtttggattcctccaaattaatttaactgagtctatcacagttaatacatatactacaagccagagcagcatagaattaacaccggtaatatggagccgacccattccactcggttggtacttccagttccaatgggaaaaccagtacggtaaaaattggcccaaatatctatgtgacgattggctgagaacggacagatatctaaaaaacttcgcccacgaacttgctcaatgtccctgcaccgtcgaacaggctttagctgacaagggcaggtttatgccagacttcgattgcgacaaagattcgaacccgatttgttactataacaaccaagcacttcattgtgtgaaaactggatctcccactttagaaggctccgaacaacaatgttgctatgataaaaacggctttttgatgctctcttacgatcagcaatggggttctagtccgagacgttgccacaacttgggtaaaatgccttacaatgaagcgacaaaagtgcctactctctcacaatggtttaatgacatggtacccaaatatttgtgttgtctttggcaagacgagcaagctgtgggatgtgaaacactgagatttgaacggagacctacacaggattgtgtagcttaccaagcaccaggtgtagcaggagtctacggtgatccacactttgttactttcgacgatgtagaatatacgtttaatggaaagggagaattcgcattggtgaaatcagttacgcaaacggacaatctggaaatccaaggaagatttgagcaaatggaccctaacacttatggtgaggttagagctactcagctgacttctgtagtagctaaaggtaataacacaatagcaattgaagtcagaaggagacctctggattctagatggagatataggttggatgttatagcagataatagaagactttattttgatagaccctcactaaaattccagcacttccaaggtgttactatttacactccaagctacatccttaatcaatcagaagtcatcattatgtttgacaatggagctggaatggaggttgtcgacaatcaaggattcatgagtgcaagagtatttttgccttggtcgtttataaataaaaccataggcctttttggaaattggagttttaacaaagaagatgacttcacacttccagatggttctagagcagcaatagtgaataacataaatgacatggaaagggtttacaatgattttggttccaaatggatgttggaggatgtgttagatcctcaaaagggtagagcattgttccacagggaattcggaagaacttcagcgacttacaacaacaaaacgttcaagcctcaattcctaatgaatccggaagatttcctaccaaccaacagatctacagatcttaagcgaatatccgaaatatgtcctctaaagttgtacgaatgttactacgattacgctatgacggttgacagggatttggcgcattacaccaagaattataaagccacgatctatcaatataaagaaacgacaaggaggaaagttgtgtcttgcggaggactagaaacaccgagattcggacgaaagaggactttcctgttcgtgcccgggacgaaggttacctatgaatgcatccaagagttcgtgttggtaggtgatcagcggagagagtgtcaagcggatggaacatggaatattcctgaatacggatacacatattgcttacgtcaagaagaatattcttcgcgtcaagctgccatcacttcaggtataatcctcgcaattatcataccattggttcttctattaggttacgttggctacaaaatatacgaaagactaacaagtaacaatcaaaactatgactacgacaccgtacaaaagactcaaaatctccaacaattcagtcgaactttaagtccatacagagaagaagacgaggacgaaaagtatcctcaaagcgacactgactcactaagcaagaaacgaagaagttacgacaaatcctacagaactcacgaacctttgcccaatagaccaaattctgagtttgaggaaaaaccattggacccttacgatcaaaccttcgaagacgacagggtttctagaacgcctacgggaagtccaaccagccctacttctagtatacaatatacaacgccttatagtcggccagacattattagagggaacagctcaaagaatttgaactataacgacatgtatgcagagccaataaagaaacctaaagaaaggattagcgctagtcagagtagtatagtgacagacgtttag

SEQ ID NO: 198 - DNA, 645 bp, Diabrotica virgifera
atgagttcttcaacagacttgccactgagctcgctgatgactttctttactcgtgcccgggcggctttagttcctttttatttcacttttcactccattttccttcttgatattttgatattttgtcggtatacacgtttcgtgtctcaagacttaaaaatgcgttacgtggctgcttacttattggccgttttgggcggcaaagcctctcccaatgctgcagatcttgaaaaaatcttgggatctgtaggtgttgaagctgaaggagaaagagtaaagaaagtcatcagcgagctcagtggcaagtctgttgaagaactcattgctcaaggtcgtgaaaagttgagctccatgccagttggtggtggtgccccagctgctgccggaggtgccgctgctgctgctccagctgctgaagtaaagaaagtcatcagcgagctcagtggcaagtctgttgaagaactcattgctcaaggtcgtgaaaagttgagctccatgccagttggtggtggtgccccagctgctgccggaggtgccgctgctgctgctccagctgctgaagaaaagaaagaggccaagaaggaagaaaagaaggttgaatctgaatcagaagacgacgacatgggctttgctctattcgactag

SEQ ID NO: 199 - DNA, 2724 bp, Diabrotica virgifera
atgatgactgaccgcttcggtttaaaatgggacccgaaaaacttagagataagaaccatgtctgtggaaaagacattggaacccctagtgcttcaagttaccaccctcgtcaataccaaggggcctagcaaaaagaagaaaggaaagtctaaacgtgccaatgctctggttagtactgttgaaaaagccacggaaaacttcatagaaaagggggagcagatagcctatgagaatccagatattactgaggaaatgctggcagctgttgacgaagtcaagaaaacgggacatgctatgagcggagctgcaagagaattttcagaagacccatgttcttctttaaaaagaggaaatatggttagggctgctagaaatcttttatcggctgtaactcgtcttttaattctagcggacatggttgatgtccaccttttgctcaaatccttacatgtagttgaggatgacctcgaaaaactaaaaaatgcttcaagcaatggcgaacttttagacaatattaaagcctttggtcaaaatgccaacgaattaatgaatcaggctgctaaaaggcagcaagaactgaaagatccacaacttcgtgatgatctagcagctgctagagctgtacttaagaaacattccactatgttattaactgcctctaaggtttatgtacgtcatccagagctagcagctgccaaagcaaatagagattatgtcttgaaacaagtttgtgaagctgtgaataccattaatgatgtagctcagggaagaactcctcaacctgcttctggaccatatgatggacctggagagttggctgctgctttggatgattttgatgatcacatggtaatggagcctctagcatacaatgaagttcataccaggccttcattggaagaacgtctagaaagcattataagtggtgcagctcttatggcagattctagttgtactagggatgaaagaagggaaaggatagttgcagagtgtaatgctgtaagacaagctttgcaagacttgttgactgaatatatgacaaatatgggcaataaagataaaagtgagagcctaatacgagcaatcgacaatatgggtagaaagactaaggatttaagaagacaactgagaaaagctgttgtagatcatgtatctgacagtttcttggaaaccaacgtacctcttctcgttttaataaaggcagctcaaaatggcaacgaaaaggaggtagaagaatatgcagttgtatttactgaacattccaataagttagtagaagttgctaaccttgtctgcagcatgtctaataatgaagatggtgtcaaaatggttagatatgctgctgctcagatcgacaatctgtgtcctgaagtaataaatgcagctagaattttagccgctagacctcgcagtaaagttgctcaagaaaatatggacgcattcaagcaatcatgggagaatcaagtgagacttctgactgaagcagtcgatgacattactactatcgacgactttttggctgtttctgaaaaccatattctggaagatgttaataaatgtgtacttgccttgcaagaaggtgattctgacacattggatcgcactgccagtggtataagaggaagatccaatagggtgtgcaatgtagtaacagctgaaatggataattacgaaccttgcatttataccaaacgtgttcttgaagccgtcaaagtattgaatgatcaagtgatgcccaagtttactcaaagagtgcaagttgcagttcaagctttgggaaatagtcctcccaaagaagtggatgaaaacgattttatcgatgcttctagacttgtttacgatggagtgagagaaataagaagagccgttctaatgaatagagccgatgaagatttagatccagaagatgtcgaattggatgaaaactatctaatagaaacaagaagcaaatcgagcgctcacacaggcgaacatggagttgatgagtatccagatattagtggaattacaacggctagggaagctatgggtaaaatgccggaagaagataaacagaagattttgcaacaggttgagttcttcaggagtgaaaaactcaagtttgaccgtgaggtcgctaaatgggacgacactggcaacgatattatcgttcttgctaagcacatgtgtatgattatgatggaaatgacagattttaccaggggtcgtggccctctaaaaaccactatggacgttattaatgcggctaaaaagatttccgaagctggaaccaaattagataaacttactcgccaaatagctgaacagtgcccagagagttccaccaaaaaagatttgttggcttatttgcaacgtattgctctttactgccaccagatgaacattacatcaaaggttaaagccgatgttcaaaacatcagtggagaacttattgtatctgggttggacagtgctacttctttgattcaagctgctaagaacttgatgaatgctgtagttctcacagtaaaagcttcatatgtggcatccaccaaatacccaagacaaggaactattgcatcgccgattgttgtctggaagatgaaagcgccagagaagaagccgttagtcagaccagagaaacccgaagaagttcgtgccaaagtacgcaaaggctcacaaaagaaagttcaaaatccaattcacgctctttctgaattccaaagcccaactgagtctgtgtaa

SEQ ID NO: 200 - DNA, 1236 bp, Diabrotica virgifera
atgtcgttctcgttcggagccactccaacaccacctcaaaaaaccgttgcctccggttttactttgccttcaaatccaatagtaacttcaactactggatttcaaagcagttttggttcaggagataataaagaccaaagtaaaccgtcattatttgcaaccccctcaagtcaacccgtttcatttgggttaactacaaaggccactacagccccaacaaccctctcctttggttttgctactcctacgactgtaccgtttggatcatcaactacaattacacctgcaacaactcctcaatttggattatcgcttccaaaggctagtgccccggccactactaccttttcacttctaggatctgccccagccactactgcagcagcacctacaggtatatcatttggtactgccactactacagcaacaacttcagctacaggtttatcatttggaactccaattggaactgctacaactacagcaacaacttcagcttcaggtttatctttcggtcttacaacagcgtcttctacaagttctgctgcacctacacttttgtcatcaacaaccacttcgacaacgtcatcagtgtctgcatctggtgctttgagtagtacaacatcagcaccgacttttgccacctcatcgttgtcttcaacaggcaccttaacattctctcaactcgaagattcgatcaacaaatggaccatggatctagaagaacaaggaaaattcttcatcaaccaggctaagcaattaaatgcatgggatactttacttatatctaatggagagaaaattttaacccttaacagtagcatcgagaaagttaagcaacaacagcaacagttagaccaagaattagacttcgtgctggcacagcaaaaggaattggaagagctgattgtaccgatagaaaaagaattgttggggatacctgttacggatatcgatagaaatcaaatgtaccaattttcggaaatagtcgattcacaattaaaacagatgtctgatgatttgaaagaagtcattgaacacataaatgaagccaataaagaggaagaagcgtcaaacccactaagccaaatcagtcgcatattaaatgcgcatatgaattcgttgcaatggatcgataggagtacagctcagattagctctcatctagaacaaattggaaaaatgcaagattcaaacagaagaaatcactcttttaataattccatgaacttttaa

SEQ ID NO: 201 - DNA, 582 bp, Diabrotica virgifera
atgtttctgtgggactggtttacgggaatgctgggatatctaggattgtggaagaaatctggaaaactattattcttaggactggataacgcaggcaaaactacccttctacatatgctcaaggatgacagactggcccagcatcttcccacgttacatcccacatcagaggagctttccattggtaacatgaggtttacgacgttcgatttggggggccacgagcaggctaggagagtgtggagggactactttccagcagtcgatgccatagtgttccttgttgatgccaacgacagctcaagatttgtagaaagccaggaacagctaaatgccctcctctcagacgaaactctatcaaactgtccaatacttatcttaggtaataaaattgatctcccaggtgctgcttcggaagatgaattacgaactagattcggcttgtttggccaaaccacaggcaaaggcaaagtagccagaaatgatctacccggtaggcctctagaactatttatgtgctctatactcaaaagacaaggttatggagaaggtttccgttggttggcacaatatatcgattaa

SEQ ID NO: 202 - DNA, 573 bp, Diabrotica virgifera
atggaggaaattaacctggatttgttggagaaacgtatagaagctttggaattaaaggtgtttccttcaggagatcccagtaccattgccgacaaaaatcaaacaataacaaatatccttacacaagttcagacattcgttaccacagctctcacttgtagagaaacaataacgtccatgttgcagttttatggaactttaaacgactatctcgacccagctggtggagcagatgaactcgaggttgaggcaaaaagacattatatattgcagttacaccctgagatcaaagacaccctacagacacatactcgaattttgcagactttactcccctttgtggaatcagaaaatatttctaaagtggttgaaatgacagctcaattggaagaggcatctgttagtcatctcagtttgtatggagagtggagagatacaatgtacaaaatggtggtagctctacaagattttactgatataatgagttcgattaaggtattgttctctcaattagataataccttgacgaatctggaatactcacttcaacctaaatttgttactgaggaatga

SEQ ID NO: 203 - DNA, 1749 bp, Diabrotica virgifera
atgaataacacaaaaacgcaggaagtctacagcgacctaacattatttacaactccagataagtttttcttggagcccaaaaatggagaggaattgcttgtgatagagagagtaactgaagagatttcagtttataaaaaccaccgtcacatcataccagcagctagtagtaggaaagatttctgtggcctcctaggaatcattaatctcttgtcggggccttatttagtaattgccacacagagggatatagtgggttatatatcaggttgtgcagtatggaggctagtaaaggcagaactaattcccttcaggagctccttaaacttaagtccagaaaaacaagccgacaatgaagtctaccttagtatgatagaacaagttttaacgacaccctttcagtatttctgttacgattacgacctgacacattcccttcagcgccttcgggacatttctccagatttctggaaacagtccctgtgggaaagagccgatcaacgatttgtatggaatggattcctattaagccctttcagaaatgtgatcagcaaaaagttttgtctgccgttgatgctagggtttgtttctattaacttttgtgttgttaatgggcatagcttgaactggatcattgttacgaggagaagtgtttttagagcaggtaccagattattccgcagaggcatagacaaagacggaaacgttgctaatttcgtcgaaactgaacaaatcgtagagtaccaaggcgatcatgcgagttttgttcaaattagaggctctattccacttttctggcagcaaaatcccgatttgcgtcttaaacctcctcctaccatgatcgatatggacccacaagagcaacattccacctgtttgaagcatctagaagaagtggcaactttatatggcaaagttgtgttagtcaatctcattgaccaaaagggagctgaaggtaacatggagaaatcctttaagaacgccatgagttcattgtcgtatccttcagcacgatacgaacctttcgacttccattctgaatgtagcaaaatgaggtgggaccgtctgaaaatcctcatagaccgtctagctctggaccaagatgaaatgggcttctttctcttattgcgggatggttccttaagctcgttacaagacggagtcttcaggacgaactgcatagattgtttggacagaaccaatgtggtccaaagtatgctagcgcacagaaatttagaaatagttttaaggaagttgaatattttacaccaaaaccagaacttggagttccagtattccttcgaggttttgtttaagaatgtttgggcagacaacgctgatattataagcacacaatactcgggaaccggagctttaaaaacggattttactagaacaggtaaaaggactaaggctggagtttttcgagacggagtcaattcgcttaccagatactacaaaaataatttaactgacgggtatcgccaggatgccatagatttgttcttaggttacggcaaaccgatatctccactaagagtagacaaatcgtggcgatatattacttacccttcggtacttttagtcgctgtatccatgtttgtagcttctgctgtgtttccttcggaatactcaaccgaatctcttctgtttttgttgttttggggttctatggtctacgccacattgcacaccatattcagatacggcgttgagttcgtggacagacctaggctcacgcagtcttag

SEQ ID NO: 204 - DNA, 1761 bp, Diabrotica virgifera
atggcacctacaatacagcaaaacaaccagaacggaacagccaatggcgttgaaaaaagaccagtaaaaactgtagaaaaaaggtcggatttaatatgtaaagtgaagtactgtaacactttacctgatattcctttcgatttgaagtttatagcatatccttttgaacccataaggtttattcaatacaacccaacatccctagagcgtaattacaaatatgaagtgctaacagagcatgatttaggtgttagtattgatcttataaacaaagatatatatgctattgagccaggagctactctagatcctgccgatgaaaaattactagaagaagacattttaacacctcaggactcaaaaagatctcgccatcatgccaagtcagtatcctggttgcgaagaactgagtacatttcaacggaacagaccagattccagcctcagactatggacaaagttgaagctaaggtcggttatagtattaagaaatcccttaacaatgaaacgttgtacatggacagagattctcagattaaggctattgaaaagacctttgaagactctaagaatgtcatcgagaagcattacagcaaaccaaatgtcgtagctgtggatattttgcctgtgtatccagatttcagcctttggaagtacccttgtgcccaagttatttttgattccgatccagctcctgttggcaagcaagtaccagctcagattgaagagatgtctcaggctatgatcagaggtgtgatggacgaaagtggagaacaatttgttgcctactttttgcccacagaagacactcttcagaaacgaagggatgattttgtcaaccagataccatatcaagatgatgaggaatatgagtataagatggcaagagagtacaactggaatgtaaagagcaaggcaagcaaagggtatgaagaaaactacttctttgtggcaagaccagatggaatttattacaatgaactggagaccagagtaaggctgagtaagagaagggtcaaagctggtgctccacctagtaacacaaggcttattgtcaaacacagacccatggatgctaatgagttcagaatgcagaggtaccgagagaaacagctggaaccaccaggtgaagatgatgaggaaatggaggttgatgaaccacaagaagaagaagctactcaagaagaacaggaacaagagaagggggagaaatcaccatctcgctctagatctagatcaaactcatctaacagaagcagatctaggtccaaatcaagatccaagtctagatccaagtctagatcaaaatcaaggtccaagtctagatcaagatccaagtctaagtcacaatctagatccagatctaggtctaaatctcgttccagatcccattcaagatcacgatcaagatcaaaatcccgttccaagtccagatcccgctctaaatcaaagtctaaatctaaatcccggtcccgatcaaaatcccaatccaaatcgccttcgagatcaagatcaaggtctcgttctaagtcaaagtcgagatccagatctgcttcaggctctagatcaccatctggttccagatccaggtctccttccaaatccaagtcaaggtccagatctaggtctagatcaggttctaaatctgcttccagatctagatcgtcttccaaagcttcttccaaatcgggatcaaggtccagatcaggatctcgatcaggatcaggctcagaatctgggtctggatctgaaagtgactaa

SEQ ID NO: 205 - DNA, 1260 bp, Diabrotica virgifera
cacagctgtcctttactgtgcttgtcacgtcaaaaatttgttggtcattttgatttaaaagaaagttcatttcattcacaactaaacaaaatgccgattgaaaatttagaagaccagggtcttgagaaaaaccctgatttagaattagcacattgtaagtttctgttaactttaccagaatatcgcagtgataaaaacgtccactccaaaataacagaagctataaagaaagatgatatggccccatggtatgaacttatttgtaaagatgctggttggaaacttgatgctaatctactgagtgcattaaaagctaagaacgctgagaagatcaagcttttggatgaagccatagaagatgccgagaaaaatttaggtgaaatggaagttcgagaagcctacttaagaaaagcagaatactacagccgaattggtgataaagacaacgcagttagtactttcagacaaacatatgataaaactgtatcacttggtcatcgtttagatattatttttcacttgataagaattggtttgttcttcatggaccatgatctcatcacaagaaatattgaaaaagctaaaacccttattgaagaaggaggtgattgggatagaagaaatcgtttaaaagtgtatcaaggtgcatattgtatgtcagtacgagacttcaaatcagctgctaacttgtttttggacacagtaagcacttttacatcatacgaactaatggactataaagcatttgtcaggtatactgtatacacctctattattagtttgccaaggaaccaattaagagataaagtggtcaaaggttccgaaatattggaagtactgcattcagaaccatttgtaaaagattaccttttttctttatataattgtcagtatgctgaatttttcacaaatcttgcagaagttgaaacagttctcagaaaagattatttcttgaatcctcactatcgtttctatgtaagagagatgaagatacttgcttatacacaattattggagtcatataggtctcttactttacaatacatggcagaagcctttggagttactgttgaatacattgataaagaactgtccacatttatagcagcaggaagattgcattgtaaaattgatcgagttgggggaattgttgaaactaatagaccagatttaaagaatgcccaatttaattctgtggtaaaacaaggagatttactgctgaatagagtccaaaaattatctagggtgatcaatatctaa

SEQ ID NO: 206 - DNA, 5328 bp, Diabrotica virgifera
atggaggaaataacctcgggactagatcccgacgaactgatggatctagatgagcctgaaggttcagatctagacgaggatgaggaagacctcatagacgaccatatttcctcaccgtttattttatcatctgcccctggatcaacaaccaattcagttgcttcttctccaataagtgaagagtttcctccacctttcagtttttcgggaaaaccactcaatgtcaaacggggccgtggaagaccaaggagagaaggaggtaagcctggcttaccgagagttgtaagaggaggaggaacaggtatgacaagagttaggaaacctagaccaccaggttttagtagaagaggcatgggaaataggagtgtcagacaaccagacagatcggattttgatttctccccctttactccatcacctattgatgagcaagctatattggatccagaaacaggagcacttttatatccagagagagaaaagttgcttccatctatggaagaacctccgtattttccagaacattggcctgggaaggtttgtgccttttgtaatttaggagaaaggagtcaattgggacaaggggaaatgctaaggttgaactgcccagaaggttttttaccacacaaagtcgctgcagaacaaattttagagaaagccttgcaagctcctgacaaggacagaggagataagagtcccaagggacctgtaacctgtagaaggcagaagggttttaacaaatgtaggcatccatctatgaatagtgaatatgttgacgaacttactattattgggtataatgaagtttgtgatgtaaccagtctatttgaaccaaatggtcagttctatgttcataggaactgtgctctgtggtctaatggagttacacgagcagaaaattcagctctgctagatgtgggtccagttgtcttacaatgttcttccaaaaagtgttcattatgtaatcattatggagctagtgtaacatgtaacttggattcttgtaataaagtttttcattttccgtgtgctaccgccgctggtgcctttcaggaaattatgtcgatttctactttctgttctaatcatataggacaagttgccatgcttaatgaagctacaccttgttttacatgccgcactatgggagatatatcaaacttaatgtactgctcaacatgcggtgcacattatcatggaacctgtgttggtttagcgcagttaccaggtgttcgagctggatggcagtgtcgaaaatgccgatgctgtcaggtttgtcggactgtcggagatgagtcaaaattaatgtcttgcgaacaatgtgataaagtctaccatgcaggatgtcaaagaccgatagttacttctattccaaaatatggatggaagtgtagatgttgcagagtatgcggcgattgtggatctcgcacgccaggagctggtttgtcttcaaggtggcatgcccattacacagtttgcgattcctgctaccagcagaggaataaagggttctcctgtcctctctgccataaagcctaccgagcgcatgctcatagggagatggttcaatgctctaattgtaaaaaatttgtacatgggacatgcgacgctgaagcagatgtagctacttaccatcaaaagaaagatcttaaccctgaatatgaatatgtatgtttacattgcaaaaacagtactgctagacaaataactgcaaaaagagcaagtattgaagactcatcggatgtaccagcttcccatgaatctctttacgatgacacctcagaattcgacctgccttctccggatgaatttgctcgtagtatgggtatgggcaaaggaaaaccgttcgccagcaaaattgctaaaaagcgcatgacctttcccgttggtggtaggccaaaaggtacaggcaaagtacctcccggtaagatgggtttcatgaaacgatctcgactatcggattttaacaggaaaaggggccataaatcaaaaatgtgcggtattttcggcgtacctggtgttggccttcaacgaccgactgccgatggaaaaagcgacgaagagcccggtgtggagaatagattggttttatgttctgccaaagataagtatacgttgacgcaagatatctgtgtcatgtgtggagcgcttggaatggaccaagaaggatgtttgatcagctgcgtgcaatgcggacagtgttaccatccatactgtatcaatgtcaaaataacaaaagttatattggagaagggatggagatgtttggactgtaccatttgcgaaggttgtggtcagcgaaacgacgaagctcgcctgatactctgcgatgattgtgacgtatcgtttcatatctactgcatggatccaccacttgactacgttcctcacggcaattggaaatgcaaatggtgtgcgatgtgtctcacttgcggggctactgatcctggttttaactgcaattggatgaacagctctacccagtgcggtccatgcgcatcacatctcaattgtcccagttgtaacgagccgtatggtgatggagaattgattattcagtgtgttcagtgcgagagatggctccatggttcctgcgattgtataaaaaacgaagacgatgccgaaaaatgcgcagaagacggttacaactgcatcctttgccgaccaagagatgtaccaccgcctcatcttgtaccaccaccacccgctccaaaaccaccaactcctacgaagagtcctgaagttgggaaaagttcgagtttttatttggacggcgtttacctaagcgagatggggaatagctttattaaatcattagctttggaacatcatgcctcgcgaaagaaacggaaaaaacttcctacggtgcaggataaagaagccggtattatggctacaattgaatctgttatagcaggcggaaattctgggggagccactgctttagatgacagcgctaaactagaattggtcgacgtcaaagacgagcctcaagagctatacaaagaaggcatgatttggacaaaagaggatggtcccgcacctgaaggtttcacggtgttcacgatggagagcggaatcagtgtcttaaggcgcaagagacaacggaatctacagaaactaggcataggtggttttctagtcagaatgagaggcattcgaaccggtcaggataacgatgaaatcgattcctcggtaatccaatctggcagtgccacacctacagagctcctacctcccatgcccgttgacggagataaaccaaaaagaaaaccgattagaagaaaaccgaaaagcaagctagctgaaacttttccggcgtacttacaagaagcctttttcggtaaagatcttttagaaaccgttgattgtaaaaaagaagttgacagttgtagcagcgatgacgaaaaatctgtcaagtataaatctatcaatttgtctcaggatgaactgatggctgtagctgcagtctcgagcaaaagtgaaaagcaagcaatagccagtattaaagactcactgaaggatattaaatcatcttcaatgataaaggaagaagacgacgataatacagaagacttaaaagacgtgcttgccttaccaggtgatttacttgatgcagaaatagtcaatagcattatggaagatgacgacgagcttactaaaaatacagaatcactggatgctttagataccaacctgcaagatgctaatgagttggctgatacattgggcagctctggaaattcgaaagaaaccaaagatgagttaagtgatattttagggccacattttaatttggaatcgatttctaatatcaacagcaaggacgtagaagacatatttaagggtgtattgactgatgaatcacaggaatcacaagagagcagcaatttcgctctacaaggaagtaatctattttccaacaatactcctcaacaaagtctagctcagcattccatgatgacctctgctgttcgtcctaaaacgttacccaatgtgagccaagttaatttgaattcaccagtaggatttcctccaccatcaccctaccactcagaatatagcaatagccctcagttcagtcctgcttttacggaatctcctaacgcttgggtgggagttcccgaaactcctgaaatagacagtaccaatgtcggagttccttcaacgtacaatcagcgttcctcggaaaagatgaaagccgacgaaagtttgggcaacggtgctaccatctcagccgttctatatgctaatatgaatcatccagaatggaagaaagatttcccggtttggtctgataggtacaagcaaataatcaagaagtggaggacactaagtcaagaacagaaagctccgtaccttcaacatgccagagataatagaagccaattgagaatgaagaaagcccagcagtcacagacctccaaggagtccaccgcatccacatcaacccccaacgtgaccaagccagtccatgccgtcccagctctagtgaccaccctccaggcagtatcgcagcagcccgtgggggtgactacagcccccacggctcccattacagaggatcaagagaagatggcgctgcaacagaaatccgccagggaagccgaacaagaaaggcaatggaagcagcttcaggctatgaggcagcagcagacgcagcagcaacagaatattatacacgaacaacgtgttcaggccatcgccagagtccagagatcaatatcggtggatccagctcagcagtttttgtcggaccaacaaagtcccttacaaccaagtacgcctcaggagcttagcccgtctgctacgccaacaccaagcccaagacagttcataggaatgaaatccccgaccttccctcttccttcaccagtgcctcagacagcaatcagacctcctacaccctcccattctccacatgatgtaagtcaggcaagcacctctgacggtaatgatcactttattcagtcaccttctactcctaaacctagttttcctaatagattacctacagatcaatttatccatcaacctgcaactcctaggccccagtttggaatacaacggccaactttacagaactttggtaatacgatgaggacagaccagcaagatattaatatcaaccgacagttgagagatctcctacagcgacaacaagtcaaaaagttggatgaaatgttaccaggtaaagttcaacaacaaagagtgtggcctccaattgaacaacaagaaaatgaggcctcagcaactactggtacttcggcagttgtggctacaacagcagataccactttcaggcaaccattgccgcccagtattgta

SEQ ID NO: 207 - DNA, 4458 bp, Diabrotica virgifera
atggaagattctccgcaagaggcacgatccaatagacgatctcgagatacttcttacaaatcaaaggcctttgaaaaattcaaacagttaaagaaaggattgaaaaataaatatgaggttgatgaaatagataatgtttatgaagtagttgaagaaaaacagtatgtcaaggaggttttgtcaagatatgatgatgattggattgtggatgatgatggcggtggctatgtggaagatggtagagatatatttgatgatgatctcgacatggagtcaattgctcaagcctcagctaaaagcaaaggcactaaacgaaaaacaaaaaatgtatctgaaaatgctgggaaaggaaaaattcaacaaatgttatccagtttaccttcaaagaaaaaagtggaaacgaaaattgatgatgatgagatgctgtcagaaattcttggagagattgattcctcgccttccactagtggacaaaagccaaagattaacgagtattcagctttagctaaaaagttggctgctaaggattacatgaaaaatttctcccaaccttctaaaaaacgtgtcattgagaggaaatcattaccaaatgaggaagctggggaggtgacacatgggtctgtgttaaaagaagtacagtctaatgtgggaaaatccacaaagaagccccaaagaaatgtcacagaacaaactgttatcaaccctttcaaaaaagtgaaagaaactcctgcagtcaaacagccacaaactgaagcagcccaagaagtaatagaagaaactcctttagaaacctttgatgacaccttgacagaagacttcgatgatgatcccatgtttgaagagctggataaaacaccaaccccagttgcatcatgtcaaaaggttgcaagtcagactattgagactgatttaactcaggatgactttggtgatgatttcgatgtcacccaaattgaagaatttgagtcacagccttctggggatgtcgaagaagccagtgaaaagctttcggatgagctgcaggctgaattcgaaaccgagtgggagaattttatgaacaaaactgttgatattgataacaccaccgaggctttattggataagagtgatatacccacaatagatgatgaagggaaaaagatattccgatttttttggtgggatgcttatgaggacccgttgaagcaaaggggaacagttttcttatttggaaggacttactgtgagaaaagcaagagcttcgtcagttgttgcgtagctgtcagaaacattgatagacgtctatttgttttaccgaggccgtatgaactcggaccagatggacaacctacagacactccggttacattcaagaaaatgtatgaagaattcaatgatagggtacttaagccgataggagttagtaccttcagatctagacagactagtaagaaatatgcttttgatccaaatataccacaagaatcggaatatatggaagtcagatatcctgcaaatgatccaaaaattgacgcagatctcatacctaaaaagacacgcaccttttcaaaaattttcggagtaaacactagtttcctcgaaatcttcttcctagaaagaaaaatcaagggaccttgctggttggatatatcaaatccagtcccagttacgaaccccttaagttggtgtaagttcgaagtgaactgtacgaagatggtggatttaaaggtgacagtgacggaaaagcctctccctccacctcctttggtggtaactgctattaacataaggacttgcatcaacaggaaaacttgtggccatgaaattgtgatggcgtcttgcttgacgcataaaaaatatgccgtagatatgcagcccccagatccgccctttcagcaacatttctgtgtgattgcttctcccggtgaccagacattaccttttgatatccacgatgccctcagcaaatacaaagcaaccaaagtacaaaaaatggactcagaaaaaggattgctaaacttttttgtaaaccaattctcctctatcgatcccgatttaatagtaggccacgacttgcagggctaccaaattaacatcttagccgaaagactttcaaaactcaatacgaacattttcaataaattgggtcgcttgaagagatccgaaaagaagaatttggagaaaagtctgtttgctggaagattagtgtgtgatataaaaatatcagctaaggaattgataaaatcaaggtcatacgatttggacgccttatgtcaagtcgttctcaaacttaacgaaaatcaaagaatcgagttagaacctgatgatgtaccaaatatgttcaaaaccacttcagatattctgaagttgatatcgtttaccatgcaggacactatgtatatactaaaaatcatgtacaatttgaatgtcattccactggcgttacagataacgaatatagccggaaatgtcatgtcgaagactctgatgggtggtagatcagaacggaatgagtttttgttgctgcacgccttttctgagaaaggctatatacttccagataaggagtataagaagagaggagatgggaagcagagttcgaaaaagaaacctacgtatgcgggaggtttggttttggatcccaaagtcggattctacgacaaccttatcctcctgatggacttcaactctctataccccagcatcattcaggaatacaacatctgttttaccacattaccaataagcgacaatgacgaaaaccttttcttacccgacagcaacctacctccaggagttttaccaacagagatcagaaaactagtcgaaagccggcgccaagtcaaaggaatgatgaaaaaaccggatatatctcttgatttacgaatgcagtacgacattagacagatggctttaaagttaacagccaatagtatgtacggatgtctgggattttcgaattctaggttctatgccaaaaatttggctgcgctggtgacgcagaaaggtagagagatattgacgaatactagggatatgattgagaagatgaattttaatgttgtttacggagatactgatagtattatgattaacaccaatattttggaatacgatcaggtatttaaaattggtgtcaaaattaaacaagaagtaaacaaattatataaacaagtcgaactcgacatagatggtgtgtttaagtacttactgcttttaaaaaagaagaagtacgctgcagtaacattgaataaagacaaaaacgggaaattggtggccgtcaaagagtataaaggtttggatattgttcgaagagattggtcccaaatatcttccgaagctggaaaatatatattgaatcaaattttgagtgaccaatccgccgatgaaagaatagagcatatccgtgaatatctaagaaaaattcgtgaacatttaactgagggcaaagtacctactccattattaataattaccaagcagttaacgaaggagccccatatgtatcccgacaaaaatagtctaccgcacgtgctagtcgctcttcgttacaaccagaaaagcggaggacattttagggcaggagacaccgtaccttatataatctgtgaagatggtaccaccaatagcgccgtacaaagagcctaccacgtagacgaactaaaaagtaattctgagctcaaagttgatgttatgtattatttaggtcagcaaatacaccccgtggtatccagaatctgcgaaccgatcgaaggaatagattcatatgagatagccgagtgcttaggattagatacgaaaaacataaaaagacccagacaggcagtaaacgaattagtcggagaaaatattagcagacccgaagttaagttcagaaacgtggacaagtttaaatttatttgctatggctgtaagcaggataatattgtggagggtgcattggtaggaaacgcaccttttctggaacggtgtcgaaacgctgattgcagtttgaaaccaatcgattacttaccctccatacaaaaccaattgaccctttcgatccaatcatacattaataagtactatgaaaatatcctaatctgtgaagatcctgcatgcacaaacgaaacaaaccgccttccacttaaatttgccaggaaatatccgatttgtacattatgtcagaagggagtcatgttcagggtgtataacgagcagcaattgtacacccagttgtcttatttccagcatatatttgatttgagtaaactgagtaaaaagcctctaatggaacaggaaatcgaatctggttattcgtcactccaagatgttgttgaaaagtatttgaatcactccggatactccataatagacctcactgaccttttctccatgctagatcctcacaaaaagcgggaaaccacaacaattgatgtaaatagagatgtagatgaagacgtccaatatatggacgaggatgaagaagaggatgtgtaa

SEQ ID NO: 208 - DNA, 1122 bp, Diabrotica virgifera
atggctttaagaacctacggagataaaccaataagttttcagctcgaagaaaatggagactactattgtgttggttccgaggtgggaaactatctacgcctctttcgaggttctctctataagaaatatcctggaatgttcaggagatcaattacaaatgaagaacggaaaaggttaattgaacttggtctaagtcaacatgttctagctagtagcgtatcactactgagagcagctgaagtagatgatatcatcgaagggaatgacgaaaaatataaagccgtatctgtccatacttcagaaccaccaatgcctagagaaagtaaatcgaagaaaaatttgcaatgggtgccatctttgccaaattccagtcatttagatgcagttcctcaagctactcctattaataggaacagagtagcatcaaaaaaggtgaggacattcccattatgttttgatgacacagatccacaagtaaacattgaaaattcttgtcagcaagaaatacttgttcctattagacttgatatggaaattgaaggacaaaaactcagagatacttttacatggaataaaaatgagagtttgatttctcccgaacaatttgcggaagtcctttgtgatgatctcgatttaaacccattgacgtttgtgcctgccatagctcaagcaatcagacagcagctggaagcttttccaaacgaaccgccaagtatactggaagagaattgtgaccagagagtaattatcaagctgaacatacatgtaggaaatacttcattagttgatcaggtggaatgggatatgagtgaaaaacaaaataacgccgaagagttcgctctcaaattatgttccgagctgggtctaggaggggaattcgtaacagccatagcatactctatccgtggtcaactctcgtggcatcagaggacttacgctttcagtgaagctccgcttccgacagttgaagttccgttcagaactcccagcgagtcagatcaatgggcgccgtttttggaaactttaacagatgccgaaatggagaaaaagataagagatcaagacaggaatacccgaaggatccggagattggcgaatacaacgccggccgtcaaccgatga

SEQ ID NO: 209 - DNA, 4005 bp, Diabrotica virgifera
atgaatacaacaacgagagttgataatacacaaaatccagtacaaaaaattgaattaacttctagaagtattgaaaatgccttaatattggataataattcgccaagattgttagatcttatgaatatcagttcccaaagtggatctacagctagtggttttgcagatcatgactatccaactatcagtggagtatcacaagttatcaacaatatgacacaagttaaatgtgttaatagcattcctttaccaacggaaattgttgaccacttttcacgggttcaatgccattgcatgatgggtctcttttgtgaaatcaatagagcttggcttactgtggatagtgatatttatgtatggacttacgaacaaaatactgatctggcatactttgatggaataagtgagaccattgtttgtgttggtcttgtaaagccaaagatgggagtcttccatgcttttataaagtatcttctgatcttggcaacttctgttgatattgtggttttgggtgtaacttttactgagaagccaggtgataccacagaggaaattcagttgataccagacccagtttttagtttaccaactgatggtgccactgttactatcatcagtagtactaatgacggaagaattttttatggcacaaaggagggaaagctctttgaaatatactatcaggctgaaagtggttggtttgggcaaagatgtaaaaaggtaaacttgtctacaagtaccctatcttttctagttccttcatttttaaatgctgctcttagcgaagaagatggaatttgtcagatttcaatagatgagagtcggcatatattgtacaccttaacagaaaaaggaactatagaagtttgtgatttgggcgaaagaggaaatacattttcaaggatagcaaaattgggccaaaatactctagtaaatcaagctatgaatactgtcaaaactttagatagtcaaaacttcagaccaatagtcagtatatcggctattgaagccacagaatctgccaacttgaatctagttgctgtatcccaaacaggagttcgattttacctgacagtagttagtctctccaatctgcaaccaaatcagagaccatatactctagctttagctcatgtacgtctaccaccaggatattctgctaatataacagtaagacctagagctgtccatgtgtcccattataacgataggaatttagtactgatttcaactgttaatgataaagatgtactttggtgcatgagctcagatatgtttccctttggtcagaccttgatggaggcttatagtgttgtaaatttggatggaccagcattagctatatcagaggtacggcatccgactcctttaccgttaccaccaaaccaagaagcgccacctctggttgtcagacaacacgcggaaccgcctaagaaatatgtggttctaacatctcacagtgttcagatttttattaaactcaggccagttgatattctcaatcagattcttagagatagccaaggcttagatactgaagcacttaagacattttttacgattcaaaaagaggatcaggcttgcgcaacttgtttgattctggcttctttagaaagtgatgagaacgttgaggttgcagaatatgccacaagggctttctttttgtatggtggagaacctaaactggtgccagctaatatatatgcgggacccagcgtatttgctcctcaaataatatcaacacccgctccacacaattaccagacgcagcaatatcaaaccgctcaacactttcaacctaatatgtcacaaacagcgccaaatactacaggatatgaattcactggtccgtttgttttttcggcgaaacataatagtttatatttgtatttaagtaggatattgcgaccaatttggaacatgagaacggttgataagctttctgttgacggaaaggtttctacgacatacagtaccgtatccagtgacgactgcatatttattctaaataatctaactgctctccataatttcctagcacgaaatacacaactgtcaaccatgagcaagaaccaaaatcaattccagaacagtacacttaataatacatctttaaatatgacgagaatgaaccataccgtgcaagacgcccaaatggaagaaaaagcatcactgaattctttcaaaattcttgtttcgctttgttgtcaaatactgggtctctggcgaatcctgtgtgaacatcaatttcattcattggtggcgtctcttacggaaaacgaacagcaaattctcgtcaatacaacttttaaagacttgttcctttacagacacgacatttgttcgtcattgatatcagctctcgttcaaacctatcttggagacaacgcttctgtcgattctatcagcagcaaattgagagaagtttgtccacaaatgtataaaaccgaagatatggcatattcaaaggcaatcgaaatcctaaaatctgctcgaacaatacaaaatgtcggagaaaaagaagaattgctcaattcagcgctacaaatttgtaaatctatcggacctaatttgaacatcggtgatgtgtgtaaagaattttgtaatcttaaaggatacaaagccgtaactgaactatgttgtcattatgcctcaaaattagacccagaaaatattgcagagatatattacaatgcaccggatagcactggagaccaggaaggttataattactatcaaaacagaatggaaatttataggcatttattgaatatgttaaatgccatgtatcaagaacttaatgtaactccagtaccgtgtctcaactacgacctcgatttttcagtaactcaatcaattttgacagatacaccagaacagtcacaaattggatatatgatgaagcaagtgatcactgatattttgcaaactcccgatcaaataatgcatataaacctatacgattggctaatatctaaaaatatgactggagatttactaacaattaataatgattccttggagacgtatcttaaaagaacagcagctcaaaatccaaatgatactgttgctttggaccttctatggaaattctatgaacaccgcaatgatcatgccgctgcagctaaaattcttaatagcctggcatcaagaactggtgttaacattcctttaaaagaaagattggcgtacttagcccggtctataatgtgtatgagaagcgacaaaataggatatgcgccatatttaggtgtcttccttagagatttggaggataaattagaagtagccaaggtacaagaacaaattttagaagcagttatgaaccaacaaaatcaaatcgaaaattatggagatattgtcacagctctgaattcgggactatttgaaatatcacagctatatgaaaatttcgctgagccgttcaaacttctcgaatgtcaactggccattattgattgtgccggatatactgatccagcgttaatagaaactatatggcaacagatattgaccgacgagctaaagaagactaccggaactggaacagacaaagtatgtcaattattaaacaaagtcaaacatttagccaaatattatgctaaatcaatgaactgttttcctttagattatattatctatgaattagaaatagtgaatgcaaagttaagaggcgatagacaactagtacctacagctctcgagagtatgaatattccatttgacagtctcatcgctgtttataataatttgaataccatatcgggaaacgaccatttctggcagttggaagaaaatgaatttcatctttgtgaagctacagctactctaattagctgttttatcagcaaccaagattcgtacagcagtatagaaaagagaaaatacatatcattatctcaggacaccgttgttgcactgctgtctaatttatacagcaaacctaatacagaagcgatagttaataagttacgaaatattcaggccaggttagccagaatttaa

SEQ ID NO: 210 - DNA, 4266 bp, Diabrotica virgifera
ttctgtctacacaaccgtaaaatatacaaattttttattaagaacaaaatgaccgaatttactttaagctatcgtgaagttataccggatcaaacagtttttgaaaattggaaagaaatctcccttaccacaggtgggacacaaagtactctccaagatataaaagtagctgaacgagccaacggattttcctatgaagattcaacaaagcatcatacaagaaacagatttatctactggagaatcaactatgatgtcttggaattggtagaacatagcctggatatcaatttaacagcaaatagagttagatacaagtttacagatactcctattctagatggagtttccattcacgaaacttatgaaaacattattgtgcttgtcccaactgtttgtagtatacaccgtttaatatttccacaccctgataggtttcatagacaggatgatttactaggagtgcatccagatttggctgctccctcaatattttcaaaagcttcacctgtggatgccagaaatccaaatactttttatgtttttaataacccaaccactgccactgaccaactgcccaatttagccagttcttacttgttacctgaaacggaggaagcattttttatattagcttatccatcaacagaattactattgataaaacaaaatcctgacaatggccaagttgtatgtacagagctgaaaggagaatctttgatgcctagatttttgtctggacttgcggaaaagtttagaccaagaaattctgacggtgataccatagtgagtctcttgttttatattgttgattatgaaacttacgttttgacactgacaagagatgcccatctcaagttttggtcctgcactaaaggacaatgtgtcgcagttatagatgtcagagaaaagacaggagatggttcaaaggatcgagtacagggagccatattaaggaaagcagtagatggcaatagtactgaaagtatcttggcggtgtttttaaattactccagtgttggtcaatttcatatcttaaatccaataataaatggccaggaaataacaattgacagattggttactttatactctcctgagaatgatcttatcgattttgccttacaaaccaatcgcctatggtctgtatggcgatgcgaagatggcgacagcgtagtctacactgccacactgccagtatcccgttgtgcttcctacaaatcaagcaattggtcacctattattttggaaacattgcccgatgccaaccaagcacctgccaatgatggagacagtgatcctagacaagtgtatttgcaacacattttccgtcccggcagatttcctttgcacataataagcaaagctctttccatttacaagaggtctactatattatctgatgcccaaatatcagcctcagctttaaaacagagaatttgtctagctgtggataatgaaatacaaaatacggtaaacggatctaatgtgaatgatgatgaatatttagaatgtgcagaatggtgttggcaaaaattctactcttgctgcgtacagtatcatatcgctagcttaaaacctctaggtctgatgttattaccttctgtctctggagcagtatttttgaaaaagtcgacgttttcattcctccgacctttggatccactggaacacatgactctctgctatgaagatgtttacagagaccaatttgtcaatttttctatgttagctgaagatctagacacaacggatgatgtaatgaacttgtttaaagtcatcgtatatttagaacaacaaatgagtgaaacattcgtccaggcattcgagaaagaaatttttaatctacatgcacctgatgttataatggaaggtttattagagaagattcagtctgagatggattgtcagttcgcctcgcacatattggaaatgatgaacgatgttactgacttatacaaaggaatgcacaaaattttagaactcttaagatatgaaaatacattagccagcccggataacgacataaatcctggagctatgtatcattttagttccttgctgggtacttcagtagtcgctgaaagtttgagacaacaagcacagataagattccaaatatgtagaaatttacttctgatctgcaacattttgttgaacgaaaaaacgttggattggggcgtattagaagccatacgttcagtttgtactccggagattgttgttctcacacaggctagttatgtagttctatggctgtgtggattaactactattgttaacttacctttcagtgctcgcgaatcttcgataaatagattggcgccactcaaattagctcctgttttgaatttgaggcctcttactacatgtacgtcgttattggagcttttcatatcctctaccggtggccaggaagccagaaaatcttttgccagagtaaattgcagcgatgaggctttggcccattggcatatctcacttctaccttatttgaatcacgtgagacatataatttggcccataactggaggtacagttcttgccgagtggttgttaagcagtggacaacatttatggttgcaacaatacgttcgtttacttagcaactggtgtgaatggaatagttgtacaagaaacttcttgctagcttccgcctttttgtcaactggagaatataacaaagcagaagatttgtttgaaacggctgctaaaggggttttaacagatggctttttacaagaacgttgtttaaaagggaatttgcctagtccaactggagcgtatattcactattatttaaaggttattcaactatttgatcttcacaaggccaaagattccgttataagcattgcaaatactgctttgagcattgtagacccagaagatcctttagcggctactttatattccatcaagttcaaacaccacttggcattaaaacactacgaattcgccttcgattcattgaatgcgaatccagatgcggaacggaaaaaagacaatctgagagatttggttaaaacactattggatgaaaagaaattggatactttattgaacttcacgtacggtagtatggatgagttctttacaaatatactgttgaccagagctagagcaaacgatgcagttaacaacattttctacgacttcttgtattcttatcaaattaaaagaggacccctgtcacacagactagctgcatcagtaatgtatgagcaggctttcagattaaatcatattaacagcgttgaagcactggaaaaacaagtgaaatgttacttggcagccaaaaacgttctacatctgtgtcaaccagaacacgcttgggtagtgagaccagctgatccagatgacgaagatgaagtaataactattcagcctttagcaggatcaaacgaagaaatgaaagtatttagattgagaaaacaacttgaagtggtaaatattgaaactgttgagaaagaacttattttcgcaagtgcaaagttaaaattggcaagatttagctcgagcctatcaccggttaatataacaactcctgtggaattggtaacattattaaatactgccggtttattcaaaactgccttagatatttgcacgacgtttgaattgtcatatgcaagcattttcgaagtactaacaaagaactgtgtctcattgacggaagaagaaaatcccagtgcttggaactggctggtagaaaacgatttgcaagatcttccagttaatagggatagtgcagctgatgtagtttggcagttcctacaggattgcttggaaaaatatgaaaaaccttgcatgactacgctacattatgtggtttgcaaaaagattataggtatgagagtatattttccccattggcttgtagcttcttacaaggttcgaaatcctgccgagtttttaagattattacatggttccggaagattagaagaagcaattgaatttaccagcgagtatatactatctgcaatgggttatggtaaagaatttttcggttttacacaacctctagctccaacgtcacctgctttttgtttacctgtctacgccatccaaaggttaattgacgaattaaaaatacagaattccatgagtctggagcaaccttatctgaaggaatatgaaaatttgaaaacattgtttaccaaatatttagaaactgccaccagagtatcgaaccagatgtgtcaaacaaaattaacatcaggatcccttagaacgaatgttttttcaatagatgctagataa

SEQ ID NO: 211 - DNA, 2907 bp, Diabrotica virgifera
atggagatgtccgatgaaaatattcaagttttaagtaaatatctacaggagacacttaatccagatccaaatgttcgcagaccggctgaaaaatttttggaaggtgtagaagttaatcaaaactatcctttactaatattaaatcttgtccataaaccagaagtggacatgacaattagaattgctggagcagtggcatttaaaaattatataaaaagaaattggtttgttgaagaagatggagttgataggattcatgaatctgatcgagctgcaataaagaatttgatagtcactttaatgttaagttcacctgaatcaattcaaaagcagttaagtgatgccattagcattattggaaagactgattttcctctaaagtggccagaattaatctcacaaatggttgaaaagttttctacaggagatttcaatgttataaatggagttctaagaacaggtcattccctttttaaaaaatatcgctatgaatttaaatcacaagagttgtggatagagattaagtatgtactagaaaaattggcacagcctctaactgacttatttgtggctaccataaatttggcacaaacccatagcaacgacgtgaatgcattaaaagttatatacagttcattggtgttaatttgtaaagtattttattccttaaattttcaagatcttccagaattttttgaagataacattcagatttggatgtcaaatttccatacgttattaacggcagatgtcaaatgtcttcaaaatactgatagcgaagaggctggtattatggaacaattgagatcccaagtatgcgacaatatagctctgtatgcacaaaaatatgatgaggaatttcagcagttcttgccacaatttgttactgacgtttggagtcttttagtatcaactggccttgaacctaaatatgatctgttagtttcaaatgctctccagttcttgtcatcggttgcagaaagagttcagtatagacatttatttgaagataacaatgttttgagcagcatctgcgaaaaagtcattatacccaatatggaatttagagtttcagatgaggagttatttgaagataatcctgaagaatatacacgtagagacattgaaggttctgatattgatactaggcgaagagctgcttgtgatctcgtaaatactctcagccagaactttgaacaaagaattatagacatatttggtcaatatttacaagtgatgcttggaaaatatgtggaaaatgccaagcagtattggagaagcaaagatgctgcattatatcttgtaacctcattagttagtagaggtgctactcaaagacatggagttacacaaactagtcagctggtcgatataaatcagttttgccaacagcacatattgtcagaattagagaggcctgatgttaatgatttgcccgttttgaaagcagatgccataaaatacatcatgacatttagatcagtgctgccaagtgccattgtaatttctacgattccacaattaataaggcacatgactagtgaaagtgcggtggtacacacttatgccgcttgtacattagaaaaaattttaattataaaggccaataatcagccaatagtcactggtgcccacctggaaccatttactacaacacttctaacaaatctttttggaatactagaaaaacctgtttcagaagaaaacgagtatgttatgaaagcactgatgagaacattttctacgttacaagaaagagttctaccattcttgaatgtcgcattgccaaaattaacagagaagctacaaatggttgcaaaaaatccatcaaaacctcattttaaccattatctttttgaaacattttcattagccataagaatcgtatgtaaggcaaatcccactgctgttacagcatttgaagatatattgtttcccattttccaaggaattctacagcaggatattcaagaatttattccttatgtatttcaaattctttctctattgatggagagtacacctcaaggtaataatctggagccctacatgcagcttttaccattcttattggctcctgtgctatgggatagacctgctaatattagtccactagtaagattattatgcgctttcgctctacaagcagccccacaaattgtagcgcaggataaagtgagcggattcctaggagtattccagaaattgattgcttcaaaaactcatgatcatgagggtttctttttgattcaaagtatgattcagcatttaccaatggaagccctagcaccttatcacaaacggatattttcccttttgtttctaagactctcttccagtaagaccacaaaatatgtaattaatctcatagttttcttttcgctgtacgttgtgaaatattcagcaaatgaactgatctcgactgttgacgatattcaagcagaaatgtttggtaaggtgcttgaaaaactatatattgctgaaatacaaaaagtttctgtagccgtcgatagaaaaattgtagcttgcggtgtaacaaaattattatgtgaaagtccagagatattttcaggaaagtatcaaaactattggccccagctattgcaggcgttattaaaattctttgaaatgccagtggactcaagcatgctacccgatgatcatttcatagaagtagatgatactcccacatatcagacaactagtgcaaaactgaattttgcaaatactgtcaagagcgatcctctccaagctattgccgaaccccgccagtttctggttcaaagcttagcaactcttggaaattctcaacctggacggcttccagtatatattagcaacatggatgtacaagttcagacaatactaaatagttacctatctaagtttgctgttcagctggtctaa

SEQ ID NO: 212 - DNA, 609 bp, Diabrotica virgifera
atggctaaggtccaattgtgtaacataaccgtgatggacaatcctagtcctttcttgaacccatttcagttcgaaataacttttgaatgtatagaagaacttagagaagatttggaatggaaaatgatatatgtaggctcagctgaaagtgaagactatgatcaaactttagactcagtttttgtaggacctatacctgaaggcaaacatatgttcgtctttcaagcggatcctccaaatgtctcacgtattccagaaaatgatgctcttggtgttacagttgtactattaacgtgttcttatagaagtcaggagttcattcgtgtaggatattttattaataatgaatatactgatccagaacttaaagaaaatttacctagtcctccacaatttgataaggtaacccgaaatattctagcatccgaaccaagagttacccgctttaaaatcaactgggaagaaaccaaccccacagaaaataacacaaactctgaccaaagtggagcatcagcacccacgacatcagaagctggaccctctgctcctgtcgaagtacctgcttttaatgaaaattccaattcgtgggctaccatggaatgttcataa

SEQ ID NO: 213 - DNA, 951 bp, Diabrotica virgifera
atggatcaaatgctccctagtccgggatttagtatcccaagtataggaacacctcttcatcaacctgaggaggatcaacttatcttaccaaatgcccttcaacagcaacagcagcagcaacaacagcagattgcgaccagcaattcccaagtacctcctttggcaccaatgggcggattgacacctacacttggacttggcatgggccatgccatgtctgtaccacaaaccaaatatgtaactggtttcgcattgcccatgagttctatgaatgcacaaactccccaacacacaatgagccctatggtgaatttagggggttcaataactacaggagctggagtgactccaacgatggcaccttcaactccttcacctatgacgccaatgactcctcattctgctgaccctggcatcattccacagttacaaaatatagtgtccacagtaaatttaagttgcagattagacttaaagaaaatcgctctccacgccagaaacgccgagtacaacccaaaacgtttcgcagccgtcatcatgaggatacgtgaaccacgtactacagccctaatcttctcttcgggaaaaatggtgtgcacgggagccaaaagtgaagaagactcgaggttagcagcaagaaagtacgccaggataatccaaaaactcggattcccagcgaagttcctggatttcaaaattcagaatatggtgggcagttgtgacgttaaattccctataagactcgaagggcttgtgctaacccacagctctttcagcagttacgaaccagagttgttccctggactcatttaccgtatggtaaaacctagaatcgtacttttgatcttcgtgtctggcaaagtggtgttgacaggtgcgaaagtgagacaggaaatatacgaagccttcgataatatttatcctattttaaaaagttttaagaaacaatga

SEQ ID NO: 214 - DNA, 477 bp, Diabrotica virgifera
atggctgccatcagatctatgtctcgccttcttattaatagatcacttcaaaccactgcaaagaggacctatgccgaccaaatgaacttcacatttgcagctggaaatcaggtttactatactgcaacttcagttaaacaagtagatgtgccatctttctctggtagctttggtatcctccccgcccatgtacccacactggctgtgctaaaacctggagtagtcactgtttacgaagatggtggtaatgttaagaaaatctttgtttccagtggtactgtcaccatcaatgatgattcatcagttcagattcttgctgaagaagcccacccagtagaaaacattgatgtcaatgcagcaagagacatccttaccaaagcccagagccagttatcatctgcaagtacagatgaggcgaaagctgaagcctccattgccgttgaagtgggagaagcgttagtcaaagcggctgaataa

SEQ ID NO: 215 - DNA, 987 bp, Diabrotica virgifera
atgagtggtgacggtagtgacactgaacaatttgatactttatttctatctgtagctcaatatcatccacagggaccaacacagctcctggatacatttgtgagttttttgagtagaaaaacagactttttcattggcgccaaggaaggagaatgggaaaagttagtgatggacacattcagaaaatatgaaaagtcgagcagggcaaaacacgaggaagaactaaaagaaaagcgagaacaagaagctcgaaaaaaagcagctgctgccaaaaaggcagaagcagaaactgtcaagcctgctcaaatcaccgaattgactgatgaagaagctgaaaggcttcaggctgagattaatgctaagaaaaacacttctgataaagctgaaagttcttcaaatggtccagaagctgcaaccacagctaaaaaagtaggagaagacgaggatgaatctgaaaaaggcaagatactgcccaactcgggaaatggatgtgatctagagaagtacaagtggacgcaaaccttaggagatattgagttaaaaattcccctcaaagtaaacttcagggtaaaacagaaagatctcgtagtaaatatgacgaagaaacacttgacgtgtggtatcaaaggtcaaccacctatcatagacgacgattttccacacgagatcaaattggaagagtcttcttgggtgatcgaagatggaaaagacctgttatttacttttgaaaagataaataaaatgaattggtggagccaaatagtcaaatccgatccagaaatcagcacaaagaagatcaatcccgaaccatccaaacttagcgatctcgacggagagacccgtggaatggtggagaagatgatgtacgaccagcgccaaaaagaaatgggcctacctacgagcgacgaacaaaagaaacaagacgttattaacaagttcatgcaacaacaccccgagatggatttctcgcaatgcaaatttaactag

SEQ ID NO: 216 - DNA, 480 bp, Diabrotica virgifera
atgcaatcttcgagtggtatggtacatggttatccgggaggccctggattgcaatggagccccgataaaaagcatagcgaccgagaaaggtggatatgtatttaccctgcttacatcaacaacaaaaaaacattggcacagggcagaaaaatagccaaagaaagatgcgttgaaaatcccactcaccaggaaattcgtgatgttctggtcgcggctggtttgaaagtgggtgtcgaaaacaaattgtacagcagagagagaagtaaagaaatgttatatcgtggtagaataaggatacagttaaagaacgacgatggaagtttgtgtaatgacagtttccctaccagagacagcattatgtaccatttaggagacatgattcccaaactgaaaagcaggcaaaataaaagctcgaccgaggctcctcagcaagcatctactggttctaaaggcaagggaaaaggaaaaggacgaagataa

SEQ ID NO: 217 - DNA, 2259 bp, Diabrotica virgifera
atggatacaaaacatcataaaatgcccaaagtggcaaaggtgaaaaacaaagctccagctgaaattcaaatcactgctgaacagcttctaagagaagccaaagagcgagacttagaaattcttcctcctccaccaaaacagaaaatctctgatccagcagaactagcggactatcaattacgaaggaggaaacaattcgaagataatataagaaaaaaccgaactgtgatatctaactggattaaatatgcccagtgggaagaatcccaaaaagaaatacagagagctcggtcaatatgggagagggcacttgatgttgaccataggaatattaccatttggttgaaatataccgaaatggaaatgagaagtagacaggttaatcatgctagaaatctatgggacagagccacagttcttttgccacgagttaatcagttttggtacaaatatacttatatggaagaaatgttagaaaatgtaccaggtgccagagcagtttttgaacgatggatggactggcaacctgacgaacaagcctggcaaacctatattaactttgaactccgctataaagagattgatagagccagacaaatatatgaaagatttgtcataacacatcccgaagtaaaacactggataaaatacgcccgttttgaggaaaaccatggcttcatacactcatctagacagatatacgagagagcagtacaattctatggtgacgatcatttagatgagaaactgtacattgcatttgcgaagtttgaggaaaaccaaaaggagcatgatagggcgagagttatttacaagtatgctctcgatcacatacctaaagatgaaactaaggaactctacaaggcgtatacaatacacgagaagaaatatggcgacagaagtggtatcgaagaagttattatgtcaaaacgaaaacttcaatatgagcaagaaatactgcaaaatccaaccaactatgacgcatggtttgattatcttcgactagtggaaggagaaaatgatctcgatattacacgagaaacctatgaaagagctattgctaatattcctccaacaaaaaacaaacagttttggagaagatatatttatttatggattaattatgcgatatttgaagaacttgaggctaaagattatgaaagaactcgtcaggtttataaggcttgtttagaaatactacctcacaagatatttactttttccaaaatatggttgctgtttgcacaatttgaaattcgtcagaagaacttaactgcagcaagaaaaatccttggaatgtcaattggtatgtgtcctcgagataagctttttagaggatacattgatctagagattcaactaagagaatttgacagatgcagaaaattgtacgaaaaatttcttgagttcggtccggacaattgcataacctggatgaagtttgccgaactggaaacactattgggggatatagaaagagctagaggtatattcgaattagccattaaccaagccagacttgacatgccagaattattgtggaaagcttacatcgactttgaaatatcacaagatgaaccagataacgcaaggcagatctacgaaagacttctggaaaggacctcccacgttaaggtttggctatcatatgctaaattcgaactcaacaatccaacagaagacgaattaaatgttcgtttagctagaagaatctttgaaagggctaatgaaaatctgaagagctttccagagaaagaagcaagagtgctactattggaaaattggagggagtttgaaaataaccatggagacgaatcgagcaaagaaaaagttaatgccaaagtaccaagaaggatcaaaaagagacagaaagttgttgatgaagatggtattgaacaagggtgggaagaagtatttgattatatattccctgaagatgaagctagtagacccaacttgaaacttcttgcagctgccaagaactggaagaaaaaagcagaagatggagatgaagcagaaagtactaataatgttgttaaaagtagcagtgatagaataagagaaaagttgctagcatctgctaaaaattggaagaaaaagcaagatggaattaaggaaaccagtgcagaagaaaacactggtgaagatatgcaagaagataatatccaaaacctggaacaagaaactgaatctaaggacttagataatgaaaatcaagattccagtaacgaaaatgatagcaatgatgattcttcttaa

SEQ ID NO: 218 - DNA, 1431 bp, Diabrotica virgifera
atggggattaaatttttggaagttataaagcctttctgcagcatactgcctgaaatagccaagccagaaagaaaaatccaattcagggagaaagtactatggactgcaatcactcttttcatctttttagtatgttgtcagattccattattcggtataatgagttcagattctgcagatcctttctactggattcgtgttattcttgcatcaaacagaggtacccttatggaacttggtatttccccaattgtaacttcaggtctgattatgcagctgttggccggtgccaaaattatcgaggttggtgacactccaaaagacagagccttattcaatggtgcccaaaaattgtttggtatggttattactgtcggtcaagccatcgtgtatgtaatgacaggcatgtatggtgatccggctgaaattggagctggagtgtgccttctcatcatcatccaactgttcgtcgccggtcttattgttttgcttcttgatgaacttctccagaaaggatatggtttaggttctggtatttccctcttcattgccacaaacatttgtgaaactattatttggaaagccttctcaccagcaacagtaaacactggaagaggaacagaatttgaaggagctgtcattgccttattccacttgttgaccaccagacaagacaaaatcagaggattacgtgaagctttctacaggcaaaatcttcccaatttgatgaacttgttggcgacagtactcgtttttgctatagtaatatacttccaaggattcagagtagatctacccatcaagagtgcaagataccgtggacaatattccagctatccaatcaaattgttctacacttcgaacatccctattattctacaatctgctcttgtatctaacttgtatgtcatctcacagatgttggctgttaaattccaagggaacttcttaattaatctattaggagtctgggctgacgttggaggcggtggcccagctaggtcttaccccattggaggattatgttactacttatctccacctgaaagtgtaagtcacattctagaagatccaatccacgcaatgctctacatcgtcttcatgttgggctcttgtgctttcttttccaaaacatggatagaagtatctggaagctcagccaaagatgtcgctaaacaattgaaagaacaacagatggtaatgagaggacacagagataactccatgattcacgaattgaacaggtacattcccaccgccgcagcttttggaggtctctgtattggagccttgtcagtactcgctgatttcatgggagccattggttcaggtactggtatcttgttagctgtcaccatcatctaccaatacttcgaaatcttcgtcaaagaacaaagcgagatgggtggaatgggagcgttactcttctag

SEQ ID NO: 219 - DNA, 483 bp, Diabrotica virgifera
atgtcgatggtaacctcaccttccgtagaacttagttcttacagagaccaacatttcaagggtactagagccgaacaggacggattattaagactatcaaccacattatacgttggaaatctatctttttatacaactgaagaacagatctatgagctcttttcaaaatgtggagacataagaagagttgtaatgggtttggataaatataagaagacaccctgtgggttttgttttgtagaatactataacagagctgatgcagaaaactgtttaaggtatataaatggtactcgtttagatgataggattgtaagaacggattgggatgcaggatttatagaaggtagacaatatggtagaggaaaaacaggaggacaggtacgtgatgaatataggactgattatgattctggaagaggaggttatggtaaaataatccagcaaaagattggaattgagaccccagcttttttgagataa

SEQ ID NO: 220 - DNA, 924 bp, Diabrotica virgifera
atggctgcaacaataggacgaatttgtggagctggtcttttaaaaccaacaaacttatcctctgtgggccagttaagttcgtattccacaacaaaagaatggacccgtggaagaaaagcacttttgggaagcttagggcttattgctggtggtactggtgccttgctgtttgctttggaccaatcagttaaagcatctgatcttgaattgcatcctccaaagaatgtttggagtcattctggaactttcaattccttggatcatgctagtgtaagaagaggttatgaagtatacaaacaagtgtgtgctgcctgccactcaatgcgcttcattgcttaccgtaacttaattggagtttcccacactgaagcagaagccaaagctgaagctgaagaacaaatgattgaagatggtcccgatgacacgggtaactttttcaaaagaccaggaaagttatctgactacttccccagtccataccccaatgaagaagcagctcgtgctgccaacaatggttcctaccctccagatttgagctatattgtatctgccagacatggaggcgaagattacatatttgcccttttgacgggttactgcgacgcgccagcgggcgtggtcctcagagacggacaatacttcaacccctatttccccggtggtgccatttcgatggcacaagccctatataatgaaaccatagaatacagtgacggaacaccagcaactgccagtcaactcgccaaagacgtcgctgtgttcctaaaatggacgtcagagccagagcatgatgacagaaagaaaatgttaatcaaagtgatcggcatcttttctcttcttattggtatcacttactatgctaagaaactcaaattctcttcactgaaatcgagaaagattgaatttaggcccaagagtaaataa

SEQ ID NO: 221 - DNA, 1722 bp, Diabrotica virgifera
atgttagctctgcaacagtattcgggcagtagtgatgaagatgatacagacaataacaaaaataaagacacctcagtagatataactgaaatccccattaattccgaattttccactaaaaataagcttgccatttgtgccgctccaaatgtactgcctacaggtttagatggagaaaaaaatcatatacatcctgatagtggagaactgacatataatccaaagtatgatatactatttgctcctgtagtagggcctgcaaatccttttaaaacacaacaacaatctgttgagagaaacatactctcgggacatattgaaaaggctcatgtaagtgattttcaattcgaaaaccagagaagaacgtttacgagctatggttacgcattagacccatcgataagtaatgatggagatggacatctaaaagttgtcggttcaactgaagagggtaaaaacgtagaaagtgttaagactgtatttgaaacttcaaagataagacccttggataagaggaaaaggaaaagaaatgataatccgggtgatatagaaggatttttgggaccatggggtggttttgttgatgaacaaaaagtttctagaccaacggaggaagaacaggctgagttagatgaaataacttctaaaaagaataagaaaggtaaaccaacagaggacaaaccaattgaggaaaagtctgtattgcatatcaaagatccagtggactatcaaggaaggtcttttttgcatgctccacaagatgttggggttaatctcaaatctgatacacctccagagaaatgttttttacccaagtcccatattcatacatggactggtcactccaaaggtgttgcagccatcaggtggtttcccagaacggcacatttgttcctgtctgctagtatggattgtaggattaagatctgggaagtttataatgagagaagatgcattagaacttactatgggcatagacaagctgtgagagacatcaactttaacaattctggaaagctttttctctcagctggatatgacaggtatattaaactttgggacacagaaactggacaagtcgtatcaagattcactagtcgaaaaattccatattgtgttaaatttaacccagataaaaataagcaacatttatttgttgctggtacatccgacaagaaaattatctgctgggatactaggtctggtgacatcgttcaggaatatgatagacatttgggagctgtcaacagcattacttttgtagacgaaaaccgaaggtttgttactacctcagatgataagtctttaagggtatgggaatgggatatacctgtcgacatgaaatacattgcagatcctacaatgcacagcatgccagcggtcacaccagcacctaatgggaagtggttagcgtgtcaaagcatggacaataagatcgtgatcttttccgccatgaatcgtttcaaaatcaaccgaaagaagacattcaccggtcacatggtggcaggttacgcatgctcgttagattattctccagacatgagctatttggtgtccggtgacgctgatggaaaggtctacgtctgggattggaaaacgacaaaattgtacaaaaaatggaaagcccacgataacgtttgtatcagcgtattatggcatccacacgaagcgagtaagatgatatcggcaggatgggatggcgttattaaattttgggattaa

SEQ ID NO: 222 - DNA, 807 bp, Diabrotica virgifera
atggtccaaaagaaacctaagaagaaggtaggaaagaaagtagctgcagctcctcttgcagtcaagaaaattgaacagaaaaaagaaattaacccactttttgaaaagaggcctagaaattttggaattggtcaggatattcaacctccccgtgatttatctcgatttgtaaaatggccaaaatacatccgtattcaaagacaaaaggctgtacttcaaaagagattgaaagttccaccaccaattaaccaattctctcaaaccattgacaaacaaacagccacccaattatttaaagtcttggaaaaatacaggcccgagacagcccttcaaaagaaaaataggttaaaggctaaggctgaagctaaggttgccaagaaagaggaggcacctgctaaaaaaccaaacacattgaaggctggtaccaatacagttactaagctgatcgaacagaaaaaagcccaattggttgttattgcacacgatgttgacccaattgagttggttctgttcctaccagccctctgcagaaaaatgggtgtcccatactgcatagttaaaggtaaagcaagacttggacttctagtaaggcgcaagacttgttcatctgtagctcttacacaagttgactctggagacaggtccaacttcaacaaacttttggaagtaatcaaaactaacttcaacgaccgtgttgatgaaatcaggaggcactggggtggtggtttgcttggatccaaatctgctgctcgtattgctaagttagagagagccaaggctaaagaattggctcagaaacaaggttaa

SEQ ID NO: 223 - DNA, 1002 bp, Diabrotica virgifera
atggcaactttaacaaaagatgtaacactccaggaaaacattccaacacatatacttcttgacaagcacatagattttattaaagaatatggacaaaaagaaagtacatatgaatatggtatgaccgattatttgagaatatctggcatgtattggggacttacggctctagaacttatgaacgccactccagctcaaagtatagaagagatcacagaattcataaagaattgtcaggatccagaaagtggtggaattagtgcctgcctataccacgatccccatattttacatacacttagtgctgttcaaattctctgcatctacaataaattagaggcaataaacgtagagggtgttgttaaatatatcgcaagccttcagttacccgatggtagttttacaggagataaatggggtgaagttgatactaggttctcattttgtgcagttatgacattatcgttgcttaataaaatggatgcaattgatgtaaataaagccgtggactttgttttacaatgtaaaaactttgatgggggtttcggatctaggccactttctgaaagtcatgcagggttaatgtattgctgtgttggctttttatctatcacaaataggttagatgccattgatagagacacccttgcttggtggttatgtgaaagacaactaccatctggaggtttaaatggtagaccagaaaaattacctgatgtatgttactcatggtgggtgttatcatcattaaccatgttgggcaggcttcattggattgatgcgaatgctttaaaaaactttattttggcttgtcaagacacagagactggaggatttgcagataggcccggtgatatcgcagatccttttcataccatatttggtttagcagcattgtcccttttgggacatgattctgtaaagaaggttaatcctacttactgtatgccacaagaagtcattgatagattacagttaaaacctcagaggttagagcaataa

SEQ ID NO: 224 - DNA, 2664 bp, Diabrotica virgifera
atgcatcaggaggccatacaactcatccaggtcctagaaaaaacagtttcaccggataaaaatgaattggaacaagcgtcatcgtttctcgaacaagctgcagtgactaacctactagaatttatcaaaactctatcagatatattaagacatggcggaaatagccctgtggcccgaatggccgcaggtttgcagttaaaaaatcaactcacctctaaagactccaacataaagaccacctaccaacaacggtggttagcttttccagaggacgtccgggggtatattaaaaataacgttgtgtgcgcacttggaaccgaaaccagcagaccatcatccgcagctcagtgcgtagcatacgtcgcagtaacagaactaccacaagggcaatggccagatctcatagcaacgttggtcaacaatgtttgccatgcaaattccacagaaatgcaaaaggaagccacattagaagctatcggttatatatgccaagaaatcgactcggacgtattagtatctcaatcaaacgacatcttaacagccatagttcatggaatgcgagcctcggaaccgagcaaccacgttcgtttagcagctacacaggccctactaaactctctagaattcacaaaggccaactttgaccaaccgacggaacggaactatatcatggaagtcgtctgtgaagccacgcagtctccagattcacagatcagagtggccgctttgcagtgtctagttaagattatgtctttgtattatcaacacatggaaccttatatggctcctgctctattccctatcactctagaagccatgaagtcggaaaacgatgctgtttctctacagggtatcgaattctggtctaacgttagtgatgaagaggttgatttggccatcgaagataccgaagccactgaagcaggtcgaccacctacaagatgttcacggcactacgccaaaggtgccctacaatatatagtaccgattctgctgcaaaaattaacgaaacaggaagaactggacgacgaagacgattggaatccttgcaaagcagccggcgtttgcttaatgcttctcgccacgtgttgcgaagacgaaatcgttccacacgttctgcccttcatcaaagaaaatattaagtctgataattggcgattccgagatgcttctttgatggctttcggatctattttaggtggtttggagagtactactttgagaccgcttgttgaacaggcgatgccgaccttgatagatctgatgtacgacaatagcgttatcgtaagagacacagccgcctggaacttcggcagaatttgcgaaatcattccggaggcggccatcaacgaaaccttcctcaaaccgctattagaaagcttgatcacaggcctcaaggccgaacctcgtgttgccgccaatgtctgctgggcgttctctggattggtggaggcagcttacgaaaatgccgacgttaatgaagaaaccggtactccagatacttacgtcttgtcacaatacttcgagttcattatacaaagactgcttgaaacaacggatcgacccgatggcgcccaacacaatttacgacctgcagcctacgaagccctcatggaaatggtgaaaaactcacccaaagattgctatgtcaccgtgcaaaagactacaatggtcattttggacagattacatcaggtcttacagatggaaactcacataagcagccacaacgatagatcgcaattcaacgatctccagagccttttgtgcgccactcttcagtcagtactcagaaaagttaccccagaagacgcgcctcacatctcagacgccataatgaccgccatgttgaccatgttcaattccaattcatgtaagagtggaggtgttcaagaagacgctattatggccgtctcgacgctggtcgaagtcctgggagaaaacttcataaaatacatggacgccttcaaaccgttcctctacctcggattgaagaaccaccaagaataccaagtgtgcgttacggcagtgggcttaaccggcgacatcttcagagctctcaaactgaaagcgctaccatactgtgatgaaataatgaccttattactagaaaatctccgcgatcagtcagtccatcgtagtgtgaagcctgagatcttgggcgtgttcggagacatcggtctcagcatcggctccgagttcaagaagtacctcgaggtggttctgtccactttggctcaggcttcgcaggcgcaagtcgaccgcaacgacttcgacatgatcgattatcttaacgacctaagagagggagttttagaagcttataccggcatcatacaagggcttaagggtgacgggcccactccacatcctgacgttttgatacttgaaccccacattccatttatcgttcaatttattactgtcgtagcacaagatacggaacattctgatagtattatagctgccgcagctggtattgtaggtgatatgtgtaatgttttcggagctccaatggttcaattcttagatctggacccaattaatgaaatgttagcacaaggtagacgtagtcgagtaaataggactaagactttggccaattgggccgttaaagaattaaagaagctgaaggccgtaaacaccgcggctgctgctagctga

SEQ ID NO: 225 - DNA, 1503 bp, Diabrotica virgifera
atggaaacaattttggaacaacagcgtcgttaccatgaagaaaaagaacgtttaattgatgccatggtaaaagaaatgcttcacaaaaagacaactttcagagaagcaataaactcagaccaccgacaaaagtacctgctggatagatatatggcttcaacagaaagactaatagatctttatgatgatagagacggacagcgtaaggctgaagtagccgctcttacgggccccaacgagttccaagaattctacagtaggttaaaattaatcaaagacttttacagaaggcatccaaacgaaatcagtgttcctatgtcagtggaatttgatgagtttgccaaagccagggaaaatcctaacgaggatatggctaactttgtagaatttacagatgaggagggctacgggaagtatttggatttacatgaatgttacgaaaagtatataaacttaaaaggcatagaaaaggtagattacattacctatttgggtatgtttgaccaactatacgatattccgaaggagagaaaaagcggtgaatataaaaaatatttgttatgcctaattgaatatttgacttggtttgtgcagcgtataaagcctctaaaggacttagacattgatctacaagaacaagttgagcaggttctgctaaactgggataatggaagtgtaccgggatggccaaaagaaacagggtctgcactaacaaatgttggagcccacttggacctctctgcattttcaagttgggaagaattggcatcgttaggtttagacagactgaaatctgccttaatggcgttaggattgaaatgtggaggtactttggaagaaagagctcaaagattattctcaacaaaaggaaaaggttccttggatccttcacttatgacgaaaaataacaaaggcaaagccaacaaagaaaaggagttattgagacaaagagaacttgcaactttagaagcccaagtgtacagattagcagagtgggtctcaccgcagagagctgcgacaaaagaaaatgtgcaaagaaaacaagctcgtactgacggagaaagagacgacagcgaaaatgaagaaagcgaagatgatagtcctgatgaaggtgacgatgatgttccgtataatccaaagaatcttcctttgggatgggatggaaaacctataccgtactggctgtataaactacatggtttaaacatcagctataattgtgagatatgtggaaattacgtttataaaggcccaaaagcattccaaagacattttgcagaatggagacacgcccacggaatgagatgccttggtattcctaacactgcacattttgcaaatgttacacagattgaggatgctttggcactgtgggaaaagctgaaagtccaaaaacaaagtgagcgttggcaacctgaaacagaggaagagtatgaagattctcaaggcaatgtggtaaatagaaagacttacgaggatcttaagagacaagggttattatag

SEQ ID NO: 226 - DNA, 639 bp, Diabrotica virgifera
atgacgataggaaaaaataataagatggtacaacacataaacttcagagttcgggtaactctgcaagactcccgtaccttcattggaactttcaaagcgttcgacaagcacatgaatatgatattaggcgactgtgaagagtttcggaaaattaaatcaaaactgtccaaagttgaacgtgaggaaaaacgagtattaggatttgttttactgagaggagaaagcatagtttctttaacaatagaaggccctcccccaccagaagaaggtttacccagagtaccaatccctggagcagccccaggaccaggaattggtagagctggaggtagaggaatgccaccaggcatggcaggtgtacctgtaggccttcaaggacctgtaagaggagtgggaggaccatcccaacaggtcatgacaccaggaggtagaggccaagtatctgcacctccacagatgaatcaaggaccaccaaggatgggaggaccaccaccaggcatgatgggaccacctcccggtatgatgggcatggctccccaaatgggaatgggacgtggaggaccaccgccaatgggaatgagaggacccccacctggtatgatgagaggtggaccacctggacctccaagacctttttaa

SEQ ID NO: 227 - DNA, 1317 bp, Diabrotica virgifera
atggatttgaatcgcagaatttatgttcgtaaagctaatcaagccctattattatgtctgcttctctcgcaaattcgcaaaaacaaatcaaaaccaaatgaaccaaacaaccaaaccaaaccaaaacgtacaatgaggccaagaagatattgggtgcgtgaaatatataagcagagaaagtcacaaggggcttttaacaatttaattcgggaaatgaaggaacatgatattcaaaaatatttcaattatcttagaatgcatccttgcacatttcaaaaattatttagtctagttggaccagcattagcaaaaacatattgtgttcgtgaaccaatttcgccagaagaaagacttgctattactttaagataccttgctagtggagacagtatgatgtccatttcatatgcatttagggttgctcacaatacagtttccaaaattataaaggaagcatgcgatgcaatttgggattgtttaaaccaagaccagctgctaacaccaagtgaagaagcttggttaaatatcgctgaaggttttggagaaagatggcaactgcctcattgtgttggagcaattgatgggaagcatgtagtaatgcaggcaccttcaaaatcaggctctacattcttcaattataagggcagccacagtatagttttgttagccctctgtgatgcaagttatcgcttcacattggtggatattggagctgaaggaagacacagcgatgggggtatattcaaaaattccaatatgggaaaattaattaatacaaataatataaattttcctcaaccttcattgctgggtcaaggagatactcctttcaatttttatattgtaggtgatgaagcttttcctctaactacttcaataatgcgtccatatccaggtcactttcttcctcgagataagcgtattttcaattacagattaagcagaggacgtagagtcattgaaaatgcttttggtatattggcttctcggtggcgaatataccgtagaaccataatagcaagtgaatcaacagtagtggcaatagtgaaagctacagtttgtctacataattttatgatgaataatggagagaaattggggcatgaacacaaatatattgttgccagtactgttgatcatgaaaatgaagctggggaattggttcatggtgactggagaagtgaacatggcaacaatgtactacccataggtagaatgggtagtaatatgtatgcaaaaaatgcacaaacgatgaggcaaaatctcttgagatattttttaaatgagggtgctatccagtttcaagaaaacaaataa

SEQ ID NO: 228 - DNA, 11073 bp, Diabrotica virgifera
gaacctcagggattggatcaagagaagatggcgctgcaacagaaatccgccagggaagccgaacaagaaaggcaatggaagcagcttcaggctatgaggcagcagcagacgcagcagcaacagaatattatacacgaacaacgtgttcaggccatcgccagagtccagagatcaatatcggtggatccagctcagcagtttttgtcggaccaacaaagtcccttacaaccaagtacgcctcaggagcttagcccgtctgctacgccaacaccaagcccaagacagttcataggaatgaaatccccgaccttccctcttccttcaccagtgcctcagacagcaatcagacctcctacaccctcccattctccacatgatgtaagtcaggcaagcacctctgacggtaatgatcactttattcagtcaccttctactcctaaacctagttttcctaatagattacctacagatcaatttatccatcaacctgcaactcctaggccccagtttggaatacaacggccaactttacagaactttggtaatacgatgaggacagaccagcaagatattaatatcaaccgacagttgagagatctcctacagcgacaacaagtcaaaaagttggatgaaatgttaccaggtacttcggcagttgtggctacaacagcagataccactttcaggcaaccattgccgcccagtattgtacgacctagagtggctctttctttagctggtcgagcaggtcctggtactattagggttggccagttagacgcccgaatgcaaggcctggatcctagaatgagattgattttacaacagcaagttggccaacaacggttatctgcgggaattcaacaccagttcgtacggtttacctcgacgccagcccgccccacgaccttagatcaatatgaacaactactccacaggcccagtcctacccagatccgggcacctgatcagcaaaacgcacctcgaatgactttgaatcaagcgagcgtcattcaaagaccgcaacttgtgcaacctactccaactactcctgcaactagtgctgctgatagcaatcccagtgaagaaggtattcccgataatgttactgctgaactggagaagctggaacaagaaacaggtactatggtagagttacaaggtgtcagtgagatcctcggaggactgggagacgacgacgatgaactgttagctgaaatgggtgccgatttcaatattctagagtatgccgatcccgagctagaagctttaacaggcggcaagacaaatatattagatctggaactcgaagaagaaccagtgaagaaagagaaaatagtatccagtgcagaaaaccaaccgactaatcaatcagtaaacgtaatttcgagccctgtgaaacctaaacaagaaccagttgaaacgcctactccaaaaccagagcccgcttccctaccgccgccacctcctcctttggcgttgcctcaacagcagcaaccggcgcctgtccaacatacgccgcccgtcgctattcaacaaccaactcaacatccgccgcaagtacaacctacgatgcacttgacgccccaacagattcatcagcagatggtacaccaggttcaacaggcagcagctcaaggcagacccatgccaccggggtcaaagatgcaaactcctgatggatttattggtattgtaatgcctaataatagtgtgcaactacagatacctcaaaactatcaacagcgactattactgttacagcaacttcaaaatcaaaagcttcaaatgcgcgtaggcactaccactccacgagtagcggtggtggcacagagtcagctaccagtcggtttggcgaccggccccaggatggtggcggcaccaccgcctccaccacccccgccgtacccaggtccaccgccgccttatccaggaaacgcggcacagcatcaacaggaacaacccctcttgctggaggacctactcgaacaagagaaacgggaacaagagaagttgcagaaccaaccttctagtcaagaagtgtcttcatcaactggaaacgaaagtgaatcggcgttgctcagcgaccacgatttcgagagactaaaggcagacgtattcaataccggacctgtcaccagtttaccgtcaacaataactaatcaaggaactactagccatacaaaccaaccatggcaacagttacaaaatcggcagatccctgccccaccggcacaaccaactatggaggtgacaaccagggtacaaatgtttaatgccaatctaattgctgcaccaccattgcctccggaaaatattgtcacggaacaagacaaacagactcagatgatgtatgaacagtggttgaatcatcagaacaatgttctagcccaacagttgcgctactacgagactgaggtacagaaacttaggaagagcagaaagtcactgaatagcaaacagagacagttgaagaaatctggtaaccagctgaccgacacagatgcagccgaactccagagaatatcaggggaacaagctattttacagaaacatctagaatcgagcagaaaacagagtcgacaacacggcatgttaatacaggaatacagaaacaagcatcctgcaccgaagcagcgggtagagcagatccaatcgcctttgggaccaccgtcgtcttcacccttgcaacacccaagtacgtcgcagtcgcccatgctgtcgccatctttatcgcctctgacacagcataattctcctctgaacagtccgggaccgctgatttcgtcgtcgccaggatctgtatcggttcagaacattttgcagagcccgaacagtatgcccacgaacagcatgtcgcctttacaatcgtcctcgatgcaagcgtcacctatgcagcagagccccatgcagccgtctcccaggataggaacaccgcattctcaaagtgaagagagtcctggatcagcgcagtcaccatctcatgtgtgccttcccccaccaatgccaagaatgacaagtcctcaacacagacgagtagtaactagtccggttggtatgacgcagatgagattcgtaagcaatcaagtactgcaacagcgagtgcggatgcaatcgcccatacaaaactttcaacaaaaacctgctacaccatctccgttaaatagccctacatctcaaacaatgaatgtaagccaacaacttcagttacataaacttcaacagcaacaaagcatgctacaacaacaacagagtctggatggtaatcaaggtgaccccaatattatccactcacagcgaactacccaacttttacaacacagaaattttattagacagcaggttgctcagcaacaacagataggccagcctcagcctttaacgcctcaacaacaccaaataatgctccaacagcaaaagcaattagctcaacaacagcagcaacaaatagcgcagatgaacgcagctaggttacagcaacaaaataatcctcctcattcaccaatgcctccaaaaagtcctatgatcaatcaacaaattatgtcaccacattctatgcccccgtctcctatgcaaatgccaccgaaaagccccatggtgtcttttagttcttctaaccaaccaaatcctaactcccctgcggcaaggagccctgcttttcaccaaggattaagtcaaactcccaccagtcctatgactcaccagccaccgtctccaatgcctagaagtccaatggttaatcaaacacagtcgccacatagtatgagaagaccaccgagcgctaatagtagccctgctatgccagataggccactaagtgttgaaaatccttcaccgagaatgtcttattcaatcgaccatttaatgcaagatactttacacagtcagagtagccataattcaatgcagtttactgataatttcacgactgatatgaatgttcaaaatagtatcagagaaaacatgcaaagtggaggagggaatcccaataatccatgtaacccaatacctctaccacctgaatatcctagatttagatattttaaactaggtttgcgaggtggtacaccaatgtgggggtttggaagaggagcaaaacggatacctactcccccaaatgctccaactaaaccggaagaaaaaatggcaaaccaagacagtatgatgttacaaaagatgaaaaaggagcctcatttaagcaaagtttctatcctaaaaagaaaagttggagctggaagtggaaaaattggctctcttgttagtacagattacaatgatatggacgatagctcatccacacctcctataactcctccattagctactacaagtcgaggaggcataccaaaaacattacccaaaaagattttggagaatcaaagcagcaaggattccgttattgtcatgcacagcccagaggacaaacaacttgatatgatggattttgacgatgacaccaatactgttttatcagcggaagtgtctctaagttctgcagctcaaaatgacgaagatatgttggaaatggagacactatcacaacaagatttagccgaaggattatctagtcccttggaacctgatcaaatagcagatgaatatttactatttcctgggaatatggtagttgacatgtctgcaggagaacatttttccgaaaaagaggaggaagaagaaaccgtagatgaagaattcaacgatgaaaacatgcatattatgattcgcagtcctacaaccagtgactatgaatacataatgcaaagtaagggtaagaagtataacgtaggtgttcatgatgaaaatgatgagatgcccgaatctccagatcaggaagacttggctgtaccgtcacctgaagtttcggacttgttgacaaattacgatgaaaatgatgttttaatgggcgatcaaagtaacagcacacctgaagaatcaatttctaccaaagaagacttcgaagagttgattgatgaaggctcacgtaagaacagcataacgaagtcagaagtaacaactaaacagatcaatgaattccacaaatacgcagggatatttaattattccaaaggagttgttcaagcgacccagaatcagacagctttaaataaaattacgggcgtagctaacaaaaaagcacctgcaaaaatatcactcgtagcgggtcctattgtacataatctatcaactgggaaggtcaatcccgaaaaattgataatcactcaaaatccaaatattttaaatacctcacaagctgctaaagttacaagtattattcttactcataattctgcggtacgaagaaatgttcttaatgtaccaaagattgtaagtacggtatctccagctattactatagtaaatgctaccacatctcaaatggcttctatactaccgtccaaattcacggtacctgtgataagtgccagtgctgtgcgacaactttccaacgtaaaagtgatggataaaccatcttcatcatcactatctatttctacacgcgacaatgttttacctaaaaagatatttgaagatgattccgtctcacctgacagttctaattgcgaggacgataaatcaaaagattcattcgatgagaaagcaaaattggaatctccttcgcgagaaataaaacctttattaaaatcagacgcatcttcgtcgaatacaatcatctcaagaagtttagaatataaaacacatgaccagcaaaagaaagctgaacatcttcaggtcatgaatataattcagaaacagagagtacctagtccgctaatgccaaagtctgcttcgcctgtgattatacacaatactcccgaattgaagatgactgcgcaagtcattcaagagacacaaactcgtatgaagatgacagccactacagaaactttggatgcatatgacggttcagtagatgatacgaagtctgttgtgatatcgattccttctcctactccatctcaagaacaaatgttggacaatatcgcctaccaggctttggaaaataggagaagagaatttgattctatcgaagatgtattagatatgatagaaaatatcactgcagaaccacctgccattttagaagaaaatgtacctgtacaaaatactaaacgtaatacgaccactgaatcaaaagaaaaggatattgacaaaccaaaaccagaaatagcaaatataccagtaagtgtaagtactaaatcttctgcagtgccacaactttcaccattgtcgcaaccaacagatttaactatgaacatggcaaatgcttcccagcaactaagatcattgttgtcttcactgcaaactacttcgacgtcttccccaactaacgtagaatcagtagttaaaaacttcggccacaaaattagcagcagtgcttctcctacagccacccaacctattgttgcgtctagagttatacagcaggctggtagacagtcgccagtggtaacaactgtgaacactgtaatcgtaccgaatttaaaacaaaaagttacagttaccactgcgagcagttctagaaatagtccagtaaagactcaagttgtgactactcaacatgtaccatcttcggctatcattacatcaacaataaactatataccaaatagaacaattgctagtatgcaagttatggcagaacatctcaaattctcatctggtagtatgtctataacaactccttcagtttccactcagcaagcaattgctaaaactacaattcataatgaaagtaagaaaccttcattaacattaacggctatgctgcaaaatcagccggctgctaatatgattactaaatcttcagcggatacgattactgcagccagcttgctcggatcacctattagtttgcctaaagctggcttaacgtccttagtacaagcgcaacctactgttgtcgttcccgtcataactacttcaatgatagcattacagactcagccatctatagtttctactgtcaaaagtgcaccaatgaaaacaaatgcagatactataacggccgcaagtctcttaagttcaagctctgttaacatagcaaaaaccggtattacagctgctttattacaagctcaaccgaatccaactcttagctctttatctactgcaacacctctaacgcaaacctctaataatattataaccagctcgacccacagagttcctacttctaccacaaatcttttacacactcagctaaccaaagtagtgaggagtaaatcagttgatgacatcaaagagatcaaacaagaagatataaaatcggaatctatggataccggtgttgatgacaataaattttcacttatttcacctagtggctgtaaaatgtcaacaattcagaatccaatactaaataaagcagatgattcgcaaaatgttctgctgaaaaagctgctacaaaacactgcttgtgctagcacacagtcaccacctcctactacagcaagcactgttacaactatttgtcccgcacctaaacttcctattagagaaacatcttttgtttctagcccgaacgtagaaccaccagtatctcaaccgagtgttgctgctgttgtgcctactcagcctttgcaattggagattaaaaaatgtttgccacctagtagaagttctagtagagatgatttgttgtctccccaaactcccagatcctctactaatagtcaagattctagtttacaaactcctccgataataaagaaagaaatagtttctattccacaaccccagcctagtccaattcacacaccacaagaagtcaaaaaggaaattatggatgagtcgtcgcaacattctgaggtttctgattacagtcgaccagatgttcctataaaagaagaaacagaaatggctgatattgcaatagaaaagccagtgcttgataaggaagagttaaagaaacaaaagaggcggatgtatcaacagaaaaggcggcagaaccaaatacttaacaaagaattggctgggcaacctaagaaacgaccaagaaaaaattcgaaaatagaagaagactatgatacttatatagatggagtgttggctcaactaaggcagttacctggaattacagtgtctgaaccggtattaaatcgtaaccatggtatagtctcacttttcgggtctggagatatgtccaaacttggaacaaaagggtactctactcaatttggggatttagacgggaaatatggctatgctgaactgccaggttattcagatttttattccaccaaaccttatggagatctggatcctataccggaaaaaccaccctcttctacccaaagaggtttctacgatcaagaattcccattgatacggtttgacacagacgatcataagaaattcgacatgttttgtagggaagatactccagattcagtactcagtagttcatctccggagtgtgtccaagtagatccagagggtagatttatgggattaagacttattagcgatagtgaaggcgaggacgaggacaatgaaatagaaagggaaatacagcaagctagagatagactgtcgccgatagtacctatgatcaaaccagtaccaattagattgaaaccagttggaggagtgcttgttaaggaaactcccagtgataacaaagaaaacatcaatacagatagtcttaacataatgacaaagatcaaatctgaaagcaaacctttattaccgacgaaggattcaggacatgttaccgtgacattaacactgacttcatcggccgctgaagacataatgggtgtgctaagggacttagcaaacattctacaaattccagctcctactagttatcaaatagtagaaaggacaacaactcctcccagccagaagctcggactctacaggaccaagggcaaagacggtaaagagggagcgccaatagacattcaaagtattcttaatggggctaccaagttctgtaaacactgtgatgtaattattttaagcaatttgataaggagaaaggtttccgaccttcctttcttggccaaagactcggaacttttaagcgacggagaggaactattcttctgtagctcgacttgctacatgcagtttgccctaatgcatagatctccttctatctccgaagataaggccgccgaaataatcaaccatttatctcagaaagataacgagacaaaacagaaaatgcagatgatggaaccgtttgacaataaatcaataatagctcaaagactctcgttcactaatcgagaaatgaagaaagaatatgaaccaatggacaccaacgattactattcctacttgcataataacgcagagaataaaccgaatcggttttatgacggtgcttacagaccgatgccggttagcagaatctacaagaacatcagatataaggtttggtcgcctggatgtttacaaccgaatcagaaacataagatacctacggataaagaaatcatggagttgttgtatagaatgcaaataacagtcacgccgccagttatgccggatgatacaagaaagtgcatgttttgtcagggtgtttgtgatggagtagctgatggcacggcaagattacttaactttgaagttgataaatgggttcacttaaattgcggtctttggtctgacggcgtatacgaaacggtgaatggggcgttaatgaatttggagaatgctttacaaacaagcctaacgacgccctgcgtacattgcaatatgttaggtgctactataagatgcttcaaaacgagatgttccagtgtgtaccatctgaattgtgcagtaaaagacaattgtgtatttttcaagaacaaaactgtctattgcatagcgcatgtccctaagaacgaaaaggacaacgagttgacgacgctctctgtatctagaagagtttatgttaatagagatgaaaacagacaagtcgctgctgtgatgcacagctcagatactgacgatctattaagagttggtagcctcatattcctaaatgttggtcaactattaccacatcagctacaaaatttccacacttccaactacatatatccgataggctacaagataataaggttctattggagtatgaaatctttaaacaaacggtgcaaatacatctgctctatccacgaacaatttggaaaacctgagtttagggtcgttgttcaagaacctccagaagacgatatagagtttgtagatccgactcccaaaggtgcttggcaaaggatccttgaccaaatcgccttccttcgcaaagagaacgaatgtttacagatgttccctaaattcacgactggagaagatctttttggtctcaccgaacccgccatagtaagagtactggaaagtatgccaggtatagagaccttagccgattataaattcaaatatggacgtaatcccttattggaacttcctttggcgatcaatccctcgggatcttgtaggactgaatcgaggtcgagaactcagttgcattggaaaaaacatcacactcaacggactacgctgtctacagctcgacctatatttggtccttcgccttccggcccaactccaagtactccaacgtttggtgagctgtcgtgtccttacagcaaacagtttgttcattcgaagagctcacagtacaaaaagatgaagcaggaatggaagaataacgtatatcttgctagatcgaaaattcaagggttaggtctatatgctgctagagacttagaaaaacacactatggttattgaatatattggagaaattataagaacagaactggctgaaagcagagaaaaacaatatgaagcaaagaatcgaggtatatacatgtttagactagatgaaaacagagtggtagacgctacgttgagtggtggcttagcgagatatataaatcactcttgtaatcccaattgtgtagctgaaaccgtggaagtagaacgtgacgtaaaaattattattttctccaagagaagaattatgcgaggagaggagctggcttatgattacaaattcgaattcgaagacgaccagaacaagatttcctgcatgtgcggtgctccgaactgccgaaaatggatgaactaa

SEQ ID NO: 229 - DNA, 2067 bp, Diabrotica undecimpunctata
atggaacgtagtcgaaagcgaagagatcggtcaatttcaaatagttcagaggacagtaataaaaaaaaacagtattccaaaaattcaaaaggaaaagacaaatataaagatacacgggataaaagtagtgacaaaagtaaagaaaaacgtaaaaaatcaaagaaaaagaaaaaaagatccaggagcagttctgatgaatccagctctaacagtgacagttctgataattcagtaaaactactggaaaagctcacaaaagaaagaattagacttgcagaagaacggaaaaagcaaaaagaactaatcaaagctaccgaaacagcagaggagaagcgaatgagacggctcgtcaagaaggaaaacaaagagagatccaggaaagagagaatgggctgggataatgagtatttacattatacaaatagtgacaatccttttggggacggaaatttgttgtctacatttgtgtggtccaagaagttgactaaagaaggattgaaaggtgttagtcaagcagaaattgaggcaataaacaggacaaaacaagaagaaaacaaaagagaactggaaaaggtaaaaaagagacgtttagaaagggaattagaaagacagaagagggatgaagaaacccagatgctccaaagaagcaaggaagcagcacaatttgaagagtgggaaaggcaagaagacaaattccatttagaacaagcaagactgagatcacatataagaatccaagatggaagagccaaacccatagatttattagccaaatatataagtgcagaagaagaggtagatgctgtggaaatgcatgaaccatacacatatctaaatggtctacatataaaagatttggaagatttagtagaggatataaaggtttataaagagttagaaaggggaaaaaatttagattattggaatgacattactgtaatagtggaagatgagttgcagaagctaagaaagcttgaaaaacagaatgattttgatttaggtttgaatagaagagaaggtattcatcagtcagtagctggggatgttacttctgtatttaaaggtaaaaccgctgtacagttagcagctttggagaagcaaatagagagaaaaataagcagcaaagccgatggtattgatataggttactgggaatccctgttatcacaacttaaggcacacatggctagagctagactaagagatagacatcaagaaagcttgaggagaaaacttcaagttttgaaagctgaacaagccataaacgtaacagctccaagtgaaagtcattccagtggaggtgaggaagctccaacgaaagatgtgcaagaaccaaagcctgggccttctcaggaacctgatgataaggaaaatgatgaagatgaacccgcagatgaggaagctgctaattcgtggctgaatgagtgttttgatgcctatgaagctggtggatatagtcccaagtttcttactccagatgaaatagagccaggaactattgttgttatagaagaagatgatctgaaaagattggaatttgcaagaattcaggtggttggtaaaggaaaaaccgtggaaaatgttataactaaggaagaattgatgttacaaaaagaagctcgtaagggcatggatgcagatgaggcacagttctctgtagagcaagctttggacagtcaagtctatctgtggtctgataaataccgtcctaggaaacccaggtattttaatagggtacacacaggatttgaatggaacaaatacaatcaaacacattatgatatggataatccccctccaaaaatcgtgcagggatataagtttaacatattctatccagatttaatcgacaaaagtagtactccagagtattatctgactccttgcccagaaaataaagaattcgccatattgagatttcatgctgggcctccatacgaagatattgccttcaagattgtcaatagagagtgggagtattcgtacaaaaggggattcaggtgtcagtttcacaataacatcttccaattgtggttccactttaaaagatataggtataggaggtaa

SEQ ID NO: 230 - DNA, 1245 bp, Diabrotica undecimpunctata
atggataatttagaaaccaatattatggataagtcaatgagatcagtcttcgttgggaatattccatatgaagcaaccgaggaaaaattaaaagatatatttggcgaagttggacaagtactatcttttaagcttgtgtttgatcgtgaaactggaaagcccaaaggatatggtttctgtgaatacagagatcaagaaaccgccttgagtgcaatgagaaatttgaatggttatgaaatagggggaagaaatttaagagtggacaatgcttgtactgaaaaatctagaatggaaatgcaaaatcttcttaaccaacctatagtagaaaatccctatggagaggcagttcaagctgaaaaggctcctgaggctataagtaaggcagttgcatctttacctcctgaacaaatgtttgaattaatgaagcaaatgaagacaaccattcagaataatccaacagaagcaagacagatgcttttgcagaatccacagcttgcctatgctcttttacaagctcaagttgtaatgaaaattattgacgcagctactgcagttagtttacttcatcctgtaaaccaagtgccagcaacactgatgcctggagacaaaaatgttcctgttcaagtaccaattagtaatcagtacagggagcctccagcacctgtccaaccaccaagacaggaatttcagcctgttcctgctcctgttatacatccatcccagaatcaagtatttgcaggtcaagatatagatctaagatccattggtgctgtgccagatctgagattaaggcccatgggtgaccaggatatgagacaactgccacctgctattcaaaatcccttaccacctactattggagaaagctttgttcgagatcctagaggttcacaggcgttcgcaggagatccaagacaagcacgcatagatccacgccagaagactatagtgcctcctccagctccactacctataccacctctaaatgcaagacccgtaatgcctcctcagcctcaagttcctgtgacgagaccagcacttacgcctcaaccggtcccaactcctactcctgcaacggccagtccaaatgttgcaaatgctggggcttcggatcaagaaaaggccgcgctcattatgcaagttttgcagctgtcagatgaacagatctctatgcttccacctgaacagaggaatagtattttggtattgaaggagcaaattgctaaaagtgcacacacacgttaa

SEQ ID NO: 231 - DNA, 1179 bp, Diabrotica undecimpunctata
atgacccaaatggatcctgaacgtgaaaaaagtcttcaagagtataggaaaaaattattagaacacaaagaagttgagtctagattaaaagagatgcgagagcagctaaaagatcttacaaaacaatatgataaatcagaaaatgatcttaaagctttgcagagtatgggccaaatagttggagaagtactcaaacaactcactgaagaaaaatttatagtcaaagctaccaatggtccccgttatgtggtaggatgtcgtcgtcaactagacaaagcaaagttaaaagcaggaactagagtagcattggacatgactacattaactattatgcgatatttgcctagagaagtggacccattggtgtataatatgagtcatgaagatcctggagatgttacttattccgctattggtggtttatctgaacagattagagaacttcgagaggttattgaattgcctttgttgaatccagaattgtttatgagagttggaattaccccacctaaaggttgtttattatatggtcctccaggtactggaaaaactctactagctagagctgtagcatctcagttggatgcaaatttcctcaaagtagtctccagtgctattgttgataaatatattggagaatctgcaagactgatcagggaaatgtttaactatgctaaagaccatcaaccttgcattattttcatggatgaaattgatgctattggtggtagaagattttctgaaggtacttcagctgatagagaaatccaaaggactcttatggaactgcttaaccagatggatggttttgattcattaggacaggtaaaaatgattatggcaaccaacagacccgatactctagatcctgctctgctccgtcctggtcgtttggacagaaaaatcgagatacctcttccaaacgagcaagcccgtcttgaaattttgaagatccatgcactcccaatcgctaaacatggagaaattgattatgaagctatcgtaaaattatctgatacatttaatggagccgatttaagaaatgtttgcacagaagctggtctttttgctataagagctgagcgagagtatgtaatccaagaagactttatgaaagccgtgagaaaggtagccgataacaagaaacttgaaagtaaattagattataaacctgtataa

SEQ ID NO: 232 - DNA, 831 bp, Diabrotica undecimpunctata
atggctcgtcgatatgataccagaactacaatattttctcctgaagggagattgtatcaggtggaatatgccatggaggctatttctcatgcaggtacttgtctaggcattttagcaaatgatggaattttgttggctgctgaaaggcgtaacactaacaaattattagatgaggtttttatttcagaaaaaatatacaaactaaatgatgatatggtttgtagtgtagctggaataacatctgatgctaatgttttaacaaatgaattgagacttataggtcaaagatatttatatcagtatggtgaatctattccttgcgaacaattagtttcctggctttgtgatgtcaagcaggcatacactcagtatggaggtaaacgtccatttggtgtttcaatattatatatgggatgggataagcattatgggtaccagctgtatcagtcagatcccagtggcaactattctggttggaaagctacttgcataggcaacaacagctcagcagcaatttcaagtttaaaacaagaatataaagaaggtcaaatgactttgaaggatgcaaagacgttagcagtgaaggttctggcaaaaacactggatatggcaaaactaacttctgaaaaagtggaaatggctactcttacccgcaaaaatgataaaactatgatcaaaattttaagcggcaaggaagtggaggaactgatttcagagtatgaaaaaagtgaagctgctgtagaagctagcaaaaaaagagcagaaggcatcagcttaattacttttaattggttttgtttaggttctctaagttataagtcattgtcataa

SEQ ID NO: 233 - DNA, 2670 bp, Diabrotica undecimpunctata
atgggtgactcaaaggtagaacctacaaaggtggataaaacaaagggtaatgaggacaaaaacaaaaatgaactgtccgaagaagacaaacagcttcaggatgaactaaatttatgtgttgagaaactccaggataatgatgaaaagagatacttgcctgctctgcaagctttatcaaatcatattcaagcctcaactacttcgatgacttctgtacctaagccgttaaaatttatgaggccccattatgacaccatgaagacagtacatgaaaaaataactgatcctgacactaaaaaagtgtgtgcagatattatatctgttttagctatgacaatgggagaaggtagagaatgtttaaaataccggcttctttctaatttggataaaattggtgaatggggacatgaatacgttaggcatttggcaggagagattgcaggagaatgggccgagactgattttatagtaaacactgaaattagagagaaactgattttacttacaaaacaaattgtgccatacaacatggcacacaacgcagaagcagaagcatgtgatttgcttatggaaattgaaaggcttgatctactagaacagtatgtggatgaaaacatttaccacagggtgtgtttatatcttaccagttgtgtaccatatgtggcagatcccgagaatactactctactacagactgctcttttactgtttagaaagttcgatcaatatccacaggcgctgagattagctatgcagttaaatgactttggactaattgaagagatttttgtcaactgtcctgattcggatgtacagaaacaactggcgtttatgttaggacgacaacagatatatgttgaaattcctgaacatacgccagaatatgaagacttaatcgagataatggcaaattgtcatcttaataatcatttcttgaacctcgctcgcgaattggacattatggatcctaaaaccccggaagatgtttataaatcccacttggaaaatagtcgtcccccattcggcggaaaccaagttgattctgccagacaaaatttagctgccagctttgttaacggatttgttaatgcagcttttggccaagataagctcttgatggaagatggaaataaatggctttataaaaacaaggaacatggaatgcttagtgctactgcttctttgggactaattcttttatgggatgtagatggtggtcttactcccatcgataaatacttatactcttctgaggatcatattaagtctggcgctttattagcttgtggcattgtaaactgtggtgtcagaaatgaatgtgatcccgcactcgcacttttgagtgattatgttcttcacaatacaaatataatgagaataggagctattgtaggtctaggtttagcttatgttggttcaaatagggaagcagtattatctttaatcacacctgtgctatctgaccctaaatcaaatatggaagtcattggaatggcggcactggcatgcggaatgatttctgcaggatctggtaattcccatgttacaacacaaataatgcaagttcttatggaaaagtccgaaatagaattaaaggatacttacgccagatttttgcctctgggtcttggattgtgtcatttaggtaaacaagaaagtattgatacaattatagcagccttagaagttatacctgaccctttcagatccatggcaactactatggtcgatatttgcgcttatgcaggtacaggaaatgttttgaaagttcaacatttgttacatatatgttcagaacattacgatgctcctgaaactcctgacaaaacttcaaaagacaaagataaaaaggaaacagagaaagaaaaagataaagatctctcagctagacaagctattgcggttttgggtatagcattaattagcatgggagaagacattggtagcgaaatggcgttccgcacatttggccatttactaagatactgtgaaccagctatcaggcgagctgttcccttggccctaggcttaatatcagtttcaaatcctaaattaagtattctcgatactttgagtaaattctcacatgatagcgatgctgaagtggcccataatgccatctttgcgatgggtctagtaggagctggtactaacaatgcaaggttagcagctatgctacgacagttagcacagtaccatgcaaaagatcccaataatttatttatggttcgcatcgcccagggtctcactcatcttggtaaaggaactttaaccctcagtccattccatagtgataggcagctgatgagtccagtagctgtagctggtctaatggcgactctcatcggcttcttggacgttaaaaatattatattggggaagtcacactacttactgtacaccttagcagctgcaatgcaaccaaggatgctagttacatttgatgatgagctaaatcctctaccagtgcctgtcagggttggattggcagtagatgttgttggccaagcaggaaaaccaaagactataacaggtttccaaacccatacaactcctgtgcttttggcttacggtgagcgagctgagctcgcaactgaggaatacattgcgttgacgccaattatggaaggatttgttattttaagaaaaaatcctgaatttaattcataa

SEQ ID NO: 234 - DNA, 1548 bp, Diabrotica undecimpunctata
atgactgataacgagatggactcgaaggacgaacagaatccttcacctgaagaagttaaaccaaaaatagatacatcagacacagactctcaaccacctcaggtttctgttacttctggtggcggtgtgatacgaagaaattttataactacagctggaaccatagtcgaaacaaacgaagaacagccgccagaacccactaccgaagagattgttaatacagaaaattcaactccgcaggaacaaagtcctgtggaacacaaaattgagcctacagagacaacaacgtatcaagaactgcatcaaacgcatcaaagagaacaatttacggaaccaaagcagtatacagtagaaatgccagcagaaagcttttcaggacaaaacttttcacaggatatcggttacacaagcaatatagctactgttaatattgaaggtaatgaggtacctataacaatatcttccgaaatagatcaaccaggtgattatacaagtttgcaaacagcccaatacaacaacggttataccgatggtccacagtatcttgcccaacatcagtatcaaaatttatacgttgacagaggcagtgttggtaattcacctccagctactttattgtttaaagatgatcccaatttagcagcagctagatatccgacaaactacgatgtatctagcagtcaatcgcagcttaatcttcttccaaatgatacctacttcactacaacagccaattgggcttcaacgagtaccggatcctatcaacaacaatacagcaataccattaacatccttcaccaagcggatagtacgcagtcatacggaggtccttacgtgaatacagcatggtcatctagttcgatagaggatggacgtccaccaagccaagaggtactagtcaaagagtgcgtgaattgtggtgctagtgttacacccctttggcgtagagacggtaccgggcattatctatgtaacgcgtgcgggttataccacaaaattaatggggttcacagacctccgattaggccttcgaaaaaaccacaggcgacaggaaacagaagaaatggtgtatcatgtgcaaattgcaaaacaaataacacaactctttggcgaagaaataatcaaggggaacctgtttgcaacgcttgcggactttactttaaattacacggggttaaccgaccgatgagtatgaaaaaggatggcatccaaacacgtaagagaagaccaaaaaactctggtggaaatccaggtccatctggccaagtccggatcggcaacatctaccaatatcaacatgctccagaacttgaaatacaacaggacacctaccagttgcctataaacgtatatccttcacccactcaaggaccttacagacaatacgcagctgagaatcttcgaggcttaaatgctcagccattgcaaccaattattgccacagatgacgaacagacaagcgtcataacttctacctcacagcaagcaaggtttcgagtagatacagaagaggacgatggtagtaacaaccaacctgccaatgcttag

SEQ ID NO: 235 - DNA, 4419 bp, Diabrotica undecimpunctata
  misc_feature (810)..(810): n is a, c, g, or t
  misc_feature (1137)..(1137): n is a, c, g, or t
atgctgtcatgttttcgaatatgctttgaaacaaggcttgtcgacctcttgagaaaaactgccgaacactatttaaaagaaatggtgcaattaatttttatgaggttgccgcagtttagtgaagatctgaaagtttcttacattaaacagttaaaaatgaaacctggagctttagatcaaacacgtactaagaggaaaaagcagtattcttcacttaaaaaagataagaatgacactgacattaagtctccccaaaccccacaaggcaatcttgcaacagtagcacaaagtagtatagtagatatgcaaggttccttgcaaaatcctgaaaacgctaaccctgtaactccaaatgctagtccaaaagaaaatttcaagtgtgatgtagatatcattgttgacagtcctgttagtaataatgaagatttaaaaaatatcgattctatatcgtctggtgtagaagaagcagtaacagaacctaaatcacttactgaagaagaaattacagaagaacagagtcagactactcaagattacataaatcaaagaggcataaggtttactccacaattgcagcaagaagctaacttgtcgccctatggtttggcatgtgtaagagaattactgagatttttaataagcctgtgtaaccctcttgataaacaaaatacagaaatcatgattcatctaggtttgacccttttaacagttgcatttgaaataagtgcggataatattggtaaatataacactctgttagctttagtaaaggatgatttatgcagaaatctattttctcttatgagtacnagactagcaatattttcattggatttacaggtgtcttttttattatttgaatcattgagaacacatcttaaatatcaattagaacactatctaaagaaattaatagacatcatcctcagcgattctcctaaagtaacctacgaacacaaggaaatagcattagataatctacttcagctgtggcgaataccagggtttcatactgaactatatgttaattacgattgcgatatgtactgtgcgaatctgtatgaggaattaactaaattgttagctaaacattcaatatcttcgactactggagtgtaccatacccatttgttatcnttggatgcacttatgataatcactgaagggattgaaaaccggtgttatgaagaaaaagatagattagacgcaggaaatagtgaattggttcagcaatcaaatgacattagcttctatgtcggaaaaaattctaggactaaaatttctccaatcatgccaaagaaggaggaattagctcaaaagaagagtattaagaagtggctaccgcaaggtaccgaatacttcaacaaaaagccaaaaaagggaatagaatttcttcaagagcacggagtactaaaacaggatattgatttggatgaaatcgctagatttttaagagaaaatccagttctgaacaaggctatgattggcgaatatataagtaatcgaagtaatttgaaaattctgcaatccttcgtcgatacttttaattttaccggagtgcgtatcgatgaagctttaagagctttcctagagacttttaggttaccaggtgaggcacccacaatctccctgatcttagaacatttcgccgaaacgtggcacaaggccaacaacgaaccatttgcagatgtggattctgcctttactttagcctatgcgataataatgctcaacgttgaccaacataacgaaaatgcaaaaaaacaaacgacccccatgtcggctaatgctttcaagaaaaatttgaagggcgttaacggaggtaacgattttgacgaagaaatgttagatgatatatatacaacaataaaaaacgaagaaatagttatgccagccgaacaagccgggttagttagggaaaattatttctggaagatcctgctgaggaagggacagacaaaagatggcatgtacatacatgataatagtggtacttacgattctgagcttttccagattgtgtatggacctatagtagcagctctgtcttctgtttacgagaaggctgaaaacgaaagtgtacataagaaagtcatgcaaggattcgaaagatgcgcctttatcgctgcaaatctcaatatgtcgacaaatttggatatgctcattctcggtatttgtaaatttactgtgttttacaaccaacagaaacagaacaacattgtggttcaatttggaatgaacagcaaggcgcagttggcccttaggacggtatttttcctaattcatcaacacggaaacaccatgagggatggatggaaacacttatttgatctcttgttagcactctatagcaacggactgttgtcaaaaacgtttgtagaggtagaagactttattgaaccaagtggcaaattaattctagtctacaaggaagcaccatctgcggcgaagcaggataccggtttactgagttctctttactcatacatggtttccgcagaaaatttatcaaaaataccgacaccagaagagcaaaactgtatagatgctgctaaagaatgtataaaggactgtaatttagagcaaatgataaccgactccaagtttctccacgaagaagctttatttgaactcgtaaaaactttaatagaattatctagaggtccggatgtacacgaaagtgtggcttatgactacaatgataacgttaccgtgttctttttggagttattgatcaaagttgttatacaaaatagagatagagtgatgaccgtgtggcaaaatgtacgggatcatatatacactttagttatgaatgcatctgttttcgatttccagttcttgttggagagatctgttatcggtctattgcgtattgcaatccgtctgatgaggaatgaagaaatgagtcatattgttcttcagtctttaagaatgctactgcttttaaaaagcagtaccctttctaggatatcacggcaaatatcatttggtttatacgagcttctgaaaacgtccgcacagaacattcacaccaacaccgactggacaattattttcacgcttttggaatgtgttggagcaggagctcaaccacctaagcctgttagttcagccgaagaaacagaattgaaaaataaatctgatggtgaaacttccgataaccacgaggaagagggcacgctctcagattcagaaggaagaaagagtccgaaagataatacccagcgatcacaaagtcctgtgagtgtcgtaacttcgcctgttggaactccaaatacaggtggatggattttggtcggcaacgaaggtgagattcaacccgttatgggccgcaccgtccctccaacccaatacggcctagctttagagaagaaccttggaagccatgaccccagaagtatgatgaagtgctgcgaaagtctcgcgtttctagtaagagatgtcgcccacattactccttacaattttgacgtttgtgttcattgtataaggacttttgtagaagctagcttacacggttctaatttcaaaaggttgagagattctaggtctaggaagaaaactttggataggtctagaactagaaaaagtccgacgagtagtcccgatgaggaagatagtgacgacgaaaacattccaagtggttatcaccaaatatcaatacagttattagatttaatgcatactttacatacgcgaacggctcagatattcaaatggtgggctgaagaaggtggggaaatatcgcaagaaacttctctttggacgcaaggctggtgccctcttctgcaaggtatagcaagactgtgctgtgatacgagaaggcctgtaaggatgagtgctataacgtacctgcagagagcgctgttagtccatgatttacaaactttgagtgggtcagaatgggaacaatgtttccaaagagtattatttcctttacttagttacctgttacagtcaataagtcctaaagatgccatatccatggaagaaactaggataagggtagcaactgtgttgtctaaagtgtttctacatcatctgtctcctctattagcacttcccagtttctttaatttatggttggtggttttagactttatggataaatatatgcatgcagataaaagtgaacttctttacgaagccattccagaaagtttaaaaaatatgcttttggtgatggattctgctaaagtttttgacggtcccgatggaaagaacattctctggaatgccacttgggaaaggatagggaaatttctacctaacatgaaagacgacttatttaaggaaatagaagaccaaaatagaaaaaacgaagaagttagtaacatagagataatagtgaataaagaagagaaagatgtaaatacagataaattgactactaacgataaccttattacgtgttag

SEQ ID NO: 236 - DNA, 618 bp, Diabrotica undecimpunctata
atgtccattctagcttacaatggtggtgctatggtggcgatgaagggagaaaactgtgtagccattgcagcagataggcgatttggtattcaagcccaaacagtagctacaaatttccgaaaaatctttgaaatgggaccacatttatatgtaggtcttccaggattagcaacagatactcaaacagttatggaaaaactccgtttccgaaaaaacttgtatgaacttaaggaaaatcgaaaaatatctccaaaagtatttgcgtctatgatatcaaatatgttgtatgaaaaaagatttgggccattttttgtggaacctgtagtagctggacttctacctgatacttatgaaccttttatctgtaatatggatttaattggttgtataaaccaaccttcagactttgttgttggtggaacagcctcagcacagttgtatggtatgtgtgaagcactttgggaacctaacctaggacctgaagatctttttgaaacaatctctcaagcactcattaatgcctttgacagagatgccatttctggttggggagctacagtatacatcatagaaaaagataaggtcactataaaaaatttgaagacacgtatggactag

SEQ ID NO: 237 - DNA, 2808 bp, Diabrotica undecimpunctata
atggatcagaaaccagggatagatctggtgatatcggcagtttcagcgttgtacaataaccctaacagcagtgagaaggaaagggcttctaaatggcttttggaactccaaaaatccgtccacgcctggactgtagcagacgaattattacatttgaaaacagacttagaatcatgttattttgctgctcaaactatgaggacaaaaattcaccagtctttccacgaacttcctcaagaagtacacacgtcgttaagagattcattacttgaacatattggccaaattaacgaagcaactaacactgttatagtaacacaattatgtgttgctctggcagatttagctctacaaatgccatcttggcagaatcctacattagacctaatcaatagattctcccaaactaatatatggccattgctagaaattttaactgtgttacctgaagaactggaaagtagatctgtcaggctaggtgaaaacagaagaatagatgtgttagaagagatgaaagtttgtgctccaacagtgaatgaatttttaaaacattgttctaaagtctatgaaactaattggcaagatcatgttcagttcaatgtaaaaatattacgttgctttacatcctggatctcagtaggagctattagtctgaatgatctttctgatagtattgttattaatagagcattcgagatactcaacttcaagcctcaaaatgataaacagaccatatcagctgcctttcatgaggctgccaccgactgcatttgtactcttttattaagtctcgaaaacaacaataaccaacttggtttggaaaattacctcttcaataatattatcaatctagacgtaccttatcacctttctgttgcaaatgaagatcagggaaaatccatggattattgcagactgtttacagagctggcagaatcatttttagaaaaaataatagcaaatagtaatacgaaacagatgcactatgctattaaaattttagatctagttttaatgtgtgttggacaccacgactatgaggtagcagaaatcacttttaacctttggtatgttttgagtgaagaattgtaccaaaaaaataacaaagaaaagacagaactattccgaccctatgtagaacgattaataacagccctgtgtaggcactgtcaaatggagccagatagcgaaggattgttagaagatggagatgaatttaaagattttaggttgaaggtagcagaattaatacgagatgtggttttcatagtgggcagtagtgcctgtttcaaacaaatgttcattaatatacaaggtccaggagttacgtgggattccaccgaggcagctctatttgtaatgcaagctgtagcaaaaaacgtaatacctggtgaaagtgaagtggtacctcaggttgtagaagcaatattaaatgttccagaaaatacacatgtagccgtaaaatacacgtcggtgcttttattaggagaactttgtgaatggatagagaggcatccgaacacactggatccagttttgaacttcttagtgtgctgtttgcctcaacctggtgtaggagctgctgcagcggtggctcttcaaaacatctgtgctagctgtaatgatcatatgccaaggcacgtcccgatactcttacagcttcttcaccaagcggattcctttgccatcaccaacacagctaccttgggtcttctaagaggagtggcctcgataataggtcgaatgccgcacgaggagttgacgaagtccttacgggaattatgttctatgcagctcaatccgatatgtcaaatcatagaacaggatgttcatccagtgaagggggccaacacagatccggtaatgtggctcgatagacttagtgcagtgcttagatatgttaatgtacatattcccgaaggtgtggaaaacccttgtaaaccggtaattctcgaagtgtggccggtattgtctcgcacgttcgataaataccaaagtgacattaggataatggagagatgttgtcgcgctgtgcgtttcatgcttcggtgcgttgcgcaagaagtgcgagaactcttagaaagtctagttggacaaatagtgaggatctatacgttataccaacattcgtgttttctgtatgtcggtagtatacttgtggacgaatacgctatagatccgatatgcgtgccaggactactggatatgctacaagcgtttctagaacctacctttcacgtgttgcaggaggagaacgggttgaagaatcatcccgatacggtagatgacttttttaggttgtgcgcaagatttatgcagagggcacctttagcatttttaaaatgttcttccttggtccacatcttacagtgtgcacttttggcttcttcactggaccaccgagaagcgaatatgtctgtgatgaaattcttttacgatttgataaaccaaggccagagcgggagggctgatcccgaattcaatcaacgacagatgttagttaaaagcatcctcgacgagtatggccaacaactagtctcaaatttaatccattcttgtgtcttctacctccattcctacatgctcagcgaagtcggcgacgtattcgtgcagctgctcgattttgacagagagatcacctgcaaatgggtagcggcgggtctcgatgtgttaccgaaaaacagtaacggtggcattatggccgccacacctcaacagttgacggatatacataccactattagtaggtcgaatacttccaagtccgtaacgcatgctctcaaggatctagccaggttatatcgttaa

SEQ ID NO: 238 - DNA, 1506 bp, Diabrotica undecimpunctata
atggctcagcggtttcccggccctgtgccaaatcaaagtccaggaggaccacctccgcaaagatatcaacaacagcccccaaatcaaggaattcggcaatatgcacaacaaaattttcctcaaagacctggatacaatcctccaccaccaaatataccatccagtggcggtacaatgattcaaagacctactggtgctccctattcaccaatgagaggtggaattattccgccacagcagggaaataaaaggcctgcagataataggacccaactgcaacagaaaagtaatgaatacagccatagtacaagtaagaagaagaaaaagctggcagataaaatcctgccacagaaagtcagagatttggttccagaaagtcaagcttacatggatctattagcatttgaaagaaaattggactctactataatgagaaaaagattggacatccaagaagctcttaagcgtcctatgaagcaaaaaaggaagttgagaatatttatttccaataccttctatcctgccaaggaacctcagcctgaaggacccgatggaccatgtcaggaaggcactgttgcttcttgggaattaagagtagaaggtcgtctcttagaagatccaaagaacgatccaaataaagttaaacgcaagttttcttctttctttaaatccctggttatcgaattggataaagagctgtatggaccagacaatcatttagttgaatggcatagaacactaaccacccaagaaacagatggtttccaggtaaaacgccctggtgacaagaatgtgagatgtactattttgttgcttcttgattatcaacctctgcagtttaagcttgatcctagactagctagacttttgggagttcacactcaaactagaccagtcattatttcagctttgtggcaatacataaaaactcatcgcttgcaagatgcccatgaacgtgagtttatagtttgtgacaagtatctggagcaaatttttaactgtacacgtatgaaatttgccgagattcctcaacgtctgaatccactattgcatcctccagatccaatcgtcataaatcatgtgatctccgtagaaggaggggccgagagcaaacaaactgcttgttacgatattgatgtagaggttgatgatacattaaaaacccagatgaacaatttcctattgagtacagctagccaacaagaaattcaaggacttgatgccaagattcacgaaaccgtcgataccattaatcagcttaaaacgaatagggaatttttcctgagcttcgctaaagatcctcaacagttcattcataagtggattgtttcgcagactcgcgatctgaagacaatgactgacgtggtcggaaatccggaagaggaaagacgctccgacttcttctatcagccttgggcacaagaagcagtttgtagatatttctatactaaggtacagcagaagagagcagagttggagcaagctcttggtattcgtaataattag

SEQ ID NO: 239 - DNA, 435 bp, Diabrotica undecimpunctata
atgccaaaagtacgacgaagtaaaaaacctcctcctgagggttgggaactgatagaacccacattagatgagttagaacaaaaaatgagagaagctgaaacagaatcacatgagggtaaaaggaaaaatgaatcattgtggccaattttcaaaatccatcatcagaaatccagatatatatttgatcttttttatagaagaaaagcaattagcagggaactatatgactattgtcttgaggaaaacattgcagataaaaatttaatagcgaagtggaagaagcaaggatatgagagtctttgttgcctacgatgtattcaaacaagagacactaactttggaacaaactgtatttgtcgtgtacctaaatctaagttagaagaaggaagaattgttgaatgtgtgcactgtgggtgcagaggttgttcaggatag

SEQ ID NO: 240 - DNA, 885 bp, Diabrotica undecimpunctata
atgccagcagctactctaggtagcataccacatcctaataatgaagactgtggcattagagatgtttgggcccataacctggaggatgaattcagaaccatcagacaaatagtacaaaaatatcagtatgttgctatggacacagaatttcctggtgtagttgcaaggcctattggagaatttagaagttctgcagattaccaataccaaatgctgaggtgcaatgtagatttattgaggataatacagcttggactgacgtttcttgatgataacggaaaaactccaggtggtgcctatactacatggcagttcaacttcaaatttaaccttcaagaagacatgtatgcacaggatagtatagacctcctgcaaaattctggaattcagtttaagaaacatgaggatgaaggtattgaacctctcgaatttgcggaattgcttatgtcatctggtattgtcctggtggaaaatataaaatggctatccttccattctggttacgattttggctacctgataaaactgttaacggacaacaatttacctcaagacgaaacagaattcttcgatttgttaaaattatattttcctaccatatatgatgtaaagtaccttatgaaatcgtgcaaaaatcttaaaggaggattacaagaagtggcagaacagctagaacttgaaaggattggaccacaacatcaagcaggttcggattctcttctgacaggaatggcatttttcaagatgaaagagatgttcttcgaagacaccatagacgactccaaattctcgggccatctctacggtctcggcacctctttcgcagtaaacggaactgccaacaactactcgaacgacaacggagataccacaaactcttcatga

SEQ ID NO: 241 - DNA, 1215 bp, Diabrotica undecimpunctata
  misc_feature (42)..(42): n is a, c, g, or t
atggttttgaaaaaccctcagccattcaacagagagcaatangacttatcaaatgtagagtttgaaactagtgaagatgtcgaagttatcgagaagtttaaaaacatgaaccttaaagaagaacttcttcgtggtatcttcgcatatggttttgaaaaaccctcagccattcaacagagagcaataaagcctattatgaaaggcagagatgtaatagctcaagcacaatctggtactggtaaaacagccaccttttctatttcgattttacaagctttagatttaacaatgcgagaaacacaagttttatgtttgtctcctactagagaattggctgtacagattcaaaaagttattctagctttaggtgattttatgaatgttcaatgtcatgcttgtattggaggtacaaatcttggagaagatatcaggaaactggattatggacagcatgtggttagtggaacacctgggagagtttatgatatgatcagaagaagagctctaagaacaagatctgtaaaaatgttggttttggatgaggctgatgaaatgttaaataaaggattcaaagaacaaatttatgatgtatatagattccttcccccatcaacacaagttgtactcatttcagctacactgcctcacgaaattttggaaattacttccaaatttatgacagatcctattaggattttggtaaaacgtgatgaattgacattggaaggtataaaacagttctttgtggcagttgaaagagaagaatggaaatttgacaccctctgtgacctctatgatacattaaccattactcaggctgtcattttctgtaacacaaagaggaaggtggactggctgacagagaaaatgagggaaaacaattttacagttagttcaatgcatggagatatgccacaaaaggaacgtgacaatattatgaaagagtttagatcgggacagagtagggtcctaatcacgactgatgtttgggctagaggtattgacgtgcaacaagtcagtttggtcatcaattatgacttaccgaacaatcgtgaattgtacatccatcgtatcggtagatctggtaggttcgggcgaaagggtgtagccattaacttcgtgaaatccgacgacatcagaattctgagagatattgaacaatattactcaacccaaattgatgaaatgccgatgaatgttgctgatttaatttaa

SEQ ID NO: 242 - DNA, 1605 bp, Diabrotica undecimpunctata
atgactgcccctacagccggtggtgacacaaatagaggaagaacggtggcatataaggacaaaagtaaacctgctgatgttaggaccagtaatattaacgccgcaaaagctgtttgcgatgctattcgtacaagtcttggtcctagaggaatggataaaatgatccaggctggaaatggcgaagtgacaattaccaatgatggagctacaatcttaaagcaaataaatgtcatacaccctgctgctaaaatgttggtagaattatcaagagcccaagacattgaagcaggagatggtaccacttctgttgttgtaattgcaggagctttgctggatgctgcagaaaagttattacacaggggaattcacccaacagcaatatctgaatctttccaaagagcagcacacttggcagttgatattttatcagacatttccactccaattgaaattactaacagagaattgttgattaaaagtgcctccacttcactaaactcaaaagttgtttcccaacattcaagtcttttgggtcctctagcggtggatgcagttcttaaaattgttgaacctggtagggaacaagcttgtaatttatcagatatcaaagttattaagcaactgggaggaacagtagaagatactgaattagtggaaggaattactttcccacaaagatctgcaaatgtgtctggaccaaaaaggattgagaaagctaaaattggttttatccagttctgtatttcacctccaaaaacagatatggatcacaatgtcattgtgtctgattatgctgctatggatagagtattaaaagaagagagagcatatattttaaatatcgtcaagcagataaagaaagctggatgtaatgtacttttggttcaaaaatcaattttgagagatgcagtttcggatcttgccttacactttttggataaaatcaagtgcatggttattaaggatattgaaagagaagatgttgaatttgtatgtaaatctttaggctgccgtcctattgcatctttagatcattttgttgctgaaaacttggttaccgctgatttagttgaagaggttggagtggcaggaaatagaatggtcaaaattacaggtgcacaaaatgcaggcaggacagtaactctactggttagaggatccaacaaattggttcttgaagaggccgatagatctcttcatgatgctctatgtgtaattcgttgccttgttcgcaagaaggcacttattgccggtggaggagcacccgagattgaggtggctcttaaactagctgccatggccaacaaactggacggcattgatgctatttgtacaagggcatatgcgaatgctttagagattataccgtttactttggctgaaaacgcaggattgaatcccatacagactgtcactgaactaagaaacagacatgccaaaggggaaacgtctgctggaataaacgttcgtaaaggggctattacagatattctcgaagaaaatgttgttcaaccacttttagttagcacttcagcattgagtttagctacagaaactgtgagatcgatcttgaaaatcgatgatattgttaacacattcacataa

SEQ ID NO: 243 - DNA, 1323 bp, Diabrotica undecimpunctata
  misc_feature (557)..(557): n is a, c, g, or t
atggaggctatggatattgttataccagaaaaagaagaaggtagtccttcggaagtaaaaccagtgctgcaggatgtggatactgaagatttgtatactaaatataaaaaactccagcagcagttggagttcttggaggttcaagaagaatacattaaagatgagcaaaggaatctcaaaaaggagtatttacatgcccaggaggaagtgaaacgtatccagtctgtcccgcttgttattgggcagtttttagaagcagtagatcaaaacactggcattgttggctcaactacaggttcaaattattatgttagaatcttatcaacaattgacagagaacttttaaaaccttctgctagtgttgctcttcataaacacagcaatgccttagtagatgttctgccaccagaggcagattcttcaataagcatgctccaggctgatgaaaaaccagatgttcaatacagtgatattggaggcatggatatgcaaaaacaagaaataagggaagctgtagagttacctttgactcactttgaattgtataaacaaattgncagtgatattggaggcatggatatgcagaaacaagaaataagggaagctgtagagttacctttgactcactttgaattgtataaacaaattggtattgatccccccagaggtgtgttgatgtatggacctcctggatgtgggaagactatgttggccaaggctgttgctcatcatactacagctgcttttattcgtgtagtcggatcagaattcgtacagaaatatcttggtgaaggtcctcgaatggtgagagatgtgttccgtttggcaaaagaaaattctccagcaatcatctttattgatgaaattgatgcaattgcaaccaaacgatttgatgcgcagacaggtgctgatcgtgaagtccagagaattttattggaattacttaaccagatggatggttttgatcagacaacgaatgttaaggtaatcatggcaactaacagagctgatacattagatcctgcacttttgagacctggccgtctggacagaaaaatcgaatttcctttaccagatagaagacaaaaacgtttgattttcagcactatcacatctaaaatgaatttgtcagaggaggtcgacttggaggactatgtagctagaccagacagaatatcaggagcagatataaacgccatctgccaggaagccggtatgcatgccgttcgggaaaaccgttacatcgttttacctaaagattttgagaagggttataagaataacatcaagaaggatgagagcgaacacgagttttacaaatag

SEQ ID NO: 244 - DNA, 489 bp, Diabrotica undecimpunctata
atgccaaatataaagttgcagtcgtctgatggtgagaccttcgaaatcgatgttgaaattgcaaaatgctctgttactatcaaaaccatgttagaagacttgggaatggatgaagaagaagaggaagtggttcctttaccaaatgtaaactctgctatactcaggaaagtcattcaatgggcgacttaccacaaagacgatcctccaccacctgaagatgacgataataaagaaaaaagaacagatgatatttcctcttgggatgcagacttcttgaaagtggaccaaggaacccttttcgagttgattttggctgctaactatctggatatcaagggactcttggatgtcacatgtaaaactgttgctaatatgattaaaggtaaagctcctgaagaaatcagaaagactttcaacatcaagaatgactttacagcgtctgaagaagaacaagtgagaaaagagaatgaatggtgtgaggaaaagtaa

SEQ ID NO: 245 - DNA, 930 bp, Diabrotica undecimpunctata
atggacgataaggcgtcgtgtaaggaactggatggatggatagaacagctaaatgattgcaagcaattaaccgaaaatcaagttaaaacactatgtgataaggctaaagaaatattgtcaaaagaatcaaatgtacaagaagtgaaatgcccagtaacagtatgtggagatgtccatggacaattccacgatctgatggaactgtttaggataggaggtaggagcccagatactaattacctgttcatgggagattatgtagatcgtggatactattctgttgagactgtcaccttactggtagcactgaaagtcaggtacaaagagagaattacaattttgagaggcaaccacgaatcaagacaaatcacacaagtttacggattttacgatgaatgtctaaggaaatacggtaacgcaaatgtttggaaattcttcaccgatctgttcgattatttgcccttaacagcactcgtcgatagtcaaattttctgcctgcacggtggattgagtcctagcattgataccttggatcacattagggcactagatcgtttacaagaggtacctcatgaaggtccaatgtgcgatcttctatggtctgacccggacgaccgcggaggctggggcatctctccccgtggagccggctacaccttcggacaggacatttcagaaacgttcaaccataccaacggtctgtctttagtatctagagcgcatcagctcgtcatggagggttacaattggtgtcacgaaagaaacgtagtgactattttcagcgcccccaattattgctaccgatgcggtaaccaggcggccattatggaattagatgatgcccttaaatattcattcttacagtttgatccagcaccaagacgtggcgaacctcatgttacgcgtagaactccagactatttcctttaa

SEQ ID NO: 246 - DNA, 768 bp, Diabrotica undecimpunctata
atgggtatctcaaaattactccttgtatttggagcactcttttgtgccataattgcaattcaagcagacaataatggaatgcaaatttttgtaaaaacactcaccggcaaaaccatcacccttgatgttgaaccgtcaaataccatcgagtatgccaaagctaaaattcaagacaaagaaggtattccaccgaatcaacaaagattaatctttgctggaaagcagttggaagacgatcgtactttctcagactacaatattcaaaaagaatctaccctacatttggtacttcgtcttaggggaggtatgcaaatttttgttaaatctttaactggaaagattgttaccctagaagtagaaccttcagatactattcaaaatgtcaaagctaaacttgatgataaaataggtgtaccaccagaacaacaaagattaatctttggtggaaatcagttggaagatggtcgtactctctcagactacaatattcaaaaagattctacattcaatttggtacttcgtcttagaggaggtatgcaaatttttgttaaatctttaactggaaagattactaccctacaagtagcaccttcagatactattcaaagtatcaaagcaaaacttgatgataaaataggtgtaccaccaagtcaacaaagaataatctttgctggaaatgagttagaagatggccgtactctctcagactacaatattcaaaacgattctacattaaattgggtacttcgtcttaaaggagggaaataa

SEQ ID NO: 247 - DNA, 1623 bp, Diabrotica undecimpunctata
atgatgcaaccacaaatattactcttaaaagagggaactgactcatcacaaggcaaacctcagttaatatcaaacataaatgcctgccagaatgtgacggatgctgtaagaacaacattagggcccagaggtatggacaagctcatagtacagaggcaaggcaatgctactatatcaaacgacggggcaactattttgaaattattggatatcgttcaccctgctgcgaaaactttggtcgatattgctaagtcacaagatgcagaggttggggatgggacaacaagtgttgtattattagcaggagagtttttaaaacaaataaagccttatgttgatgagggtgttcatccaagaataataataaaagcagtcagaagatcgttccaaatttgccttgagaaaataagtgaaatatctgttaaaatcaataaatcaaatgctgatgaatttagatctctattggaaaagtgtgctgcaacagcaatgagctcgaaattaattaatcaacaaagatctttcttttctaaaatggttgtagatgctgttctattactagatgatttactacctctcaatatgattggtatcaaaaaggtacaaggtggaggtcttgaggagtcacttttggtagcaggtgtagcatttaagaaaactttttcttatgctggatttgaaatgcaacccaaggtatacaaagattgtaaaatagccctgttaaacattgaattggaacttaaagctgaaagagataatgcagaagtaagagtagataatgtaaaagaatatcagaaaattgttgatgcagagtggacaattctttacaataaacttcaaaaaatttatgagtctggagctaatgttgttttgtccaaattacccataggagatgttgctactcaatactttgctgacagggatatgttctgtgctggtcgtgttcaagaagatgatatgaaacgtacgctgaaagcatgtggaggtgctgtaatgaccactgttaatgacatcaacgattctgtactcggtaaatgtgagctgtttgaagaaaaacaaataggaggagacagatttaacttctttaaaggctgtcccaatgccaaaacatgtactttaattttacgtggaggagcagaacaatttttagaagaaaccgaaagatcactacatgatgccatcatgattgttagaaggactattaaaaatgatgcagttgtagctggtggtggtgccatagagatggaattatcaaaaattttacgggatcattctcgtacaattgccggcaaagaacagcttctgattggtgcaatagctaaggcattagagatcatccccagacaattatgcgataatgccggatttgacgccactaacattcttaataaacttcgacagaaacacgcgcagggtcactgctggtatggtgtggacataaacaatgaagacatcagtgataacttcgaagcctgcgtatgggaaccggccatcgtcaaaattaacgccctgacggcagccacagaagcaacgtgtttgattctgtctgttgatgaaacgataaaaaatcaaaaatctgagcagccacctcaaatgggaggtcgtggtatgggaaggcccatgtaa

SEQ ID NO: 248 - DNA, 3843 bp, Diabrotica undecimpunctata
  misc_feature (8)..(8): n is a, c, g, or t
  misc_feature (1953)..(1953): n is a, c, g, or t
  misc_feature (3779)..(3779): n is a, c, g, or t
atgtcaancgacgaacaattatccaatcaatctcactacgacttcggtttgagagccttaaaatccgtacttatatctgccggtaatgtcaagagagaccgaattcagcggattaaagaaggaatgacccaacggggggaaaccaacattgatgaagccagcatcgctgagaatttaccagaacaggaaatcttgatccaatcggtgtgcgaaaccatggtacccaagttggtggctgaagatataccacttctcttcagtttgttgaatgatgtattccctaatgttcagtatacaagagcagaaatgaaaggtctcaaggatgaaatcaggaaagtatgttctgaagagtatttggtatgtggagaaggtgacgaacgaggatcagcttggatggagaaggtacttcaactttaccaaatatctaatttgaatcacggtttgatgatggtcggtccaagtggttccggtaagagttcggcatggagagttcttcttaaagctcttgaacggttcgaaggcgttgaaggagttgcacacgtcatcgatccaaaagctattagcaaagaggcactgtatggtgttttggatcccaataccagagaatggacagatggtcttttcactcacatattaagaaaaattattgacaacgtcaggggagaaattaacaaacgacaatggatcatcttcgacggtgacgtcgatccggaatgggtagaaaacttgaattcagtacttgatgacaacaaattgttgactttgcccaacggtgaacgtctttcccttcctccaaacgttagggttatgttcgaggttcaagacttgaaatatgcgacactagccacggtttctcgttgcggtatggtctggttctctgaagatgtgttgtcaactgacatgattttcgaaaactatatccttcgtttgaggaatatacccttggaagaaagcgaagatagcagctttggcaagaaatccgacaaagacgatatgctttctcccactcttcaactacaagtcgatgttgttaatctactacagccgtacttatcacccgatggtctagtcgtacgttgtctggaatatgcgatggaacaagaacatattatggacttcacacgccttcgagcactcagttcattattctctatgttaaatcaagccgtaagaaacgttcttcaatataatcacatgcatcccgattttccattaaccaatgatgtcttagagaaatatgttccaaaatgtttgatatattccatcctttggagtttcgctggagatgccaaactgaagattcgttctgatttaggagattttatcagatctgtaacaacagtacctcttcctccagacaacaacatgcccataatcgactacgaggtcaccatcgagggagaatggtcgctttggtccaataaagtgccacaaattgagatcgagactcacaaggtcgcttcacctgatgttgtagttcccactttggatacagtaaggcacgaatccttgctttatacttggttagctgaacataaaccattggtattatgtgggccacccggttctggtaaaacgatgactctattctccgccttaagggctttacctgatatggaagttgttggcttgaacttttcatctgctacaactcctgaattgcttctgaagacattcgaccactactgtgaatacagaaaaacgcctaatggtgtggttttgtcaccaatacagctgggcaaatggttggtgctattctgtgacgaaattaatttaccagacatggacaactacggcacccaacgtgttataatgttcctgcgtcaaatcgtggaacagaaaggtttttacagagcctcagatcaatcctgggtctcactagaacgtatacaattcgttggtgcttgtaatcctccaactgatcccggcaggaagcctctatcccaccgattngtggaacagaaaggtttttacagagcctcggatcaatcctgggtctcactagaacgtatacaattcgttggtgcttgtaatcctccaactgatcccggcaggaagcctctatcccaccgtttcctgcggcacgtacccgttatttatgtagattacccaggagagacatctttgaaacagatctacggtactttcaccagagctatgctaaggttggcgcctggtctgaaaggttatgccgaaccattgactaatgctatggttgaattttatttggcatctcaagatagatttactcaagatatgcaacctcattatgtatattctccaagagaaatgacgagatgggtaagaggaatttgtgaagctataaggcctcttgataatcttcatgttgaggggttggtaaggctttgggcccacgaagctctccggctattccaagacagattagtcgaagacaccgaaagacgttggaccaacgaaaacattgatgctgtagccttaaaacacttcccatcagctaactgtgagaaagctttggaaagacccattctttacagcaattggttatctaaggattatgtacctgttggaagagaacaactaagagaatatgtaaaggccagactaaaagttttctacgaagaagagcttgatgttcctttggtgctgttcgatgaggtgttggaccatgttttaaggattgacagaatattcaggcaacctcaaggtcacttactacttatcggagtttctggtgctggaaaaacaactctgtccagattcgtagcttggatgaatggtttatctatattccaaattaaagtacacaacaaatacacagcggaagatttcgatgaagatctaagatctgttttgagaaggagtggatgcaaacacgaaaagattgctttcattttggacgagtccaatatgttagattccagtttcttggaaagaatgaacactttactagctaatggtgaagttcctggactttttgagggggatgaatatacaactcttatgacccagtgtaaggaaggtgcccaaagggaaggtttaatgttggattccaatgacgaattatacaaatggtttacacaacaagtaatgcgtaatttgcatgttgtcttcactatgaatccttctaccgatggtctgaaagatagggccgccacttctccagctttgttcaacaggtgcgtcttgaactggttcggtgactggtcagatggagctctcttccaggttggtaaagaattcacgaaccgtttggaccttgaaaaacaaagttggagatgtccagacttcttcccggctgcttgcaatcacatttcagcgtctcccactcatagagaagccgtcataaatgcctgtgtatatgtacatcagactcttcacaaagccaacagcagattggtcaagagaggaagccgtaccatggcgattactccaagacattacttagattttattcatcatctcgttaaactgtacaatgagaaacgctcagatctcgaggagcagcagttgcatttgaatgttggtctgaataagatcgccgaaactgtagaacaggttgaagaaatgcaaaagagtttggccgtcaaatctcaggagctacaggccaaaaatgaagctgccaacgctaaactcaggcagatggtgaaggatcaacaagaagctgaaaagaagaaggtacagagtcaagagattcagcagcagttggctgaacaaacaattcacattgagcagaaacggtcagaagtaatggctgatctagaacaggtcgaacctgccgttattgaagcccaactagncaccatctcgttaaactgtacaatgagaaacgctcagatctggaggagcagcagttgcatttga

SEQ ID NO: 249 - DNA, 1317 bp, Diabrotica undecimpunctata
gtgacacaacctttgggtgatatactagtatttttgactggacaagacgagatagaaacatgccaggagcttttacaagataaagttcgtaggctagggtcaaaagttaaagaattgcttatattgccattatatgcaaacttacccagcgatatgcaaggtaaaatttttgaacagacgcctcctggtgctagaaaagttgttttggccacaaatatagctgaaacgtctttaacaatagacaatattatatacgtaatagatcctggttttgctaaacaaaatcatttcaattcgagaacagggatggagagtttgatggtagtaccaatatctaaagcttctgcaaaccagagagctggcagagcaggcagagtagcagctggaaaatgttttagattatacactgcttggtcttataaacatgagctagaagacaatactgtacctgagatccagcgaataaatttaggaaacgctgtactcatgttgaaggcactaggaataaatgacttggtacattttgattttttggatcctcctcctcatgagactttagtgttagcattagaacaattatacgctttgggagctttaaatcatcacggagaattgaccaaattgggcagaaggatggctgagttacctgtagatccaatgatggcgaaaatgattttagcttcggaaaaatataaatgctctgaagaaatagtgaccataggagccatgttatctgtaaacggagccatattttacagaccaaaggataaaataattcacgctgatactgctcgaaaaaatttcaatcacttagcaggagatcatttaagtcttcttaatgtttataatcaatggagggattctgattactccctacaatggtgttacgaaaattttatacaatacagatcaatgaagcgagcccgcgatgtcagggaacagctggttaatttgatgacaagagtagaaatagaaattgtttccaacgtttctgaaaccgtggacatccgcaaggctatcacttccggttatttctaccacatagctagattttccaaaggtggaagttacaagacggtgaagcacaaccagagtgtcaccattcatcctaacagtgcactttttgaatctttgccgaggtgggttctctaccacgaattagtttttacttcaaaggagtttatgaggcaagtaatagagatcgagagtaaatggttgttggaagtagctccacattattataagcaaaaggaattagaagattcgacaaataaaaagatgcctaaaacggtaggcaggagtaccagaactgattag

SEQ ID NO: 250 - DNA, 1371 bp, Diabrotica undecimpunctata
atgaaggtagaggaggtgaaaagtactgtaaaaacccaaagaataagtgctcacagtcatattaaaggtttaggtttagatgaagcaggttttgcaattccatcagctgccggcttggttggacaagaacaggcaagggaggcggctggcatagtagtggacatgataaaaagtaaaaaaatggctggaagggctgtacttctagctggcccaccaggtactggtaaaacagcaattgcacttgcaatagcccaagagttgggaaataaagtacctttttgcccaatggtaggatctgaagtgtacagttctgaaataaagaagactgaagttcttatggagaattttcgaagagcaattggtttgagaattagggaaaccaaagaagtttatgagggggaagtcagtgaattgacaccagtagaaacagagaaccctgctggaggttacggaaaaactgtaagtcatgttatcattgggctaagaactgcaaagggtagtaaacagctcaaactggatcccagtatatatgaagcactccaaaaagagaaagttgaagttggagacgtcatttatattgaagccacaagtggtgcagttaaaagacaaggaagatctgatgcctatgccaccgaatttgatttagaagctgaagaatatgtaccattaccaaaaggagatgtacataaaaagaaggaagttattcaggacgttacattacatgatctagatgccgctaatgctaaacctcaaggtggacaagacgttctgtcaatgatgggccaacttctaaaaccaaagaaaacagaaatcacagataaacttagaaaggaaatcaataaaatagtagataaatatattgatcaaggtattgcagaattagttcctggtgtactatttatcgatgaagtacacatgttggatatagaaacattcacttatctacacagagctttagaaagtgccatagctcccattgttatttttgcaacgaatagaggtcgttgtctaattagaggaacggacgatgttttttctccacatggtattcctttagatctgttagataggctgttgattattcggacaattccttacggtagaagtgacatggaacaaatattgaagctaagagctaccacagaaggcttagaaattgatcatgaagcaatcacatcgttaggtgaaattggggcaaaagcaactttaagatatgccgttcagttattaacgccagcacatctaacggcaaaaattaacggaagaaataatatacttcaaagtgacattgaagaagttggttccttattcttagatgctaaagcttcagcgaaagttttatctgaaaataaagagaagtttatgacgtaa

SEQ ID NO: 251 - DNA, 2199 bp, Diabrotica undecimpunctata
atgacttctattataaaacttcaagctttgtcaggagccaaagatgaatctcccccatgctatattcttcaaatagatgaagtgcgaatacttttagattgtgggtgggacgaaaaatttgacatggaatttattaaggaaataaaaaggcatgttcataatatagatgctgtattactgtcttatccagatatttatcatttgggagcactcccctatgtagttggaaaactgggtttaaattgcccaatttatgcaactatacctgtatacaaaatgggacagatgtttatgtatgatttatatcaatctcagtataatatgaaagaattttgtattttttcactggatgatgttgatgctacatttgaaaaaattattcaattaaaatacaatcaaaatgtaccattaaaaggtaaaggttatggtttaacaattacacccttaccagctggtcatatgattgggggtacaatatggaaaataatgaaaatggaagaagatataatatattgtaatgatttcaatcataagaaagagcgacatttaaatggttgtgagctcgatagactgcaaaaaccttccttacttattactgatgcatttaatgctacttatcaacaagccagaagaagggctagggatgaaaaactaatgactaatattcttcaaactcttcgtaacaatggtaacgtacttatagcagtagacacggcaggcagggttctggagttggctcacatgttggatcagctatggcgtaacaaagaatctggcctgttagcatactccttagcgttgttaaacaatgtcagttataacgttatagaatttgccaaatcccagatagaatggatgagtgataaattaatgagaagttttgaaggcgccagaaataatccctttcaatttaagcacttgcagtggtgtcacagtttagcagaattaagtaaagttcctagtccaaaggttgttcttgcaagttcacccgatttggaaagtggattctccagagaattgttcttgcagtggtgttctaattccaacaacagtattatattaacaacaagaacatcccctggtactttagctagagacttaattgataacggagcagaaagaaatatagatttaacggtagaaaggcgagtaaaactcgaaggtgtagaacttgaagaatatgaaaaacgacaacgagcgcgaggtcacaatgtagaaaaggaagatgcagattcggactctgattctgacatagaaatgtctgttatcaccaaaggtagacacgacatagttattaaacaagagggaaaaataaatgccggtttctttaaggtcacgaaaaaaatgtaccccatgtatcctttccatgaagaaaaaattaagagcgatgaatatggagaaattataaaacctgaaaattacaaattggcagatgtgactggagaaggagaagacaataaagaaaatgtattgataaaaaaggaaatagaggaagaaatcactgaaatacatgaacagccaacaaaatgcatagtacttcagagaactgtacaagttaattgtcaggtacattacatcgattttgagggtcgctctgatggagaatcccttatgaaaattttgtcgcagctcaaacctcgaagagtaatagtcgttagaggtaccgaggaaaatacatctgtcatagcaaaacattgcgaaggtataaaagccagagtttttactccatctcgaggggaaattgttgatgctacaagcgaaacacatatttaccaagttaggttaacagatgcactagtctcacagttaaggttccaaaaagccaaagaagcagaggtagcttggattacagcgaacgtagttcttaaagagagtcaagcagacgctaagcgtgtttatgttgatgatgaaccaatggaagttgaagatgtggacacaaggattttgacgctggaacctgtacttgaaggagattgtcatgatccagtttttataaacgagttaaaattatctgaatttaaacaagttttaggaagacaaaacattacttcagaattttcaggcggtgtcctgtggtgttccaatggaacaatagccgtaaggagagtggagtctggaaagattatgctggaaggctgtatatctgaagattattatagaattaaggatttattatatgagcagtatgctatattgtaa

SEQ ID NO: 252 - DNA, 2286 bp, Diabrotica undecimpunctata
atggctcctttagagtcaactaataacaacggcaatgaggaacctggtccaataaatccaattgtgggaatcatttatccaccaccagaggtgagaaatattgtcgacaaaactgcaagttttgttgctagaaatggtccagaatttgaagctcgtattagacaaaatgagttaggaaaccctaagtttaattttttaaacagtggggatccttaccattcttactatcaacataaagttaaagactttagggaaggaaaaggacaagatcctgcctctggattaactcaagccgtctcaaaactttctgttactgcatcagctcaacagaaacagcaggagattttaaagcaggtagaacagccctttatacctaaggaaacacctgcagaatttgaatttatagctgatccaccatcaatttcagctctagatttagatattgttaagcttacagctcagtttgtagctagaaatggtagagcttttctgacacaattgatgaatagagaacaaagaaatctacagtttgattttttgaggcctcaacactcattatttcaatacttcaccaaattactggaacaatatacaaaggttcttattcccccaaaaagtatgcatgagagcctgcgaaatgaggctaatagtccgaaaaatgtattagagcaagtcaaatatcgtgcagaatggttgaagtatcaagagcaacaaaaagctaaggaagaggaacttttagaacgagaacgggttgcctatgcacaaattgactggcatgagtttgtagtcgtcgaaactgttgactaccaacccttcgaaattggaaattttccagctccaactacccctgaagaagtcggagcccgtatcttaattcaagagagaatagaagaaggtgaagatatcgaaatgcaactagagagtgatgaggaagaatcaccagttacggaatctggtttaagtagtatgcaggacaagaccaatcggaagacacgcgacgacaccagaattcaagacatggaagaagaaagttccgatgaagagaaaggagaagacgacgaggaattagttttacctccgccaccaccgtctattcaaccaccgttaccccctattcccgataaagttgtcgtgaaaaaatatgatcccaaacaagctgtcaatgttagccgaccaacaatcggagatgattatctcgtgtcacccatcactggagagaaaatacctgcgaacaaagtgcaagaacatatgcgtattggtctgttggatccgcgttgggtagagcagcgcgacaaacaaataacggacaaaatgaaccaagaaacagtatatgctgctggtagtgccatcgatgcttcattgaaactgctcgccgagcgacgtactgatatttttggtgttggagatgaagaaacagctattggtaagaagattggcgaagaagatgttagaaaagacgagaaggtaacttgggatgggcatacgagcagcgttgaagccgctacaagagctgctagagctaatatcaccttggaggaacaaattcatcaaatacacaaggtaaagggtttgcttcctgatgaagagaaagagaaaatcggcccaaagaatattggttcaaaatctggtaaaatcaacatacaaagcgtaattactacgaagccacctactgcacttcctccaaaaccgccagtctctttaattcaaactcaagcaactgcgtcgctgatatcagtacctccacaacctatgctaccacctcaacctcctattatgatgatgtcagcgacatctatgcctccaattagaccacctccaataatgatgacaggacctccaccaatacctggttttcccgtagcaccaatgtcctcacctatgggtccgcctatgaatctgcccccaataaaacatcaggcggacgcgcctcacgaagatgaaccgagtaacaaaaagatgagaaacgaagattcgcttatacccgaaaaagtctttttagcaagacatcaaagccaagtggctattaagatttcgattcctcatatgccagaaaaatctgaatggaagctgacaggtaaaatgatttcgtggactgtaccgcttgccgaatctgtagcgaatttgaaggcgaaactgcaagaagaaactaatatgcctccagctaaacagaagctcttttttgatggtatgttctttaaggattctaacagtttagcatactacaacgtgactactggttcaatcattcagctacagattaaggagagaggaggaaggaaaaaataa

SEQ ID NO: 253 - DNA, 969 bp, Diabrotica undecimpunctata
atgccgagtcaagaattaacaactaataaagtaatagtccatcctttggtccttctaagtgtagtagaccattttaatcggatgggcaaaatcggcaatcaaaagcgtgttgttggtgttcttcttggttgttggcgtgctaaaggagttttagatgtttctaacagttttgcagttccctttgatgaagatgacaaagataaatctgtttggttcttggaccatgattatttagaaaatatgtatggaatgtttaaaaaagttaatgctagggaacgagtagtgggttggtaccacactggccccaaactgcatcaaaatgatattgccattaatgagttaatcagaagatattgtccaaattcagttctagttattatagatgctaaaccaaaagatttaggtttaccgactgaggcttatcaagctgtagaagaagtacatgatgatggttcacctacttctaaaacatttgagcatgttcctagtgaaattggagctgaagaggcagaagaagttggtgttgaacacttattgagagatattaaagatacaactgttggcactttgtctcagagaataacaaatcagcttttaggattaaaaggtctccattcacagttacgtgatattagggactatttagtacaagtttgtgctaaccaacttccaattaatcaccaaatcatctatcaattacaagatatatttaatcttttaccagatataaatcaggatgcatttaatacatcgttttatgttaaaaataatgatcaaatgttagttgtttatctggcagctttagttagatctattgttgctctacataatcttattaacaacaaactaacaaatagagatgcagaagaaggaaaaaaggaagatagtaagaaagatagcaaagataaggacaaagataaagagaaggaaaaggataaggatgccaagaaggatgaaaagaaaaagtaa

SEQ ID NO: 254 - DNA, 1656 bp, Diabrotica undecimpunctata
atgtttggtggaggacgtgcccctattttggtgttaagtcaaaataccaaacgagaatccggccgaaaagttcagctggaaaacatcaatgccggaaagcaaatcgcggatgtgataaggacatgccttggtcctcaagctatgttaaaaatgcttatggatccaatgggaggtattgtgatgactaatgatggcaatgctattttacgtgaaattacagtacaacatccagctgctaaaagtatgattgaaattgcaagaacacaagatgaagaagttggagatggtactacctcagtaattgtcttagcaggagaaatgttagtggcagctgaacagtttttggaacaacacattcacccaacaatcataattcgccagtacagacaagcacttgaagatatgatccagttattggaaggtccattgagtataccagtcgatagaaatgataaaaatgctcttgcacaagttgttaaaggctgcattggtacaaaattcataagtaaatggtcagatttagcagtaaatattgctttagatgcagtaaacacagtattattagaagaaaatggcagaactgaagttgatatcaagaggtatgccaaagttgagaagattcctggaggatctattgaagagtctaaaattttaaaaggtgttatgcttaataaagatgtaacacatcccaaaatgaaaagatatatacagaatccgagaataatacttttggattgcgcattagaatataaaaaaggggaatctcagacaaatgtagaaatcacgggagacacagacttcaccaaactattagaactggaagaggagcacgttaagcgtcaatgcgatgacataatcgcactcaaacccgacgtcgtcttcacagaaaaaggagtgtccgatttggcgcaacactttttgctgaaagccggtattaccgctatcagacgtgtacgaaaatctgataataacagaattgccagagcctgcggagccacgattgttaacagaactgaagagttacaagaaagcgatgttggtttaggagctggactcttcgaaatcaagaaaattggggatgagtatttctgctttgtggttgaatgcaaaaatccaaaggcgtgtacaattttactcagaggtgccagtaaagacattctcaacgaaactgaaaggaatctacaagacgctctacaagtcgccagaaatattatcctatctccccgtttagtgcccggaggtggcgccatagaaatggccgtagctcaacgtttgatgcagaaggcgacgcacggaccttatagagctcttgcacacgctttagaaattattccaaaaactcttactcagaactgcggagctaacaccatcagaacgttaactgctttgagagcgaaacacgccaaccacacagacgttaacaaaccatgcctttggggtatcgatggcgaaactggagaactcgtggagatggacaagaaagaattgtgggagcctctagctgtcaaactacaaacatacaaaaccgctatagaaactgccattctcttacttcgcatcgacggcatcgtatctggctccaaaaagaaggggggcaacgaaccaccgactcctagccaaatgcaacagcaagaagctagaggagatgctgaataa

SEQ ID NO: 255 - DNA, 702 bp, Diabrotica undecimpunctata
atgatgcaaaccgccaataatgtatattatcccgattattccactgctccaatgcaacgtcaaattaatccttatgccgacaatggagggagtgtagtagcaatagcaggtgaagactttgtaataattggtgcagatacacgtttgagtgctggattttccatttacactagagaacaaaacaaactattcccgctatcaggcactacagttttaggctgtgcaggatgttggtgtgatactctaacattaaccagaatccttaaatctcgcatgcagatgtaccaacaagagcataacaaaacaatgtctacaactgcatgtgcccaaatgttgtcaaccatgctctactacaagagattctttccttattatatatcaaacattcttgttggtttagataatgaaggaaagggctgtgtttacagctatgatccaatcggacattgtgaaaaagctacttatagagcaggtggttcggctggagctctgctccaaccccttttggacaatcagattggacaaaagaacatgcttaaaacatctggagaacctcttagtcaggagaaagctttggctacactgaaagatgtatttatttctgctgctgaaagagatatctacactggagatagtgtacttataaatattattactaaagatggagtaaaggaagagtccttccagttgagaagggattag

SEQ ID NO: 256 - DNA, 897 bp, Diabrotica undecimpunctata
atgttccaatttggattcaacatgtttcctgagattcccaggccttttaacatgacttataagtgctactcagtggctatgtttcctggcaatgaacgagaagacgttgaaaggggtggaaaaattatcatgcccccatcagctttggaacaattgactaggttaaatatcaactatcctatgttgtttaagcttgtgaataaaaagactcatcgcacaacacattgtggagttttagaatttgttgctgatgaaggaaaagtttatttgccactttggatgatgaacaacttagtactcactgaaggagatttggttcagatggaaagtgtttcccttccagttggcacattttcaaaattccaacctctcaatccagacttcttggacattactaatcctaaggcagtcttagaaaatggtttaagatcttttgcttgccttacaacaggagatgtcattgcagtaaagtacaatcaaaaggcttatgagttgtgtgttctagaaaccaaacctggagatgcaattagcatcattgaatgtgatatgaatgtggaatttgctgctcctgttggatacaaagaacccgaacaagtcaaaaaggaagaagaagaaatggccatagatcctgcagatttaatgccagaaccttctggatttgtagcatttagaggtgcaggaaatcgacttgatggcaaaaagcgtaaagatacttccggagctgatagttcagtggctaaaccaacttatgtgagaggaattccagattatgattaccaaataggcaacttaacattcatcaggagaatgatcaagcagaaatctaatgataatacagaggacagcgagttcaaagcatttagtggagcaggatttagtttaaaatcaagaacataa

SEQ ID NO: 257 - DNA, 1113 bp, Diabrotica undecimpunctata
atgaccacactgggatctaaaatcattaacaaatgtcataaacagatggcagaaatagctgttaatgctgttttagctgttgcagatttagaacagaaagatgttaattttgaacttattaaagttgaaggaaaggttggtggaaaattggaagacacaacattagttaaaggtgtagttattgacaaaacaatgtcccatccacaaatgcccaaagaactaaaagatgtaaaattggctattctcacctgtccatttgaaccaccaaaaccaaagaccaaacataagttggatgtaagcagtgtggaagattataaggaactaagacagtatgaacatgataagttcaaggaaatagttggattagtaaagaaagctggagctacattagcaatttgccaatggggcttcgatgatgaagccaatcatttattgttacaacaagagttaccagctgtaagatgggttggaggtccagaaattgaacttatagccatagctactggcggtaggatagtaccccgttttgaagagcttactccagaaaaacttggttatgctggtttggtacgggaaattgcatttggcaccactaaagatagaatgttggttattgaagaatgttcaaattcacgggcagttacaattcttgttagaggaggtaaccaaatgttagtagctgaagccaagagaagtctccatgatgcattatgtgttgtcaggagtttagttcaggaaccaagagtagtgtatggtggtggagcagcagaaattgcctgcagtttggcagtcgcggctcaagcagatcaactagcttccttggaacagtacgcctatcgtgcatttgctgaggctttagaaagtataccacttgctttggctgataacagtggactgtctgccatccatacattaggagaagtgaaggctaaacaagcagctacaggagatccagctctcggtatcgattgtatgaatactggaaacctcaacatgagagaacaacatgttatcgaatcactcagatcaaagaggcaacaatttttgttggctacccagttggttaaaatgatattgaaaattgatgatgtacgccaacctgcatcgggataa

SEQ ID NO: 258 - DNA, 342 bp, Diabrotica undecimpunctata
atggcttctgctatggatgttgatgccgaagaagtagaattgcccacttccagtagctcaaaaggagaaaagaaacgttttgaagtaaaaaagtggaatgctgtagctttgtgggcctgggacattgtagtggataactgtgccatttgccgaaatcatattatggatctatgtattgaatgccaggcgaaccaggcgtcagccaccagtgaagaatgcactgtagcttggggtgtttgtaatcatgcgtttcacttccactgcatatctagatggttaaaaactagacaagtatgtcctttagataatagagaatgggagtttcagaagtatggacattag

SEQ ID NO: 259 - DNA, 1605 bp, Diabrotica undecimpunctata
atggtatccctaaatcccgtaagaattctcaagcaagaagccgaagaagaaagggcagagattgcccgactgagtagttttgtgggtgctatagctataggagatttggttaggagcaccttgggaccaaaaggaatggataaaattttagtatccagtggtagatctgcaggatcagttgaagttactaatgatggagcaactattctaaaatcggtgggtgttgataatcctgctgctaaaattttggtagatatgtcaaaagtccaggatgatgaagtaggagatggcacaacatcagtgacagtattagcatctgaactacttaaagaagcagaaaaacttgtagaacagaaaatccacccacaaacaatcattgcaggttggagaaaagcagtagatattgccagaaaagctcttctagacactgccaaagacaacagctctgatttagaaaagttcagagaagatctgatgaacattgccagaactacactcagctcaaagattctgtcacaacataaagaacattttgccaaactggcagtagatgctgtgttaagattgaaaggttcaggtgatttacagtctatccagctaattaagaaaactggtggtaccttggaagaatcctttttggatgaaggtttcttattggacaaaaaacctggtgtacatcaaccaaagagagtagaaaatgcaaaaatcctgatagccaacactcctatggacacagataaaatcaaagtatttggttctcacattaaggtagattcaatggctaaaattgcagagctggaatctgcagaaaaggaaaaaatgaaagataaagtcaacaaaattcttaaacataatgctaatgtatttattaatagacagttgatttacaattatcctgaacaactatttgctgatgcaggagttatggctattgaacatgcagattttgatggaattgaaaggctagcacttgtcacaggaggagagattgtctcaacatttgaccatccagaattggtaaaactaggaacttgtaagcttattgaacaaatcatgattggagaagatatcctgctccgtttcagtggtgttgctcttggagaagcttgcacaattgtcatcagaggtgctacacaacagatcattgatgaagctgaccgatccattcatgatgctttgtgtgtattagcagccacagtcaaagagagtcgaattgtgtatggaggaggttgcagtgaaaccctaatgtccacagcggtatctagagctgctgctaacactccaggaaaagaagctgtagcaatggaagcctttgccagagccttgttgcagttgcccacaattattgcagacaacgcaggttatgactctgctcaattggtcagtgagcttaaggcagcacataacagtagccagagcaccatgggacttaacatggagaagggtgaattgggagatatgaaaaccttgggaatcacagaatcttttgttgttaaaagacaagtattagtctcggcatctgaagcagctgaaatgatcttgcgtgttgataatatcatcaaagctgcaccaaggaggagaacagaagacaggggaatgtgctag

SEQ ID NO: 260 - DNA, 789 bp, Diabrotica undecimpunctata
  misc_feature (412)..(412): n is a, c, g, or t
  misc_feature (777)..(777): n is a, c, g, or t
atgtttcgaaaccaatacgacagcgatgtgacagtgtggagcccccagggtcgtctgcatcaggtagaatatgccatggaagcagttaacctaggttcagccacagttggactaaaaagtaaaactcatgctgtacttattgcgttgaagagggcttcttcagaactgtctgcctaccaaaagaaaattatcaatatagacgatcacattggtattaccatctctggacttacagcagatgctagaattcttagtagatatatgcgaaacgaatgcttgaattataagtactctttggatacttatatgccgttaaataggctcattagtattttaggcaacaaaatgcaaacatgtacccaaagatatgaccgcaggccattcggtgtgggtcttctagtagctggttatntgcgaaacgaatgcttgaattataagtactctttggatacttatatgccgttaaataggcttattagtattttaggcaacaaaatgcaaacatgtacccaaagatatgaccgcaggccattcggtgtgggtcttctagtagctggttatgatgaatctggttcccatatctaccaaacgtgcccttctgctaatttctacgattgcaaagctatgtccattggagctcgatcccagagtgccaggacttacttagaaaaacatctcgatgaactgccatccagtgctttagaagaacttatcaaacatggattgagggctcttagagatactctacctcctgaggttgacctcacaaccaaaaanatgtctccatag

SEQ ID NO: 261 - DNA, 2550 bp, Diabrotica undecimpunctata
atgccgataaagcctggaaatgaaacggaaaatatggaaataaccttttgtgatgaagatctcccatatgaagaagaaattttaagaaacccttattcagttaaacactggttaagatatatagaccacaaaaagacagcaccaaataatggcgtcaatataatctttgaaagagctctaaaggaattaccaggatcctacaaattatggtataattatttaagaactagaagaaaccaaataaagagtaaatgtataacagacccaggttatgaagaagtgaataatgcatttgaaaggtcattagtgtttatgcacaagatgcctagaatatggatggattattgcacattcttaacagatcagtgtaaaataactaggacaagaaaagtatttgacagggctttgagggcattaccagtgacccagcataacagaatttggcccttgtatttaaaatttgttcagaaacatgatattccagaaactgcagtaagagtatttcgaagatatatgaaattatgtccagaaaatgcagaagaatttatagattacctcacaggtattgaaaggctagatgaagcagctcagctgatggcaaagattgtgaatgatgagggttttgtttctcaacaaggaaaatcaaaacatcagttgtggaatgaattgtgtgaattgatctcaaaaaatccggaaaaggtacattctctaaatgtagatgccattattaggggtggtttgaggagatatactgatcaactgggtcacctatggaattctctagccaactactatgttcgcagtggtctatttgaaagagctcgtgatatatatgaagaagctatccaaacagtgaccactgttagggacttcacccaagtctttgatgcttatgcccaatttgaggaactaagtttaagcaagagaatggaagaagttgctaacaagtctagtcctactgaagatgatgatactgaattagaattgagacttgcaaggtatgaatatttgatggaaagaagattattgctgctgaattctgttttgttgagacagaatccacacaatgtgcaggaatggcacaaacgagtacagctttatgaaggaaaaccagtagatataatcaacacttacacagaagctgttcaaactgtagatccaaaactggctgtaggaaaacttcataccttatgggtggactttgccaaattctacgaaacaaatggtcaaatagaagatgctcgcctcatctttgaaaaagcatcccaagtttcttacgtcaaagtagatgatttggcaacagtgtggtgtgaatgggccgaaatggaaataaggaacgagaattatgatgaagctttaagactcatgcataaagcaactgttatgcctagtcgaaaagtagcatatcatgatgacactgaaacagtccaaagtcgtctttataagtctctcaaagtttggtctatgtatgcagatttagaagaaagtttcggtacatttaagtcttgtaaagccatttacgacaaaattatagatttgaagattgcaactccgcaaattattataaattatgggatatttctagaagaaaataattactttgaagaggcattcagagcatatgaaaaaggaatatctctatttaaatggcccaatgtatacgacatatggaacacctatttgacgaaattcctaactcgttatggaggatcaaaactagaacgcgccagagatttgttcgaacaatgcttggatggatgtccacaacagtttgccaaacatctctatctgctttatgcaaaattagaagaggaacacgggatggctagacatgccatggctgtatatgaaaggtcaaccaaagctgttccagagcaagaaatgttcgatgtttttaatatctacatcaaacgagccgccgaaatttatgggattcccaaaacgaggcagatctacgaaaaggctatcgagttacttccagaggacaaaactagagaaatgtgtctaagatttgctgatatggaaacaaaacttggtgaaattgatagagccagggctatatatgctcactgtagccaaatttgcgatccgaggataacggcagagttttggcagatttggaaagagttcgaagttcgtcatggtaatgaagataccatgcgagaaatgttgagaataaaacgtagcgtacaagctgtgtacaacacacaggtgaacatgatgtcagcccaaatgttgagttccgcgggcagcatgagcggtacagtagcggatttggcgccgggggttaaagacggtatgagacttttagaagccaaagctgttgaaatggctggaacttcacaactcgctaaaccgggaggtattatgtttgttaggggagaaactcaaggagctaataaagataaggttgttaatcctgacgaaattgatatagacagtgaagaatctgaagcagaagaggaagaagtaccagtcgaaaagcagagcgtaccatcagaagtttttggaagtcttaagaaacaaggagaggaagacgatgacgattag

SEQ ID NO: 262 - DNA, 1167 bp, Diabrotica undecimpunctata
atggccaacggacctatagcagaaagaaatcgagatgccactatttatgtgggaggcctagatgataaagtttcggagtccctattgtgggagctctttgtacaagcagggcctttagtcaatgtacatatgcccaaagatcgagtaacgacaatgcaccagggctatgggtttgtagaatttatgggagaggaggatgcagattatgctattaaaattatgaacatgataaaattgtatgggaagcctataagagtaaacaaagcttcagctcatcagaaaaatttggatgtaggggctaatatttttattggaaatttagacccagaagtagacgaaaagttactctacgatactttttcggcgtttggagtaatattacaaacacctaagattatgagagatcctgatactggtaactccaaagggttcgctttcatcaattttgcaagttttgaagcatcagatgcctctatcgaagccatgaatggccaatatttgtgcaatagacccatatcagtgtcatatgcattcaagaaagactccaaaggagagagacatggttctgcagctgaacgtctccttgctgctcagaatccattatcacaggctgataggcctcatcaactgtttgctgatgcacctccaataggtttgatgcccatgtcaatggccccacctcctccaccagtcataatgacaggaatgatgcccccgccacctccaacactttcaaacttgccaccacctcctcctcctgtaccaccaccaagttctttcccaccaggaataccacctcctccattacctccctcccaaccacccttaccacctggtgcacccccaacaatgccaactgcagcaggaggccaagccagaccccctctaccacctcctccagtggcacctcatggactgatacctccacctccaacatggacaggtgcagctcctgggagcttgcccattcctccaggtccacctactcctgctggaagtgcttcatttggaggaatgtttccacctcctccaccccctggaggaagaccaccaccgcctaactggaggccacctcctccaccaccaccaggttttgcaggaaatagaccagctttcccaccgaggggacctccaccacccccacccacttttgatactaaaatttga

SEQ ID NO: 263 - DNA, 774 bp, Diabrotica undecimpunctata
atgggtcgtgtaattcgtgcacaacgtaaaggtgcgggatctgtattcaagtcccacacaaaaaagaggaaaggagcacccaaacttcgttatttagatttctcagaaagacatggttacattaagggtgttgtaaaagatatcatacatgaccctggccgtggtgctccattggcagtagtacatttcagagatccctacaagttccaaaccaggaaggaattatttattgctcctgaaggaatgtatactggacaatttttgtactgtggaaaaaaagctaacctccaaattggaaatgtattgcctgtaggaactatgcctgaaggtaccattgtatgcaatttagaagaaaaaactggtgaccgtggtcggttagctcgtgcatctggaaactatgctactgtaattgcccataatcatgatacaaagaaaaccagagttaagttgccctctggagccaagaaagttattccatcaaacaatagggctatggttggtattgttgctggaggtggtcgtattgacaaaccaatcttgaaagcaggtcgtgcttaccacaaatacaaagttaaacgtaactgctggcctaaggtacgtggtgttgctatgaaccctgttgaacatcctcacggaggtggtaaccatcaacacattggtaaagcatccacagttaaaagaggaacatctgctggtcgtaaagttggtcttatcgctgctaggagaactggtaggattaggggaggcaaagttgatgccaagaaagaagattag

SEQ ID NO: 264 - DNA, 423 bp, Diabrotica undecimpunctata
acgcgagaaataatggcacgtacaaagcaaacagcccgaaaatccactggtggtaaagcaccacgtaaacagttagcaaccaaagctgctcgtaagagtgcgcctgccactggaggagttaaaaaacctcatcgttacaggccaggtaccgtagctcttcgtgaaattagacgttaccagaaaagtactgaattacttatcagaaaactacctttccaacgtcttgttcgtgaaatcgcacaagattttaaaaccgatttacgttttcagagttcggcagttatggctttacaggaagcgagtgaagcatatttggtaggtttgtttgaagataccaatttatgcgctattcacgccaagagagtcactattatgccaaaggacattcagctagccaggagaatcaggggcgaaagggcgtaa

SEQ ID NO: 265 - DNA, 1593 bp, Diabrotica undecimpunctata
atggctattagtttgttaaatcccaaagctgaagtcgctagggctgcacaagccctagccgttaatatatcagctgcaaaaggtattcaagatgtaatgaagtcaaaccttggtcctaaaggaacggtaaaaatgttggtatctggtgccggcgatataaaaataaccaaagatggaaatgttttattgcacgaaatgcaaattcaacaccccacggcctcccttattgctcgagcctcaactgcccaagatgatatgactggcgatggcactacatctacagttttagtcataggtgaactattaaaacaagccgatattttcatagctgaaggtcttcatcctagattgttaacagaaggctttgataaggctagggcaaaagcattggaactactggacaagatgaagattccaattgatgcaaacaaagaaactttgacagatatttgcaggacaagtttaagaacaaagctacatcaaaaacttgctgatgttttgacagacgtttgtgtggatgctgttctagctataaagaaagatgataaacctgttgatcttcatatggttgaattaatggaaatgcaacacaaaacagaaactgatactcagttaattaagggtttggtcctggaccatggctcacgtcatccagatatgcctaaaagtctcaacaattgctacattttaacatgtaatgtcagcatggaatatgaaaaaagtgaagtcaattcaggattcttctacaaaactgcagaagagagggagaaattagtgactgctgagcgtgaattcattgaacagagagttaagaaagtcattgaattgaaaagatcactctgtaatggaactgataagacttttgtcgttattaaccaaaaaggtattgaccccatgagtctggatatgcttgccaaagaaggaatcatagctctcagaagagctaagcgacgtaacatggaacgtctatcattggcttgtggtggagtagctatgaacagctttgatgatctgcaagaatctcaacttggtagagctggacatgtgtacgaacatgtgttgggagaaaataagtatacatttgtggaagattgcaaaatccctcaatcggttaccattttaataaaaggacccaataaacatactttgacacagattaaagatgctgttagagatggattaagggctattaataatgccattgatgacaaagcagttattccaggtgctggtgcatttgaagttacagccaataaagaattgctagcatttaaagacactgttaaaggtaaagctcgtctaggagttgctgcttatgcagaagctttactggtacttcctaagactttggctgttaactctggatttgatgcacaggacaccattgtgaaactacaagaagaatcccgtttgaatccagacccaattggtttagatttaacttctggagaaccgatcaatcctaaagatgctggcatctatgacaactatattgttaaaaaacagataatcaattcctgttcggtcattgccagcaacctcttattggttgatgaaattatgagggctggaatgagcagcttaaagggataa

SEQ ID NO: 266 - DNA, 3120 bp, Diabrotica undecimpunctata
atgtctagtggtagtttagcagacaactccatcgatcctccagccaaaaagcggaagcttgaatcaaagattgctaccctcgaaatggcgaacaatgaagcttcaggatcttctaccggtgatattgatgagggactttactcgagacaactttacgttttagggcacgatgctatgcgccgcatggcaaatagtgatgttctaatatcaggtttgggtggtttgggagtagaagtagctaaaaatgtaattcttggtggtgttaaatctgttacccttcatgatgaggctctttgcactattcaggatttgtcctctcaattttatttaacagaggcggacattggcaaaaaccgcgcagaagcttgctgtaagcagttatctgaacttaacacttatgtccccacaaagtcttatacagggccccttgatgaagatttcatcttaaagttcagtgctgttgtcttaaccacaagcagtcgtgaagaacaattaaggattagcgagataacacatgaaaaaaacattgctttaattatagcagacacaaaaggcctttttgcacaagtattttgtgattttggaaagtcatttactgttgttgatgtaaatggagaacctttagtatctgcaatgatagcagatatttcaaatgatgttgaaagtgtagtcacttgcattgatgatacaaggcatggtatggaggatggagattatgttaccttctcagaagttcagggaatgactgaattaaataactgtgaaccaatcaagatcaaagtattaggaccatacacctttagtattggtgatactaccaaattttctaaatacactagaggtggtattgtaagtcaagttaaaatgcctaaacatctggaatttaaatcatttaaagattctcttgaaaatcctgaaataccgattactgatttttcaaaaatggattttcctgggcagcttcatttagctttcaccaccttacataaatttgtagagaagactggaaggctacctaaaccatggaacaacgaagatgctacagaatttgttaatttagcaaaatcattagctgcaaagggtgattctgatggagaagttaattcagacctcttagaaacatttgccaaggtatcagctggagatttgaatcccataaatgccaccattggtggtattgtagcccaagaagtaatgaaggcatgttctggaaaattccatcctattttccaatggttctactatgatgccatagaatgcttaccacaagacaaatcagaaatcactgaagaattagctgccccgactggaagtagatatgatggccaagttgctgtttttggaaaagaattccaaaataagatagcatcattgaaatattttattgttggtgctggagctattggttgtgaattgttaaagaactttgctatgatgggtgtaggaactcaaggagaagttacagttactgacatggatttaattgaaaaatctaatttgaacaggcagttcctcttcagaccacataacgtccaacaaccaaaatctgtcacagctgcaaaggtcattaaaaagatgaatcccgatatcaatgttgttgcacatgagaatcgtgttggacctgaaactgaaaatgtctacaatgatgatttctttgaaaagttagatggagttgctaatgcactcgataatgtagatgctaggatttatatggacagaagatgtgtttactaccgcaagcctcttctagagtctggaactctaggaactaagggaaacactcaagtggtggcgccttttctctctgaatcatatagttcttctcaagatcccccagagaaaagcattccaatctgtaccttaaagaatttccctaatgctattgagcatactctacaatgggcgagagatatgtttgaaggattatttaaacaaaatgctgaaaatgcttcgttgtatataaccgaccccgattttcttgatagaactgttaaactacctggtgtacaacctttggaggtactggaatctgtaaaggctgccttagttgatgagagacctaaagatttaaatgattgcattgcatgggcacgtaatcattggcaagaacagtattccaaccaaatcaggcagttgttgttcaacttcccacctgatcaattaaccagtacaggccagttgttctggtctggaccaaaaagatgtccagaagcgctaacatttgatgtaaatgatccgctacacttggattatgttatagcagcagctaatttgaaggctgaagtttatggtataccaactagtagaaatagagaacaaattgcagaagttgttaagcaagtcaatgttccagaatttatccctaaatctggcgtaaagatagcagttaccgattctcaaatggcaatgaatggtaataatgtggatttggatcgcgtttcccaaattaaagaagaactgccctcagtagcagaactaggtggactacgtcttactcctttagaatttgaaaaggatgatgacaccaatttccacatggacttcatagtggctgcttcaaatctacgtgcagctaattacaaaataccacctgctgatagacataaatcaaaacttattgctggtaagattattcccgcgatagcaacaacaacctcagttgtcgctggaatggtttgcttggaactctacaaactcgccagaagtgttacatcgttagctccattcaaaaataatttcataaaccttgctctgcctttcttcagttgctcagaaccaatagcagcccaacaaatggaatattgtggtaacaaatggacactctgggatcgcttcgatgttcaaggagaaatgacacttagtgaatttttggaatatttcaaagagaaacatggtcttgaaattacgatgttgtcccaaggcgtttgtatgctgtattcattctttatggcaaaagctaaagcccaagagcgttttggtctttcaatgtcagaagtcgtcagacgggtatcaaagaagaaaattgaacctcacgtaaaagcattagtatttgaactgtgttgcaacgattctactggcgaagacgtggaagttccttatgttaaatacaatttatgttga

SEQ ID NO: 267 - DNA, 762 bp, Diabrotica undecimpunctata
agaattttagcattggtcagatctaaaaaactaaatctcaaacatctaaagcattttattttggatgaatgtgataaaatgttggagttattagatatgagacgtgatgttcaggaaatatatcgtaacactccccatgaaaaacaagtcatgatgttcagtgccaccttaagtaaagaaattagaccagtttgcaagaaatttatgcaagatcccatggaagtatatgttgacgatgaagctaaattaacattgcatggtctacaacaacattatgtaaaactaaaagaaaatgaaaagaataaaaagttatttgagttactagatgttttggaattcaaccaggttgttattttcgtaaaatccgtacaaaggtgtgtggcgctggcacaactactgactgaacaaaactttccagcaataggaatccacagaggaatggatcaaaaagaaagactgtcccggtatgaacaattcaaggatttccaaaagagaattctagtagccactaacttatttggacgtggtatggatatcgaaagagtgaacattgtcttcaactatgatatgcccgaggattccgacacttacctgcacagagtggcgcgagctggtcgtttcggtaccaaaggtctagccattaccttcgtatcagaagagggggatgccaaaatattgaatgaagtacaagaacgatttgatgttaatattaccgaattacctgacgaaatagatctcagttcatacattgaaggaagataa

SEQ ID NO: 268 - DNA, 1032 bp, Diabrotica undecimpunctata
atgaataaaataactaatcaaaacagacgtactatagatcatattgctgccaagtgttatttctatcattcaagggttgccgaattaaccgataaattggattcaattagaggctttttacattctcgtctacgtactgctacactcaggaatgattttgaaggtcaagctgtgcttataaattgcctgttgagaaattatttgcattattctttgtatgatcaagccgataaactagtgagtaagtgtgtatttcctgaaactgcaagtaacaatgaatgggcaagattcttgtattacttaggcagaattaaggctgcacgattagaatacagtgtagcacataaacatctcgtgcaggccatgagaaaagcaccccagaatgctgctattggtttcagacagactgttcaaaagctaacagttgtagttgaactattgttaggagatataccagaaagacaggtgtttagacaatctagtatgaggcactcccttgctccatactttcaattaacacaagcagttagaatgggaaatttgcaaagatttggtgaggtgttagagaactttggcccacaatttagacaagatcatacatttacactaattttgagactgcaccacaatgttcttaaaacagctataagatctataggattatcatactccagaatatctccccaagacatagctaagaaactggggctggattcagctgaagatgcagaatttatagtagcaaaagcaatcagagatggggtcatcgaagccacacttgatccacagggcggttttatgaggagcaaagaaagtactgatatctactgcacaaaggaacctcaactggcgtttcatcagagaatatcattttgtttagatttgcacaatcaaagtgtcaaagctatgagatatccccccaaggcttatggaaaagaacttgaatcagctgaagagagaagggaaagagaacagcaggatctggagttggccaaggaaatggctgaagaagatgatgatggtttcccttaa

SEQ ID NO: 269 - DNA, 1668 bp, Diabrotica undecimpunctata
atggctaccaaccaccaaaaccttccaatttcgagtattcttaaatcaaaaagtgaagttgatgatgaaccaaagaaaaaatcaagagaagattggcgtaaagccaaggaacttgaagaagcccgaaaagctggtacagctccggctgcagtcgatgaagaaggaaaagatatcaaccctcatattccacagtacatttctaatgcaccttggtattatggaacatctggacctactcttaaacatcaaagaccccaagaagagaaacagaaggagtactcgagcatcgacgaatggtacaagcgtggtgttgacacttcaaaaatagttactaaatatcgtaaaggtgcatgtgaaaattgtggagctatgactcataaaaagaaagattgtatggaaagacctcgcaaagttggagccaaattttctggagcaaatattgcaccagatgaattcgcccagaaaaacttagcattgagctttgatggaaaaagagatagatggagtgggtatgacccatctgagcacaaagctgtaatagaagagttccagaaagttgaggaagctaaaagacaactgaaggctgacaaattaaatgcaaacgaatcttctgacgacgaagaaaaagatgaggacaaatatgtagatgaagtagatatgcctggtactaaagtagacagcaaacagagaattactgtaagaaatttgaggataagagaagacactgccaaatatttgagaaatcttgatttgggttctgcttattatgatcccaagacgagatcaatgagggaaaaccctaatcctgaaaaagatgctacgtacagtggagagaatttcgttcgttttactggtgatacgaccaatcatgctaaggctcagttatttgcttgggaagcgtatgaaaagggtgtggatgttcatcttttagctgaaccaacaaaattagaactactcaaaaaagaatatgagaaaaagaaagaagaggttaaatcgacaattcaaagcagtgtgttagataagtacggaggacaggaacatttagaggcaccacctaagagcttgttgttggctcaatcagaagtttatgtggaatattcaagatctggtaaagtcattactggggcggaaaaagaagtcattagatccaaatatgaagaagatgtgtacataaataaccacacatcagtgtggggatcgtattggagaggaggacaatgggggtacaaatgttgtcactccttcataaagaattcctattgcctaggcgaggcaggaaaaacggttaacgctcctgtaacgcaagatattccaacggatcaagacgttggtgaagcaagcagtacaaaggaagccgggatatcagatggtgaaagcgaagatagtagttccagtaattcatcagaaggtgagaaactgaaaaagaaacagagaagattaaagaaaaaggaaaagaaggcaaagaaaaaggagaagaaagctaaagaaaagttgaagaaaaaacaggaaaaagaaatggccccagaagtagatgagcaaataatgttggacgataggaaaaggccgtacaacagtatgtttgacgttaagaaacccacagaagaagaaatggaggaatattataaaaggagaaagagggatgaagatcctatgaacaactttatgtaa

SEQ ID NO: 270 - DNA, 627 bp, Diabrotica undecimpunctata
atgggtattagtagagaccattggcataaacggagggccacaggaggcaaaaggaaacctctccgtaagaagaggaagttcgaattaggacgcccagccgcaaataccaagcttggagctcgtagaattcactatgtccgtacacgaggcggtaacttgaaatatcgtgcattgaggattgaaaaaggaaatttcgcatggggcagcgaaggtactgctcgtaaaacacgtattattgatgtcgtttacaatgccagtaataacgaattggtacgtaccaaaacattggtaaaaaatgccatcgttgttattgatgcaacccctttcagacaatggtatgaaaaccactacattttacctttagggcgcaagaagggggcaaaattgacaacagaagatgaagaaattttcaataagaaacgtagtaaaaaagtacagaaaaaatatgaaactaggcaaaaaacagctaaagtagaacctgctctagaagaacaattccaaactggaagattattagcttgcttagcatcaaggccaggacaatgtggtagagctgatggttacgtcttggagggtaaagaactggaattctacattcgtaagattaagtctaagaaagctaaataa

SEQ ID NO: 271 - DNA, 936 bp, Diabrotica undecimpunctata
atggatagacttcttcgactaggaggtggtatgccaggtttaacccaggcaccgccgccttctgatgctcctgttgtggatactgccgaacaagtatacatatcctccttagccctattaaaaatgttaaagcacgggcgtgctggagtacccatggaagtaatgggtcttatgttaggagaattcgtggacgactataccgttcgagtaattgatgtatttgctatgcctcagactggtaccggtgttagtgtagaagctgttgatccagtttttcaagcaaaaatgcttgacatgctaagacagactggtagaccagaaatggttgtgggatggtaccattcacatccaggttttggatgttggttgtcaggagttgatatcaacacccaacaaagttttgaggctctctcagaaagagctgtagcagtagtagttgatccaatacagtcagtgaaaggcaaagttgttattgatgcatttaggttaataaatcctaatatgatggtattgggtcaagagcctcgccaaactacctctaacttgggacatctacagaagccatcagtgcaggctttgattcatggtctaaatcggcattactactccatcagtattaattacagaaaaaatgaattggaacaaaaaatgctactaaatctccataaaaaatcctggatggatggtctaactttagcagattactcagaaaattgtagtgtcaatgaaaagactgttgctgatatgttagaactagccaagaattacaacaaggcattagaagaggaggaaaaaatgactccagaacaacttgctattaaaaatgttggtaaacaagatcctaagaggcatttagaagaaaaggttgatattttgatgaccaataatattgtccagtgcttgggagctatgctagatactgttgtttttaagtaa

SEQ ID NO: 272 - DNA, 1215 bp, Diabrotica undecimpunctata
atgacggtaattaacaagatggaggtagacggaggtccgaagggagaaggttttcggtcgtattatattacaaagattgaagaactgcagcttatagtagctgaaaagagtcaaaatcttagacgtttgcaagctcaaagaaatgaactcaatgctaaagttcgtatgttgagagaagaacttatgttacttcaagagcaaggaagttacgttggagaagttgtaaagcccatggataagaaaaaagtccttgtgaaagttcatccagaaggaaaatttgtagttgacattgacaaaaacatagacataaatgatgttactccaaattgtagagtggccctcagaaatgaatcttacacattgcacaaaatacttccaaataaggttgatcctttagtttccttgatgatggtggagaaagtccctgattcaacttatgaaatggtaggaggacttgacaagcaaattaaagaaatcaaagaagtaattgaacttccagttaaacatccagaactgtttgatgcacttggtattgcacaacctaagggtgtgttgttatatggacccccaggtactggaaaaactcttctggcacgtgctgtagctcatcatacagaatgtacatttattagagtatctggttcagaattggtacagaaattcataggagaaggatcccgtatggtaagagaactattcgtaatggccagagaacatgccccttcaattattttcatggatgaaattgattccattggatcttcccgtattgaatcaggatctggtggtgattctgaagtccaaagaaccatgttggaacttctaaatcaattggatggctttgaagctaccaaaaacattaaagtaattatggctaccaacagaatagatattttggatcctgctttactcagaccaggaagaattgacagaaaaattgaattccccccaccgaatgaggaagcgagattggacatcttaaagattcactccaggaaaatgaaccttacaagaggaataaatcttagaaaaatagctgagttgatgccaggtgctagtggagctgaagttaagggcgtgtgtacggaagctggtatgtatgcactaagagaacgaagagtgcatgttactcaagaagattttgaaatggctgttgccaaagttatgcagaaagattctgagaagaatatgtccatcaagaagttgtggaaatga

SEQ ID NO: 273 - DNA, 600 bp, Diabrotica undecimpunctata
atggtgaaaatatattgtcttagtgttttatataaaggaccaacaactgcgacctggttaaaatctggtttcgagcttcaaagcttcagctttttccaaagagggtcaattcaggagtttatgtcattcttttgcaaaaccatagtggaaagaacaataccagcttcaagacagagtgttaaagaaggagaatatttgtgtcatgtatatgtaagagctgacaacttagctggtgttatgataactgatcatgagtacccatcaagggtttctcacacactaataacaaaagtactagacgaatttgctgccagaattcccgcagctaactggcccaaccttgaggagagagatgtagcatttccacaattaaatacctacttagcaaaatatcaaaatcctagagaagcagatgctatgactaaaattcaagaagatcttgatgaaacgaaaattattttgcataataccatacaagcagttttggaacgaggcgagaaactagatgacttggtgagcaagtcggaaggtttaagcatacagtccaaggcattctacaagacagcgagaaaaacgaatagttgttgtaattttacatag

SEQ ID NO: 274 - DNA, 729 bp, Diabrotica undecimpunctata
atgtttcttacaagaagcgagtacgatagaggagtaaataccttttcacccgaaggaagattgtttcaagtagaatatgccatagaagctattaagttaggatctactgctattggaatatgtaccagtggtggagtagtgcttgctgtagaaaaacgtattacttcccccttaatggaacctactacgattgagaaaattgtagaagttgacaaacatattggatgtgccgtttcaggacttatggcagattcaaggactatgatagatagagctcgtgtggaatgtcagaatcattggtttgtctacaatgaaaatataagtgtagaatcctgtgcacagggagtatcaaatttggctattcagtttggagattctgatgaagatggtgcagccatgtctagacctttcggagtagcaattttgtttgctggtatagatgaaaaaggacctcaattgtaccacatggacccgtcaggaacattcgttcagtttgatgcgaaggcaataggatcaggatccgagggggcacagcaaagtttacaggaggcatatcatcgcagtatgaccctggaagaagctaccacaactgctttaacaattctaaaacaagttatggaagaaaagttgaattcttcaaatgttgaggttatgactatgactccaaaagatatgttccacatgttcacaaaggaacaagtggaagaggtaattgctaaattgtcttaa

SEQ ID NO: 275 - DNA, 1176 bp, Diabrotica undecimpunctata
atgctgatctttttttcacaaattgttgtcgatgccgccaatgctgttaaagttacagattcaaaaggaaatagcatgtatcccataaaggccgtcaatgtcttgaaagctcatggtaaaagcgccagagagagttttctcgtacccggttatgcattgaactgcaccgtcgccagccaagctatgcccaaaaaaattgttaacgctaaaatcgcatgtttagatttttcattgcagaaggctaaaatgaagatgggtgttcaggttttaattactgatccaaatcaactggaagcaatccgtacaagagagctcgacatcaccaaagaacgcatccaaaaaatcctctctactggtgttaatgttattcttgtgagtggtggtatcgatgatctttgcctgaaatacttcgtggaaaatggagcgatgggtgtaagaagagtaaagaaagcagacttaaaacgcattgccaaagcaaccggtgccactttcctaacctctctaagtaacatggaaggagatgagagtttcgattctagcatggtaggagaggcagcggaagttgttcaagacagaatttctgatgatgaattgataatcattaaaggaccaaaagcacgtactgcagcctcaataatcttgcgaggacccaacgatttctattgtgatgaaatggaaagatctgttcatgacgccctgtgtgttgtaaaacgtgtactcgaatcaaaaagcgtcgtagtgggtggaggcagtgtcgaagcagcgctttcgatatatttggaaaactttgccaccacactaagctccagggaacaattggctatcgccgaattcgccaggagtttactggttatccctaaaacgttggcagttaatgcagcgcaggacgctaccgatttagtagctaagttgagagcataccaaaactccagtcaaacgaaaaaggatcatgcgcacttgaaatatgtaggattagatctcatggaaggtaccgttcgagataaccgaaaagcgggagttttggaaccgaccatgtccaaagtaaaatcactgaagtttgcaaccgaagctgccattaccatcttgagaatagacgatatgattaaattggattccgaacaaagaggtggaaagaactaccagcaagcgatggacagtggagaattatatgattaa

SEQ ID NO: 276 - DNA, 882 bp, Diabrotica undecimpunctata
aaagttataaaagtttccgggtacggggccattatgccacaaaggaggtgcagcagaattaaacattttctttttaaaacaactgtaacttcagcaaattcaacaatgacttacagtttacacttactgtttaagttttcggttttgactttgtggcataatggccccgtacccggaaacttttataactttcccggctcgcacaccagctattcaaaccctataacacatacacagtctcccgttacaacatcaacttctgtattagctattacttacgataaaggagtactgatggccggagatctggttgcttcatatggatctttagctaggtacagaaattgtccaagggttattaaagtcaatcagaatatcatattgggagccggcggagactatgctgattttcaatacgtgaagagttttattgagcaaaaaataattgatgaagaatgcattgatgatggactaaaaatgaaaccaaaatcattgtactgttggcttaccagagtaatgtaccaacggaggagtaaattggacccattttggaataatttggttataggaggaatccaggatggagtcccatttctaggaactgtagataaattaggaactgcatatacagacaaagttatctgtacaggttatggagcgcacatagccttgccccttctgagagactccttagataaaaatggggctcttaacttagctgatgccaagactctgatacacaaatgcatggaagtgttgttctatagagatgctagaagttttcctaaatatcagcttggtattattgataaagatgatggtgtcagtattgaggggcctatttcagttgaagagaactggaatattgctcatatgacataa

SEQ ID NO: 277 - DNA, 1869 bp, Diabrotica undecimpunctata
atgtatcagttgtcccatttactatcagaacaaaaatcattattaagtgctctgtcaacaacatctattttagaagacactcagcacctgagcattgaaagggagaataagagtaatgacaaggatgtagaagaggaaaataagcagaaacttgcagccattttagaaaaagtggaaggatgcaaggaattgttagaagtaccaggaagaaaatttttatatgaaggagatttgttagaaattgatccaacagaaaatacatctttgaaaactgttcacgtgtatttatttacagatggatttatgataacaaatagaaattccaatagtcgaggtttgatgaagtacatttatgaaataatgtacgatttaagtagtctggcagtggttaacgtgagagatttaggaaatgttaaacacgcgtttaaattgttaattttcccggacacgagagtttttcaatgttcttctaattccaacaagaaagaatggttggacaaatttgaccaagcaaagaagactagactagctcaagagcaacaaaagagagaatctatttcggaaaaatcaccctcacgatcagcttcaatagagtctccgagttataatccatttgacgaaattgaagacgatgtaggaatggtgcacccagaatggtttttggacattccagaggaacttgatgtgtgtgtagctcaaagacacttcgaagaagctctttcattgttacaaaaagctaaggaatatattaaccaaatgacggccggtaatgagaaacacgatcatgtgttcctcgatattcaaaggaaggttgaacaaagacaaaatagccttaccgaagttttaatgaaagaactggaagttaatcctgataaatctttacaaggaggattgagggctgccagaagagcagtaaggttattaaatcagttaggaagagaaaaccaatcatgtaacttattcctgaaattgtgtagcagtatgttgaggacgcagtgtaagcgtgtaaaaagagaaggatccaccacaacatacatacgaaatttggcgagtgtagtattcactaatatgtgtcatatgtctgatgagtttctaagggcctttcccgattcaccaacttgtgcttcagcttatgttgtgtgggccagcaacgaactacttctttttactggacattttataaaacaagtatttatgccccagacctcgctatcaactgttacagaatgcatagtattagtccgaacgcaaggtgaaaggttatacagctatggcctggatttatgttaccaactggacggtgctttacgatcttccttagtcaaagctttaaaagacggaaaagataaacttatagattcgataaaacttagagccctagaagataaatggatcccaattaacctgcattccaaatccgctttgggaagatttctacacgaacattcgcaaatgggattaaatttggagagttatgtttcaggtgacacttggatacaactcacagcgagtactttatcgtttacgaaaatgtttttccaattgttaaatgactgtatgaagttaaaaacgactgaattggtatacaccatagatgaaactttgtataatgttttcgacgctcaattgaagcacaatgaaaatgctcttcgcaatgagttaaatcaggatcaaagaaacttcctcactaaaaatgctgaatttttactggtaaatgtgatcgaaatgtcgcagaaaatatacaatcaaaatgtaggctacgagtgtgcaacacttcaaaaactacaaggcgaatatgtggctttaaagaagggcgtttctccaacaactagaaatactaaaacaaaatactcatctgaatttttgtaa

SEQ ID NO: 278 - DNA, 2652 bp, Diabrotica undecimpunctata
atgaaagatgtctgtcaaattactggtaaagaccttaacccacattcccatgctccaactgaaagagaagatagggatagaaatcctgacaggcctgtaaacagcagtacatctgtgttaagacttccagtaaacatagatgaaggagaagaagactcccggaaaagagtaacaagaatttcaagtcccgagagatgggaaataaaacagatgatttcatcaggatgtattgctaagagtgagttgcctgactttgatgaagaaactggattgttacccaaggatgaagatggagaggccgatattgaaattgaattggttgaagatgaagctccatttttgcaaggtcacggtagagccttacatgatcttagtcctgtaagaatagtcaaaaatccagacgggtcattagcccaagctgccatgatgcaatccgctttggctaaagaaagacgggaacagaaaatgattcagcgggaacaggaggtcgattcccagccttccggtaagaataagagttggatagatcctcttccagaggacgaatcaagaatgatgggcagaggaataggcttacaagttcaagatttaccagaatggaaaaaacatgtaataggtggcaaaaaatcatcattcggtaaaaagaccaacttaacaataatagagcaacgtcaatccttaccaatatataagctcaaagaggaattacgaaaagccgtaaccgacaatcaaattcttatagttattggtgaaactggttcaggaaaaacaacacaaataacacagtacttagctgaagctggatttacatcgagaggaaagattggttgtactcaaccaagaagagtggcagccatgtctgtagctaaaagagttgctgaagaattcggatgtcgtttgggacaagaggttggttacaccattcgtttcgaagattgtactagtcccgaaactatgataaaatacatgacagatggtatgttattaagggaatgtctcatggatctggacctcaaacaatactcagtaataatgttggatgaagctcatgaacgaactatccatacagatgttctctttggattattaaaacaagcagtcatgaaacgagaagaactgaaactgatagtaacctcagctactttagatgctgttaaattttcacagtatttctttaaagcacccatatttactattcccggtaggactttccccgttgaggttttatatacaaaagagccagaaactgattatttagatgctagtttgataacggtgatgcaaatacatttgagagaacctccaggagatattttactttttttgactggtcaggaggaaattgacactgcttgtgaaattttgtatgagagaatgaaatctttaggtccggatgtacctgaacttataattcttcctgtgtattccgcgttgccttcagagatgcagacaagaatcttcgaaccagcgccacctgggagcagaaaagttgtgatcgctacaaatatagcagaaacctcgttgacgatagatggtatctactacgtagtcgatccaggcttcgtaaaacaaaaagtctacaactccaaaactggaatggattcgttggtagttacgccgatttcacaggctcaagcaaaacaacgggcaggtcgtgctggtagaactgggcctggtaaatgttacagactatatacagagagagcatacagggatgaaatgcttccgacacctgtacctgaaattcaacgaaccaaccttgcaacaacagtgctacagcttaaaacgatgggtatcaacgacctgcttcatttcgatttcatggacgctccaccggttgagtcgttaattatggctttggaacagttacattctttgtcagcgcttgatgatgaaggattactaacacggttaggaagaaggatggcagaatttcccttggaaccaaatctttcaaagatgttgataatgtcagttgccctacaatgctcagacgaaattcttacaatagtcagtatgttatcggtccaaaatgtattttaccggccaaaggataaacaagcattggcagatcagaaaaaagcaaaattcaatcaacccgaaggtgaccacttgacgcttttggcagtatataatagttggaaaaacaataaattttctaatgcttggtgttacgagaactttgtacaaatccggacattaaagagggcgcaagatgtgagaaaacaactgttaggaatcatggacaggcataaattggacgtagtatccgctgaaaggaacactgttagagtacagaaggccatttgctctggatttttcaggaacgctggaaaaaaggatcctcaggaaggttatagagctctagtagacagtcaggttgtttacatacatccttcaagtgccttatttaataggcaaccagaatgggtaatttaccacgaattggtccaaacaactaaagagtacatgagagaagttacaactatagatccaaaatggttggtcgagtttgctcctgccttctttaaattctccgatcctacaaaacttagtaaattcaagaagaaccagaggttagaaccattgtataataaatatgaagagccgaatgcttggaggatatcgcgagtaagaaggagaagaaattaa

SEQ ID NO: 279 - DNA, 1248 bp, Diabrotica undecimpunctata
atgtcgtcgaaaagaaaaagtaaagaaagcataattgctagggttaattttccactatatactcttcagatgttaacatcaaggcatgtaattgtcggtggtggaggaggaacatccaaaactggtgtacataatggttttgaaatatttgagatttttcatgatggaacacggtttgcagcaaaagaagtaactagacatgaaactggaggcaatgttgttatgaactgttctgtttacagtgatagaaaatattctcttatggtagctggacaagaaagtgactgtcaattgtacaaactgaatcctaaactagtcgaggaagtagaaaatatcggcaataatactcatctcaggcaaagaaatacaaaaaacaaagaagttacagatgacaacaaaaatgtgacaaaagagttatattttgatgttaaggctatagaaaatgttcaaactgactttaatggcagtgaaccattatcgagggtagtaaaaattaatcatgatggtacattattagctacaggtggtacagatggagatgtacgaatatggaagtttcctagtatgcaacctttatttattcttaaggcacatacaaaagaaatagatgatatagattttagtaggtatgacaattatgtgattaccatagccaaagatggtttagcagtattgtgggattgtatgacaggaaaagaaagaacgaaactaacatggaaacagcctgaaggatcaaaatatttatataaacgttgtagatttggtgtgatagaaggactagacaagaaatgtgcactatacacaatatcaaatccaataggagtagctaaaaaacaaaaatcctatctccagcagtgggtacctgaagaaaacatgttaagaaggtgtatagaatttgatgagagtctggctgctttagctgttcgtgatgatggtagatttgttgctgttggtacaatgtttagtggatcagtgtccattcttgtagcatttaatttacagaaaattttaaccattgttggagcacattccatgttcgtcacagggctggagtttcttcccacccagaacttgaaccattccattagtagtgtagtagaagccgcagtcttgtcaatttctgtagataaccaactatgcatccataccgtgccatacagaaaaactataccattgtggatcgctatcgcactactagttttaactttatttttgactttttcactatgttcatatttaggtttgtga

SEQ ID NO: 280 - DNA, 1242 bp, Diabrotica undecimpunctata
atggccggagcaatgttatttgaaagagctcagtctgtttcttctcaacacgagaagcttttaaaattatccagggatgaagaagatgacgaacaaaatattgtcaataaagaacaagacatccttaatcttggtgagaaatataaaaaggagggcaaggcaaaggaactcgcagaacttataaaggccaccaggccttttttgagtttaataagcaaagcaaaagctgctaaattggtaaggtctctcgttgattattttctggatttagaagctggcattggtattgaagtacaactctgcaaagaatgtatagaatgggcaaaggaagagagaagaacttttctacgtcagtcccttgaagctaggctgattgccctttattttgacactggaatgtacagcgaagcgttacaactggaatcaaccttactgaaagagttaaaaaagttggatgataaaaatttgttagtggaagtacaactacttgaaagcaaaacatatcatgctttaagtaatttaccgaaggctagagctgcactaacttcagcacgaaccacagctaatgctatctattgccctccaaagatgcaggcagctttagatttacaatcaggagtattacatgctgcagatgagaaggatttcaaaacagcttattcttacttttatgaagcttttgaaggttttgatagtgttgaatccccaaaagccctcacagcgcttaaatacatgcttttgtcaaaaattatgatcaacagtccagaagatgtccaacaaattgttagtggtaaattggcctttaaatatgctggtcaagatatagaggctatgaaatcagttgcacaggctgcacacaagcgatccctagcagatttccaacaagctgtaaaacagtttaaacatgaattagaagatgatgttattgttagagcacatttaggaactttgtatgacaatatgttggagcagaatctttgcaggattatcgaaccatattctagggtacaagtggagtatgtagcaaaaaccataaagctcccagtactacaagtggagaagaaattatcccagatgattttagatgccaagtttcatggaattttggaccaaggagaaggtgtcctcatagtattcgaagaaagtgcagtagacaaaacttacgaaatggccctagaaacgatccagagtatgagcaaagtagtagatactctttatcaaaaagcaaagaaattgtcatag

SEQ ID NO: 281 - DNA, 1764 bp, Diabrotica undecimpunctata
atggcatccaaatcaaaaaaagggtcaacaccgttagcttcacagcgaccggcgagccccttaagtcctaccagacattctagattacaagagaagcatgaacttcagaaccttaatgaccgtttggctggatatatagatcgagtaagatatttagaaggtgaaaataacagattaacgagggaaatacaaaccactcaggaaacggtaacaagggaagtttcaaacataaaatctatgtacgaccatgaattatcagatgctagaaaactattagacgaaacccaccgtgaaaaagcacgtttagaaatagatgttaaacgtcttttagaagagaatgacgaactcaagtctgagttagcgaaaaagaataaagatttggctctagctgaaaattctgccagaatatacgagacaagatgtaatgaattacagcttaaagcaaatcaagcagcttctgatgctaagaaagcaatcgcagatgctaaagaacttgaaaaagaacgtgataagctacgtaaacttcttgataaccatcgtaaacagctagaagaagaatcattggcgagggtggaagttgaaaatgccaaccaaagccttcgagaagagctatcatttaaggatcagatccatcaacaacagttgaccgaaactcgtactcgtcgtcaagtagaaattagcgaaattgatggtcgtctggcagaaaaatacgaggctaaacttcaagaggctctacaagatctcagagatcaatatgaaggtcaaatggccaacaaccgtggcgaaatcgaattgctatatgaacagaagattaaaaacttgcaatcggctaatgacagacaccagacatctgcttccggtgctcttgatgaattgagacaagttagaaccagaattgatagtttgaattctcgaattagtgaattagagaaccaaaatgctggtttagcagcgagagctagagatttggagaagttattagagaacgagcgcttgcgtcacgtggaagatcttgcaatgctagaaagagaattacatagactccgagaagaaatggctaaccaacttcaagaataccaggatcttatggatattaaagtttctcttgatttagagatagctgcttatcgtaaacttctcgaatctgaagaagctcgtctgaatattaccccaacaggtagtgaagttcatgaagtaactcacagaagtcaacgcagctcgtcccaacgtcgcactccagtcagattgggagccaaaagaaaacgaacactacttgaagaaagccaagaatcaagcttaaatgactattctgtaaacagttcttcaaaaggtgacattgaagtcacagatgtcgatccagaaggacactatgttaagttgcacaataaaagtaatcaagaagtcgcacttggaggatggcaagtgattagacgtgttggtgatgaggaaaccacatttaaatttcacaggtcattaaaactggaggctaatggttatgtaacaatatggagctctgacctcaacaaagatcacgaacctccaaataatttagttatgaagggtcaaaaatgggttgtaggtgataacatggtcaccacaatattgaataataacggcgatgaagtggcgatctctgaaagggttaaaagacaattaacaagctcccatctgagacacagagaattagcagctggttacctatcagaagaactccaccatcaacaaggtgatccacaagtagatgagagatgtaggcttatgtaa

SEQ ID NO: 282 - DNA, 2283 bp, Diabrotica undecimpunctata
atggatgaactacaacttttcagaggagacacagtcctactgaagggcaagcgaaggaaagaaactgtttgtatagtattatctgacgacacatgtagcgatgaaaaaattcgtatgaatagaaatgttagaaataatttaagagttaggctatcagatgtagtttctatccaagcttgccctgatgtaaagtatggcaagagaattcatgtacttcccatagatgatacagtggaaggacttacaggaaatctctttgaagtatacctgaaaccctactttctggaggcctatcgaccaatacacaaagatgacgtattcgttgtacgtggaggaatgagagccgttgaattcaaagtcgtcgaaaccgatcctgctccgtactgtatagtggctccagatacagtcattcattgtgatggagatccaatcaagcgcgaagaggaagaagaagctcttaacgctgttggatacgacgacatcggaggttgtagaaaacagctcgctcaaatcaaagaaatggtagagttaccactgagacatcccagtctcttcaaggctattggagttaaaccacctagaggcatcttactgtacggtccaccgggtactggtaagaccctcattgcacgtgcagtagccaacgaaacaggagctttcttcttcttgattaacggtcctgaaattatgagcaaattggccggtgaatccgaaagcaatcttcgtaaagccttcgaggaagccgacaagaattccccagctattattttcattgatgaattggatgccatcgctcccaaaagagagaaaacacatggagaggttgaacgtcgtatagtatctcaacttttaactttgatggacggtatgaagaagagttcccacgttatcgttatggccgctactaacagaccaaactcaatcgatccagctttacgtagattcggaagattcgacagggaaatcgatataggaatacccgatgcaactggcagacttgaagttttacgtattcataccaagaacatgaaattggccgatgatgtcgacttggaacagatcgctgcggaaactcatggtcacgtaggtgccgatttagcttcgctgtgctcggaagcagcccttcaacaaattagagaaaaaatggacctcattgacctcgaagacgaccaaattgacgcagaagtcctaaactcactggcagttaccatggaaaacttccgttacgccatgacgaagagcagcccaagtgctttacgtgagaccgtagtagaagtgccaaacgtcacttgggacgatatcggaggattggctaacgtcaagaaggaattgcaagaattggtgcaatatccagtggaacatccagataagttccttaagttcggtatgcaaccgtccagaggagtgttgttctatggaccgcctggttgcggtaaaacgttattagcgaaggctattgccaatgaatgtcaagccaattttatctcagttaaaggaccggagttgcttactatgtggtttggtgaatctgaagcaaacgtcagagatatcttcgacaaggctcgatctgcagcaccttgtgtactattcttcgacgaattagattcaattgccaagtcacgtggtggaaatgtaggtgacgccggtggtgcagccgacagagttattaatcaaattctaacagaaatggacggtatgggagccaaaaagaatgtctttattatcggtgctacaaacagaccagatattatcgatcctgcaatattgcgtccaggtcgtctcgatcagttgatctacatccctctgcccgacgagaaatctagagaagcaatcttcaaagccaacctgaggaaatcgcctgtagccaaagacgtagatcttgtatacatcgctaaagttactcatggtttttctggtgccgatttgactgaaatctgccagagagcttgcaaacttgccatcaggcaaagcatcgaaaccgaaattaggagagaaagagaaagggccttgaatcccaatgttgctatggatttggacgatgacgatccagtcccagaaattaccagggcccacttcgaggaggccatgcgtttcgccagacgttccgtttcagacaacgacatcagaaaatatgagatgttcgcccagaccttgcagcaatctcgcggattcggtaccaacttccgtttcccgacagcagccggtggacctgccgctcccggaggcacagcaggggatcaggccaacttccaggacgatcctgaagatgatctgtatagttaa

SEQ ID NO: 283 - DNA, 825 bp, Diabrotica undecimpunctata
atgggagaccagtttgattgtgctttggacttaatgaggaggttacctcctcagcaaattgaaaaaaacttaagtgatctcatcgatttagttcccagtctatgtgaagatctactatcatctgtggatcagccattaaaaattgcaaaagataaagaaactggaaaagattatcttctttgtgattataatagagatggcgattcctacaggtcaccatggtccaatacatactacccacccctagaagatggttcaatgccatctgagaagttaagaaaactagaactagatgccaatcttgcatttgatcaatacagggaaatgtattttgaaggaggtgtatcctctgtttatttttgggatttagaccatggatttgcaggagtcattctaattaaaaagactggagatggtagtaaaaagattaaaggatgttgggattccttacatgtagtagaagtacaagagaagagttcgggaagaaactcccattataaaatgacttcaactgctatgttatggcttcaaactaataaacagggatctggaactatgaacttgggtggaagtctaactcggcagatcgaacaagatgcagctgtaaatgatatcaatccccacatagccaacattggaagaatggtagaagatatggaaaacaaaattcgcaatacattgaacgaaatttacttcagcaaaacaaaggacatcgtcaacagtctgcgatcagttcaaccgttgaccgaaagccgccaacagcaggcacttaagcaagatctcgcggcggcccttcagcgtagacaaaacaaaactgagaactga

SEQ ID NO: 284 - DNA, 3768 bp, Diabrotica undecimpunctata
atggaacgcccaccccgaaacgaaccccctgtggaaccagtgaatggagtggtccagccgccagtccatccacctccagagagtccgggccgcgtcaccaatcaacttcagtttttacagaaaactgtgttaaaggctgtctggaagcaccaattcgcttggcccttccagcaacccgtcgatgccagaaaactcaacttgcccgactaccatagaataattaaacagccaatggacctgggaacaattaaaaaaagactagacaacaattactactggtcgggcaaagagtgcattcaagacttcaacacgatgtttacaaactgctatgtctacaacaagcctggagaggatgttgttgtcatggctcaaacgttagaaaaggtatttttgacaaaagtggcggatatgccaaaggaggagttcgttgttgaatcgcctaataaagcgggagcggcaaaaggaaagaaggggcggaccagtacagcgggcgctgccagtgcacccccaacaccaactacagccaccgctggttcgggaggcaggggtaggcctcccgccactgtctcttctacaagcgccactccagttgctaccactacaggatcttcagggatacctttaggcactcaagcaccggctacagtacctggcagcaccgcaactaccaccatagccgcggctagcaccaacaacagctctctgtcgaatcagcaactgaactcttcttccagttccattcacggaagcggctccagtttaggaaattccttagattccagcagcgtcatgcctgccaacgttatacctccggcacaaccagccaaggtaaaaaagggcgtgaaaagaaaggccgatactacgacacctgctacagcctacgattatccgccaacattggagtcgaagtccgcaaagatatcgacgcgccgagagtccggtaggcaaatcaaaaagcccaccaggccggaactggacggtcacccgccacaaccccctccacttaaaccaaaagaaaaactaccagaatcactgaaagcctgcaatgaaatcctcctagaattattttctaagaaacattctagttacgcctggcctttttatcaacccgtagacgcagaattactcggtctgcacgactaccacgacatcataaagaaacccatggattttagcactgtaaaaaataaaatggagaaccgagagtatcgcactcctcaagactttgccgccgacgttagactgatttttagtaattgttacaagtacaacccttctgaccacgatgtggttgctatggcgaggaagttgcaggatgtgtttgaagtgaaatatgctaagattcccgacgaacctgtcaatagggtaggagcccctgccgttaataacatccctaccaaatcagaatcgagtacatccggttccagctcagattcttctagcgataccgaagattcagaggaagaaaggcgaaataaacaactgaagctgctagaaaaagagttgacggcgatgcaagaaaagatgcgtaaactggtagacgagagcacgcgtaagaaaaaagagaagaaaaaggacaaagtaaaaaagaaaccgacatcaggtgggtctctcgcgaacgcctccctatcaactctaccaaacagcagcagcgcgggcttgggtaagccgggtgccggtggtcacggggctctaaacaagtcaaacaacaacaactcaatagcggcggacagcgttgacgacagcatcgccagtgttgtgtcgggcgccgatctaaagatggccgagtcgcaccatccgcaaactggaacaggcgctcaccatccgccggcaggcaagtccctgaacatgcatcacaacatgacggcaaacgctggcgccaacgcttccgcgcaggctaaaacacctaaaagtaaaggactccgcggcaataaacccgctgcagctaccaacgcggctcccaacaagagggttaaagccaacaacaaagctggcgcgggtaggaagaaaaacgccgcacagccaccaccgatgcagttcgattctgaggacgaagataatgccaaaccgatgtcttacgacgaaaaacggcaattgtctttggatattaataaattaccaggtgacaaattgggtagagttgtacatataatccaatccagggaaccgtcgttgagggattccaatcctgacgaaatcgagatcgatttcgaaacgctgaaaccctcaaccttaagagaattagagagttacgttgcgtcgtgtcttcgcaaaaagccacataaaaaagtagctggcaaatctaaggacgaacaaatagcggaaaaaaagcaagagttagaaaaaagactaatagatgtaaacgataaaatcggcaactccaagaaggcccccaaaaaagatgaagccaacaaggtagatccaacgggcgcgggaggtccctcaggccgcttatcctctagctccagcagttcggactccgacagcagtagtagcagtctgtcctctagttctagcgactccagtgacagtgaagcaggtgggacggcgaaccgacaggccaaaaagaaagcgaataaaaaatcacctaatccttctctaggaagttccaccaccaccaccactacgactataaaagtaccgccgcctcaaacaacggcaacacctgcaccaccgtcacaagccgcaccagctatcacaacagcagcaactgctaatttaacaacaactgtcagcgtaccaccacttactactacaacgacaacgatagctgcaccaattcaaccggcggcagttccaaacgtcgcagttcccgcgcaaacgacgccagtcgcacccgccttcacgccgagcgtaaccgtcaaaccatcactccaagccgctcctatcgctccaacggtgccgcctcttattaagtcgatcgagaaactgcctattacaactcacttacctcctaccgttcctacgataacgcctccaactgtacctcaagctcctaagtcggtagcgttaccgactccttcgcctgataaacctaaacctaacattatttctcccattggtacttttaccgaccctatcgaacaatcattggctagtcttgaacacgatattaagcagaacgaccctatggacgttataacggcgtctactatgatgcaactgcctactacattgagtaatcctgtcgtgtcacatccacatcctagcttaaacttaaatccaaccattaaccatcctattttacagcctagcacacttagtatggacttgaaagcgcctattatgggaactatggcgccgagcaataccatgttgcatcacggattgcaacaagcgatggaaacggatatcacgatacctccaccacccaccaatatgttacatgggcagaacaatggttttggcatgaaacacaattttgatctgactacaaataacaacggtctttcgtcgatgggactaccgatggaaatgtcgatatcgtcaatgttcgatccgattccgcaaaatattaacaatcccatgatgaagaacgattcccaacttaagatggacgatcgcatggataccttaggcggacttttgaacgataaaaagtctaatcctctcatacaaaagccgatgtcgcaatcgtttggcttcaagaacgacaaaccagatcacaacgtcaaaaacgctagttcctggtcgagcttggccaaaggaaaatcaccacaaaacaatattccgggcggcagcagtaagcagcaagttatggatagtttt

SEQ ID NO: 285 - DNA, 1224 bp, Diabrotica undecimpunctata
atgtcgttatccaccgctcgcccattagtgagcgtatacaatgagaagtcggaggaagtaaagggctcaaacatttcacttccagcagtgtttaaggccccaatcagacccgatgtagtaaacttcgttcaccaacaggtttctatgaaccatcgtcaaccctacagcgttagtgacaaagctggacatcaaacatctgccgaatcatggggtaccggacgtgctgttgctcgtatcccccgtgtaagaggaggtggtacccaccgttctggtcagggagctttcggtaacatgtgtcgcggtggacgcatgtttgccccaaccaagccatggcgtcgctggcacagacgcgtgaacatcaatcaacgccgttacgctttggcgtctgctgtagctgctagtggcgtaccagccttagttatgagcaaaggacatgtcattgaccaaatccctgaattgccattggttgtcagtgacaaggtacaagaaatgagcaaaactaaacaggccgttcagttcttgagaagaatcaaagcatgggctgacattcaaaaggtttacaagagtcaacgtttccgtgctggtaagggaaaaatgcgtaataggagacgcatccaacgtaaaggaccattggttgtttactacaaagatcaaggtctccgtcgtgctttccgtaacatcccaggcattgacctcattagcgtacagaagttaaacttgttgaaacttgctcctggtggtcatgtaggtcgcttcattatttggaccgaatccgctttccaacggttagataaattgtttggcacatggaaaacaccatcattagaaaagaagggttacaatctaccccaacctaaaatggcaaatactgatctatctagattgttgaaggctgatgaaatcaaagctgtattacgtgctcctcaaaagaaggttgtacgtcgtgtacgtcgtctcaatccattgaccaacgccaaggctatgcttaaattgaatccatatgctgctgtactcaaacgtgaagccattttgaagaatcaaaagagacagttaaacagagaagaacttttggccaagaaacgtggtattaccttgagtgccgacaacgtcgtgattagatccagaaaattgcaagaaaggagaagggcacaaatcttgaaggacaagaaatcaaagcctaagaaggtcaagaaggctccagccaaggctgcaggaaagaaataa

SEQ ID NO: 286 - DNA, 5466 bp, Diabrotica undecimpunctata
atggcagacttcatagattctgaagcagaagaaagtagtgaggaggaggaattagatcacagggatcgtaaaaaagcccaaaaagccaaagttgtagatagttcagatgaagatgatgaagatgatgacgaaagactgagagaggaattaaaggatttgattgatgataatcctattgaagaaagtgatgctgagtctgatgcttcaggaagggaaaaacgtaagaaatctgatgacgaggatttggatgatcgactggaagatgaagattatgatttgcttgaagaaaatttgggtgttaaagttgaaagaaggaaattcaagcgactgcggcgatttgaagatgaggaaagtgaaggagaagaagaacatgatcccgaacaagacagggaacaaatcgctatggatatattttcagatgatgacgatgaaagacgatcggaacggagtcacagacctgccgtcgaacaagacaattatggtgtcggcgaagaagaagaggaaggggagtactcggatgccgatgactttatagttgacgatgacggcagacccatagccgaaaagaagaagaaaaagaaaccaatatttactgatgccgctctccaagaggctcaagaaacctttggtgtcgattttgattatgatgaatttagtaaatatgatgaagatgattacgaagatgaagaggaggaggatgacgaatacgaggaagatgatgtggagaaaaggaaacggcctaaaaagacttcaaagaaaaaaccgacgaagaaatccatttttgaagtgtatgaacctagtgaacttaaaagaggtttctttaccgatctcgataatgaaatccgtaacactgatattcccgaaagaatgcaacttcgtgatgttccgatcaccgccgttcctgatgactcaactgaacttgatgatgaagcagaatggatttacaggcaagcattttgcaacagaactgtttctaatgtggattctcatttatcatcagaggcaagagagaaattgaagaagactcctcataccatcggaaagatcagaaaagcgttagattttatcagaaatcaacaattagaagtaccatttattgctttttatagaaaggagtatgttcaaccagaacttaatattaacgatttgtggaaagtatataaatacgatgcaaagtggtgccaactgaaaacacgcaaagaaaacctcttaaagctttttgaaaaaatgaggtcgtatcaaactgacaccgtaatgaaagatccagatgcaccaattccagacaaccttcgtatcatgactgagtcggacattgagcgattgaaaaatgttcagaccgccgaagagttgaatgacgttcacaatcatttcattttgtattacgctgcagatttgccagccatgcatgccgcgtggagaatcaaagaaaaagaaaggagaagacaggaaagaaaggaggctagacttaagctcatcgctgaaagtgaagaaggagctgaaattcctgaagagcctgaagaaatcgatgatgacgaacctgaaactgaaaccttaaaatacgccaataggtcaggcagctatgcactgtgcagtaaaggaggtttgggcccgctagcgaagaaatttggtttaacacctgaacaatttgccgaaaacctgagagataattatcaaaggcacgaagtagatcaagaacatatagaacctgtagaagtggccaaggaattcgtgtcgccgaaattttctacagtggaagaagtattacaagctgctaaacacatggtagcattacaaatagcaagggaaccgttagtaaggaaatgtgtcagagaaattttctttgaacgagctagattaagcgtttatccaaccaaaaagggtatgaaagttatagatgaagctcataattgctatagtatgaagtatttaaaaaataaaccagtaagagatcttgcaggcgaccaatttttaaagttatgtttagccgaagaggagaacctacttactattaccatcaatgaccatatacaaggaaacactactaacaattacatcgatgaagtcaaacaattatatataaaggatgaattcagcaaacacgttcaggactggaatgcgctaagaatggaatcggtagaaagggctttaacgaaaagtgtcttgccagatttaagatctgaattaaaacgaacgttgatcacagaggctaaagaattcgtgctgaaagcttgctgtagaaaattatataattggataaagattgctccatacgcaataaaatttcccgatgaagacgaagatgactgggatacatccaaaggtgtcagaagtatgggtgtggcatacgtaccagagcacacagtatcagcttttacctgtatttcagcaccagacggagatataactgattatctcagattaccaaatattctaaaaagaaaaaatagctttcgaactgatgaaaaacttatgaaggaagccgatcttcaatcactgaaaaatttcatataccttaaaaagcctcatgtgatagcagtagggggtgagtccagagaagccttaatgatcgctgatgatatcagaggagtaataaatgaactaatagaatccgatcaatttccacagattagggttgaaattattgataatgaattagcaaaagtgtacgcaaattccattaaggggacgactgatttcagagattatccggagttgttgaggcaagctatttcattagcgcgaagaatgcaagatcctttagttgaattttcccaattatgtaatagtgatgaggagattttgagtcttaggtttcatcctttacaggaacaagtccaaaaagaagaactactagaagctctctgtttagaatttgtcaacagaacaaatgaagtaggtgtcgatataaaccttgccgttcagcaaattcataaaagtagtttagttcaattcatatgcggtctaggaccgcgtaaaggacaagcgttacttaaagttctgaaacaaactaatcagaggcttgaaaacagaactcaattggttacattttgtcatatgggcccaaaagtttttattaattgttctggattcataaagatcgatactaatagtttaggagacagtactgaggcatatgttgaaatattggatggctctcgagttcatcccgaaacttacgaatgggcacgaaaaatggctgtggatgctttagaatatgacgatgacgagggagctaatcctgcgggcgctttagaggaaattctcgaggcgccagagaggttaaaagatcttgacttggatgcctttgcggaggaattggaaagacaaggatttggaaacaagagtataacattgtatgacattagagcagaattgaactcgcgatataaagatttgagacagccttttcgttctgcaaatcctgaagaactattcgatatgcttactaaagaaactcccgaaacattttatattggaaaaatggttacatctaccgtgtttggtattgcaaggaaaaaaccaaaaccagaccagctcgatcaagctaacccggtccgtaatgacgaaactggcttgtggcagtgtcccttctgtttgaaaaatgattttcctgaattatccgatgtatggaatcattttgatgcaggcgcatgtcctggtcaagctactggagttaaactaagactggataatggtattttaggttatatttatataaaaaatataagcgacaaaccagtcgctaatcctgaagaaagagtaggcataggacaattaattcactgtagaataataaaaatagatgtagagaagtttagtgttgattgcacatcgaaatctagcgatcttgcagataaaaatcatgaatggagacctcagcgagatcctcattatgatcaagaacgtgaagacaaagacaatcgaacggaagccgagaagaagaaggagaaacagcgtatgacgtacattaagagagttattgttcatccggcgttccataacatatcctacgccgaagccgaaaaatgcatggttaatatggatcagggtgaagttatcattaggccttcgagtaagggtgcggatcatttgaccattacttggaaagtgactgatggaatctatcaacatattgatattaaggaacaaggaaaagttaacgctttttctttaggaaaatcattatggattggaaatgaagaatttgaagatcttgatgaaataatagctagacacgttacaccaatggcagcgcatgctagagatttactgtattttagatattacaaagatttcgcgggtggtcataaagataaggctgaagaatatcttaaagatgaaaaaaagaaaaatgcttctaaaattcattatgtaattagtgctgctaagaatatacctggtaaatttcttctttcgtatcttccacgaaacaaagttagacacgaatatgtaacagttactccggaaggcttccggtttagacaacaaatgtttgattccgttggttcgttgtttaaatggttcaaagaacatttccgggagcctccgccaggtggcgcaacgccgggtagtacgccaaggctggcctcaagccgaactggatatggaactgccacacctgcgtttagtatgaataatgaagctattcaaagagttgctcaaaatttgccaagtcatgtagttcaagcgttatctgctgccaccaatcaaactccacattatccccacactcctggttatggcggcaattatattaatacgccttacactccaagcggtcaaactccgtacatgactccataccatacaccgcacactcagcaaaccccccgctatggtcatcaaacgccttcccaacacatggcgagctcagcaccacaaggtctcaacaatccctttttacatcctggcgctgtaacgccttcccaacgaactcctagttatcgtaaccatcctgcacaatctccaatgcttcctacaagtcctgtaccgagtccaggctcccagagttcatacagtagtcatttaagtcataatcagcgaagtggaagttatgctgactcattgagattccagccacccgaatcaccgcgaagctcagtaagtaatagaagcttccattctgatagatatggcggtgacaggtatggtaaaggaagtcatggcggaagatatggcggaagctcaaatgaagatagatatggaaagggaggaaatgaaaatacggattggcagaaagctgcagaagcatgggctcgatctagatctactccgcgaagtgatagccgcaatactccaagatctgtaggtcaacgaactcctagatacgacagcgatgccgaacgttctagaatgaaacacctcagcaagagcccgaggtctgtcaggtctactcctcgaaccaatacatctccacattctatgtccttaggtgatgctacccctctgtatgacgaaagtatctaa

SEQ ID NO: 287 - DNA, 2451 bp, Diabrotica undecimpunctata
atgccacataccaaggaagctaatttgagttcaccagaacgtaaaagacgaagaaagagtaagtctaaatctccagaacgaaaagagaaaaagtcttccaaaaagaaagcacacaatagtagagacagggattcatcagaggaagattacaaccctaaagattatcaaagatactatggggaagatcgcccgaacagtgacaaatattggaataaatatccaaggaaagataagaccaaaattggtcaaagatattatgatgcggttcctgaagaatctgtcaagaagggcgctgataaaaattcagacgaaaaggagttatcaaagtcagtggagcctgttcctgataaatcagtcatcaaaccaagagaaagaaaaactgtagatatgttaacatcaaggactggtggtgcttatatccctccagctaaattacgattgttgcaagctagtattacagacaaaacatcagcagcctatcaacgaatagcatgggaagccttgaagaaatccgttcatggatacattaataaaattaacacctcaaatattggcatcattgctagagaattattgcatgaaaatatagtaagaggtagaggtttgttgtgcaagtcaataatacaagctcaagcagcatctcctacttttacaaatgtttatgcagccttagtagctgttattaattcaaagtttcctagtataggagaacttttattgaagaggttggttttgcagttcaaaagaggatttaaacaaaataataaatctatttgtatatcagctactactttcgtagctcatttagtaaatcagagagtcgcacatgaaattttagctttagaaatacttacattgttagtagagacacctacagatgattctgtggaagtggccatttcatttttgaaggaatgtggacaaaaacttacagaagtttcaagtagaggtattactgctatatttgagatgttaagaaacattttacatgaaggtcagttagaaaaaagaattcaatacatgattgaagttatgttccaaataaggaaagacggatttaaggatcatgctgctgttgtagaagaattagatttagtagaagaagaagatcaattcactcatcttattatgttagatgatgttaaagaggctaatgcagaggatatattgaatgtgttcaaatttgatgataattatgaagaaaatgaagataaatacaaaacccttagtaaagaaatattaggcagtgatggtgaatctgaatcaggttctgaaggttcagaagaggaatctgaagatgaaaatgaggatgaagtcaaggatcaggggacaataattgacaatactgaaactaatttaatttctcttagaagaacaatatatttgactattcagtctagtttagattttgaagaatgtgcacataagctactgaagatggagttgaaacctggacaagaaatagaattgtgtcacatgtttcttgactgttgtgcagaacaaagaacctacgaaaaattttatggcttgttggctcaaagattttgtcaaatcaacaaagtgtacatcgagcctttccaacaaatttttaaagatacttattctacaactcacagactagatgccaataggttgagaaatgttagcaaattttttgcacatttactttttactgatgccattggatgggaagtactggaaatcatgaaattaaatgaagaagataccaatagttctagtaggattttcataaaaatcttgtttcaagaattggctgaatatatgggactaggaaaattaaatgcaagattaaaggatgagaccctacaggcttatttttcaggactgtttcctagagataacccaaagaataccagattttctattaacttttttacctctatcggtttgggaggattaactgatgaactgagagaacatttaaaaaatattccaaaaatgatggaaatgaagttagccactggtaaagaaaaggaaagcagcgatagcagcagttcagaaagtagttctgaagatagtagtgacgatagctctgaagattcgtcaagttctgaagacgacaaagtcaaaaacaagaagaaatcaaaaaagttaaaagaaaaaaaatcgaaaacaaattctaaatctagacctagatcgaaagaaaaagaacacgcagataaacccagagacaaacgtagaaaggaagatagatataaatctgacaaaaatcccgatagatcctcgtccaaacaatattccaaagaagataacgacaagcgaagaaaagattacgaatggatgaaaagtagatatgaagataatattaagcagttaaaaaacgataaaagggtatttgaaaagtcttccaaacgacgatcaagatctagggacaaggtaaaaggcagggaagagcgtagacgtagaagcagagaaagacgaagaagctaa

SEQ ID NO: 288 - DNA, 1782 bp, Diabrotica undecimpunctata
atggcgttaaagaatcaagttggtcaaaaaatcatgaatgaagtcattaagcacaagcccaccaagaagaatgggccaactccaggacagcaagctcatggggtagagtggaggatccttgtggtggatcagcttgccatgcggatggtttcagcatgctgtaaaatgcatgatatatcagcagaaggcattacattggttgaagatattatgaagaagagggaaccacttggtaccatggaagctgtgtacttgataactccttcagaaaagtcagttcatgctttaatgaatgactttgaacctccaagacagatgtacagaggggcacatgtgttttttacagaagtatgcccggaagaactgttcaatgagctgtgcaagtcttgtgcggccagaaaaattaagactctcaaggaaatcaacattgcgttcttgccgtacgagtctcaggtgttctcattggattcaccagacacgttccaatgtagctacgatccctcgttttccgccgccagaaacgccaatatggaaagaatggcggaacaaattgcgactctctgtgcaactctaggagaatatcctcacgtcagatatagaaccgattgggaaaggaatgttgagctggctcaactaattcagcaaaaattggacgcctataaagccgatgaacctaccatgggagagggaccggaaaaggcgagatcgcagttgctaattctcgatcgaggtttcgactgtgtatctcctcttcttcacgaactcaccttccaagcaatggcctatgacttattgccaatagaaaatgatgtgtataagtacgaagcatcagctggcgttctgaaggaagtccttctggatgaaaacgacgaactttgggtcgatctacgccaccaacatatcgcagtggtgtctcaaagcgtcacgaagaatctgaagaaattcacagactcaaaacgcatgacccagagcgacaagcagtcgatgaaggatttgtccaccatgatcaaaaagatgccgcaatatcagaaggaattgtctaagtatgcgacgcatcttcatctcgctgaggactgtatgaaggcctatcaagggtatatcgacaagctgtgtaaagttgaacaggatttggcaatgggaactgacgccgaaggcgagaaaatcaaggatcacatgcgcaacatcgtccccatcttgctagatcccaaaatcaccaatgaatacgataagatgcgtattatagcattgtacgctatgacgaaaaacggtataacagatgaaaatctctccaaattggctacccatgcccaaatcaaggacaaacagaccattgccaaccttcagttactcggagtcaatgttattaatgatggaggaccaagaaaaaaacaatatacagtaccgcgcaaagaaaggattacagaacagacataccaaatgtcaagatggacacccatcattaaggatataatggaggattgcatagacgacaaactggatcagaaacactacccatacttgagcggacgagcacaatcgactggataccatgcagcgccctccagtgcccgttacggccagtggcacaaagatagaggccaacaagctgtgaagaacgttccccggctgctcgtcttcgtcgtgggtggaatcagcttctcagagatcaggtgcgcctacgaagtgaccaacgcccagaaaaactgggaagtaatcatcggctcgtcgcacatactcactcccgaggacttcctaagcaatctggcaacgttggccggctag

SEQ ID NO: 289 - DNA, 2139 bp, Diabrotica undecimpunctata
atgatgcaacaatatatgaaagaattagaacaggaaccatttgatgctgaagaatttgtagaacgtttagcttggagaactttagctgaatctaaaggcgatggggaggaacatgagattaatcctgctcttttacacgagtcttttgtacaagctataaaagatcttaatttacttcatgaacggcaacaaaagaaatgtgaaaaactagaagttgtggttagggaagatgaagcgaccttttttcaagagatatataatttacttgaacagaataagcaagccatggacacttttcaagagttagatggtaaaatcaatcatgtagcaacaaaagtactacatttaggtgatcagttggacagtgttaatggtcctagatctagagtagtagatgctttaaagttaatgatacatttaacagagttcttatctgaagaatcagtattatcacctatctttacaagaccagaattgatagatgatgctgctgatgtgattcaaaaattataccttatatctcaagatttacctcctaaatttgatgttgctaagagaaaaattgaaagaaaatactcagatatagaaaaatctttaatagaagaattcgttctagctatggataatgaaaatttaaatagaatgaaagaaatagctactgttttatctcagtttaaaggatattctcagtgtgtagatgcttacattgatcacagtcaaatgggatgtctatcgagcaaggacgtattttctaactttttaacgctttgtaaatacaatcatgaaataattgtcaaggtttttaataatccagaacaagtgatggcaaaatttgtattgaacatatttcaactcaaactcgtggaatacatcgatcagaggttaaattccaagttaggaacctacagctatttacaagtattatatgagttatattacaagactaatcagttatccaatgatttgagcgtatttaacatgggaaatgacaagaactttttatcgaagttaacaacaaatatttttaataaatatattaatgattatatcacaatggaactaaaaggtctgaaagataggtgctctgcaaatttacaaaaatactatgaatccaaaggtcatcagaagaagcagattcagtcagggggttttcaagatcttcgaagagatcttcaagctgttataggaactcgagcaaacattaatattgcacagatcgaaaattatggtggggaaacttttttatctgaagaattagctattacgatattacaagatacaaaacacgcttttcaaagatgtcagttgttatccaaacccacagaaagggcctcaaacgcaactcaaattttggatcgattgataaacagcttattagtagagcatgtcgactatgcagtagaattgggcttacaagctgtgcctgttgtagaaggaaccaaaactcccccagcgctatatttttttagtgtcgtccaccacagtaataatattatacatcttgttgagaaacagttcatggatttattggttccattagttgaaaacaccccaaggaataacgattgtgtacaaaagaaaaagtttgtactggaagatatagaacggaagattaacacaggactagataggtgtctcaatgccatttcgagctgggtcaaactgtatctccaaacagaacagaaaaaatctgacttcaaacctgaatctgacgacttcgacacagtagcgtcacccgcttgtaaaaacgtcatcaattacgttaatagtattgtaaaagaaattaaagcgaacctggatggtaataatgtcacagccatattgcaagaacttggcataagattacaccgagtggtgtatgatcacatgttgcagttccagtataacacagcaggtgcgatggtggctatctgtgatttaaacgattatcgtcattgtacaaaagcgctcggcccattagttattgaactttttgatacactgcatgccctctgcaatcttttgcttgttaagcctgaaaatttacagcaagtgtgttctgaagattctctagtaaagctggatagaacaatccttcacaattttatccaactcagaagcgacttcaaggtacaaaaacaaatgattctaaaagtgtaa

SEQ ID NO: 290 - DNA, 813 bp, Diabrotica undecimpunctata
atggatttccaaaacagacctggaggaaagaccggtggaggcggtgtcgcctcttggtcagaaactaacagggatcgcagagaaagacttcgacaacttgctttagaaactatagatttacaaaaggatccctattttatgaaaaaccatttgggatcatacgaatgtaaactctgtttgacattgcacaacaacgaaggaagttacttggcccacactcagggtaaaaaacatcaggctaatttagctaggagagcagccaaagaggctaaagatgcacctacacttttgcaaccagagaaacccagagtagaacctaagaagtttgtgaagattggtcgacctggttatagggtaacgaagcaaagggatgctgaaagtggacaacagagtcttttgttccagattgattatccagaaataagtgatatgattctacctcgtcaccgttttatgtcagcttatgaacaaaaaatcgaacccccagatcgtaaatggcagtatctcctatttgcagcagaaccttatgaaacaattgccttcaaagtaccaagcagagaagtagagaaaaccgacagcaaattttggactcattggaacaaggatactaagcaatttttcctacaatttgcatttaaaaatgacaataagagaactgttaatacagtggtccaaagacatacaattgttggtgcagcaccaccacctccaatgctgccagttccaccaccaccaagaccaccaatgttcaatcctattcctccaccaccgccaataatgagaactgtattaccagtgcctcctccacattaa

SEQ ID NO: 291 - DNA, 405 bp, Diabrotica undecimpunctata
atgtctattggtgtacctattaaagtcctccatgaagcagaaggtcatgtaataacctgcgaaacaattaccggcgaagtatatagaggaaaactgatagaagctgaagataatatgaattgccaaatgactcaaattactgtaacttacagagatggaagagtagctcaattggaaaatgtttatattagaggatcaaaaattagatttctagtattaccagatatgttgaaaaatgctcctatgttcaaaaaacaaactaaagcgggaacggcaggtcgaggaaaatctgctatactgcgagcccaagctcgggggagaggcagggggcaaacacaaccagtacgaggtagaggtaattggcaacagaatcaacaagcagcacctgcaggaaggggaagataa

SEQ ID NO: 292 - DNA, 1452 bp, Diabrotica undecimpunctata
ttgcgcagacgtttgtgctgtcacttctgtcgttctgtcagattatgctgtcaggtaataaattctgaaaatttagggaagaaagatatttgttttataagttttcacacaacttcattgagaagtatggcttcaactattacaagaactccaatcttgcgagcaatttccgcaagaagctattctcaagttctgccagtatctggtaatccaagtgttgaaccaaaaactagtactcttcccaacaaactagttgttgcagcagtagataatgacgccagtcttacaagagtttcagttgtgtttagagctggaagccgtaatgaaaaagctgataatttaggtgctgctcatgttataagaatagcagcgggattatccactaaaaatgcctcccagtttgccataatccgaaacattcaacaagttggtgcaaatcttacagccacatctgatagagaaaccatatcctataccttggaaggaacaagaagtgctgttgaaaaggctctaccatatctagcagaagtagctaccaaccaagaatttagaccttgggaactttcagaactgtccaacagattaattttggatattttaaccagacctttacaattaagagccattgatttgcttcacaatgctgcctaccgtagcaaagggttaggtaactcactcttcattccaaagtctcaagtgggaaaagtttcatctgaaacattacaacattatgtagctaacaactttgtagctggccgtgctgcagttgttggtacaggtataagtgagagtttgttaaatcaatttgctgctagtttggaaattccaaatggtgaaggcagcaccaatccatccccttacaaaggtggtgaactcagatcaaacaaaggtggaccacttgcttttgttgcagttggaggagaaggagctcctttgaaaaacaccaaagaagctcttgcatttgcagttctacagaaagctgtatgtgctggccctcagatcaaatatggtgtacttgataatggagtctacagcaaagctcttggtggatcatcggatgtatctgcctgcgctgttaatgtgagctattcagacagtggtttgtttggtattttgcttgctgcacctgctggatctgtaggcaaagcagttcaatcagctgttaaagttttgaaatcaggctccgttacagatgctgatgttcaacgaggcaaaaatcaattgaagacatctatccttctgaatgctgaaagtggtgctgacgttgtaagggatcttggaacccaagcagttttgtctggtgctccacacagcgccagtgctttagctgctgccgtagactctgtcagcaccagtgatgtacaaagtgctctaaggaaagcaggaggaaaattaaccttagcatcaattggaaacattaatgatgtaccatatttagatgaattgaaataa

SEQ ID NO: 293 - DNA, 333 bp, Diabrotica undecimpunctata
atgaggagggcccacgcaggtaactactacgaaccattaccacaaacttccaacgaaatcgaagatgaaaatgatagaatgactaatgatctgcaagaaaagattggtgtcctaaaatcgttgactatagacattggaaacgaagttaaataccaggacagacttctcagagatgtcgatgacgatatagataagacaggaggtttcttgggcacaactatgtcaagagtactgagattatccaaaggatcccataattacctcatcctatatttatttgtgttttctgtaattgtattttttgttctgtacctggttattaagtttaggtag

SEQ ID NO: 294 - DNA, 1158 bp, Diabrotica undecimpunctata
atgttgggaagagtattcaacggctctggaaaacctattgacaaaggtcccccaattctggctgaagattacttagatatccaagggcaacctatcaacccatggtcccgtatctaccccgaggaaatgatccaaactggtatcactgccatcgatgtgatgaactctattgctcgtggtcagaagattcccattttctcagctgctggtctgccacataacgatattgctgcccaaatttgtaggcaagccggtcttgtcaaaattccaggcaaatcagttttggatgatcatgaagacaactttgccattgttttcgctgctatgggtgttaacatggaaactgctagattctttaaacaagatttcgaagaaaacggttctatggaaaatgtatgtctgttcttgaacttggctaatgatccaaccattgaaagaatcatcaccccgcgtcttgctctaacagctgccgaattcttggcttaccagtgtgaaaaacacgtgttggtcattttaactgacatgtcttcatatgctgaagctttgcgtgaggtatctgccgccagagaagaagtacccggtcgtcgtggtttcccaggttacatgtacaccgatttggccaccatctacgaacgtgccggtcgtgtcgaaggccgtaacggttccatcactcaaatccccatcttgactatgcctaacgacgatattactcaccctattcctgacttgacaggttatattaccgaaggacagatctacgtcgatcgtcaattgcacaacaggcaaatctatccaccaattaacgtactgccatctctctcacgtttgatgaagtctgccatcggcgaaggtatgaccagaaaggaccactctgacgtttctaaccaattgtatgcttgctatgctattggtaaggacgtccaagccatgaaagctgtagtaggtgaagaagctctaacaccagacgatcttctctacctcgagttcctaacgaaattcgaaaagaacttcatcacccaaggaaactacgaaaaccgtaccgtcttcgagtcattggacatcggctggcaactactccgtatcttccccaaggaaatgttgaaacgtatccctgcaagcacattggcggaattttatccaagagacgctcgtcactag

SEQ ID NO: 295 - DNA, 741 bp, Diabrotica undecimpunctata
  misc_feature (701)..(701): n is a, c, g, or t
atgagtcgcggacacgcaggaccccgtattcacgttccagacgaattaagagaagtactcctcgaatttacaattagttatttattggaacaacctggagatgttattagttacgccgccgaatactttacgaggttgagggaaaccagggtaacatccagagtgtatgatgaagctgctgcctcgcaggaggaacttgtatcacctgacgaatctgtaatgtccaaagatgaagaaccttcaatccggtttgctggtaggcgtaaatcagtattcgcagaaacttacgatccagaagaagacgacgacgatgatgatggcgccaaattggtgtatccgaaatctgatgagcaacgtcagagattggccactgctgttaaaaacatattgctgttcagatctctagataaagatcaaatgaatgatgtcttggatgccatgttcgaaagagtagtcaaaaaggatgaattggtaatcaagcaaggagatgacggcgataatttttatgtaattcaaagtggaactttccatgtgtttgtcgcaccagatccatcgaaagaacccaatcacattcacacttacgaaaatagtggcagcttcggagagttggcgttgctctacaacatgccccgtgcagctacggtcaaagcgaatagcgaaggttccctttgggctatggataggcagaccttcagacgtanaagtctgcgttcaaaaagaggaagatgtacgaagcgttga

SEQ ID NO: 296 - DNA, 2421 bp, Diabrotica undecimpunctata
atgagttacatgcagtctaaccaaaatagaccaatgtctcaaagctaccatcagggtcccaacgacctgcccatgcagtcttctaaagaacagactttactatggcagcaaaactcatacatgggagactctggcattcaatctggggctgctacacaggtaccatctctgacaggtaaagaggaagaagaaatggatctgtttgatttggatcaaccctatcagggttttacacaagagcaggttgatgaaatgaacaatcaactgaatcatactaggtctcaaagagttagggctgccatgtttcctgaaactttggatgaaggtattgaaatcccttccacacagtttgatcccaaccatcaaacagcagtccaacgtttggcagaacctagtcagatgctcaagcatgctgtagttaatcttattaactatcaagatgatgctgaccttgctactagagcaataccagaattgatcaagcttcttaatgatgaagaccaagtagtagtatctcaggcagctatgatggtccaccagctatctaagaaggaagcatctagacatgctattatgaacagtcctcaaatggtagctgccttagtaagagctatatcaaactctaatgacttggagactaccaaaggagctgttggtaccctacacaagttatcacaccaccgacaaggtttacttgctatttttaaaagtggaggtattccagcacttgtaaaattgctcagttctcctgtagaaagtgttcttgtctatgctataaccactcttcacaaccttttattacatcaagatggatctaagatggctgttagacttgcaggtggtttgcaaaagatggttgcactactccaaagaaaccatgtaaaatttttgtcaattgttactgattgcttgcaaattttggcttatggtaaccaagagagcaagttaatcattttggcaagtcaaggacctattgaattggtcagaatcatgagatcttacgattatgagaagttgttgtggactacttctagagttctgaaagttctttcagtttgtgccagtaacaaaccggctatagttgaagcaggaggaatgcaagctttggcaatgcacttgggaaatccaagtacaagattggttcaaaattgtctctggacattgagaaatctatcagatgctgctacgaaagttgatggtctagaaagcttattgcaatctttggtacaagtattagcatcttctgatgtcaatgtagtgacatgtgctgctggtattctttccaatctgacttgtaacaatcagcgcaataaagtaactgtttgtcaagtgggaggggttgatgcacttgtacgcactatagtcagtgcaggagatagagaagaaatcacagaaccagctgtttgtgcactgcgtcatttgacatccagacatgtggaatcagaaatggcacagaatgctgtcaggctcaactatggaatgcagattattgtaaaactgttgaacccaccttcccgttggccattggtgaaagcagtgattggtttgatcagaaatttggctttatgtcctgcgaatcatgccccgttgagagaacatggtgcaatacatcatcttgtacagctgttaatgagagctttccaagatacacagagacaaagagcaagtgttgcgagtggcggcagccaaccacctggtacatatgcagatggtgtgagaatggaagaaattgtggagggtacagtgggagctcttcacattttatcaagagagtcccataatcgtgccataataagacagcagatggttgtgcccatatttgtgcagctactcttcaatgatattgaaaacatccaacgtgttgcagcaggagtgctttgtgaactagcagctgacaaagaaggagctgagatgatagaacaagaaggagccactgcacccttgactgagcttttacattcaagaaatgaaggtgtcgctacatatgcagcagctgttttattcagaatgagtgaagataaaccacaggactataagaaacgactatctatggagttaacgaactccttgtttagagaagagaacctctggaatccagacctagggatgggccctgatttacaggatatattgagtccagatcaagcttatgacaacatgtacgcacaaggtccccctagtgttcacagtagccacggcggtaggccttaccagcaacaagggtatgaccagatacccatagatatgcaaggtctagatattggctcccatggaggcggaaatgggtcgacctatagcgcaatcgacgccatggatgttaccagcggggatccggatcttaacttcgatactattgatcaacttcccacccctcctcaagataataaccacgccgcagcttggtacgatacagacctgtaa

SEQ ID NO: 297 - DNA, 816 bp, Diabrotica undecimpunctata
atggcccgaaacgccgaaaaagcgatgacaacattagctcgatggagagcagcacaactaggagaaatagataagcataaaaagcgaaggccttatcttgcatcagaatgtaaaaatttacatgcttgtgaaaaatggagaatgcagataataagagaaattgcgaaaaaagtagctcaaattcaaaatgctggccttggagaatttaggataagggacttaaatgatgaaataaataaactactgagggagaagcgacattgggaggaccaaataaaggaattgggtggacccgactatcagagagttggaccgaggatgttggatcatgaaggaaaagaagtacctggaaatagagggtataaatactttggggcggctaaggaattaccaggtgttcgagaactttttgagcaggagccgcctcctcctccaaggaaaagtagagcagaactaatgaaagacatcgatgcggactactatggatacatggacgacgatgacggaattttgattccactggaagttaaagctgaaaagatagccgttcaaaatacagtagctgagtgggttagtaaaaaagaacaaaatttggagaacgcagaagaccaaacagaagaaaatatatatgcagttgaagagtctgaagatgaagatagtaaggaaactgtacaacagttagtagatggatcacagcaaagattcgtagcacatgtacctgtaccatctcaacaagatatagaacaggccctactgaggcgaagaaaacttgaacttatggaaaaatacggcgtagaagaggaaccgaaagcgtag

SEQ ID NO: 298 - DNA, 648 bp, Diabrotica undecimpunctata
atggctggagaacaagatatgcccaccttcaaatgcgtcttggtcggagacggaggcaccggtaaaactacctttgtaaaaagacatatgactggtgaattcgaaaagaaatatgtagccaccttaggggtagaagttcaccctttagtttttcacacaaatagaggacaaattcgttttaatgtatgggacacagcaggccaagaaaagtttggtggtctgcgtgatggatactacatccaaggacaatgtgccataattatgtttgatgttacttctagagtcacttacaaaaatgttccaaactggcacagagatcttgttagagtttgtgaaaatatcccaattgtattgtgtggaaacaaagttgacatcaaagataggaaagttaaggcaaagagcattgtcttccatagaaagaagaatttacaatactatgacatctctgcaaaatccaattacaatttcgaaaaacccttcttgtggttggctaggaaactcattggagatccaaacttagaatttgtagctgcacctgccttgcttcctccagaagtccaaatggatccccaatggcaacaacaaatcgaaaaggatcttaaagaggcctcagaaactgcactgcctgatgatgatgaagatttataa

SEQ ID NO: 299 - DNA, 1035 bp, Diabrotica undecimpunctata
  misc_feature (1023)..(1023): n is a, c, g, or t
atgcctagaataatgataaaaggtggtgtttggagaaacactgaggatgaaattctcaaagctgctgttatgaaatatggtaaaaaccaatggtctaggatagcttcgctacttcacagaaagtctgcaaaacagtgtaaagcccgttggttcgaatggttagatcccagtattaaaaaaactgaatggtctagagaggaagatgaaaaactattacatttggctaaacttatgcctactcagtggagaacaattgctcccattattggaagaaccgcagcacagtgtttggaaagatatgaatatttattggatcaagcacaaaagaaagaagaaggtgaggatgcagtggatgatcccagaaagctgaaacctggagagattgacccaaatccagagacaaaacctgcaagaccagatcccaaagatatggatgaagatgaattagagatgttatctgaagctagagctagattagccaatactcaaggcaaaaaggccaagaggaaggctcgtgagaagcaattggaagaggcgagacgtttagcagctctccagaaacgcagagaactgagagctgccggaatagaagttacttctcgcagaaagaaaaaacgaggagtagactacaacgccgaaataccattcgaaaagagaccagcaattggattttatgatacatctaatgaagtattagatcctatggctcccgatttttcaaaaatgaggcaacagcacttggatggggagctaagaagtgaacaagaggagagagagcgtaaaaaagataaacagaaattaaagcagcgcaaggaaaacgacattcctcaagcgatgttacaaaaccaggaaccagctaaaaaacgatcgaagttggtgctcccagaaccacaaatttcagaccaagaaatgcatcaagtggtgaagttgggcaaagcgagtgaagcagctagggaaatagttacagaaagcggtgttgaaaccactgatactttgttgaatgattatactttcaaccctcanatcaagtggtga

SEQ ID NO: 300 - DNA, 474 bp, Diabrotica undecimpunctata
atgatgcaattcatgttattatttagtaggcaaggcaaacttaggttacaaaaatggtatgtggctcatccagacaagctcaagaaaaaaattacaagagaattaatcacaactattttagctagaaagcctaaaatgtgtagttttctggagtggagagacttaaaaattgtttacaaaagatatgcaagtttgtatttttgctgtgcaattgaacaatgtgacaatgaactcctaaccctggaaattatacaccgttatgtagagctccttgataaatactttggaagtgtttgtgagttggatataatcttcaactttgagaaagcctactttatattggatgaactgatgctggggggtgaagttcaggaaacaagtaaaaagaatgttttgaaagccattgctgcccaggatctattacaagaggaggaaactccgcagggatttttcgacgaccatggtcttggttag

SEQ ID NO: 301 - DNA, 1251 bp, Diabrotica undecimpunctata
atgtatggattacagagaatttcataccgaatatatattcgcaatgggtttcgacattattcccaacaacctgcaaagagaaattcctttattggccggctctttgaaaattttaaagatgagctggccaaaaacaaagaaatgaaagaatctctgaaaaaatttcgagaggaagctcaaaaattagaacaaagtgatgcattaaaagcagctaggcagaaatttgaaagtgtagaaaaagaagctagtaaaagtagtgaagtttttaaagaaagtttaggttctgttaaggaaaaacttaaaggagttatagatgaagctagtaagtcagatttagcaaagaaggctggcaaattcacagaagaagttggtaaaactacacataaaataagcgaaacagctcaagaaattagtaaaactggagcatttcaaagtatatctcaagctactaaggctgttaaacaagaaatagacaatactagtatagaaggtagagtatatgttagtcctaaaatactacggaagagaacagaaacaagtgcagttgtccatcaaaaatattatgaaccaaacacagatgctacaggtgttgaactacacaaagattcaaagttttatgagtcttggcaaaatttcaaagataacaatccatatgtacataaagttatggactggaaattaaaatatgatgaaagtgaaaatcctgtcatccgtgcttccagagcactcacagaaaaagttggtgatatcatgggtggtttatttcagaaaacagaactatctgaaacacttacagaaatatgtaagatagatcctgactttgataccaaaagatttctgaaacaatgtgagactgatattattcccaatattcttgaagccatgacgagaggagagttagaggttcttaaagattggtgtcatgaaggtccatttaatctttttgccgttcctataaaagaagcttataagaagggatacaaaattgaatcaaaaattttagacatcgatcatgtggatttagttttgggaaaagttatggaacaagggccagttttaataatatctttcacatcccaacaagttatggctgtccgagatgcctcaggtggagttgttgagggagatcctgacaaagtgatgagagttaactatgtgtgggtactatgcagagatgtcacagaaccggatcctagagcggcatggagactccttgatctttctgccaacagcaacgaacaactggtttaa

SEQ ID NO: 302 - DNA, 930 bp, Diabrotica undecimpunctata
atgagttccgattcagaactaagtgatagcgacattgagcttcaacaagcatttgcagatggtaagctaaaacctggcttaaatactgtggaagaaggaccaaaacacttcacaaataatgtgagtggtttaaaacaaaaattagaggaaatacaactcaagttaccatggatagaacgactcgactgcgtaaatgctcaagcccctttagcacctgaattagcagctcaaatgttgacacatgagcaaaaaagaagtaatgagcttagaaataataaaaagctcacgcagtttactccaaatgaagacccggttttaaacgactttaaaagggaaatgatgttccatagacaagctcaggctgctattctagattctataccaaagctaaaagatatgggagtactaactaaaagacccgatgattactttgctgaaatggcgaaaacagatgcccatatgcagaagattagggaacatcttatgacgaagcaggagcaacagaagagaagtgagcgagtcaaacaacttagacaacagaggaaagaaggtaaaatgttacaagttcagacaaaacttcaaagacaacaagaaaagaaagatatgcttgcccaggttaaaaaagtaaggaagggaatgtccaaagatcttgacttccttgacggaaaaaataaatcttctgccagaaaaatggcagaaaaacggaaaatgaaagataaaaagttcggttttggtggcaagaaaaagggaatgaaaaggaacacaagagatagtgctgcagatataactgaatttaaaaatcctggtaaacctggaaaaaaatttaacaatagtggaaaaggggtaaaaggtggtaaagtaagcaaaggaggaaaccaaagaatgggtaaaagtaaaaggattaaaatgagatctaaaggaaggaagtga

SEQ ID NO: 303 - DNA, 3723 bp, Diabrotica undecimpunctata
atggatgaactacagaaattggaatatctttccttggtttcgaaggtttgtactgagttagaaaaccatctcggtatgaatgataaagatttggctgaatttattattcatctttccgagaagaatggtacatttgaatctttcaaaaaggcactcatagaaaatggagctgagttctcagattctttcatctcaaatttgctacgaattattcaacatatgaaaccaaagaaaaataaaacgaaagttgaagctgatgtatatcaaaaagaaactctggctaccaaatttcctggtttagctttaccaaatgaaaaacaaaaacctttgtttatagatgaagaagcacctgttggagaaaatgaagatgatgacattgtagctgacctaatgaaacagtttgaagcggatgctccctcaaacaatcaaaagcaaacaacaactaaatctggaagtgcaagtcctatagaaagaaaacgatcagataggtcaagaagtaggtctggatctagaccaagaaaaagacggaaatctaaatcaagggacagggactctagaaaggacaaaaggcgaagtagatccagagaccagaagaaaaacagaagagatagaagtggttctagaagcaaaagaaataaggaaagaagtaggtctaggaatcggagaagcagatcaagagatagaagaagtagatcgagagacaggagaaacagatctaaggatagaaaatacaaaaactattctagagataaagatagaagagaaagaagcaattcacgaggcataaaacgggaaagaagtactgaaaagaagttcaaaagtgaaaaagataatcctgaatttgaagaggatcctaccccaggaaagatatataatggaaaagtatcaaatattgtaccttttggatgctttgtccagctggagggacttaaaagaaggtgggaaggcttggttcatatttcacagcttagagcagaaggcagagttactaatgtatctgaagtaacatctagaggagctagagtaaaggtcaaagtattgacagtaacaggccagaaggtatcattatctatgaaagatgtctgtcaaattactggtaaagaccttaacccacattcccatgctccaactgaaagagaagatagggatagaaatcctgacaggcctgtaaacagcagtacatctgtgttaagacttccagtaaacatagatgaaggagaagaagactcccggaaaagagtaacaagaatttcaagtcccgagagatgggaaataaaacagatgatttcatcaggatgtattgctaagagtgagttgcctgactttgatgaagaaactggattgttacccaaggatgaagatggagaggccgatattgaaattgaattggttgaagatgaagctccatttttgcaaggtcacggtagagccttacatgatcttagtcctgtaagaatagtcaaaaatccagacgggtcattagcccaagctgccatgatgcaatccgctttggctaaagaaagacgggaacagaaaatgattcagcgggaacaggaggtcgattcccagccttccggtaagaataagagttggatagatcctcttccagaggacgaatcaagaatgatgggcagaggaataggcttacaagttcaagatttaccagaatggaaaaaacatgtaataggtggcaaaaaatcatcattcggtaaaaagaccaacttaacaataatagagcaacgtcaatccttaccaatatataagctcaaagaggaattacgaaaagccgtaaccgacaatcaaattcttatagttattggtgaaactggttcaggaaaaacaacacaaataacacagtacttagctgaagctggatttacatcgagaggaaagattggttgtactcaaccaagaagagtggcagccatgtctgtagctaaaagagttgctgaagaattcggatgtcgtttgggacaagaggttggttacaccattcgtttcgaagattgtactagtcccgaaactatgataaaatacatgacagatggtatgttattaagggaatgtctcatggatctggacctcaaacaatactcagtaataatgttggatgaagctcatgaacgaactatccatacagatgttctctttggattattaaaacaagcagtcatgaaacgagaagaactgaaactgatagtaacctcagctactttagatgctgttaaattttcacagtatttctttaaagcacccatatttactattcccggtaggactttccccgttgaggttttatatacaaaagagccagaaactgattatttagatgctagtttgataacggtgatgcaaatacatttgagagaacctccaggagatattttactttttttgactggtcaggaggaaattgacactgcttgtgaaattttgtatgagagaatgaaatctttaggtccggatgtacctgaacttataattcttcctgtgtattccgcgttgccttcagagatgcagacaagaatcttcgaaccagcgccacctgggagcagaaaagttgtgatcgctacaaatatagcagaaacctcgttgacgatagatggtatctactacgtagtcgatccaggcttcgtaaaacaaaaagtctacaactccaaaactggaatggattcgttggtagttacgccgatttcacaggctcaagcaaaacaacgggcaggtcgtgctggtagaactgggcctggtaaatgttacagactatatacagagagagcatacagggatgaaatgcttccgacacctgtacctgaaattcaacgaaccaaccttgcaacaacagtgctacagcttaaaacgatgggtatcaacgacctgcttcatttcgatttcatggacgctccaccggttgagtcgttaattatggctttggaacagttacattctttgtcagcgcttgatgatgaaggattactaacacggttaggaagaaggatggcagaatttcccttggaaccaaatctttcaaagatgttgataatgtcagttgccctacaatgctcagacgaaattcttacaatagtcagtatgttatcggtccaaaatgtattttaccggccaaaggataaacaagcattggcagatcagaaaaaagcaaaattcaatcaacccgaaggtgaccacttgacgcttttggcagtatataatagttggaaaaacaataaattttctaatgcttggtgttacgagaactttgtacaaatccggacattaaagagggcgcaagatgtgagaaaacaactgttaggaatcatggacaggcataaattggacgtagtatccgctgaaaggaacactgttagagtacagaaggccatttgctctggatttttcaggaacgctggaaaaaaggatcctcaggaaggttatagagctctagtagacagtcaggttgtttacatacatccttcaagtgccttatttaataggcaaccagaatgggtaatttaccacgaattggtccaaacaactaaagagtacatgagagaagttacaactatagatccaaaatggttggtcgagtttgctcctgccttctttaaattctccgatcctacaaaacttagtaaattcaagaagaaccagaggttagaaccattgtataataaatatgaagagccgaatgcttggaggatatcgcgagtaagaaggagaagaaattaa

SEQ ID NO: 304 - DNA, 1620 bp, Diabrotica undecimpunctata
atgaatccaggcgccccaaattaccccatggcgtctttgtacgttggggatttacactctgatattactgaggccatgctttttgagaaattttcaacagcgggccctgttctttcgattcgcgtttgcagagacttgattacacgtagatccttgggttatgcgtatgtaaattttcagcaacctgctgatgctgagcgtgcattggatacaatgaactttgacttgattaaaggacgtcccatcagaataatgtggtctcaacgagatccatcattgagaaaatctggtgttgggaatgtttttattaagaatttggatcgttctattgacaacaaggctatgtatgatactttctcagcttttggtaacattcttagttgtaaggtagctcaagatgaaaacggctccagtaaaggatatgggtttgtacattttgaaactgaagaagctgcaaataaatctattgaaaaggtaaatggtatgttgttaaatggaaaaaaagtatatgttggccgctttattccacgcaaagaaagagaaaaggaactgggagaaaaggccaaacttttcacaaatgtatatgttaaaaattttggtgaagatttatctgaggaagagttgcggaatatgtttgaaaaatatggtaaaattaccagctacaagataatgagtaaggatgatggtaaatctaaagggtttggctttgttgcatttgaaaatccagaggcggccgaaacagcagtagaagcattgaatggaaaagagttgatggaaggaaaacctttgtatgtaggaagagcccaaaagaaagctgagcgccagcaagaactaaaacgtcgatttgaagcccttaaaatggaaagacttaatcgttatcagggtgtaaatctctatgttaaaaacttggatgatactatagacgatgaacgtctccgtaaagaattctctccgttcggaaccataacttctgccaaagtaatgatggaagaaggtagaagcaagggttttggtttcgtatgcttttcctctccggaagaagctacaaaagcagtaacagagatgaacggcagaattgtcggtacgaagcctttatatgttgccttagctcagcgtaaagaagatcgcaaagcacatttaacatctcagtacatgcagcgcatggcaaatatgcgtatgcaccagatgggccagttcattcaaccaggtgcgtctagcggctatttcgtccctaccattcctaccgcacagagattctatggaccagcccagatggctcagattcgtaccagtcccagatggcctgcccaaacacctgtaagaccaggtgctcaaggaggagctactgcctacactggcatgccaaacacttacagagcggctactcgtccaccaaaccagtcaacaactatgcgtagcaacatcagtgtacctagaccaattactggacaacaacctcaaagtggcgtcgtaccttcaactggtcgaacagcaaacttcaagtatacttcgaacatgagaaatccaccacaatccatgggaggtataccaggagccgcagctcctgtacagcaagctgtacacatccagggtacgcatgtatgcagatatggcaggtaa

SEQ ID NO: 305 - DNA, 2742 bp, Diabrotica undecimpunctata
atgaccgactctaaatattttactactaccaaaaagggagaaatatttgaattaaagtcagagctaaataatgataaaaaggaaaagaaaaaagaagctgttaaaaaggttattgcttctatgacagtaggcaaagatgtttcagctttgtttccagatgtagtaaactgcatgcagactgataatttagagctcaaaaagctagtttatttatatttaatgaactatgctaaatctcaacctgacatggctattatggcagtaaatacttttgtaaaggactgtgaagatcccaatccacttattagagcgcttgctgttagaacaatgggttgtattagagtagataaaatcactgaatatctttgtgagccactaaggaaatgtttaaaagatgaagatccttatgtaagaaaaacagcagctgtttgtgttgccaaattgtatgacatttcatctggtttggtagaggatcaaggctttttagaacagctaaaagaattgttgagtgattccaaccctatggtagttgctaatgccgttgcagctttatccgagataaatgagagcagtcctactggtcaacctctagttgaactcagtacaaacactattaacaaacttcttaccgccctaaacgaatgtaccgaatggggccaagtattcatccttgattccctttcaaattatacccctcgtgatgaacgcgaggcacaaagtatttgtgagcgtattactccgagactggctcatgcaaatgctgctgtggttttgtctgctgttaaagttttgattaaaatgatggagattctggctggagatactgatttctgcaatactttaagcaagaaactagctcctcctctggttacattgcttagttccgaaccagaagtgcagtacgtggcattaaggaatattaatttgattgtccagaagaaacctgatatacttaaacacgaaatgaaagtattctttgtcaaatacaatgatccaatctatgtgaaattggaaaagttggacataatgatccgtctagcatctcaagtcaacattgctcaagtcctcagtgaactaaaagagtatgctacagaagttgatgtagactttgtcaggaaggccgttagagccattggtagatgtgccatcaaagttgaaccttctgcagagagatgcgtggctacacttttggaccttattcaaactaaagtcaactacgttgttcaagaagccattgttgtaattaaagatatatttagaaaatatcccaataagtatgaaagtattatcagtacactatgtgaaaatttggatactcttgatgagcccgaagcgagggccagtatggtatggattattggagaatatgcagaaagaattgacaatgcggatgagttattggatagtttcctggaaggttttggagatgaaaacgctcaagttcagttgcaattattaacagctgttgtaaaactgtttttgaagcggcctcaacatacacaaggcttagttcagcatgtattaagcttagctacacaggattctgataacccagatctaagagatcgtggttttatttattggaggttattaagtaccgatcctgcagcagccaaagaagtagttcttgccgacaaacctctgatttctgaagaaactgacttactagaacctacacttcttgacgaactgatctgccatatatcttccctcgccagtgtttatcataaacctccaactgcctttgtcgaaggaaggtctgcaggtattcgaaagtctttgccagctagacaaggatctgctgaagaaacaagtagcgctccagaaccaactgttattcctaatcaagagagtcttattggtgacttactctcaatggatcttaatgccccagctcctccgatcgcacaaccagctgtaccagccagtaatgtagatcttttaggtggaggattggattctttgttggatattggtaccactcctgcacctcccacaactacgggacttcttggtgacatttttggaataccaactgctcctaccatgtataccccacccaaaactatatggttaccggctgaaaaaggaaaaggattggaaatacatggagcgttttcaagaagagccggacagatgtctatggatttgacattcaccaacaaagccatgcaggcgatgtctgcctttgctattcaatttaacaaaaacagcttcggcatagttcccggttcaccactcactgtacctgcccttcagcctggacagagcttggaatataatttagcgttggctactactggaccagtacaacgtatggatccactcaccactctccaagtggcaattaaaaacaacgtcgacatcttctattacgcctgccaaattcccattcagattctgtttaccgaagacggcactttggataagagggttttccttactacttggagagatattccggcagctaatgaggtccaatacactgttaatgatgttaaggggaacaccgatggagtttctagcaaaatgacattgaataacatctttactatcgccaaacgcaatgtggaagggcaagacatgttatatcagtcactgaagttgacgaataatatctgggttttacttgaactgaaacttcagcctggattaaccacagctacacttagtttgaaatctagatctgtagaagtcgcaccgtacgttttccaagcttatgattcaattttgaagaattag

SEQ ID NO: 306 - DNA, 498 bp, Diabrotica undecimpunctata
atgccacccaagttcgatcccacagaaattaaatatgtttacatgagatgtgtcggaggtgaagtgggagctacttcttctttggctcctaaaatcggtcctctaggtttgtctcccaaaaaagttggtgacgatattgccaaaggtactgctgattggaaaggtctaaaaatcacagttcaattgaaaatccaaaatcgtcaagctactatttctgtagttccatctgcctcttccctgattattagggctcttaaagaaccaccacgagacaggaagaagcaaaagaacattaaacacagtggtaacattacttttgatgaaatcattgctattgccaggcaaatgaggcccagatcaatggccaaacagttatctggaactgtaaaagaagttttaggaacagcccaatcagttggatgtacaattgatggtaaagcagcacatgatgttattgatgaggttaatgaaggaaccatagaagtaccagatgaataa

SEQ ID NO: 307 - DNA, 1095 bp, Diabrotica undecimpunctata
atgccagaagaaggaaaaagggcattaattttggttggaggttatggtaccagattgagacctctaactttaagtagacccaaacctcttgtagaatttgcaaataaacccattctgcttcatcaaatagaagctcttgtagatgccggagttactgaagttatattagcagtgtcatatcgtgctaaacaaatggaagaggaattgacagtggaagccacaaaattgggtgttagtataatattttcccatgaaacagaacctttaggtacagcaggaccaattgcattagccagggaacatctttctaaaagcactaaaccattctttgtccttaattcagatattatttgcgatttcccatttaaagcattggcagaattccataaaaaccatggaaaagaaggtacaatagtggttactaaagtggaagaaccatcaaaatatggtgtagtagtatatgacaaagacaacagcatccaaagttttgtagaaaaacctcaagaatttatttctaataaaattaatgctggtttatacattttaaatccaagtgtcattaataggatagaattaaaaccaacttctattgagaaagaagtatttccttacatggcggctgataaacagttgtatgcatttgaattggaaggtttttggatggatgttggtcaaccaaaagattttcttactggaatgtgtttatatctgaaacatttaaggcaaacaaatgaagaaaaactttataaaggaccaggtgctgttggcaatgtcttagtagatcctactgctaaaattgggaacaattgtcaaattgggcctaatgttacaataggaccaggtgttgttatagaagatggggtatgtataaaacgatctacaatacttaaagatgctacgattagctcaaattcttggttagaaagctgtattgttggatggaagtgttgtgttggaagatgggtaagaatggagggttccacagtactaggagaagatgttatagttaaagatgaaacatacattaatggaggtcaagtgttacctcataaaaatattgcaacttcagttccagaacctcaaattatcatgtga

SEQ ID NO: 308 - DNA, 897 bp, Diabrotica undecimpunctata
aatctgtcaactagaaaacccaacctaaacatggcgtcagacggggacgacgttattagtgaccaagaaaaagtgaaaatagtatcggattttattctccattcaccacctggtgaatttaatgaggtatttaatgatgttagaaaacttttaaacgacgatgaccttttaaaagaaggcgctagcggagcattcgctcagtataataaagatcaactgacccccgttaaaatagaaaacgccgatcatttagtgcttattacggaatacaacgatttagggaataatagattcttcgaccccagaagtaagcagagttttacctatgatcacttaagaaaagaagcattagactatcaagtctatacccccgatagcacttctgagccttggagggctgccttagactcagagttcattcagtacactaggaaccattataaagatggagtatgtagtgtggtaggccgcaaccagagcggagttattaacttaacagcttgtattgaagaccaccagttctctcctaagaactactggaatggaagatggagatctcagtggtccattagtctaactgatgattccactgctgaggttcgaggcgtactcaaagtacaggtccattattatgaagagggtaatgtacaattagtgagtactaaagaaataaaagaaactgttcctgtttcatctgaggcacaaactgctaaagaaatcatccaagtaatagaagccgccgaggatctctatcaaacggcaatttcagaaaactatcagaatatgtcagatacaaccttcaaggccctacgaagacttcttcctgtcaccaggacaaaaatggattggaataaaatcgtatcctatagcattggtaaagaactcaaaacgcaatga

SEQ ID NO: 309 - DNA, 2127 bp, Diabrotica undecimpunctata
atgaaaccagtgtttgtttatatcaccgatatcgcagatagtgttcaaaacattggagaatacacgattgttccttctcagtatagaactagagtaaaccaatatttgactgatattaagtttggattcctccaaattaatttaactgagtctatcaaagttaatacatacactacaacccaaacaaccatagaattaacaccggtagtatggagccggcccattccactaggttggtattttcaattccaatgggagaaccagtacggcaaaaattggcccaaaactctatgtgacgattggctgagaacggacagatatctaaagaacttcgctcacgaacttgctcagtgtccctgcaccgtcgaacaggctttagctgacaagggcaggtttatgccagatttcgactgtgacaaagattcgaatccgatttgttactataacaaccaagcacttcattgtgtgaaaactggatctcccactttagaaggctctgaacaacaatgttgctatgataaaaacggctttttgatgctctcttacgatcaacaatggggttctagtccgagacgttgccacaacttaggtaaaatgccttacaatgaagcgacaaaagttcctactctctcacaatggtttaatgatatggtacccaaatatttgtgttgcctttggcaagaagagcaagctgtgggatgtgaaacactaagatttgaacgtagaccaacacaagattgtgtagcttaccaagcaccaggcgtcgcaggagtctatggtgatccacactttgttactttcgacgatgtagaatatacgttcaatggaaaaggggaattcgcattggtgaaatcagttacacaaacggacaatctggaaatccaaggaagattcgagcaaatggaccctaacgcttatggtgaggttagagctactcagctgacatctgtagtagctaaaggtaataacacaatagcagttgaagtcagaaggcgaccactagattctagatggagatataggttggatgttatagcagataatagaagactgtatttcgatagaccctcactaaaattccagcacttccaaggagttactatttatactccaacctacatccttaatcaatcagaagtcatcattatgtttgacaatggagctggaatggaggttgtcgataatcaaggatacatgagtgcaagagtatttttgccttggtcgtttataaataaaaccataggcctttttggaaattggagtttcaacaaagaagacgactttacacttccagatggttccagagcagcaatagtatctaacataaatgacatggaaagggtttacactgattttggttccaaatggatgttagatgatgtgttagatcctcaaaagggtagagcgttattccatagggaatttggaagaacttcagccacttacaacaacaagacgttcaagcctcaattcctaatgaccccggaagatttcataccagccaacagaactgcggatattcagcgaacatacgaaatatgtcctctaaggatgtacgaatgttactacgattacggtatgacgcttgatagggatttggcacattataccaagaattataaagccacaatatatcaatataaagaaactacaaggaccaaagttgtgtcttgtggtgtactggaaacaccgaggtttggacgaaagagtactttcctgttcgtgcctggaactaaggttacctacgaatgcattcaggagttcgtgctggtaggtgatcagcgcagggagtgtcaagcggatggaacgtggaatattcctgaatacggatacacttattgcttacgtcagcaagaatactcccaacgacaggctggtctggcttccgggataattatggcaattcttataccgctcatcttgcttttcgtctatctagcgtatcgtttcttacaaaaaaagcagaaagagaaagaagctgaaaaattagaagagcagcaatttatggatcaacaaagaagggcacacgaagcagctactaagaagttaacagaagccgaatatgcttcagaagatgaagacagtaatgttacaagcacgggcgcaaaagaaacaactgtatattaa

SEQ ID NO: 310 - DNA, 303 bp, Diabrotica undecimpunctata
atgtcgtcgtcttctgattcggattcaaccttcttttcttccttcttggcctctttcttttcctcagcagctggagcagcagcaggggcacctccggcagcaggtgcagcaccaccaccaactggcatggagctcaatttctcacggccttgtgcaatgagttcttcaactgacttgccactgagctcgctgatgactttctttactttttctccttcagcttcaacacctacagaccctaatattttttcaagatctgcagcattgggagaggcttttccgcccaaaacggccaataagtaa

SEQ ID NO: 311 - DNA, 2724 bp, Diabrotica undecimpunctata
atgatgactgaccgtttcggtttaaaatgggacccgaaaaacttagagataagaaccatgtctgtggaaaagacattggaacccctagtgcttcaagttaccactctcgtcaatacaaaggggcctagtaaaaagaagaaaggaaagtctaaacgtgccaatgctctggttagtactgtggaaaaagccaccgaaaacttcatagaaaagggggagcagatagcctatgagaacccagatattactgaggaaatgttagcagctgttgacgaagtcaagaaaactggacatgctatgagtggggctgcaagagaattttcagaagacccatgctcttctttaaaaagaggaaatatggttagggctgctagaaatcttttatctgctgtaactcgtcttctaattctagcagacatggttgatgtccatcttttgctcaaatccttacatgtagttgaggatgaccttgaaaaactaaaaaatgcttcaagtaatggcgaacttttagacaatattaaagcctttggtcaaaatgccaacgaattaatgaatcaagctgctaaacggcagcaagaactgaaagatccacaacttcgtgatgatttagcagctgctagagctgtacttaagaaacattccactatgttattaactgcatctaaggtttatgtacgtcatccagaattagcagctgccaaagcaaatagagattatgttttaaaacaagtctgtgaagctgtgaatactattaatgatgtagctcagggaagaactcctcaacctgcttctggaccatatgatggacctggagagttggctgctgctttggatgattttgatgaccacatggtaatggagcctctagcatacaatgaagttcataccagaccttcattggaagaacgtctagaaagcattataagtggtgcagcccttatggcagattccagttgtactagggatgaaagaagggaaaggatagttgcagagtgtaatgctgtaagacaagctctgcaagacttgttgactgaatatatgacaaatatgggcaataaagataaaagtgagagcctagtaagagcaatcgacaatatgggtagaaagactaaggatttaagaagacagctgagaaaagctgttgtagatcatgtatctgacagtttcttggaaaccaatgtacctctcctcgttttaataaaggcagctcaaaatggcaacgaaaaggaggtagaagaatatgcagttgtatttactgaacattccaataagttagtagaagttgctaaccttgtctgcagcatgtctaataatgaagatggcgtcaaaatggttagatatgctgctgctcagattgacaatctgtgccccgaagtaataaatgcagctagaattttagctgctagacctcgcagtaaagttgctcaagaaaatatggacgcattcaagcagtcatgggagaatcaagtcagacttctgactgaagcagtggatgacattactactatcgatgactttttggctgtttctgaaaaccatattctggaagatgttaataaatgtgtacttgcgttgcaagaaggtgattctgacacattggatcgcactgccagtggtataagaggaagatccaatagggtatgcaatgtagtaacagctgaaatggataattatgaaccttgcatttatacaaaacgtgttcttgaagctgtcaaagtattgaatgaccaagtcatgccgaaatttactcaaagagtgcaagttgcagtccaagctttgggaaatagtcctcccaaagaagtggatgaaaacgattttatcgatgcttctagacttgtttacgatggagtaagggaaataagaagagccgttctaatgaatagagccgatgaagatttagatccagaggatgttgaattggatgaaaactatctgatagaaacaagaagcaaatcgagtgctcacacaggcgaacatggagttgatgagtatccagatattagtggaattacaaccgctagggaagctatgggtaaaatgccggaagaagataaacagaagattttgcaacaggttgagttcttcaggagtgaaaaactcaaatttgatcgggaagttgctaaatgggacgacactggcaacgacattatcgttcttgctaaacacatgtgtatgattatgatggaaatgacagattttaccaggggtcgtggccctctaaaaaccaccatggacgttattaatgcggctaaaaagatttccgaagctggaaccaaattagataaacttactcgtcaaatagccgaacagtgtccagagagttccaccaaaaaagatttgctggcttatttgcaacgtattgctctctactgccaccagatgaatattacctcgaaggtcaaagcggatgttcaaaacatcagtggagaacttattgtgtctgggttggatagtgctacttctttgattcaagctgctaagaacttgatgaatgctgtagttctcacagtaaaagcatcatacgtggcatccaccaaatacccaagacaaggaactatcgcatcgccaatcgtcgtttggaagatgaaagcgccagagaagaagccgttagtcagaccagagaaaccagaagaagttcgtgccaaagtacgcaaaggctcacaaaagaaagttcaaaatccaattcacgctctttctgaatttcaaagcccaaccgagtctgtgtaa

SEQ ID NO: 312 - DNA, 1236 bp, Diabrotica undecimpunctata
atgtcgttctcgtttggagccaccccagttccaactcaaaaaaccgttgcctctggttttactttgccatcgaatccaatagtatcttcaactactggaattcaaagcacatttggttcaggagataataaagaccaaagtaaaccttcattgtttgcaactccctcaagtcagcctgtttcatttgggttaactacaaaagccaatacagccccaacaaccctctcctttggttttgctactcctacgactttaccgtttggatcatcaactacaattacacctgcaacaactcctcaatttggattatcgcttccaaaagctagtgctccagccactactagtttttcacttctaggatctgctccagccactactgcagcagcacctacaggtatatcatttggtactgccactactgcagcaacaacttcagttacaggtttatcatttggaactccaattgggactgctacaactgcagcaacaacttcagcttcaggtttatctttcggtcttacaaccgcttcttctacaagttctgccgcacctacacttttgtcttcaacgacaacttcgacaacatcatcagtgtctgcatctggtgctttgagtagtacaacatcagcaccgacttttgccacctcatcgttgccgtcaacaggcaccttaacattctctcaactcgaagattcgatcaacaaatggaccatggatctagaagaacaaggaaaattcttcatcaaccaggctaagcaattaaatgcatgggatactttacttatatctaacggagagaagattttaacgcttaacagcagcatcgaaaaagtcaaacaacaacagcaacagttagaccaagaattagacttcgtgctggcacagcaaaaggaattggaagagctgattgtaccgatagaaaaagaattgctggggatacctgttacggatattgacagaaatcaaatgtaccaattttcggaaatagtcgattcacaattaaaacagatgtctgatgatttgaaagaggttattgaacacataaacgaagccaacaaagaggaagaagcaacaaatccactaagccaaatcagtcgcatattaaatgcgcatatgaattccttgcaatggatcgataggagtacagcgcagattagctctcatctagaacaaattggaaaaatgcaagactcaaacaggagaaatcactcttttaataattccatgaatttttaa

SEQ ID NO: 313 - DNA, 582 bp, Diabrotica undecimpunctata
atgtttctgtgggactggtttacgggaatgctgggatatctaggattatggaagaaatctggaaaactattattcttaggactggataatgcaggtaaaactacccttctacatatgctcaaggatgacagactggcacagcatcttcccacgttacatcccacatcagaagagctttccattggtaacatgaggtttacgacgttcgatttagggggccacgagcaagctaggagagtttggagggactattttccagcagtcgatgccatagtgttccttgttgatgccaacgacagctcaagatttgtagaaagccaggaacagctaaatgccctcctctcagatgaaactctttccaactgtccaatacttatcttaggtaataaaattgatctcccaggtgctgcttcagaggatgaactacgaactagatttggcttgtttggccaaacaacaggcaaaggcaaagtagctagaaatgatctacctggtaggcctctagaactatttatgtgctctatactcaaaagacaaggttatggagagggattccgttggttggcacaatatattgattaa

SEQ ID NO: 314 - DNA, 573 bp, Diabrotica undecimpunctata
atggatgaaattaacctagatttgttggagaagcgtatagaagctttagaattaaaggtgtttcctgcaggtgatcccactactattgccaacaaaaatcaaacaataacaaacattcttacacaagttcagacctttgttaccacagctctcacttgtagagaaacaataacgtccatgttgcagttttatggaactttaaatgaatatcttgacccagctggtggtgcagatgaactcgaggtagaagcaaaaagacattatatattgcagttgcacccagagatcaaagacaccctacagacccatactcgaattttgcagagtttacttccatatgtagaatcagaaaacatttccaaagtggttgaaatgactgctcaattggaagaagcatctgttagtcacctcaatttgtatggagagtggagagatacaatgtacaaaatggtcgttgctcttcaagatttcactgatataatgagttcaattaaagtattgttctcccaactagataatacattaacaaatctggaatactcacttcaaccaaaatttgttacagaggaataa

SEQ ID NO: 315 - DNA, 1725 bp, Diabrotica undecimpunctata
atgaataatacaaaaacgcaggaagtctacagtgacctaacattatttacaactccagataagttcttcttggagcccaaaaatggggaggaattattagtgatagagagagtaactgaagagatttcagtttacaaaaatcaccgtcacatcataccagcagctagtagtcgaaaagatttctgtggcctccttggtataattaggctgttgtctgggccatatctagtaattgccactcagagagatatagtgggttatatatcaggttgtgcagtatggaggctagtaaaggcagaactcattcccttcaggagctccctaaacttaagtccagaaaaacaagctgacaatgaagtgtaccttagtatgatagaacaagttttaacaacaccctttcagtatttctgttatgattacgacctgacacattccctccagcgccttcgggacatttcgccagatttctggaaacagtccctgtgggaaagagctgatcaacgatttgtatggaatggattcctgttgagccctttcaaaaatgtaatcagcaaaaagttttgtctgcctttgatcctcggatttgtttctattaacttttgtgttattaatgggcatagcttgaactggatcattgttacaaggaggagcgttttcagggcaggtaccagattattccgcagaggcatagacaaagatggcaacgtcgctaatttcgtcgaaaccgaacaaatcgtagaataccaaggggaccatgcgagttttgttcaaatcagaggctctattccacttttctggcagcaaaatcccgatttgcgtcttaaacctcctccaaccatgatcgatatggacccacaagagcaacattccacctgtttgaagcatctagaagaattggcaactttatatggcaaagttgtgttagtcaatctcattgaccaaaagggagcggaaggtaacatggagaaatccttcaaggaggccatgagttcattgtcgtatccttcagctcgatacgaaccgttcgatttccattctgaatgtagcaaaatgagatgggatcgtctcaaaatcctaatagaccgtctagccctggaccaagacgaaatgggcttctttctcttattacgggatggttccttaagctcgttacaagacggagtcttcagaacgaactgcatagattgtttggacagaactaacgtggtccaaagtatgctagcgcacagaaatttagaggtagttttaagaaaattgaatattttacaccaaaaccagaacttggagttccagtattccttcgaggttttgtttaagaatgtatgggcagataacgccgatattataagtacccagtactcgggaaccggggctttaaaaacagattttactagaacaggtaaaaggactaaggctggagtttttcgagatggagttaattcgcttactagatactataaaaataatttaacagacgggtatcgccaggatgccatagatttgttcttaggctatggcaaaccgatatctccactaagagtagacaaatcgtggcgatatattacgtacccttcggtacttttggtcgctgtatccatgtttgtagcttctgctgtatttccttcggaatactcaaccgaatctcttctgtttttgttattttggggttctatggtctacgccacattgcacaccatattcagatacggcgttgagttcgtggac

SEQ ID NO: 316 - DNA, 1749 bp, Diabrotica undecimpunctata
atgcctcctacaatccagcaaaacaaccagaacgggacagccaatggcgttgaaaaaagaccagtaaaaactgtagaaaaaaggtcagatttaatatgcaaagtgaagtactgtaatactttacccgatattcctttcgatttgaagtttatagcatatccttttgaacccataagatttattcaatacaacccaacatccctagagcgtaattacaaatatgaagtgttaacagaacatgacttaggtgttagtattgatcttataaacaaagatatatatgctattgaaccaggagctactttagatcctgctgatgaaaaattactagaagaagacattctaacaccgcaagactcaaaaagatctcgccatcatgccaagtcagtgtcctggttgcgaagaactgaatacatttcaacagaacagaccagattccagcctcagactatggacaaagttgaagctaaggttggttatagtattaaaaagtcccttaacaatgaaactttgtacatggacagagactctcagattaaggctattgaaaagacctttgaggattctaagaatgtcattgagaagcattacagcaaacctaatgtggtagctgtggatattttgcctgtttatccagatttcagcctttggaagtacccttgtgcccaagttatttttgattctgatccagctcctgttggcaagcaagtaccagctcagattgaagagatgtctcaagctatgatcagaggtgtgatggacgaaagtggagaacaatttgtagcctactttttgcccacagaagacactctccaaaaacgaagagatgattttgtcaaccagataccatatcaagatgatgaggaatatgaatataagatggcaagagagtacaactggaatgtaaagagcaaggcaagcaaagggtatgaagaaaattatttctttgtggcacgaccagatggaatttactacaatgaactggagaccagagtaaggctgagtaagagaagggtcaaagctggtgctccacctagtaacacaaggcttattgttaaacatagacctatggatgctaatgagttccgaatgcagaggtaccgggagaaacagctggaaccaccaggtgaagatgatgaggaaatggaagtagatgaaccacaagaagaagaagctactcaagaagaacaagaacaagaaaagggggagaaatcaccatcccgctctagatctagatcaaactcatctaacagaagcagatctaggtcaaaatcaagatccaagtccagatcaaaatcaagatccaagtctaagtcacaatctagatccagatctaggtctaaatctcgttccagatcccgatcgagatctaaatcccgctccaagtccaggtctcattcaaaatcgaagtctaaatctaaatcccgttcccgatcgaaatctaagtctaaatcccgttccagatcgaagtctcaatccaaatcgccttccagatcaagatcaaggtctcgttctaagtcaaagtcgagatccagatctgcttcaggctctagatcaccttctggctctagatccaggtcaccttccaaatcaaagtcaaggtccagatccaggtctagatcaggttccaaatctgcttctagatctagatcgtcttccaaagcttcttccaaatcgggatcaaggtccagatcaggatctcgatcaggatcgggctcagaatcggggtctggatctgaaagtgactaa

SEQ ID NO: 317 - DNA, 1170 bp, Diabrotica undecimpunctata
atgccgattgaaaatttagaagaccagggtcttgagaaaaaccctgatttagaattagcacattgtaagtttctgttaaatttaccagaatatcgtagtgataaaaatgtccacgcaaaaataacagaagctataaagaaagatgatatggccccatggtatgaactcatttgtaaagatgctggttggaaacttgatactaatctactaagtgcattaaaagctaagaacgctgagaagatcaagcttttagatgaagccatagaagatgctgagaaaaatttaggtgaaatggaagttcgagaagcctacttaagaaaagcagaatactacagccgaattggtgataaagacaacgcagttagtactttcagacaaacatatgataaaactgtatcacttggccatcgtttagatattatttttcacttgataagaattggtttgttcttcatggaccatgatctcatcacaagaaatattgaaaaagctaaaacccttattgaagaaggaggtgattgggatagaagaaatcgtttaaaagtttatcaaggtgcatattgtatgtctgtcagagacttcaaatcagctgctaacttgtttttggacacagtaagcacttttacatcgtatgaactaatggactataaagcatttgtcagatatactgtatacacctctattattagtttgccaaggaaccaattaagagataaagtggtaaaaggttcagaaatattggaagtattgcattcggaaccatttgtaaaagattacttgttttctttatataactgtcagtatgccgaatttttcacaaatcttgcagaagttgaaatagtgctgagaaaagattatttcttgaatcctcactatcgtttttatgtaagagagatgaaaatacttgcttatacacaattgttggagtcatataggtctcttacgttacaatacatggcggaagcctttggcgtcactgttgaatacattgataaagaactgtccacatttatagcagcaggaagattacattgtaaaattgatcgagttgggggaattgttgaaactaatagaccagatttaaagaatgcccaatttaattctgttgtaaaacaaggagatttactgctgaatagagtccaaaaattatctagggtgatcaatatctaa

SEQ ID NO: 318 - DNA, 4707 bp, Diabrotica undecimpunctata
  misc_feature (15)..(15): n is a, c, g, or t
  misc_feature (1548)..(1548): n is a, c, g, or t
  misc_feature (4681)..(4681): n is a, c, g, or t
atgtcaaaggccggntaccacgcaggatgtcaaaggccgattgttacttctattccaaaatatggatggaagtgtagatgttgcagagtgtgcggcgattgtggatcccgaactcccggagctggcttgtcttcaaggtggcacgcccattacacagtttgcgattcctgctaccagcaaagaaataaaggcttctcatgtcctctctgccataaagcttaccgagcgcatgctcatagggagatggttcaatgctcaaattgtaaaaaatttgtccatgggacgtgcgacgctgaagcagatgttgctacctaccaccaaaagaaagatcttaaccctgaatatgaatatgtatgcttgcattgcaaaaatagtactgctagacaaataactgcaaaaagagcaagtattgaagattcatcggatgtaccagcttctcatgaatctctttacgatgacacctcagaatttgacctgccttctccagacgaatttgcccgtagcatgggtatgggcaaaggaaaaccgttcgccagcaaaattgcgaaaaagcgcattaactttcccattgccggtaggccaaaaggtacaggtaaagtacctcccggtaaaatgggttttatgaaacgatctcgattatcggattttaataggaaaaggggccataaatcaaaaatgtgcggtattttcggcgtacctggtgttggacttcaaagaccgactgccgatggaaaaagcgacgaagagccgggcgtggagaatagattggttttatgttctgccaaagataagtatacgttgacgcaagatatttgtgtcatgtgtggagcgcttggaatggaccaagaaggatgtttgatcagttgtgtgcagtgcggacagtgttaccatccatactgcatcaatgtcaaaataacaaaagttatattggagaagggatggagatgtttggactgtacgatttgcgaaggttgtggtcagcgaaacgacgaagctcgcctgatactctgcgatgactgtgacgtatcgtttcatatctactgcatggatccaccactcgactacgttcctcacggcaattggaaatgcaaatggtgtgcgatgtgtctcaattgtggggctaccgatcctggttttaactgcaattggatgaacagctctacccagtgtggcccatgcgcatcacatctcaattgtcctagttgtaacgagccgtacggtgatggagaattgattattcagtgcgttcaatgtgagagatggcttcatggttcctgtgattgtataaaaaacgaagacgatgccgaaaaatgcgcagaagacggttacaactgcatcctttgtcggccaagagatgtaccaccgccccaccttgtaccgccgccgcccgctccaaaaccaccaacccctacgaagagtcctgaagtcgggaaaagttcgagtttttatttggacggtgtttacctaagtgagatggggaacagctttattaaatcattagctttggaacatcatggctcgcgaaagaaacgaaaaaaacttcctacnggcggaaatgctggtggagcgactgctttagaagacagtgctaaactagaattggtcgacgtcaaagacgaacctcaagagctatacaaagaaggcatgatttggacaaaggaggatggtcccgcacctgaaggtttcacggtgtttaccatggagagcggaatcagcgtcttaaggcgcaagagacaacggaatctacagaaactaggcataggtggttttctagtcagaatgagaggcattcgaaccggtcaggataacgatgaaatcgattcctcggttatccagtctggcagtgctacacctacggagctcctacctcccatgcctgttgatggagataaaccaaaaagaaaaccgattagaagaaaaccaaaaagcaagctagccgaaacttttccggcgtacttacaagaagcctttttcggtaaagatcttttagaaactgttgattgtaaaaaagaagtcgacagttgtagtagcgacgacgaaaaatctgtgaagtataaatccatcaatttgtctcaggatgaattgatggctgtagctgcagtctcgggcaaaagtgaaaagcaagcaatagctagtattaaagactcactgaaggatattaaatcatctccaatgataaaggaagaagacgacgataatacagaagacttaaaagatgtacttgccttacctggagatttacttgatgcagaaatagttaatagtattatggaagacgatgacgagcttactaaaaatacagaatcactggaagttttagataccaaccttcaagatgatactgagttgactgacacattgggcagctccggcaactcgaaagaaaccaaagatgagttgagtgatattctaggaccacattttaatctggaatcgatttctaatatcaacagcaaggatgtagaagacatatttaagggtgtattgactgatgaatcacaggaatcacaagagagcagcaattttgccatacaaggaagtaatcttttttccaacaatactcctcagccaagtttagctcagcattccatgatgactcctgctgttcgtcctaaaacgttacccaatgtgagccaagtcaatttaaattcaccagtaggatttcctccaccatcaccttaccactcagaatatagcaacagccctcagttcagtcctgcttttaccgagtctcctaacgcctgggtcggagttcccgaaactcctgaaatagacagtaccaacgtaggagttccttcaacgtacaatcagcgttcctcggaaaagatgaaagccgacgaaagtttgggcaacggtgctaccatttctgcagttctctatgctaatatgaatcatccagaatggaagaaagattttccggtttggtctgatagatacaagcaaataatcaagaaatggaggacactaagtcaagaacagaaagctccatatcttcaacatgcaagagataatagaagccaattgagaatgaagaaggcccagcagtcacagacctccaaggagtccaccgcatccgcatcaacccccaacgtgaccaagccagtccatgccgtcccagctctagtgaccaccctccaggcagtatcgcagcagcccgtgggggtgactacagcccccacggctcccattacagaggaccaagaaaagatggcactgcaacagaaatctgccagggaagccgaacaagaaaggcaatggaaacagcttcaagctatgagacagcagcagacgcagcaacaacagaatattatacacgaacaacgtgttcaggccatcgcgagagtccagcgacaaatatccgtggatccagctcaacagtttttgtcggaacaacaaagtcccttgcaaccaagtacgcctcaggagcttagtccgtctgctacaccaacaccaagcccaagacagttcataggaatgaaatccccgacctttcctcttccttcaccagtggctcagacagcaattagacctcctacaccctctcattctccacatgatgtaagtcaggcaagcacccctgacggtaatgatcactttattcaatcaccttctactcctaaacctaattttcctactagattacctacagatcaatttatccaccaacctgcaactcctaggccccagtttggaatacaacggccgcctttacagaactttggtaatacgatgaggacagatcagcaggatattaatatcaaccggcagttacgagatcttctccagcgacaacaggtgaaaaaattggatgaactgttaccaggtaaagttcaacaacaaagagtgtggcctccaattgaacaacaagaaaatgaggcctcggcaactactggtacttcggcagttgtggctacaacagcagataccactttcaggcaaccattaccgcccagcattgtgcgacctagagtggctctctctttagctggtcgagcaggtcctggtactattagggttggccagttagatgcccgaatgcaaggcctggatcctagaatgagattaattttgcaacagcaagttggccaacaacgattatctacgggaattcagcatcaattcgtacggtttacctcgacaccagctcgccccgcgaccttggatcaatatgaacaactactccacagacccactgctactcagatccgagcacctgatcagcaaaacgcacctcgaatgactttaaatcaagctagcgtcattcaaagaccgcaaatggtacaacctactcaaagtactcctgcaactagtgctgctgatagtaatcccagtgaagaaggtattcccgataatgttactgctgaactggaaaagcttgaacaagaaacaggtactatggtagagttacaaggtgtcagtgagatcctcggagggctgggagatgacgacgatgaacttttagctgaaatgggtgccgatttcaatatcctagagtatgccgatcccgagctggaagctttaacaggcggcaaaacaaatatattagatctggaactcgaagaagaaccagtgaagaaagagaaaatagtatccagtgcagaaaaccaaccgactaatcaaacagtaaacgctatttcgagccctgtgaaacctaaacatgaagaaccagttgaaacgcctngcaatttcgagccctgtgaaacctaa

SEQ ID NO: 319 - DNA, 2913 bp, Diabrotica undecimpunctata
atggaaatcagatatccagcaaatgatccaaaaattgatgccgatcttatacccaaaaggacacgcaccttttcaaaaattttcggattaaacactagttttcttgagatctttttcctagagagaaaaattaaggggccttgttggttggacatatcgaatccagtgccagttacgaaccccttaagttggtgtaagttcgaagtgaactgcgcgaagatggttgatttacaggtgacagtgacagaaaagccactgcctccacctccgctggttgtaactgctattaacataaggacttgcatcaacagaaaaacttgtggccatgaaattgtgatggcttcttgcttgacacataaaaagtatgccgtagatatgcagcctccagatcctccgtttcaacaacatttctgtgtgattgctactcctggtgatcagacgttgccttttgatatccacgatgccctcagtaagtacaaagcaacaaaagtacaaaaaatggactccgaaaaaggattgttgaacttttttgtaaaccaattctcttctattgatcccgatttgataataggccatgacttacagggctaccaaattaatattttagccgaaagactttcaaaactcaatacaaatattttcaataaattgggtcgcttgaaaagatcggaaaagaaaaatttggaaaaaagtctttttgctggaagattagtatgcgatataaaaatatcagctaaggaattaataaaatcacgttcatacgatttggacgccttatgccaagttgttctgaaacttaacgaaaatcaaagaatcgaattagaacccgatgatgtaccaaagatgtttaaaaccacttcagatattctgaaattggtatcgtttaccatgcaggacactatgtatatattaaaaatcatgtataatttgaatgttattccattggcgttgcagataaccaatatagctggtaatgtcatgtctaagactttgatgggtggtagatccgaacgaaatgagtttttgttgttgcacgctttttccgagaaaggctatatacctccagataaggagtataagaagaaaggagatggaaagcagagttcaaaaaagaaacctacgtatgcaggaggtttggttttggatcccaaagtcggattttacgacaatcttattctcctaatggacttcaattctctataccccagcatcattcaggaatacaacatttgttttactacattaccggtaagcgacagtgacgaaaacctcttcttaccagacagcaaccttcctccgggagttttaccaaccgagattagaaaactcgtcgaaagccgtcgtcaagtcaaaggaatgatgaaaaaaccagatctatctgctgatttacgaatgcagtacgacattcgacagatggctttaaagttaacagctaacagtatgtacggttgtctgggattttcaaattctaggttctatgccaaaaatttggctgcgctggtaacgcagaaaggtagagaaatattgacaaatactagggatatgatcgagaagatgaattttaacgttgtttatggtgatactgacagtattatgattaataccaatattttggaatacgaccaggtatttaaaattggtgtcaaaattaaacaagaagtaaacaaattatacaaacaagtagaactcgatatagatggtgtatttaaatatttactgcttttaaaaaagaaaaagtatgctgcagtaacattgaacaaagacaaaagcggaaaattggttgccgtcaaagaatataaaggtttggacattgttcgaagagattggtcccaaatatcttctgaagctggaaaatatatattgaatcaaattttgagtgaccaatccgccgatgaaagaatagagcatattcgtgaatatctaagaaaaattcgtgaacatttaaccgagggcaaagtacccactccgttattaataattaccaagcagttaacgaaggagccccatatgtatcccgacaaaaattctctgccgcacgtacaggtcgctcttcgttacaatcagaaaagcggagggcattttagggctggagacaccgtaccttatataatttgtgaagatggaaccaccaatagcgccgtacaaagagcctaccacgtagatgaactaaaaagtaattctgatctcaaagttgatattatgtattatttaggtcagcaaatacaccccgtggtatcgcgaatctgcgaacctattgaaggaatagattcttatgagatagccgaatgcttaggattagatacaaaaaacatcaaaagacctaggcaggcagtcaacgaacttattggggaaaatattagcagacccgaaatcaagttcagaaatgtggacaagtttaagtttatttgctttggctgtaaacaggaaaatattgttgaaggagcattggtaggaaactcacctttcctggaacggtgtcgcaactcggattgcagtgtaaaaccaatagattacttacctttcatacaaaaccagttggccctttcgatccaatcatacattaataagtactacgaaaatatcttaatatgcgaagatcccgcatgtacaaacgaaacaaatcatcttccacttaaatttgccaggaaatacccaatttgtacattatgtcagaagggagtcatgttcagggtatataacgagcagcaattatacacccagttatcttatttccagcacatatttgatttgagcaaactaagtaaaaagccgctaatggaacatgaaatcgaatctggttattcgtcacttcaagatattgttgaaaaatatttaaaccattccggatactccataatagacctcactgaactgttctccatgctagatcctcacaaaaagcgggaaaacaca

SEQ ID NO: 320 - DNA, 1116 bp, Diabrotica undecimpunctata
atggctttaagaacctacggagataaacctataagttttcagctcgaagaaaatggagactactattgtgttggatccgaggtgggaaactatctacgcctctttcgaggttctctctataagaaatatcctggaatgttcaggagatcaattacaaatgaagaacggaaaaggttaattgaacttggtctaagtcaacatgttctagctagtagtgtttcacttctgagagcagctgaagtagatgatataattgaagggaatgacgaaaaatataaagctgtatctgtccatacttcagaaccaccaatgcctagagaaagtaaatcaaagaaaaatttgcaatgggtcccatctttgccaaattccagtcatttagatgcagttcctcaagctactcctattaacaggaacagagtagcagcaaaaaaggtgaggacgttcccattatgttttgatgacacagatccacaagtgaacatcgaaaattcttgtcagcaagaagttcttgttcctattagacttgatatggaaattgaaggacaaaaactaagagatacttttacatggaataaaaatgagagtttgatttctccagaacaatttgcagaagttctttgtgatgatcttgatttaaacccattgacatttgtgcctgccatagctcaggcaatcaggcagcagttggaagcatttccatcagaaccgccaagtataattgaagagaattgtgaccagagagtaattatcaagctgaacatacatgtaggaaatacttcattagttgatcaggtggaatgggatatgagtgaaaaacaaaataacgccgaagagttcgctctcaaattatgttccgagctgggtctaggaggggaatttgtaacagccatagcatactctatccgtggtcaactctcgtggcatcagaggacttacgctttcagtgaagctccgcttcctacagttgaagttccgttcagaactcccagcgagtcagatcaatgggcgccatttttggaaactttaacagatgccgaaatggagaaaaagataagagaccaagacaggaatactcgacgcatccggaggttggcgaatacaacgccgggttggtag

SEQ ID NO: 321 - DNA, 4161 bp, Diabrotica undecimpunctata
  misc_feature (2179)..(2179): n is a, c, g, or t
atgaatacaacgagagttgataatacacaaaatccagtacaaaaaattgaattaacatctagaagtattgaaaatgctctaatattggataataattcgccaagactgttagattttatgaatataaattcccaaagtggatctacagctagtggttttgcagatcatgactatccaactatcagtggagtttcacaagttatcaacaatatgacacaagttaaatgtgttaatagcattcctttaccaacggaaattgttgaccatttttcacgggtccaatgccattgcatgatgggcctcttttgtgaaatcagtagagcttggcttactgtggatagtgatatttatgtatggacttacgaacaaaatactgatttagcatactttgatggaataagtgagaccattgtttgtgttggtctggtaaagccaaaagtgggagtcttccatgcttttataaagtatcttcttatcctggcaacttcagttgatatcgtagttttgggtgtaacttttactgagaaaccaggtgataccacagaggaaattcagttgataccagacccagtttttagtttaccaactgatggtgctactgttactatcatcagtagtactaatgatggaagaattttttatggcacaaaagagggaaagctatttgaaatatactatcaggctgaaagtggttggtttgggcaaagatgtaaaaaggtaaacctgtctacaagtaccctatcttttctagttccttcatttttaaatgctgcccttagtgaagaagatggaatttgtcagatttcaatagatgagagtcggcatatattgtacaccttaacagaaaaaggaactatagaagtttgtgatttgggtgaaaaaggaaatatgttttcaaggatagcaaaattgggccaaaatactctagtaaatcaagctatgaatactgtaaaaactttagatagtcaaaactttagaccgatagtcagtatatcagctattgaagcaacagaatctgccaacttgaatttagttgctgtatcccaaacaggagttcgattttacctaacagtagttagtctctccaatatgcaaccaaatcagagaccatatacactaactttagctcatgtacgtctaccaccaggatattcggctaatataactgtaagacctagagctgtacatgtgtcccattatagcgacagaaatttggtactgatttcgactgttaatgataaagatgtgctttggtgcatgagttcagatatgtttccctttggtcagactttgatggaggcttatagtgttgtaaatctagatggaccagcattagctatatcagaggtgcggcatccaactcctttaccgttaccatcaaaccaagaagcgccacctctggttgtcagacaacacgcggaaccacctaagaaatatgtggtcttaacatctcacagtgttcagatttttattaaactgaggccagttgatattctcaatcagatacttagagatagtcaaggcttagacactgaagcgcttaagacgttttttacgattcaaaaagaggaccaagcttgcgcaacttgtttgattctggcttctttagaaagtgatgagaacgttgaagttgcagaatatgccacaagggctttctttttgtatggtggagaacctaaactggcgcaagccaatatatatgccggacccagtgtatttgctcctcaaataatatcaacacctgctccacaccaataccagtctcagcagtaccaaaccgctcaacacttccaatctaatatgtcacaaacactgccaactgttccaaatactaccggatatgaattcaccggtccgtttattttttcggcgaaacataatagtttatatttgtatttaagtagaatattgcgaccagtttggaacttgagaacggttgataagctttctgttgacggaaaggtttctacgacatacagtaccgtttccagtgatgactgcatatttattctaaataatctaactgctctccataatttcctagcacgaaatacacaactgtcaaccgttagcaagaaccaaaatcaattccagaacactacacttaataatacatctctaaatatgacgagaatgaaccatacagtgcaagacgcccaaatggaagaaaaagcatcantccataatttcttagcacgaaatacacaactgtcaaccgttagcaagaaccaaaatcaattccagaacactacacttaataatacatctttaaatatgacgagaatgaaccatacagtgcaagacgcccaaatggaagaaaaagcatcactgaattctttcaaaattcttgtttcgctttgttgtcaaatattgggtctgtggagaatcctgtgtgaacatcaatttcattcattggtggcgtctcttacggaaaacgaacagcaaattctcgtcaatacaacttttaaagacttattcctttacagacacgacatttgttcttcgttgatatcagctctggttcaaacgtatctgggtgacaacgcttctgtagactcaatcagcagcaaattaagagaagtttgtccacaattgtataaaaccgaagatatggcatattcgaaggcaatcgaaatcctaaaatctgctcgaacaatacaaaatgtcggagaaaaagaagaattgcttaattcagcgctacaaatttgtaaatctatcggaccgaatttgaacataggtgatgtctgtaaagagttctgtaatcttaaaggatataaagctgtaactgaattatgttgtcattatgcctcaaaattagacccagaaaacattgcggagatatattacaatgcacccgatagcactggagaccaggaaggttataattactatcaaaacagaatggaaatttataggcatctattgaatatgttaaattccatgtatcaagaacttaatgtaactccagtaccgtgcctcaactacgacctcgatttttcagtaactcaatcaattttgacagataccccagcacagtcacaaattggttatatgatgaaacaagtgatcaccgatattttggaaactcccgatcaaataatgcatataaccttatacgattggctaatatctaaaaatatgactggagatttactaacaattaacaacgattccttggagacatatcttaaaagaacagcagctcaaaatccaaatgatactgttgctttggaccttctatggaaattctatgaacaccgcaatgaccatgctgctgcagctaaaattcttaatagcctggcatcaagaagtggtattaacattcctctaaaagaaagattggcctacttagcccgatccataatgtgtatgagaagcgacaaaataggatatgcgccatatttaggtgtcttcctgagagatttggaggataaattagaagtggccaaggtacaagaacaaattttagaggctgttatgaatcaacaaaatcaaatcgaaaattatggagatattgttgcagctctgaattcgggactttttgaaatatcacagttgtacgaaaatttcgctgagccgttcaaactcctcgaatgtcagctggccattattgattgtgccggatataccgatccagcgttaatagaaactatatggcaacaaatattgaccgacgagctaaagaagactaccggaactggaacagacaaagtatgtcaattattaaacaaagtcaaacatttagccaaaaattatgctaaatcaatgaactgttttcctttagattatattatctatgaattagaaatagtgaatgcaaagttaagaggcgatagacaactagtacctacagctcttgagagtatgaatattccgtttgacagtctcatcaccgtttataataatttgaataccatatctggaaacgaccatttctggcaattggaagaaaatgaatttcatctttctgaagctacagctactctaatcagctgtttcattagtaaccaagattcgtatagcagtatagaaaagagaaaatacacatccttatctcaggacaccgttgttgcattactgtctaatttatacagcaaacctaatacagaagcgatagttaataagttacgaaatattcaggccaggttagccagaatttaa

SEQ ID NO: 322 - DNA, 3561 bp, Diabrotica undecimpunctata
atgaccgaatttactttaagttatcgtgaagttataccggatcaaacagtttttgaaaattggaaagaaatctcccttaccacaggtgggacacaaagtactctccaagatataaaagtagctgaacgagcaaatggatttgcttatgaagattcaacaaagcatcatacaaggaatagatttatttattggagaatcaactatgatgtcttggaattggtagaacacagcctggatatcaatttaacagcaaatagagttagatacaagtttacagatactcctattctagatggagtttccattcacgaaacttatgaaaacattattgtgcttgtcccaactgtttgtagcatacaccgtttaatatttccacaccctgataggtttcatagacaggatgatttactaggagtgcatccagatttggctgctccctcaatattttcaaaagcttcacctgtggatgccagaaatccaaatactttttatgtttttaataacccaaccactgccactgaccaactgcccaatttagccagttcttacttgttacctgaaactgaggaagcattttttatattagcttatccatcgacagaactactattgataaaacaaaatcctgacaatggccaagttatatgtacagagctgaaaggggaatctttgatgcccagatttttgtctggtcttgcagaaaagtttagaccaagaaattctgacggtgataccatagtgagtctcttgttttatattgttgattatgaaacttacgttttgacattgacaagagatgcccatctcaagttttggtcctgtactaaaggacaatgtgtcgctgttatagatgtcagagaaaagacaggagatagttcaaaggatcgagtacaaggagccatattaaggaaagcagtagatggcaatagtactgaaagtatcttggcagtgtttttaaattacgccagtggtggccaattccatatcttaaatccaataataaaaggccaggaaataacaattgacagattggccactttatactctcctgagaatgatcttattgattttgcgttacaaaccaatcgcctatggtctgtttggcgatgtgaagatggcgacagcgtagtgtacactgccacactgccagtatcccgttgtgcttcctacaaatcgagcaattggtcacctattattttagaaacattacctgatgccaatcaagcacctgctaatgatggagatagtgatcctagacaagtgtatttgcaacacattttccatcccggcagatttcctttgcacataataagcaaagctctttctatttacaagaggtctactattttatctgatgcccaaatatcagcctcagctttaaaacaaagaatttgtctagctgtggataatgaaatacaaaatacgttaaacggatctaatgtgaatgatgatgaatatttagaatgtgcagactggtgttggcaaaaattctattcttgctgtgtacagtaccatatcgctagcttaaaacctcttggtctaatgttattaccttctgtctctggagcagtatttttgaaaaaatcgacgttttcattccttagacctttggatcctctggaacacatgactctctgctatgaagatgtttacagagaccaattcatcaatttttccatgttagctgaagatctagacacgacagatgacgtaatgaacttgtttaaagtcatcgtatatttagaacaacaaatgagtgaatcattcgcccaggcattcgagaaagaaatttttaatctacgtgcacctgatgtcatcatggaaggtttattagagaagattcaatctgagatggattaccagttcgcatcgcacatattggaaatgatgaacgacgttactgacctatacaaagcaatgcacaaaattttagaactcttaagatatgaaaatacattagccagccctgataacgacataaatcctggagctatgtatcatttcagttccttgttgggcacttcagtagtcgctgaaagcttgagacaacaagcacagataagatttcaaatatgtagaaatttacttctgatctgcaacattttgttgaacgaaaaaacgttggattggggtgtactagaagccatacgttcagtctgtaccccggagattgttgtactcacacaagctagttatgtagttctatggctgtgcggattaactactatagtaaacttacctttcagtgctcgcgaatcttcgataaacagattggcgccactcaaattagcccctgttttgaatttgagacctgttactacatgcacgtcgttattggaactcttcatatcctctaccggtggccaggaagcaaggaaatcttttgccagggtaaattgcagcgacgaagctttggcccactggcatatctcgcttttaccttatttgaatcacgtgagacatataatttggcccataactggaggtacagttcttgccgagtggctgttaagcagtggacaacatttatggttacagcagtacgttcgtttacttagcaactggtgcgaatggaatagttgtacaagaaacttcttgctagcttctgcctttttgtcaactggagaatacaacaaagcagaagatttgtttgaaacgggtgctaaaggggtttcaacagatgcctttctacaagaacgttgtttaaaagggattttacccagcccaactggagcgtacattcactactatttaaaggttattcaactatttgaacttcacaaggccaaagattccgttataagcattgcaaatactgctctgagtattgtagacccagaagatccgttagcggctactttatattccatcaagttcaaacaccacttggcattaaagcactacgaactcgccttcgattcgttgaatgctaatccagatgcggaacggaaaaaagacaacctgagagatttggtcaaaacactattggatgaaaagaaattggatactttattgaactttacgtatggtagcatggatgagttctttacaaatatactgttgactagagctagagcaaacgatgcagtcaacaacattttctacgacttcttgtattcttatcaaattaaaagaggacctctgtcacacagactagctgcatcagtaatgtacgagcaggctttcagattaaatcatattaacagtgttgaagcactggaaaaacaagtgaaatgctacttggcagccaaaaacgttctacatctatgtaaaccagaacacgcttgggtagtgcgaccagctgatccagatgaagaagatgaagtaataactattcagcctttggccggatcaaacgaagaaatgaaagtgtttagattgagaaaacaagttgaagttgttaatatcgaaactgttaagaaggaacttattttcgcaagtgcaaaattaaaattggcaaggtttagttcgagcctatcaccagttaacataacaactcctgtggaattggtaacattattaaatactgctggtctattcaaaactgccctagacatttgc

SEQ ID NO: 323 - DNA, 2907 bp, Diabrotica undecimpunctata
atggaaatgtccgatgaaaatattcaagttttaagtaaatatctacaggagacgcttaatccagatcccaatgttcgtagacccgctgaaaaatttttggaaggtgtagaagttaatcaaaattatcctttattaatattaaatcttgtacataaaccagaggtggacatgacaattagagttgctggagctgtagcatttaaaaattatataaaaagaaattggtttgtggaagaagatggagtagataggattcacgaatctgatcgggttgcaataaagaatttgatagttactttaatgttaagctcacctgaatcaattcaaaaacagttaagtgatgccattagcattattggaaagactgattttcctctaaagtggccagaattaatctcacaaatggttgaaaagttttctacaggggatttcaatgttataaatggagttctaagaacaggtcattccctttttaaaaaatatcggtatgaatttaaatcacaagagttatggatagaaattaagtatgtactagaaaaattggcccagccgctaactgacttatttgtggctactataaatttggcacatactcatagcaacgacgtgaatgcattaaaagttatatacagttcattggttttaatttgcaaagtattttattccttaaattttcaagaccttccagaattttttgaagataacattcagatttggatgtcaaattttcataccttattaacggcagatgtcaaatgtcttcaaaatactgatagcgaagaggctggtattatggaacaattaagatcacaggtatgcgataatatagctctgtatgcacaaaaatatgatgaggaatttcagcagttcttgccacaatttgttactgacgtttggagtttgttagtgtcaactggtcttgagcctaaatatgatctgttagtttcaaatgctctccagttcttatcgtcagttgcagaaagagttcagtatagacatttatttgaagataacaatgttttaagcagcatctgcgaaaaagtcattatacccaatatggaatttagagtttcagatgaggagttattcgaagataatccagaagaatatacacgtagagatattgaaggttctgatattgatactaggcgaagagctgcttgtgatctcgtaaatactcttagtcagaactttgaacaaagaattattgacatatttggccaatatttacaagtgatgcttggaaaatatgtggaaaatgccaagcagtattggagaagcaaagatgctgcgttatatcttgtaacctcactagttagtagaggtgctactcaaaaacatggagttacacaaactagtcagctggtcgatatcaatcagttttgccaacaacacgtattgtcagaattagaaaggcctgatgttaatgatttgcccgttttgaaagcagatgccataaaatacatcatgacatttagatcagtgcttccaaatgcgatcgttatttctacgattccacaattaattaggcatatgactagcgaaagtgcggtggtacacacttatgccgcttgtacattagaaaaaattttaattataaaggccaataatcagccaatagttactggtgcccatttggaagcttttactacaacgcttctaacaaatctttttggaatactagaaaaacctgtttcagaagaaaatgagtatgttatgaaagcactgatgagaacattttctacattacaagaaagagtcctaccattcttgaacgtcgcattgccaaaattaacagaaaagctacaattggttgcaaaaaatccatcaaaacctcattttaaccattatctttttgaaacattttcattggccataagaatcgtatgtaaggcaaatcccactgctgttacagcatttgaagatatattgtttcccatttttcaaggaattctacagcaggatattcaagaatttattccttatgtatttcaaattctttctcttttgatggagagtacacctcaaggtaataatctggaaccctacatgcagcttttaccattcttgttggctcctgtgctatgggatagacctgctaatattagtccactagtaagattattatgcgctttcgctctacaagcagctccacaaattgtatcgcaggataaagtgagcggatttctaggagtattccagaaattgattgcttcaaaaactcatgatcatgagggtttctttttgattcaaagtatgattcaacatttaccaatggaagccctagcgccttatcacaaacggatattttcccttttgtttctaagactctcctccagtaagaccacaaaatatgtaattaatcttatagttttcttttccttatacgtggtgaaatattcagcaaatgaactgatctctactgttgacgatattcaagcagaaatgtttggtaaggtgcttgaaaaactatatgttgccgaaatacaaaaagtttctgcagccgtcgatagaaaaattgtagcttgcggtgtaacaaaattgttatgcgaaagtccagagatattttctggaaagtatcaaaactattggccccagctattacaggcgttattgaaattctttgaaatgccagtggatgcaagcatactacccgatgatcatttcatagaagtagatgatactcccacatatcagacaactagtgcaaaactgaattttgcgaatactaccaagagcgatcctctccaagctattgccgaaccccgacagtttctggttcaaagtttagcagctcttggaaattctcaacctggacggcttccggtatatatcagcaacatggatgtacaagttcagacaatactaaatagttacctatctaagtttgctgttcagctggtctaa

SEQ ID NO: 324 - DNA, 609 bp, Diabrotica undecimpunctata
atggctaaggtccaattgtgtaacataaccgtaatggacaatcctagtcctttcttgaacccatttcagttcgaaataactttcgagtgtatagaagaacttagagaagatttggaatggaaaatgatatatgtaggttcagctgagagtgaagactatgatcaaactttagattcagtttttgtaggacctatacccgaaggcaaacacatgttcgtgtttcaagcggatcctccaaatgtctcacgtattccagaaaatgatgctcttggtgttacagttgtacttttaacatgttcttatagaagtcaggagttcattcgtgtagggtattttattaataatgaatatactgatccagaacttaaagaaaatttacctagtcctccacaatttgataaggtaacccgaaatattctagcatctgaacctagagtaacccgattcaaaataaattgggaagaaactaaccccacagaaaataacacaaactcagaccaaaatggagcatcagcaccctcgacatcagaagctggaccttctgctccggttgaagtacctgcctttaatgaaaattccaattcgtgggcaaccatggaatgttcataa

SEQ ID NO: 325 - DNA, 951 bp, Diabrotica undecimpunctata
atggatcaaatgctccctagtcccggatttagtatcccaagtataggaacaccgcttcaccaacctgaggaggatcaacttatcttaccaaatgcccttcaacagcaacagcagcagcaacaacagcagattgcaactagtagttcccaagtacctcctttggcaccaatgggaggcttaacacctactcttggacttggcatgggtcatgccatgtctgtaccacaaaccaaatatgtaactggttttgcattgcccatgagttcaatgaatgcacaaactcctcaacacacaatgagccctatggtcaatttagggggttctataacaacaggagcaggagtaactccaacaatggctccatcaactccatcgccaatgactccaatgacacctcattctgcagatccaggaatcattccacaattacaaaatatagtgtccacagtaaatctaagttgtagattagacttaaagaaaattgccctacatgccagaaatgctgagtacaacccaaaacgttttgcagctgtaatcatgaggatacgtgaaccacgtaccacagctctaatcttctcttccggaaaaatggtgtgcactggagccaaaagtgaagaagactcaaggttagcggcccgaaagtatgccaggataatccaaaaactcggattccctgcgaagtttttagatttcaaaattcagaatatggtcggcagttgtgacgttaaattccctataagacttgaagggcttgtgctaactcacagctctttcagtagttacgaacccgagttgttccccggacttatttaccgtatggtaaaacctagaatcgtgcttttgattttcgtgtctggcaaagttgtgttgacgggtgcaaaagtgaggcaggaaatatatgaagccttcgataatatttatcctattttaaaaagttttaagaaacaatga

SEQ ID NO: 326 - DNA, 477 bp, Diabrotica undecimpunctata
atggctgccatcagatctatgtctcgccttcttcttaatagatcacttcaaactactgcaaggaggacctatgcagaccaaatgaatttcacttttgccgctggaaatcaggtttactatactgcaacttcagttaaacaggtcgatgtaccatctttctctggtagctttggtatccttcctgcccacgtacccacactggctgtgttaaaacctggagttgtcactgtttatgaagatgatggtaaagttaagaaaatctttgtttccagtggtactgtcaccataaatgatgattcatcagtacagattcttgcagaagaagcccacccagtagaaaacattgatgtcaatgcagcaagagatatccttaccaaagcccagagccagttatcatctgcaagtacagatgaggcgagagctgaagcctccattgccgttgaagtaggagaagctttagtcaaagcggctgaataa

SEQ ID NO: 327 - DNA, 987 bp, Diabrotica undecimpunctata
atgagtggtgacggtagtgacactgaacaatttgatactttatttttatctgtagctcaatatcatcctcagggaccaacacagcttctggatacgtttgtaaattttttgagtagaaaaaccgactttttcattggcgccaaggaaggagaatgggaaaagttggtgatggacactttcaaaaaatacgaaaagttaagcaggtcaaagcacgaggaggaactaaaagaaaagcgtgaacaagaagctcgaaaaaaagcagctgctgccaaaaaggcagaagctgaagttgttaagcctgctcaaatcactgaattgactgatgaagaagctgaaaggattcaggctgagataaatgctaagttaaacacttctgttaacgctgaaagttcttcaaatggttcagaagctgcagctgcgactaaaaaagtagaagaagatgaggatgaatctgagaaaggcaagatactgcctaacacaggaaatggatgtgatctagagaagtacaagtggacacaaaccttaggagatattgagttaaaaattcccctcaaagtaaacttcagggtaaagcagaaggatctcgtagtaaatatgacgaagaagcacttgacgtgtggtatcaaaggccagccgcctatcatagacgacgattttccacatgaaatcaaattagaagagtcgtcttgggtgatcgaggacggaaaggacctattatttacttttgaaaaggtaaacaaaatgaattggtggagtcaaatagtcaaatccgatccagaaatcagcacaaagaagatcaatcccgagccatccaaacttagcgatctcgacggagagacccgtggaatggtggagaaaatgatgtacgaccaacgccaaaaagaaatgggcctacctaccagcgacgaacaaaagaaacaagacgttattaagaagttcatggagcaacatccggaaatggatttcacacaatgcaaatttaattag

SEQ ID NO: 328 - DNA, 480 bp, Diabrotica undecimpunctata
atgcagtcttcgagtggtatggtacatggttatccaggaggtcctggattacaatggagccccgataaaaagcatagcgatcgcgaaaggtggatatgtatttatcctgcttacattaacaacaaaaaaacattggcacaagggagaaaaatagccaaagaaagatgcgtggaaaatcctacccatcaggaaattcgtgatgttctggtggcggctggtttgaaagtgggtgttgaaaacaaattgtacagtagggagagaagtaaagaaatgttatatcgtggtagaataagaatacagttaaaaaatgacgatggtagtttgtgtaatgacggtttccctaccagagaaagcattatgtatcatttaggagacatgattcccaaactgaaaagcaggcaaaataaaagctcaggcgaggctcctcagcaagcatctactggtactaaaggcaaggggaaaggaaaaggacggagataa

SEQ ID NO: 329 - DNA, 2259 bp, Diabrotica undecimpunctata
atggatacaaaacatcataaaatgcccaaagtggcaaaggttaagaacaaagctccagctgaaattcaaatcactgcggaacagcttttaagagaagctaaagagcgagatttagaaattttgccccctcctcctaaacagaaaatctcagatccagctgaattagcagactatcaattacgaaggagaaaacaatttgaagataatataagaaaaaaccgaactgttatatctaactggattaaatatgctcagtgggaagaatcccaaaaagaaatacagagagcccgatcaatatgggagagagcacttgatgttgaccataggaatattaccatttggttgaaatatactgaaatggaaatgagaagtagacaggttaatcatgctaggaatctatgggacagggccacggttcttttgccaagagttaatcagttttggtacaaatacacttatatggaagaaatgttagaaaatgtaccaggtgctagagcagttttcgaaagatggatggactggcaacctgatgaacaagcctggcaaacctatattaactttgaactccgctataaagagattgatagagccagacaaatatatgaaagatttgtcataacacatcccgaagtaaaacattggataaaatacgcccgctttgaggaaaaccatggcttcatacactcatctagacagatatatgagagagcagtacaattctatggtgacgagcatttagatgagaaactctacattgcgtttgccaagtttgaagaaaatcaaaaggagcatgatagggcgagggttatatacaagtatgctctcgatcatatacctaaagatgagactaaggaactctacaaggcgtatacaatacacgagaagaaatatggtgacagaagtggtatcgaagaagttattatgtcaaaacggaaacttcaatatgagcaggaaatactacaaaatccaaccaactatgacgcatggtttgattaccttcgattagtggaaggagaagatgatctcgatattacacgagaaacatatgaaagagctattgctaatattcctccaacgaaaaacaaacagttttggaggagatatatttatttatggattaattatgcgatatttgaagaacttgaggctaaagattatgaaagaactcgccaggtttataaggcttgtttagaaatacttcctcataagatatttactttttcaaaaatatggttgctctttgctcaatttgaaattcgtcagaagaacttaactacagcaagaaaaattcttggaatgtcaattggtatgtgccctcgagataaactttttagaggatacattgatttagagattcaattaagagagtttgacagatgcagaaaattatacgaaaaatttcttgagtttggaccagaaaattgcatcacctggatgaagtttgccgaattggaaacacttttgggagatattgatagagctagaggtatatttgaattggcgattaatcaagcaaggctcgacatgccagaattattgtggaaagcttacattgactttgaaatatcacaagatgaaccggacaatgcacggcagatatatgaaagactcttggaaagaacctcccacgttaaggtttggctatcgtatgctaaatttgaacttaacaatccaacagaagatgaattaaatgtgcgcttagctagaagaatctttgaaagggccaatgaaaatctaaagagctctccggagaaagaagcaagagtgctcctattggaaaattggagggagtttgaaaataatcatggggacgaatcgagcaaagaaaaagttaatgccaaagtaccaagaagaatcaaaaagaggcagaaagttgttgatgaggacggtgtggaacaaggatgggaagaagtatttgattacatattccccgaagacgaggctagtagacccaacttgaaacttcttgcagctgctaagaactggaagaaaaaagcggaagatggagatgaaaaagaaaatactaatattgttgttaaaagtagcagtgatagaataagagaaaagttgctagcatcggctaaaaattggaagaaaaaacaagatggacttaaggaaaacaatccagaagaaaatacgagtgaagataaacaagaagataataatccaatcctggaacaagaaactgaatctaacgacctggataatgaaaatcaaaacttcagtaacgaaaatgatagtaatgatgattcctcttaa

SEQ ID NO: 330 - DNA, 1431 bp, Diabrotica undecimpunctata
atggggattaaatttttggaagttataaagcctttctgcagcatactgcctgaaatagccaagccagaacgaaaaatccaattcagggagaaagtactatggactgcaatcactcttttcatctttttagtatgttgtcagattccattattcggtataatgagttcagattctgcagatcctttctactggattcgtgttattcttgcatcaaacagaggtacccttatggaacttggtatttccccaattgtaacttcaggtctaattatgcagctgttggccggtgccaaaattattgaggttggtgacactcctaaagacagagccttattcaatggtgcccaaaaattgtttggtatggttattactgtcggccaagccatcgtgtacgtcatgacaggcatgtatggtgatccggctgaaattggagctggagtgtgccttctcatcatcatccaactgttcgttgccggtctcattgttttgcttctcgatgaacttcttcagaaaggatatggtttaggttctggtatttccctcttcattgcaacaaacatttgtgaaactattatttggaaagcgttctcaccagcgacagtaaacactggaagaggaacagaatttgaaggagctgtcattgccttgttccacttattgaccacaagacaagacaaaatcagaggattacgtgaagctttctacaggcaaaatcttcccaatttgatgaaccttttggcgacagtactcgtttttgctatagtaatatacttccaaggattcagagtagatctacccatcaagagtgcaagataccgtggacaatactccagctatccaatcaaattgttctacacttcgaacatccctattattctgcaatctgcccttgtatctaatttgtatgtcatctcacagatgttggctgttaaattccaagggaacttcttaattaatctattaggagtttgggctgacgttggaggcggtggcccagctaggtcttaccccattggaggattatgttactacttatctccacctgaaagtgtaagtcacattctggaggatccaatccatgcaatgctctacatcgtcttcatgttaggatcttgtgctttcttctctaaaacatggatcgaagtatctggaagctcagccaaagatgtcgctaaacaactaaaagaacaacagatggttatgaggggacacagagataactccatgattcacgaattgaacaggtacattcccaccgccgcagcttttggaggtctctgtattggagctttgtcagtacttgctgatttcatgggagccattggttcaggtactggtatcttgttagctgtcaccatcatctaccaatactttgaaatcttcgtcaaagaacaaagcgagatgggtggaatgggagcgttactcttctag

SEQ ID NO: 331 - DNA, 483 bp, Diabrotica undecimpunctata
atgtcgatggtaacttcaccttccatagaacttagttcttaccgagaccaacattttaagggtactagagccgaacaggacggattattaagactatcgaccacattatacgttggaaatttatctttttatacaactgaagaacaaatctatgagctcttttcaaaatgtggggatataagaagagttgtaatgggtttagataaatataagaagacaccctgtgggttttgttttgtagagtactataatagagctgatgcagaaaactgtttaaggtatataaacggtactcgtttggatgataggatagtaagaacagattgggatgctggatttatagaaggtagacaatatggtagaggaaaaacaggaggacaggtacgtgacgaatataggactgattatgactctggaagaggagggtatggtaaaataatccagcaaaaaattggaattgagactccagcttttttgagataa

SEQ ID NO: 332 - DNA, 687 bp, Diabrotica undecimpunctata
  misc_feature (638)..(638): n is a, c, g, or t
atggctgcaacaataggacgaatttgtggagctggtcttttaaaaccaacaaacttatcctctgttggccagttaagttcgtattccacaacaaaagaatggactcgtggaagaaaagcacttttgggaagcttagggcttattgctggtggtactggagccttgctgtttgctttggaccaatcagttaaagcatctgatctagaattgcatcctccaaagaatgtttggagtcattctggaactttcaattccttggatcatgctagtgtaagaagaggttacgaagtatacaaacaagtatgtgctgcctgccactcaatgcgcttcattgcttaccgtaatttagttggagttacccacactgaagaggaagccaaagctgaagctgaagaacaaatgattgaagatggccctgatgacacgggtaacttcttcaaaagaccaggaaagttatctgactacttccccagtccatatcccaatgaagaagcagcccgtgctgccaataatggttcatatcctccagatttgagttatattgtatctgccagacatggaggtgaagattacatatttgcccttttaacgggctattgcgacgctccagcgggcgttgtcctcagagacggacaatnacccctacttccccggtggtgccatttcgatggcacaagctctatataa

SEQ ID NO: 333 - DNA, 1716 bp, Diabrotica undecimpunctata
atgttagctcttcaacaatattcgggcagtagtgacgaagatgatacagacaaaaataaaagtaaagacattccagtaaatacaactgaaattaccattaattccgagttttccattaaaaataagcttgctatttgtgcagctccaaatgtagtgcctacaggtctagatggagaaaaaatgcatatacatcctgatagtggagaactgacatataatccaaagtacgatgtattatttgctcctgttgtaggtccagcaaatccctttaaaacgcaacaacaatctgttgaaagaaacatgctctcgggacatattgaaaaagctcatgtaagtgattttcaatttgaaaaccagagaagaacttttacgagctatggttatgcattagacccatcaataagtaatgatggccatctaaaagttgttggttcaactgatgaaggtaaagacgtagaaagtgttaagactgtatttgaaacttcaaagataagacctttggataagaggaaaaggaagaaaaatgataatccaggtgatatagaaggatttttgggaccgtggggtggttttgttgatgaacaaaaagtttctagaccaacagaggaagaacaggctgagttagatgaaataacttctaaaaagaataagaaaggtaaaccaacagaggacaaaccaattgaggaaaagtctgtattgcatatcaaagattcagtggactatcaaggaaggtcttttttgcatgccccacaagatgttggggttaatctcaaatctgatacacctcctgaaaagtgttttttacccaagtctcatattcatacatggactgggcactccaaaggtgttgcagccatcagatggtttcccagaacagcacatttgttcctgtctgctagtatggattgtaggattaagatttgggaagtttataatgagagaagatgtattagaacttactatgggcatagacaagctgtgagagatattaactttaataattctggaaagcttttcctttcagctggatatgacaggtatattaaactttgggacacagaaactggacaagttgtttcaagattcactagtcgaaaaattccatactgtgttaaatttaacccagataaaaataagcagcatttatttgttgctggtacatccgacaagaaaattatctgttgggatactaggtctggtgacatcgttcaggaatatgataggcatttgggagctgtcaacagcattactttcgtagacgaaaaccgaaggtttgttactacctcagatgataagtcgttaagggtatgggaatgggatatacctgtcgacatgaaatacattgcagatcctacaatgcacagcatgccagccgtcacaccagcacctaatggaaagtggttggcgtgtcaaagtatggacaataagattgtgattttctccgccatgaatcgttttaaaatcaaccgaaaaaagactttcaccggtcatatggtagcaggttacgcatgctcgttagattattctccagacatgagctatttggtatccggtgacgcagatggaaaagtatacgtctgggattggaaaacaacaaaattatacaaaaaatggaaagcccacgataacgtttgcatcagtgtattatggcatccacatgaagcgagcaagatgatatcggcaggctgggatggcgttattaaattttgggattaa

SEQ ID NO: 334 - DNA, 807 bp, Diabrotica undecimpunctata
atggtccaaaagaaacctaagaagaaggtaggaaagaaagtagctgcagctcctcttgcagtcaaaaaagttgaacagaaaaaagaagttaacccactttttgaaaagaggcctagaaattttggaattggccaggatattcagcctccccgtgatttatctcgatttgtaaaatggccaaaatacattcgtattcagagacaaaaagctgtactgcaaaagagattgaaggttccaccaccaattaaccaattttctcaaactattgacaaacaaacagccacccaattatttaaagtcttggaaaaatacaggcctgagacagcccttcaaaagaaaaataggttaaaggctaaggctgaagctaaggttgccaaaaaagaagaggcacctgctaagaaaccaaacacattgaaggctggtgccaatacagttactaagttgattgaacagaaaaaagcccaattggttgttattgcacatgatgttgacccaattgagttggttctgtttctaccagccctttgcaggaaaatgggtgtcccatactgcatagttaaaggtaaagcaagacttggacttcttgtaaggcgcaagacttgttcagctgtagctcttacacaagttgactctggagacaggtccaactttaacaaacttttggaagtaattaaaactaacttcaacgaccgtgttgatgaaatcaggaggcactggggtggtggtttgcttggatccaaatctgctgctcgtattgctaagttagagagagccaaggctaaagaattggctcagaaacaaggttaa

SEQ ID NO: 335 - DNA, 1002 bp, Diabrotica undecimpunctata
atggcaactttaataaaagatgtaacactccaggaaaacattccaacacatatacttcttgacaagcacatagattttattaaagaatatggacaaaaagaaagtacatatgaatacggtatgacagattatttgagaatatcgggcatgtattgggctcttggggctctagagcttatgaacgccactccagctcaaagtatagaagagatcacagaatacataaagaattgccaagatccagaaagtggtggaattagtgcctgcttaaaccatgatccccatattttacatacacttagtgctgttcaaattctctgcatctacaataaattagaggcaataaatgtagagggtgttgttaaatatattgcaagccttcagttacctgatggtagttttacaggagataagtggggtgaagttgacactaggttctcattttgtgcagttgcaacattatcattgcttaataaaatggatgcaattgatgtaaataaagccatagactttgttatacaatgtaaaaactttgatggtggtttcggatctaggccactttcagaaagtcatgcagggttaatgtattgctgtgttggctttttatctattacaaataggttagatgccattgatagagatacccttgcttggtggttgtgtgaaagacaattaccatcaggtggtttaaatggcaggccagaaaaattacctgatgtatgttactcatggtgggtattatcatcattaaccatgttaggcaggctccattggattgatgccaatgctctgaaacactttattttggcttgtcaagatacagagacaggaggatttgcagataggcctggtgatattgctgatccttttcatactatatttgggttagcagccttgtcccttttgggacatgattctgtaaagaagattaatcctacttactgcatgccacaagaagtcattgataggttacaattaaaacctcagaggttagagcaataa

SEQ ID NO: 336 - DNA, 2664 bp, Diabrotica undecimpunctata
atgcatcaggaggccatacaactcatccaggtgctagaaaaaacagtttcaccggacaaaaatgaattggaacaagcgtcgtcgtttctggaacaagctgcagtgactaacctactagaattcatcaaaactctatcagatatattgagacatggcggaaatagccctgtcgcccgaatggctgcaggtttgcagttaaaaaatcaactcacatctaaagactctaacataaagatcacttaccagcagcggtggttagctttcccagaggacgttagggggtatattaaaaataacgttgtgtgcgcacttggaaccgaaacaagcagaccttcctccgccgctcagtgcgtagcatacgtcgcagtaacagaactaccacaagggcaatggccagatctcatagcaactttggtcaacaatgtatgccacgcaaattccacagaaatgcaaaaggaagccacattagaagctatcggttatatatgccaagaaatcgactcggacgttttagtatctcaatcaaacgacatcttaacagccatagttcatggaatgagagcctcggaaccgagcaatcacgtacgtttagcagctacacaggccctactaaactctctagaattcacaaaggccaactttgaccaaccgacggaacggaactatatcatggaagtcgtttgtgaagccacacagtctccagattcacagatcagagtagccgctttgcagtgtctagttaagattatgtctttgtattatcaacacatggaaccgtatatggctcctgctctattccctatcactctcgaagccatgaagtccgaaaacgatgccgtggctctacagggtatcgaattctggtctaacgttagcgatgaagaggttgatttggccatcgaagatacggaagctactgaagcaggtcgaccacctacaagatgttcacggcactacgccaaaggtgcacttcagtatatagtaccgattctgctgcaaaaattaacgaagcaagaagagctggacgacgaagacgattggaacccttgcaaagccgccggcgtttgcttaatgcttctcgcaacgtgttgcgaagacgaaatcgttccgcacgttctgccattcattaaagaaaatattaagtctgataattggcgtttccgggatgcttcggtgatggctttcggatctattttgggcggcttggagagtactacgttgagaccgcttgttgaacaggcgatgccaaccttgatagatctgatgtatgacaatagcgttaccgtaagagacacagcagcttggaacttcggcagaatttgcgaaatcattccagaagcagcgatcaacgaaaccttccttaaaccgctattggaaagcttgatcacaggcctcaaggctgagcctcgagttgctgccaatgtgtgttgggcattctctggattggtggaggcagcttacgaaaatgccgatgttaatgaagaaaccggtgctccagatacttacgtcttgtcacaatacttcgagttcattatacaaagactgcttgaaacaacggaccgacccgatggcagccaacataatctacgacctgccgcttacgaagctctcatggaaatggtgaaaaactcaccgaaagattgctacgtcaccgtgcaaaagactacaatggttattttggacagattacatcaggtcttacagatggaaaatcacataagcagccacaacgataggtcgcagttcaacgatctccagagtcttttgtgcgccacccttcagtccgtactcagaaaagttactccggaagacgcgccgcacatctcagacgccataatgaccgccatgttgaccatgttcaattccaattcgtgtaagagtggaggtgttcaagaagatgctattatggccgtctcgacgctggtggaagtcctgggagaaaacttcataaaatacatggacgcgttcaaaccgttcctctacctcggattgaagaaccaccaagaataccaagtgtgcgttacagcagtaggcttaactggcgatattttcagagccctcaaactaaaagcgctaccgtactgtgatgaaataatgaccttattactagaagatctccgcgatcagtcggttcatcgtagcgtaaagccagaaattttgggcgtattcggagacatcggtcttagcatcggctccgaattcaagaagtacctcgacgtggttctgtccactttggctcaggcttcgcaggcccaagtcgatcgcaacgacttcgatatggtcgactatctcaacgagctaagagaaggagttttagaagcttatacgggcatcttacaaggtctcaaaggcgacggtcccactccacatcctgacgttttgatacttgaaccccacattccatttattgttcaatttattactgtcgtagcacaagatacggaacattctgatagtattatagctgccgcagctggtattgtaggtgatatgtgtaatgttttcggagctccaatggttcaattcttagatctggatcctattaatgaaatgttagcacaaggtagacgtagtagagtaaataggactaagactttggccaattgggccgttaaagaattaaagaagctgaaggccgtaaacaccgcggctgctgctagctga

SEQ ID NO: 337 - DNA, 1503 bp, Diabrotica undecimpunctata
atggaaacaattttggaacaacagcgtcgttaccatgaagaaaaagaacgtttaattgatgccatggtaaaagaaatgcttcacaaaaagactacttttagagaagctataaactcagaccaccgacaaaagtacctactggatagatatatggcttcaacagagaggctaatagatctttatgacgatagggacggacaacgtaaggctgaagtagctgcacttacgggccccaacgagtttcaagaattctatagtagattaaaattaatcaaagacttttatagaaggcatccaaacgaaattagtgttcctatgtcagtggaatttgacgaatttgccaaagccagggaaaatcctaacgaagatatggctaactttgtagaatttactgatgaggagggttatgggaagtatttggatttacatgaatgttatgaaaagtatataaacttaaaaggcatagaaaaggtagattacattacctacttgggtatgtttgaccaactatatgatattccaaaagaaagaaaaagcggtgaatataaaaaatatttgttatgcctaattgaatatttgacttggtttgtacagcgtataaagcctctaaaggatttagacattgatctacaagaacaagtggagcaggttctggcaatttgggatactggaagtgtcccagggtggccaaaagaaacaggatctgcactaaccaatgttggggcccacttggatctctcagcattttcaagttgggaagaattggcatcgttaggtttagacagactgaaatctgccttgatggcgttaggattaaaatgtggaggtactttggaagaaagagctcaaagattattctcaacaaaaggaaaaggttttttggatccttcacttatgacaaaaaataataaaggcaaagccaacaaagaaaaggaattattgaggcaaagagaacttgcaacattagaagcccaagtgtacagattagcagagtgggtctcaccgcagagagctgcaaccaaagaaaatgtgcaaaggaaacaagctcgtaccgatggagaaagagatgacagcgaaaatgaagaaagtgatgatgatagtcctgacgaagcggacgatgatgttccttataacccaaagaatcttcctttgggatgggatggaaaacctataccatactggctgtataaactacacggtttaaacatcagctataattgtgagatatgtggaaattacgtttataagggcccaaaagcattccaaagacattttgcagaatggagacacgctcacggaatgagatgtcttggtattcctaatactgcacattttgcaaatgttacacagattgaagatgcactggcactgtgggaaaagttgaaagtccaaaaacaaagtgaacgttggcaacctgaaactgaggaagagtatgaagattctcaaggcaatgtggtgaatagaaagacttacgaggatcttaagagacaagggttattatag

SEQ ID NO: 338 - DNA, 639 bp, Diabrotica undecimpunctata
atgacgataggaaaaaataataaaatggtacaacacataaacttcagagttcgggtaactctgcaagactctcgtactttcataggaactttcaaagccttcgacaagcacatgaatatgatattaggagactgtgaagagtttcgaaaaattaaatcaaaaatgtccaaagttgaacgtgaggaaaaacgagtattaggatttgttttactgagaggagaaagcatagtttctttgacaatagaaggtcctccccctccagaagaaggtttgcccagagtaccaattcctggcgcagccccaggaccaggaattggtagagctggaggtagaggaatgccaccaggcatggcaggtgtacccgtaggcttgcaaggacctgtaagaggagtgggaggaccatcccaacaggttatgacaccaggaggtagaggccaagtatcagctcctccacaaatgaatcaaggaccaccaaggatgggaggaccaccgccaggtatgatgggacctcctcctggaatgatgggcatggccccccaaatgggaatgggacgtggaggaccaccgccaatgggaatgaggggaccgccacctggtatgatgagaggtggaccacctggacctccaagacctttttaa

SEQ ID NO: 339 - DNA, 942 bp, Diabrotica undecimpunctata
atgctcttccattttttttgtaatgatgttcctgtaatagataaaatattgttactttgttgcagatatttggcaagtggatgttctatgggtgaattacattattcttataagattggaaggtctactgtggcaggaataattcatgaagtatgtaaagtgttatggagagaactaaaaactgtagtaatggaaatacccacagcagataaatggagagaaattgctaacgggtttgagaaacacgctaagtttcctaactgcattggcgcaatcgatgggaaacatatacggttattccaaccggcacagtctgcttcactatattataattataaacactttttctcactactactactagcattgtgtgatgcaaattattgttttacatgggttgatattggtgcatatgggaaaaatagcgactcgggagtatttcaagaatctacattgtacagaatgcttatggagaagacactgaacattcctgaaccaacggcaataacaggtgggtccattgtgccctatgtaatagtgggtgatgaagcttttgctctgatggaaaatttaatgaaaccatttggtggaaaattactcacgtacgaaaaaaaaatttttaattatcgtttaactcttgcaagacggtatatcgaatgtacatttggtatcatgtgcaacaaatggcgaatattacatcgaccgttagatgtaaatattaatttcgctgaagatattgtgaaagctatttgcgtactccacaattatgttaggcaaagagatggttctacgtttgaagagacgctttatacagcaccgctaactaatctacaacaatcctccactcgacgcactggaagagtgacagaaaatgtacgaaataaatttatgcattatttcgttaatgaaggcaaagtggactggcaaaatagcatgatttga

SEQ ID NO: 340 - DNA, 15177 bp, Diabrotica undecimpunctata
tattttccagaacattggcctgggaaggtttgtgccttttgtaatttaggagaaaggagtcaattgggacaaggggaaatgctaaggttgaactgcccggaaggttttttaccacacaaagtcgcagcagaacaaattttagagaaagctttacaagctcctgacaaggataggggagataagagtcctaagggacctgtaacctgtagaaggcagaagggttttaataaatgcaggcatccatctatgaatagtgaatatgttgatgaactgactattattgggtataatgaagttagtgacgtaaccagtctatttgaacccaatggacagttctatgttcataggagctgtgctctgtggtctcatggagttacacgagcagaaaattcagctctgctagatgtgggtccagttgtcttacaatgttcttccaaaaagtgttcattatgtaatcattatggagctagtgtaacatgtaacttggattcttgtaataaagtttttcattttccgtgtgctaccgccgctggtgcctttcaggaaattatgtcgatttctactttctgttctaatcatataggacaagttgccatgcttaatgaagctactccttgttttacatgccgtactatgggagatatatcaaacttaatgtactgctcaacatgcggggcccattatcatggaacctgtgttggtttagcgcagttaccaggtgttcgagctggatggcagtgtcgaaaatgccgatgctgtcaagtctgtcggactgttggagatgagtcaaaattaatgtcttgcgaacaatgtgataaagtgtaccacgcaggatgtcaaaggccgattgttacttctattccaaaatatggatggaagtgtagatgttgcagagtgtgcggcgattgtggatcccgaactcccggagctggcttgtcttcaaggtggcacgcccattacacagtttgcgattcctgctaccagcaaagaaataaaggcttctcatgtcctctctgccataaagcttaccgagcgcatgctcatagggagatggttcaatgctcaaattgtaaaaaatttgtccatgggacgtgcgacgctgaagcagatgttgctacctaccaccaaaagaaagatcttaaccctgaatatgaatatgtatgcttgcattgcaaaaatagtactgctagacaaataactgcaaaaagagcaagtattgaagattcatcggatgtaccagcttctcatgaatctctttacgatgacacctcagaatttgacctgccttctccagacgaatttgcccgtagcatgggtatgggcaaaggaaaaccgttcgccagcaaaattgcgaaaaagcgcattaactttcccattgccggtaggccaaaaggtacaggtaaagtacctcccggtaaaatgggttttatgaaacgatctcgattatcggattttaataggaaaaggggccataaatcaaaaatgtgcggtattttcggcgtacctggtgttggacttcaaagaccgactgccgatggaaaaagcgacgaagagccgggcgtggagaatagattggttttatgttctgccaaagataagtatacgttgacgcaagatatttgtgtcatgtgtggagcgcttggaatggaccaagaaggatgtttgatcagttgtgtgcagtgcggacagtgttaccatccatactgcatcaatgtcaaaataacaaaagttatattggagaagggatggagatgtttggactgtacgatttgcgaaggttgtggtcagcgaaacgacgaagctcgcctgatactctgcgatgactgtgacgtatcgtttcatatctactgcatggatccaccactcgactacgttcctcacggcaattggaaatgcaaatggtgtgcgatgtgtctcaattgtggggctaccgatcctggttttaactgcaattggatgaacagctctacccagtgtggcccatgcgcatcacatctcaattgtcctagttgtaacgagccgtacggtgatggagaattgattattcagtgcgttcaatgtgagagatggcttcatggttcctgtgattgtataaaaaacgaagacgatgccgaaaaatgcgcagaagacggttacaactgcatcctttgtcggccaagagatgtaccaccgccccaccttgtaccgccgccgcccgctccaaaaccaccaacccctacgaagagtcctgaagtcgggaaaagttcgagtttttatttggacggtgtttacctaagtgagatggggaacagctttattaaatcattagctttggaacatcatggctcgcgaaagaaacggaaaaaacttcctaccgtgcaggataaagaagccggtattatggctacaattgaatctgttatagcaggcggaaatgctggtggagcgactgctttagaagacagtgctaaactagaattggtcgacgtcaaagacgaacctcaagagctatacaaagaaggcatgatttggacaaaggaggatggtcccgcacctgaaggtttcacggtgtttaccatggagagcggaatcagcgtcttaaggcgcaagagacaacggaatctacagaaactaggcataggtggttttctagtcagaatgagaggcattcgaaccggtcaggataacgatgaaatcgattcctcggttatccagtctggcagtgctacacctacggagctcctacctcccatgcctgttgatggagataaaccaaaaagaaaaccgattagaagaaaaccaaaaagcaagctagccgaaacttttccggcgtacttacaagaagcctttttcggtaaagatcttttagaaactgttgattgtaaaaaagaagtcgacagttgtagtagcgacgacgaaaaatctgtgaagtataaatccatcaatttgtctcaggatgaattgatggctgtagctgcagtctcgggcaaaagtgaaaagcaagcaatagctagtattaaagactcactgaaggatattaaatcatctccaatgataaaggaagaagacgacgataatacagaagacttaaaagatgtacttgccttacctggagatttacttgatgcagaaatagttaatagtattatggaagacgatgacgagcttactaaaaatacagaatcactggaagttttagataccaaccttcaagatgatactgagttgactgacacattgggcagctccggcaactcgaaagaaaccaaagatgagttgagtgatattctaggaccacattttaatctggaatcgatttctaatatcaacagcaaggatgtagaagacatatttaagggtgtattgactgatgaatcacaggaatcacaagagagcagcaattttgccatacaaggaagtaatcttttttccaacaatactcctcagccaagtttagctcagcattccatgatgactcctgctgttcgtcctaaaacgttacccaatgtgagccaagtcaatttaaattcaccagtaggatttcctccaccatcaccttaccactcagaatatagcaacagccctcagttcagtcctgcttttaccgagtctcctaacgcctgggtcggagttcccgaaactcctgaaatagacagtaccaacgtaggagttccttcaacgtacaatcagcgttcctcggaaaagatgaaagccgacgaaagtttgggcaacggtgctaccatttctgcagttctctatgctaatatgaatcatccagaatggaagaaagattttccggtttggtctgatagatacaagcaaataatcaagaaatggaggacactaagtcaagaacagaaagctccatatcttcaacatgcaagagataatagaagccaattgagaatgaagaaggcccagcagtcacagacctccaaggagtccaccgcatccgcatcaacccccaacgtgaccaagccagtccatgccgtcccagctctagtgaccaccctccaggcagtatcgcagcagcccgtgggggtgactacagcccccacggctcccattacagaggaccaagaaaagatggcactgcaacagaaatctgccagggaagccgaacaagaaaggcaatggaaacagcttcaagctatgagacagcagcagacgcagcaacaacagaatattatacacgaacaacgtgttcaggccatcgcgagagtccagcgacaaatatccgtggatccagctcaacagtttttgtcggaacaacaaagtcccttgcaaccaagtacgcctcaggagcttagtccgtctgctacaccaacaccaagcccaagacagttcataggaatgaaatccccgacctttcctcttccttcaccagtggctcagacagcaattagacctcctacaccctctcattctccacatgatgtaagtcaggcaagcacccctgacggtaatgatcactttattcaatcaccttctactcctaaacctaattttcctactagattacctacagatcaatttatccaccaacctgcaactcctaggccccagtttggaatacaacggccgcctttacagaactttggtaatacgatgaggacagatcagcaggatattaatatcaaccggcagttacgagatcttctccagcgacaacaggtgaaaaaattggatgaactgttaccaggtaaagttcaacaacaaagagtgtggcctccaattgaacaacaagaaaatgaggcctcagcaactactggtacttcggcagttgtggctacaacagcagataccactttcaggcaaccattaccgcccagcattgtgcgacctagagtggctctctctttagctggtcgagcaggtcctggtactattagggttggccagttagatgcccgaatgcaaggcctggatcctagaatgagattaattttgcaacagcaagttggccaacaacgattatctacgggaattcagcatcaattcgtacggtttacctcgacaccagctcgccccgcgaccttggatcaatatgaacaactactccacagacccactgctactcagatccgagcacctgatcagcaaaacgcacctcgaatgactttaaatcaagctagcgtcattcaaagaccgcaaatggtacaacctactcaaagtactcctgcaactagtgctgctgatagtaatcccagtgaagaaggtattcccgataatgttactgctgaactggaaaagcttgaacaagaaacaggtactatggtagagttacaaggtgtcagtgagatcctcggagggctgggagatgacgacgatgaacttttagctgaaatgggtgccgatttcaatatcctagagtatgccgatcccgagctggaagctttaacaggcggcaaaacaaatatattagatctggaactcgaagaagaaccagtgaagaaagagaaaatagtatccagtgcagaaaaccaaccgactaatcaaacagtaaacgctatttcgagccctgtgaaacctaaacatgaagaaccagttgaaacgcctgctccaaaaccagagcccgcttctctaccgccgccgcctcctcctttggcattgccacaacaacagcctgcgcctgtccaacatacaccacctgtcgctattcaacaaccaactccacatcctccgcaagtacaaccaacaatgcacttgacgccccaacagattcatcaacagatggtacatcaggttcaacaggcagcagctcaaggcagacccatgccaccggggtcaaagatgcaaacgcctgatggatttattggtattgtaatgcctaataatagcgtgcaactacagatacctcaaaactatcaacaaaggctattactcttacaacaacttcaaaatcagaaacttcaaatgcgcgtaggcactacaactccacgagtagcggtggtggcacagagtcagctaccagtcggtttggcgaccggccccagaatggttgcggcaccaccgcccccaccacctccgccgtacccaggtccaccgccgccgtatccaggaaacgcggctcaacatcaacaggaacaaccccttttgctggaggacctgctcgaacaagagaaacgggaacaagagaagttgcagaatcaaccttctagtcaagaagtgtcttcatcaactggaaacgaaagtgaatcagcgttgctcagcgaccacgatttcgagagactaaaggcagacgtattcaataccgggcctgtcaccagtttaccgtcaacaaataatcaaggaactgctagtcatacaaaccaaccatggcaacagttacaaaatcgacaaatccctgccccgcctgcccaacccactttggaggttacaaccagggtgcaaatgtttaacgccaatctaattgctgcgcccccattgcccccggaaaatattgttacggaacaagacaagcagactcagatgatgtatgaacagtggttgaatcatcagaataatgttctagcccaacagttgcgctactacgagactgaagtgcagaaacttaggaagagcagaaagtcactgaatagcaaacagagacagttgaaaaaatctggtaaccagctaactgacacggatgcagccgaactccagagaatatcagcagaacaagccattttacagaaacatctagaatcgagcagaaaacagagtcgacaacacggcatgttaatacaggaatacagaaacaaacatcctgcaccgaagcagcgggtagagcaaattcaatcgcctttaggaccaccgtcgtcgtctcctttgcaacacccaagtacgtcgcagtcgcccatgctgtcaccatctttatcgcctctgacacagcataattctcctctgaatagtccgggaccgcttatttcatcgtcgccaggatctgtatcggttcaaaacattttgcagagccccaacagtatgcctacgaacagcatgtcacctttacaatcctcctcgatgcaagcctcacctatgcagcagagccccatgcagccgtctcccaggataggaacaccgcattctcaaagtgaagagagccccggatcggcgcagtccccatctcaagtatgccttcctccaccaatgccaagaatgacaagtcctcaacacagaagagtagtgactagtccggttggtatgacgcagatgagattcgtaagcaatcaagtacttcaacagcgagtacgaatgcaatcgcccatacaaaactttcagcagaaacctgctacaccatccccgctaaatagccctacatcgcaaacgatgaatgtaagccaacagcttcagttacataaacttcaacagcaacaaagcatgctacaacaacagagtctagatggtaatcaaggtgaccccaatattatccattcacagcgaactactcaacttttacaacatagaaattttattcgacaacaggttgctcagcaacagcaacaacagataggtcagcctcagcctttaacgcctcaacaacaccaaatgatgctccaacagcaaaagcagttagctcaacaacagcagcaacaaatagcgcagatgaacgcagctaggttacagcaacaaaataatccccctcattcaccaatgcccccaaaaagtcctatgattaatcaacaaattatgtcaccacattctatgcccccttctcctatgcaaatgccaccaaagagccccatggtgtcttttagctcttctaatcaaccaaatcccaactcccctgccgcaagaagccctgcttttcaccaaggattaagtcaaactccaaccagtcctatgactcatcagccaccgtccccaatgcctagaagtccaatggttaatcaaacacagtcgccacatagtatgagaagaccaccgagcgctaatagtagccctgctatgccagataggccacttagtgttgaaaatccttcaccaagaatgtcttactcaatcgaccatttaatgcaagatactttacacagtcaaagtagccataattcaatgcagtttactgataatttcaccactgatatgaatattcaaaatagtattagagaaaatatgcaaagtggaggagggaatcccaataatccatgtaatccaatacctttaccacctgaatatcctagatttagatattttaaactaggtttgcgaggtggtacgccaatgtgggggtttggaagaggggcaaaacggatacctactcccccaaatgctccaaataaaccggaagaaaaattagtaaaccaagacagtatgatgttacaaaagatgaaaaaggagccccatttaagcaaagtttctcttcttaaaagaaaggttggagctggaagtggaaaaattggctctcttgtgagtacagattacaatgatatggacgatagttcatccacgcctcctataactcctccattagctactacaagtcgaggaggcataccaaaaacattgcccaaaaaaattttggaaaatcaaagcagcaaagattccgttattgtcatgcacagcccagaagacaaacaacttgatatgatggattttgacgatgatactaatactgttttatcagcggaagtgtctctaagttctgcagctcaaaatgacgaagatatgttagaaatggagacactatcacaacaagatttagctgaaggattatctagtcccttagaacccgatcaaatagcagatgaatatttactatttcctggcaatatggtagttgacatgtctgctggggaacatttttccgagaaagaggaggaggaagaaaccgtagatgaagaatttaatgatgaaaacatgcatatcatgattcgtagtcctacaaccagtgactatgaatacataatgcaaagtaagggtaagaaatataatgtaggtgttcatgatgaaaatgatgacatgcccgaatctccggatcaggaagacttagccgtaccgtcacctgaagtttcagacttgttgacaaattacgatgaaaatgatgttttaatgggtgatcaaagtaacagcacacccgaagaatcaatttctaccaaagaagacttcgaagagttgattgatgaaggttcacgtaagaatagcataacgaagtcagaagtaacaactaagcaaataaatgaatttcataaatacgcgggaatatttaattattccaaaggagttgttcaagcgactcagaatcagacagctttaaataaaattacgagcgtggctaacaaaaaagcacctgcaaaaatatcactcgtagccggtccaattgtacataatctatcaaccgggaaggtaaatcctgaaaaattaataatcactcaaaatccaaatattttaaatacttcacaagccgctaaagttacgagtattattcttacccataattctgcggtacggagaaatgtccttaatgtaccaaagattgtaagtaccgtatctccagctattactatagtaaatgccaccacatctcaaatggcttctatactaccgtcgaaattcacagtacctgtgataagtgccagtgctgtgcgacaactttccaacgtaaaagtgatcgataaaccatcttcatcgtcactgtctatctctacacgtgacaatgttttacctaaaaagatattcgaagacgattccgtgtcacctgacagttctaattgcgaggatgataaatcaaaagattcattcgacgaaaaaggaaaattggaatctccttcgcgagaaataaaacctttattaaaaacagacgcatcttcgtcgaatacaatcatcgcaagaagtttagaatataaaacacacgatcaccaaaagaaagctgaacaccttcaggtcatgaatataatacaaaaacagagaatacctagtccgctaatgccaaagtctgcttcgcctgtgattatacacaatactcccgaattgaagatgactgcacaagttattcaagaaacacaaactcgtatgaagatgacagccactacggaaactttggacgcatatgacggttcagtagacgatactaagtctgttgtaatatcgattccctctcctactccatctcaagaacaaatgttggacaatatcgcttaccaggctttggaaaataggagaagagaatttgattctatcgaagatgtattagatatgatagaaaatatcaccgctgaaccgcctgctattttagaagaaaatgtacctgtacaaaatcctaaaaagaatacaaatactgaaactaaagaaaaggatattgacaaaccaaaaccagaaatagcaaatataccagtaagtactaaatcttctgcagtgccacaactttcgccattgtcgcaaccaacagatttaactatgaacatggcaaacgcttcccagcaactaagatcattgttgtcttcactgcaaactacttcaacgtcttcaccaactaatgtagaatcagtagttaaaaatttcggccacaaaattagcagtagcgcttctcctactgccacccaacctattgttgcgtctagagttatacagcaggctggtagacaatcaccagttgtaacaacagtgaacactgtaatcgtaccgaatttaaaacaaaaagttacagttacctcggcaagcagttctagaaatagtccagtaaaaactcaagttgtgaccactcagcatataccatcttcggctattattacatcaacaataaactatataccaaatagaacaattgctagtatgcaagttatgacagaacatcttaaattatcatctggtagtatgtctataacaactccttcagtttccactcagcaagcaattgctaaaactacaagtcataatgaaagtaagaaaccttcattaacattaacggctatgctgcaaaatcaacctgctgctaatatgattactaaatcttcggcggatacaattactgcagccagcctgcttggatcacctattagtttacctaaaactggtttttcaacttccttagtacaagcgcaacctactgttgtcgttcccgttataactacttcaatgatagcattacaaactcagccatctattgtttctactgtaaaaagttcaccgatgaaaacaattgcagatactataacggccgcaagtcttttaagttcgagttctgttaacattgtaaaaaccggtattacagctgctttattacaagctcaaccgaatccaactcttagctctttatctactgcaacacctctaacgcaaacctctaataatattataaccagctcgacccacagagttcctacttctactacaaatcttttacacacccagctaaccaaagtagtgaggagtaaatcagttgacgatatcaaagagataaaacaagaagagataaaaacggaaattatggataccggtgtcgatgacaataaattttcacttatttcacctagtggctgtaaaatgtcaacaattcagaatccaatattaaataaaggggatgattcgcaaaatgttttgctgaaaaagctgctacaaaatactgcttgtgctagtacacagtcaccacctcctactacagcaagcactatcacaactatttgtcccacacctaaacttcccattcgagaaacatcttttgtttctagcccgaacgtagaactaccagtatctcaaccgagtgttgctgctgttgttcctactcagcctttgcaattggagattaaaaaatgtttaccccctagtagaagttctagtagagatgaactgttatctccccaaactcccagatcttctaccaatagtcaagattctagtttacaaactcctccaataataaagaaagaaataatgtctgtaccaccacctcagccaagtccaattcacacaacacatgaagtcaaaaaggaacttatggatgagtcttcgcaacattctgaggtttctgattacagccgaccagatattcccataaaagaagaaacagaaatggctgatattgcaatagaaaagccagtgcttgataaagaagagttaaagaaacaaaagaggcggatgtatcaacagaaaaggcggcagaatcaaatacttaataaagaattggctgggcaacctaagaaacgaccaagaaaaaattcaaaaatagaagaagactacgatacttatatagatggagtgttggctcaattaagacagttacctggaattacagtatctgaaccggtattaaatcgcaaccatggtatagtgtcacttttcgggtctggagatatgtccaaacttggaacaaaaggatactctacccagtttggggatttagtcgggaagtatggctatgctgaactgccaggctattcagatttttattccaccaaaccttatggagatctggatcctataccggaaaaacctccctcttcaacccaaagaggtttctacgatcaagaattcccattgatacggtttgacacagacgatcataagaaattcgacatgttctgtagagaagatactccagattcaatactcagtagttcatctccggaatgtgtccaattagatccacagtgtagatttatgggattaaaacttattagcgatagcgaaagcgaggacgaggacaatgaaatagaaagggaaatacagcaagctagagatagactgtcgccgatagtacctatgatcaaaccagtaccaattagattgaaaccagttggaggattgcttgttaaagaaactcccagtgataacaaagaaaacatcaatacagatagtcttaacgtaatgacaaagatcaaatctgaaaacaaaccgtcgataccgacgaaagattcaggacatgttaccgtgacattaacattaacttcatctgctgctgaagacataatgggtgtactaagggacttggcaaacattctacaaattccagctcctacgagttatcaaatagtggaaaggacaacaacccctcccagtcagaaactcgggctctaccggaccaagggcaaggatggtaaagagggagcgccaatagacattcaaagtattcttaatggggctaccaagttctgtaaacactgtgatgtaattattttaagcaatttgataaggagaaaggtttccgaccttcctttcttggccaaagactcagaacttttaagcgacggagaggaactattcttctgcagctcgacttgctacatgcagtttgccctaatgcatagatcaccttctatttccgaagataaggccgccgaaataatcaaccatttatctcagaaggataacgagagtaaacaaaaaatgcagatgatggaaccatttgacaataaatcattaatagctcaaagactctcgttcacaaatcgcgagatgaagaaagaatatgaaccaatggataccagcgattactattcctacttgcataataatgcagagaataaaccgaatcgattttatgacggtgcttacagaccgatgccggttagcagaatttacaaaaacatcaagtataaggcttggtcgcctggatgtttacaaccgaatcagaaacataagatacctacggataaagaaatcatggaactgttgtatagaatgcaaataaccgtcatgccgccagttatgccggatgacacaagaaagtgcatgttttgtcagggtgttggtgatggggtagctgatggcacggcaagattacttaactttgaagttgataaatgggttcacttaaattgcggtctttggtctgacggggtatacgaaacggtgaatggggcgttaatgaatttggagaatgctttacaaactagcttaacgacgaactgcgtacattgcaatatgttaggtgctactataagatgcttcaaaacgagatgttccagtgtatatcatctgaattgtgcagttaaagacaattgtgtatttttcaagaacaaaactgtttattgcatagcgcatgttcctaagaacgaaaaggacaacgagttgacgacgctctctgtatctagaagagtttatgttaatagagatgaaaacaggcaggtcgctgctgtgatgcaccactcagacactgacgatctattaagagttggtagcctcatattcctaaatgtaggtcaactattaccacaccagctacaaaatttccacacttccaactacatatatccaataggctacaagataataaggttctattggagtatgaaatctttaaacaaacggtgcaaatacatctgctctatccacgaacaatatggaaaacctgagtttagggtcattgttcaagaacctccagaggacgatatagagtttatagatcctactcccaaaggtgcttggcaaaggatccttgaccaaatcgccttccttcgcaaggagaacgaatgtttgcagatgttccctaaatttacgactggagaagatctttttggtctcactgaacccgcaatagtaagagtacttgaaagtctgccaggtatagagaccttacccgattataaattcaaatatggtcgtaaccctttattggaacttcctttggcgataaatccctcaggatgttgtaggactgaatcgaggtcgagaattcagttgcattggaaaaaacatcacactcaacggactactttgtctacagctcggcctttgtttggtccttcgccttcaggtccaactccaagtactccaacgttgggtgagctgtcgtgtccttacagcaaacagtttgttcattcgaagagctcgcagtacaaaaagatgaagcaggaatggaagaataatgtatatcttgctagatcgaaaattcaaggattgggtctatatgctgctagagacttagaaaaacacactatggttattgaatatattggggaaattataagaaccgaactggctgaatgcagagaaaaacaatatgaagcaaaaaatcgaggtatatacatgtttagactagatgaaaacagagtggtggacgctacgttgagtggtggcttagcgagatatataaatcactcttgtaatcccaattgtgtagctgaaaccgtggaagtagaacgtgacgtaaaaattattattttctccaagagaagaattatgagaggagaggagctggcttatgattacaaattcgaattcgaagacgaccaaaacaagatttcctgcatgtgtggcgctccgaactgccgcaaatggatgaactaa

SEQ ID NO: 341 - DNA, 1272 bp, Diabrotica barberi
gtagatgctgttgaaatgcatgaaccttacacatacctaaacggtttacatatcaaagatttagaagatctagtagaggatattaaggtctataaagagttagaaagggggaaaaatttggattattggaatgatataactgtaatagtggaagatgagttgcagaagcttaggaagctggaaaaacagaatgattttgatttaggtttgaatagaagagaaggtatacatcagtcagtagctggagatgttacttccgtatttaaaggtaaaaccgctgtccagttagcagctttagagaagcaaatagagggaaaaattagcggcaaagctgatggtattgatataggttactgggaatccctgttatcacaacttaaggcacacatggctagagcaagactacgagatagacatcaagaaagcttgagaagaaaacttcaagttttgaaagccgaacaagccatcattgtaacagctccaagcgaaagtcattccagtggaggcgaggaagctccaacgaaagatgtacaagaaccaaagcctggaccttctcaggaacctgatgataagcaaaatgatgaggaggaacctgcagatgaggaagcagctaattcatggctaaatgagtgttttgatgcctatgaagctggtggatatagtcccaagtttcttactccagatgaaatagagccgggaacaattgttgtgatagaagaagatgatttgaaaagattggaatttgcaagaattcaggttgttggtaaaggtaaaactgtggaaaatgttataacgaaggaagagttgatgctacaaaaagaggctcgtaaaggcatggatggagacgaggcacagttctctgtagagcaagctttggacagccaagtctatctttggtctgacaaataccgtcctaggaaacccaggtactttaatagagtacacactggattcgaatggaacaaatacaatcaaacacattatgatatggacaatccccctcctaaaatcgttcagggatacaagttcaacatattctatcctgatttaatagacaaaagtagtaccccagagtattttctcactccttgcccagaaaataaagaatttgccatattgagatttcatgctgggcctccgtacgaagatattgctttcaaaattgtcaatagagagtgggagtattcgtataaaagaggatttaggtgccagtttcacaataacatcttccaactgtggttccactttaaaagatataggtataggagataa

SEQ ID NO: 342 - DNA, 1263 bp, Diabrotica barberi
atggacaacctagaaaccaatattatggataagtcgatgagatcagtcttcgtggggaatattccatatgaagcaactgaggaaaaattgaaagatatatttggcgaagttggacaagtactatcttttaagcttgtatttgatcgtgaaaccggaaaacccaagggatatggtttctgtgaatacagagaccaagaaaccgccttgagcgcaatgaggaatttaaacggttatgaaataggcggaagaaatttaagagtggacaatgcttgtacagaaaaatctagaatggaaatgcaaaatctcctcaaccaacctccagtagaaaatccctatggagaggcagttcaagctgaaaaggctcctgaggctataagtaaggccgttgcatctctacctcctgaacaaatgtttgaattgatgaagcaaatgaagacaactattcagaataatccaacagaagcaaggcagatgcttttacagaatccgcagcttgcctatgctcttttacaagctcaagttgtaatgaaaattattgacgcagctactgcagttagtttacttcatcctgtgaaccaagtaccagcgacacttatgcctggagacaagaatgttcctgtccaagtaccagttaataatcagtacagggagcccccagcacctgttcaaccgcctgtccatccaagacaagacttccaacctgttcctcctcctgttatgcatccatctcaaaatcaagtatttccaagtcaagatatagatctgagatccattggtggtgtgccagatctaagaaacctaagacccatgggtgaccaggatatgagacaaatgccatctgctattcaaaatcccttaccacctactatcggagaaagctttattcgagatcctagagcagcacaggcgtttgcaggagatccaaggcaagcacgcatggacccacgtcaaaaacccatggtgcctcctcctcaaggccaaatgcccataccacctccaatcgcaagaccacctgtaatgccgcctcagcctcaagttcctgtgacgagagcagcacctctacctcaaccgtctccagctcctactcctgcaacggccagtccaaatgttgcaaatgccggggcttcggatcaagaaaaggccgcactcattatgcaagtattgcagctgtcagatgaacagatctctatgcttccacctgaacagaggaatagtattttggtattaaaggagcaaattgcaaaaagtgcacacacacgttaa

SEQ ID NO: 343 - DNA, 999 bp, Diabrotica barberi
atgacccaaatggaccccgaacgtgaaaaaagccttcaagagtacaggaaaaaattattagaacacaaagaagttgaatctagattaaaagagatgcgagagcagctaaaagatcttacaaaacaatatgataaatcagaaaatgatcttaaggctttacagagcatgggccaaatagttggagaagtactcaaacaactcactgaagaaaaatttatagttaaagctaccaacggtccccgttatgtggtaggatgtcgtcgtcaactggacaaggcaaagttaaaagcaggaactagagtagcattggatatgactacattaactattatgaggtatttgcctagagaagtggacccattggtgtataatatgagtcacgaagatcccggagatgttacttattctgctattggtggtttatctgaacagattagagaacttcgagaggttattgaactgcctttgttgaatccagaattgtttatgagagttggaatcactccacctaaaggttgtttgttgtatggtcctccaggtactggcaaaactctactagctagagctgtggcgtctcagttagatgcaaacttcctcaaagtcgtttccagtgctatcgttgataaatatattggagaatctgcaagactgatcagagaaatgtttaactatgctaaagaccatcaaccttgtattattttcatggatgaaattgatgctattggtggtagaagattttctgagggtacttcagctgatagggaaatccaaaggactcttatggaactgcttaaccaaatggatggttttgattcattaggacaggtaaaaatgattatggcaaccaacagacccgatactctagatcctgctctgctccgtcctggtcgtttggacagaaaaatcgagatacctcttccaaatgagcaagcccgtcttgaaattttgaagatccatgccctcccgatcgctaaacatggagaaatcgattatgaagcc

SEQ ID NO: 344 - DNA, 777 bp, Diabrotica barberi
atggctcgtcgatatgataccagaactacaatattttctcctgaagggaggttgtatcaggtggagtatgccatggaggctatttctcatgcaggtacttgcctgggcattttagcaaatgatggcattttgttggctgctgagaggcgtaacactaacaaattattagatgaggtttttatttcagaaaaaatatacaaactcaatgatgatatggtttgtagtgtggctggaattacatcagatgctaatgttttaacaaatgaattgagacttataggtcaaagatatttatttcagtatgccgaatctattccttgcgaacagttagtttcctggctttgtgatgtcaagcaggcatacactcagtatggaggtaaacgtccatttggtgtttcaatattatatatgggatgggataagcattatggataccagctatatcagtcagatcccagtggcaactattctggttggaaagctacctgcataggcaacaacagttcagcagcaatttcaagtttgaaacaagaatataaagaaggtcaaatgactttgaaggatgcaaagacgttagcagtaaaggttctggcaaaaacattggatatggcaaaactaacttcagaaaaagtggaaatggctacacttacccgcaaaaatgataaaaccatgatcaaaattttaagcggcaaggaagtagaagaactgatttcagagtatgaaaaaagtgaagctgctgcagaagctagcaaaaaagagcagaaggcatcagcttaa

SEQ ID NO: 345 - DNA, 2739 bp, Diabrotica barberi
atgggcgatacaaaggtagaacctacaaaggtcgataaagcaaaggggacggaggacaaaaacaaaaatgaactgtcggaagaagacaaacagcttcaagatgaattaaatttgtgtgttgagaaactccaggataacgatgaaaagagatacctacctgctttgcaagctttatcaaatcatattcaagcctcaactacttcgatgacttctgttcctaagccgttaaaatttatgaggccccattacgaaaccatgaagacagtacatgaaaaaattactgatcctgatactaaaaaagtctgtgcagatattatatctgttttagctatgacaatgggagaaggcagagaatgtttgaaataccgtcttctttctaatttggataaaattggcgaatggggacatgaatatgttaggcatttggcaggagagattgcaggagaatgggccgagactgattttatagtgaacactgaaattagggaaaaacttatcttactaacaaaacaaattgtgccatataatatggcacacaatgcagaagcagaagcatgtgacttgcttatggaaattgaaaggcttgatctactagaacagtatgttgatgaaaacatataccatagagtgtgtttatatctcaccagctgtgtaccctatgtagcagatcctgagaatactactctactgcagactgctcttttactgtttagaaagtttgatcagtatccccaggcactgagattagcaatgcagttaaatgactttggattaattgaagaaatttttgtcaactgccctgattcggacgtacaaaaacaactggcttttatgttaggacgacaacagatatatgttgaaattcctgagcatacgcctgaatacgaagatctaatcgagataatggcaaactgtcatcttaataaccacttcttgaacctagcccgcgagttggacattatggatcctaagaccccagaagatgtttacaaatcccatttagaaaatagccgtcccccattcggtggaaaccaagttgattccgccagacaaaatctagccgccagctttgttaacggttttgttaatgcagcttttggtcaagataagctcttaatggaggatgggaataaatggctttacaaaaacaaagaacatggaatgcttagtgctactgcttctttgggactaattcttttatgggatgtagacggtggtcttactcctatcgataaatacttgtactcttctgaggaccatatcaagtctggcgctttattagcttgtggcattgtaaactgcggtgtaagaaatgaatgtgatcccgcactcgcacttttgagtgattatgttcttcacaacacaaatataatgagaataggggctattgtaggtctaggtttagcgtatgttggttcaaatagggaagcagtattatctctaatcacacctgtgctatctgaccctaaatcaaatatggaggtcattggaatggcggctctagcatgcggaatgatttctgcaggatctggtaattcacatgtgacaacatcaataatgcaagttcttatggaaaagtccgaaatagaattaaaggacacttacgccagatttttgcctctgggtcttggattgtgtcatttaggtaaacaagaaagcattgatacaattatagcagcattagaagttatacctgaccctttcagatccatggcaactactatggtcgatatttgcgcttatgcaggcacaggaaatgttttaaaagttcaacatttgttacatatatgttcagaacattacgatgctcctgagactcctgacaaaacttcaaaggacaaagataaaaaggaaacagagaaagaaaaagataaagatctttcagctagacaagctctgttccaacctcctgacaaaacttcaaaggacaaagataaaaaggaaacagagaaagaaaaagataaagatctttcagctagacaagctattgctgttttgggtatagccttaattagcatgggagaagacattggtagcgagatggctttccgaacatttggtcatttactaagatactgcgaaccagccatcagacgcgctgtaccattggctctaggcttaatctcagtttcaaatcccaaattaagtattctcgatactttgagtaaattttcacatgatagcgatgctgaagtggcccacaatgccatctttgcgatgggtctggtgggagctggtactaacaatgcaaggttagcagctatgctaagacagttagcacagtaccatgccaaagatcccaataatttatttatggttcgtattgctcagggtctcactcatcttggtaaaggaactttaaccctcagtccattccacagtgataggcagctgatgagtccagtagctgtagctggtctaatggcgacactcatcggcttcttggatgttaaaaacattatattggggaagtcccactacctcttgtacaccttagcagctgcaatgcaaccaaggatgttagtgacatttgacgatgagctaaatcctctaccagtgcctgtcagagttggattggcagtggatgttgttggccaagcaggaaaaccaaagactataacaggtttccaaacccataccactcctgtgcttctggcttatggtgagcgagctgagctcgcaactgaagaatacattgcattgacgccaattatggaaggatttgttattttacgaaag

SEQ ID NO: 346 - DNA, 861 bp, Diabrotica barberi
ggtagtgattacgaagggggcactatgtttaatggtaactttgaaggcacgtacgggactgcgtatgcccacggtattcatgggggctcgtattcgccctcgaacaagcagcatttaggggtcaatggggcgcaaggcgttcagtcgcccaataagccacggaataaatctagaactagcgccgagggtagagagtgcgtcaactgcggggcgacaagtactccactgtggagaagggacggcactggtcattatctatgcaatgcatgtggactttattacaagatgaatggacaaaacaggccactcatcaaacccaaaagaagactgagtttacaaagtgcggcgaggcgagcaggaacgagttgcgcgaactgtaaaaccacaactacgaccctctggaggcgcaatcagaacggggagcctgtctgtaacgcctgcggactctactataaactacacaacgttaacaggccattgacgatgaaaaaggaaggcattcaaactcgcaacagaaaactttcttcaaagagtaaaaagaaaaaatcgggtgcatcgtgtctgtctttgggcggcatgatgggtgacatgatgaagcctttagatagcaaaggtgccttcggtggaggcttcggcgcaggtatgggtggcggacatccgcatcttaacgctgctcttcatcctcaccacgctatgacacattggcatcagtatcagcatacccaagggttcgtttcaggtccacctccacccgccccaccatccgcagcttcgtatcaccatcatatgagttcgttaagcgctgctgggttaggattgacgtcaaacggaatgacaagttggagatcagaatacacgtga

SEQ ID NO: 347 - DNA, 5010 bp, Diabrotica barberi
atggcacttccagggaacgggatatttgtcgtcaaaggagaaatctccaacatgatggcggctatgaaaagaggaacaaggtggtcgtctcattcttatcaggacgatgatgtagattccttactaagaaactttcaagaactaagagatattctagacaatgtagacgacttaagattcgtagaacccaacacattcttggccccctttttgaatgtcataaggtccgaagaaaccactgggcccgtgaccagtctcgccctatcagctgttaataagtttttgtcctatggattactggatcccttgcatgcatctatccctcaaaccatccacagtatagcagatgcagtcacccatgcccgtttcgttggaacagatcagtcgtcagatggagtagttctcataaggatattgcaagtcctaagaactctaacattatctccagaaggtaccgccttaactaatgaaagcctctgtgagataatgctgtcatgttttcgaatatgctttgaaacaaggcttgtcgacctattgagaaaaactgccgaacactatttaaaagaaatggtgcaattaatttttatgaggttgccgcagtttagtgaggatctcaaagtttcttacattaaacagttgaagatgaaacctggagctttagatcaaacacgaactaagaggaaaaagcagtattcttcacttaaaaaagataagagtgacacagacattaagtctccccaaaccccacaaggtaatcttgcagcagtagcacaaagtagtatagtagatatgcaaggttccttgcaaaatcctgaaaacgctaaccctgtaaccccaaatgctagtccaaaagaaaacttcaagtgtgatgtagatatcgttgttgatagtcctgttagtaataatgaagatctaaaaaatatcgattctatatcgtctggtgtagaagaggcagcaacagaacctaaatcacttactgaagaagaaattacagaagaacagagtcagagtactcaagattacataaatcagagaggcataaggtttactccacaattgcagcaagaagctaacttgtcaccctatggtttggcatgtgtaagagaattactgagatttttaataagcctttgtaaccctcttgataaacaaaatacagaaatcatgatccatttaggtttaactcttttaacagtggcatttgaaataagtgctgataatattggtaaatataacactttgctagctttagtaaaggatgatttatgtagaaatctattttctcttatgaacactgaaagactagcaatattttcattggatttacaagtgtcttttttattatttgaatcattgaggacacatcttaaataccaattagaacactatctaaagaaattaatagaaatcattctcagcgattctccaaaagtgacctacgaacacaaggaaatagcattagataatctgcttcaactgtggcgaataccagggtttcatactgaactatatattaattacgactgcgatatgtactgtgcgaatctgtacgaggaattaactaaattgttagctaaacattcaatatcttctaatactggagtgtaccatacacatttgttatctttggatgcacttatgataatcactgaagggattgaaaaccggtgttgcgaagaaaaagataggttagacgcaggaaatagcgaattggttcaacaatcaaatgacattagcttctatgtcggaaaaaattctaggactaaagtttctccaatcatgccaaagaaggaggaattagctcaaaagaaaagtattaagaagtggctaccgcaaggtactgaatacttcaacaaaaagccaaaaaagggcatagaatttcttcaagaacacggagtattaaaacaggatattgatttggacgaaatcgctagatttttaagggaaaatccagttctaaacaaggctatgattggtgaatatataagtaatcgaagtaatttgaaaattctgcaatccttcgttgatacttttaattttgtcggagtgcgtatcgatgaagctttgagagcttttctagagacttttagattaccaggtgaggcacccacaatctccctgatcttggaacatttcgcagaaacctggcataaagccaacaacgaacctttcgcagatgtggattcggccttcactttagcctatgcgataataatgctcaacgtcgaccaacataacgaaaatgccaaaaaacaaacgactcccatgtcggctaatgctttcaagaaaaatttgaaaggcgttaacggaggtaacgattttgacgaagaaatgttagatgatatatatacaacaataaaaaacgaagaaatagttatgcccgccgaacaagctgggttagttagggaaaattatttctggaagatcttgcttagaaagggacagacgaaagatggcatctacatccatgataatagtggtacttacgattctgagcttttccagattgtttatggacctatagtagcagctctgtcttctgtttacgagaaggctgaaaacgaaagtgtacataaaaaagtcatgcaaggattcgaaagatgcgcctttattgctgcaaatctcaatatatctacaaatttagatatgctcattctaggcatttgtaaattcactgtgttctacaatcagcagaaacagaacaacattgtggtgcaatttggaatgaacagcaaggctcagttggcacttaggacggtattttctctaattcatcaacacggaaacaccatgagggagggatggaaacatttatttgatctcttgttagcactctatagcaacggactgttgtcaaaaacatttgtagaggtagaagactttattgaaccaagtggcaaattaatgctagtctacaaggaagcaccatctgcggcgaagcaggataccggtttactgagttctctttactcatacatggtttccgcggaaaatttatcaaaaataccgaccccagaagagcaaaactgtatagatgccgctaaagaatgcataaaagactgtaatctagagcaaatgataaccgactccaagtttctccacgaagaagctctgtttgaactcgtaaaaaccttaatagagttatctagagggccggatgtacacgaaagcgtggcttatgactacaatgataacgttaccgtgttcttcttggagttattgatcaaagttgttatacaaaatagagatagagtgatgaccgtatggcagaatgtgcgggatcatatatacactttggttatgaatgcgtctgttttcgatttccagttcttgttggagagatctgttattggtctattacgtattgctatccgtctgatgagaaatgaagaaatgagtcatatagttcttcagtccttaagaatgctactgcttttaaaaagcagtaccctttctaggatatcccggcaaatatcatttggtttatacgagcttctgaaaacgtccgcacagaacattcataccaacactgactggactattattttcacgcttttggaatgtgtgggagcaggggctcaaccacctaagcctgttagctcagccgaagatacagaactgaaaagtaaatctgacggtgaaacttccgataaccacgaggaagagggcaccctttcagattcagaaggaaggaagagtccgaaagataatacccagaggtcacaaagtcctgtgagtgttgtaacttcgcctgttggaactccaaatacaggtggatggattttggtaggaaacgaaggtgaaattcaacccgtcatgggccgcaccgtccctccaacccaatacggcctagcgttagagaagaaccttggaagccatgaccccagaagtatgatgaagtgctgcgaaagtcttgcgtttctagtaagagatgtcgcccatattacaccttacaattttgacgtttgtgttcattgtataaggacttttgtagaagctagcttacatggttctaatttcaaaaggttgagagattctaggtctagaaagaaaactttagataggactagaactagaaaaagtccaacaagtagtcccgatgaggaagatagtgacgacgaaaacattccaagtggttatcagcaaatatcaatacagttattagatttaatgcatactttacatacgcgaacggctcagatatttaaatggtgggctgaagaaggtggtgaaatatcgcaagaaacttctctttggactcaaggttggtgtcctcttctgcaaggtatagcaagactgtgctgtgatacgagaaggcctgtaaggatgagtgctataacgtacctgcaaagagcgctattagtccatgatttacaaactttgagtggatcagaatgggagcaatgtttccaaagagtattatttcctttacttagttacctgttacagtcaataaatcctaaagatgccatatcgatggaagaaactaggataagggtagcaactgtgttgtcgaaagtgtttctacatcaccttactcctctattagcacttcccagtttctttaatctatggctggtggtgttggactttatggataaatatatgcatgcagataaaagtgaacttctttacgaagctattccagaagcacttcccagtttctttaatctatggctggtggttttggactttatggataaatatatgcatgcagataaaagtgaacttctttacgaagctattccagaaagtttaaaaaatatgcttttggtgatggattctgctaaagtttttgacggtcccgatggaaagaacattctatggaatgccacttgggaaaggatagggaaatttctacctaacatgaaagacgacttatttaaggaaatagaagaccaaaatagaaaaaacgaagaagttagtaacatagagataatagtgaataaagaagaaaaagatgtaaatacagagaaattgactactaatgataaccttattacgtgttag

SEQ ID NO: 348 - DNA, 786 bp, Diabrotica barberi
tcaatttcactgtttcacgtttgtaagtacgtttgcagactgtattcagtgtattgtattttagtattttacaattctttgaattgcagattatttagcagtttagtacaaaaacctgaagtaaattctataatctataacgaaaagtgcttaaattttagtggcaaaatgtccattctagcttacaatggtggtgctatggtggcgatgaagggagaaaactgtgtagcaattgcagcagataggcggtttggtattcaagcccaaacagtagctacaaatttccaaaaaatctttgaaatgggaccacatttatatgtgggtcttccaggattagccacagatacccaaacagttatggaaaaactccgtttccgaaaaaacttgtacgaacttaaggaaaatcgaaaaatatctccaaaagtatttgcctctatgatatcaaacatgttgtatgaaaaaagatttgggccattttttgtggaacctgtagtagctggacttctacctaatacttatgaaccctttatctgtaatatggatttaattggttgtataaaccaaccttcagactttgttgttggtggaacagcctcagcacagttgtatggtatgtgtgaagcactttgggagcctaacttaggacctgaggatctttttgaaaccatctctcaagctctcatcaatgcctttgacagagatgccatttctggttggggagctacagtgtacatcatagaaaaaaataaggtgactgtaaaaaatttgaagacacgtatggactag

SEQ ID NO: 349 - DNA, 2808 bp, Diabrotica barberi
atggatcagaaaccagatatagatctggtgatatcggcagtttcagcgttgtacaataaccctaacagcagtgagaaggaaagagcttctaaatggcttttggaactccaaaaatccgtccatgcctggactgtagcagacgaattattacatttaaaaagagacttggaatcatgttactttgctgctcaaactatgaggacgaaaatccaccagtctttccacgaacttcctcaagaagtgcacacgtcattaagagattcattacttgaacatattggccaaattaacgaagcaactaacactgttatagtgacacaattgtgtgttgctctggcagatttagctctacaaatgccatcttggcagaatcctacgttagacctaatcaatagattctcccaaactaatatatggccattgctagaaattttgactgtgttacctgaggaactggaaagtagatctgtcaggctaggtgaaaacagaagaatagatgtgttagaagagatgaaaattagtgctccaacagtaaatgaatttttaaaacattgttccaaactctacgaaactaattggcaagatcacgttcagttcaatgttaaaatattacgctgctttacatcctggatctcagtaggagctattagtctgaacgatctttctgatagtattgttattaacagagcattcgagatactcaacttcaagcctcaaaatgataaacataccatatcagctgccttccatgaggctgccactgactgcatttgtactcttttactaagtcttgaaaacaacaataaccaacttggtttggaaaattacctcttcaataatattatcaacctagatgtaccttatcacctttctgttgcgaatgaggatcaaggaaaatctatggactactgcagactgtttacagaactggcagaatcatttttagaaaaaattatagctaatagtaatacaaaacagatgcactatgctattaaaattttagatctagttttaatgtgtgttggacaccatgactatgaggtagcagaaatcacatttaacctttggtatgttttaagtgaagaattataccaaaaaaataacaaagaaaagacagaactattccgaccctacgtagaacgattaataacagcactatgtaggcattgtcaaatggagccagatagcgaagggttgttagaagatggagatgaatttaaagattttaggttgaaggtagcagaattaatacgagatgtagttttcatagtgggcagtagtgcctgtttcaaacaaatgttcattaatatacaaggtccaggagttacgtgggattccacggaggcagctctatttgtaatgcaagctgtagcaaaaaacgtaatacctggtgaaagtgaagtggtacctcaggtcgtagaagcaatattaaatgttccagaaaatacacatgtagccgtaaaatacacgtcagtgcttttgctaggagaactttgtgaatggatagagaggcatccgaacacgctggatccagttttgaactttttagtgtgctgtttgcctcaacctggagtaggagctgccgcagcggtggcccttcaaaacatctgtgccagttgtaatgatcatatgccaaggcacgtcccgatactcttacagcttcttcaccaagctgattccttcgccatcaccaacacagctaccttgggtcttctgcgaggagtggcttcgataataggtcgaatgccgcacgaggagttgacgacggctttacgggaattatgttctatgcagcttaatccgatatgtcaaataatagaacaggatgttcatccagtgaagggagcccaaacggatccagtaatgtggctagatagacttagtgcggtgcttagatatgttaatgtacatattccggaaggtgtggaaaacccttgtaaaccggtaattctcgaagtgtggccggtattgtctcgcacgttcgataaattccaaagtgacattaggataatggagagatgttgtcgtgccgtgcgtttcatgctgcggtgcgtcgcgcaagaagtgcgtgaactcttagaaagcctagttggacaaatagtgaggatctatacgttataccaacattcgtgttttctctatgtcggtagtatactcgtggacgaatacgcaatagatccgatatgcgtgccaggactgctggatatgctgcaagcgtttctggaacctacctttcacgtgttgcaggaggagaacgggctgaagaatcatcctgatacagtggatgacttttttaggttgtgtgcaagatttatgcagagggcgcctttagcatttttaaaatgttcttccttggtccacatcttacagtgtgcccttttggcttcttccctggaccaccgagaagcgaatatgtctgtgatgaaattcttttacgatttgataaaccagggccagagcgggagggctgatcccgaattcaatcaacgacagatgttagttaaaagcatcctcgacgagtatggccaacaactagtctcgaatctaatccattcttgtgtcttctacctccattcctacatgctcagcgaagtcggcgacgtattcgtgcagctgctcgatttcgacagagagatcacctgcaaatgggtagcggctggtcttgacgtgttaccgaagaacagtaacggcggcatcatggccgccacacctcaacagttgacggatatacataccactattagcagggcgaatacttccaagtccgtaacgcatgctctcaaggatctagccaggttataccgttaa

SEQ ID NO: 350 - DNA, 1554 bp, Diabrotica barberi
atggctcagcggtttcccggccctgtgccaaatcaaagtccaggaggaccgcctcctcaaagatatcaacaacagccccctaatcaaggaattcggcagtatgcacaacaaaattttcctcaaagacctggatacaatcctccaccaccaaatataccatctagtggcggtacgatgattcaaagacctgctggtgctccctattcaccaatgagaggtggaattattccgccacagcaaggaaataaaaggcctgcagacaataggactcaaatgcaacagaaaagtaatgaatacagccatagtacaagtaagaagaagaaaaagctggcggataaaatcctgccacagaaagtcagagatttggttccagaaagtcaagcttacatggatctgctagcatttgaaagaaagctggactctactattatgagaaaaagattggacatccaagaagctcttaagcgtccgatgaagcaaaaaaggaagttgagaatatttatttccaataccttctatcctgccaaggaacctcagcctgaaggacccgatggaccatgtcaggaaggcactgttgcgtcttgggaattaagagtagaaggtcgtcttttagaagatccaaagaacgatccaaataaagttaaacgcaagttttcttctttctttaaatccctggttatcgaattggataaagagctgtatggaccggacaatcatttagttgaatggcacagaaccctaaccactcaagaaacagatggtttccaggtaaaacgccctggtgacaagaatgtgagatgtactattttgttgcttcttgattatcaacctctgcagtttaagcttgatcctagactagctagacttttgggagttcacactcaaactagaccggtcattatttcagctttgtggcagtacataaaaactcatcgcttgcaagatgcccatgaacgcgagtttatcgtttgtgacaagtatttggaacaaattttcaactgtacccgtatgaaatttgccgagattcctcagcgtctgaatccactgttgcatcctccagatccaatcgtcatcaatcacgtgatctccgtagaaggaggggccgagagcaaacaaactgcttgttatgatattgatgtagaggttgatgatacattaaaaacgcagatgaacaatttcctattgagtacagctagccagcaagagattcaaggacttgatgccaagattcacgaaaccgttgataccattaatcagctagaaggaggggccgagagcaaacaaactgcttgttatgatattgatgtagaggttgatgatacattaaaaacccagatgaataatttcctattgagtacagctagccagcaagagattcaaggacttgatgccaagattcacgaaaccgttgataccattaatcagcttaaaacaaatagggaatttttcctgagcttcgctaaagatccacaacagttcattcataagtggattgtgtcacagactcgtgatctaaagacgatgactgacgtggtcggaaatccggaagaagag

SEQ ID NO: 351 - DNA, 435 bp, Diabrotica barberi
atgccaaaagtacgacgaagtaaaaaacctcctcctgagggttgggaactgatagaacccacattagacgagttagaacaaaaaatgagagaagttgaaacacaatctcatgagggtaaaaggaaaaatgaatcattgtggccaattttcaaaatccatcatcaaaaatccagatatatatttgatcttttttatagaagaaaagcaatcagcagggaactatatgactattgtcttggtgaaaacattgcagataaaaatttaatagcgaagtggaagaagcaaggatacgagagtctttgttgcttaagatgtattcaaacgagagacaccaactttggaacaaactgtatttgtcgtgtacctaaatctaagttagaagaaggaagaattgttgaatgtgtgcactgtgggtgcagaggttgttcaggatag

SEQ ID NO: 352 - DNA, 885 bp, Diabrotica barberi
atgccagcagctactctaggtagcataccacatcctaataatgaagactgtggcattagggatgtttgggcccataacctggaggatgaattcagaaccatcagacaaatagtacaaaaatatcagtatgttgctatggacacagaattccctggtgtagttgcgaggcctattggagaatttagaagttctgcagattaccaataccaaatgctgaggtgcaatgtagatttattgaggataatacagcttgggctcacatttcttgatgataatggaaaaactccagggggtgcctatactacatggcagttcaacttcaaattcaaccttcaggaagacatgtatgcacaggatagtatagacctcctgcaaaattctggaattcagtttaagaaacatgaggatgaaggtattgaacctcttgaatttgcggaactgctgatgtcatctggtattgtcctggtggaaaatataaaatggctgtccttccattctggttatgattttggctatctgataaaactgttaacggacaacaacttacctcaagacgaaacagaattcttcgatttgttaaaattatattttcctaccatatatgatgtaaagtaccttatgaaatcgtgcaaaaatcttaaaggaggattacaagaagtggcagaacagctagaacttgaaaggattggaccacaacatcaagcaggttcagattctcttctgacaggaatggcatttttcaagatgaaagagatgttcttcgaagacacaatagacgactccaaattctcgggccatctctacggtctcggcacctctttcgcagtcaacggaactgccaacaactactcgaacgacaacggagataccacgaactcttcatga

SEQ ID NO: 353 - DNA, 1209 bp, Diabrotica barberi
atggcaattccaaatagaggtgcctcagtttttgaggacttatcaaatgtagagtttgaaactagtgaagatgtcgaagttatcgagaagtttaaaaacatgaaccttaaagaagaacttcttcgtggtatcttcgcatatggcttcgaaaaaccctcagccattcaacagagagcaataaagcctattatgaaaggaagagacgtaatagctcaggcacaatctggtactggtaaaacagctaccttttccatttcgattttacaagccttagatttgacaatgcgagaaacgcaagttttatgcttgtctcctactagagaattggctgtacagattcaaaaagttattctagctttaggtgacttcatgaatgttcaatgtcatgcttgtattggaggcacaaatcttggagaagatattagaaaacttgattatggacagcatgtcgttagtggaacacctggaagagtttatgatatgatcagaagaagagctctaagaacaagatctgtaaaaatgttggttttggatgaggctgatgaaatgttaaataaaggattcaaagaacaaatttatgatgtctacagattccttcccccatcaacacaagttgtactcatttcagctacactgcctcatgaaattttggaaattacttccaaatttatgacagatcctattaggattttggtaaaacgtgatgaattgacattggaaggtataaaacagttctttgtggctgtcgaaagggaagaatggaaattcgataccctctgtgacctctatgacacattaaccattacacaggctgttattttctgcaacacaaagaggaaggtagactggctgacagagaaaatgagggaaaacaattttacagttagttcaatgcacggagatatgccacaaaaggaacgtgacaatattatgaaagagtttagatcaggacagagtagggtcctaatcaccactgatgtttgggctagaggtatcgacgtacaacaagtcagtttggttatcaattatgacttaccgaacaatcgtgaattgtacatccatcgtatcggtagatctggtaggttcggccgaaagggtgtagccatcaattttgtgaaatcagacgatatcagaattctgagagatatcgaacaatattactcgacccaaattgacgaaatgccgatgaatgttgcggacttaatttaa

SEQ ID NO: 354 - DNA, 1605 bp, Diabrotica barberi
atgactgcccctacagccggtggtgatacaaatagaggaagaaccgttgcatataaggacaaaagtaaacccgctgatgtcaggaccagtaatattaacgccgcaaaagctgtttgcgatgctatccgtacaagtcttggccctagaggaatggataaaatgatccaggctggaaatggtgaagtgacaattaccaatgatggagctacaatcttaaaacaaataaacgtcattcaccctgctgctaaaatgttggtagaactatcaagggcccaagacattgaagcaggagatggtaccacatctgttgttgtaattgcaggagctttgttagatgctgcagaaaagttattacataggggaattcaccctacagcaatatctgaatctttccaaagagcagcacagttggcagttgatattttgtcagacatttctactccaattgaaattactaatagagaattgttaattaaaagtgcatccacttccctaaactcaaaagttgtttcccaacactcaagctttttgggtccacttgctgtcgatgcagttcttaaaattgttgaacctggtagagaacaagcttgtaatttatctgatatcaaagttattaagcaacttggaggtacagtagaagataccgaattagtagaaggaatttgtttccctcaaagatctgcaaatgtctctggaccaaaaaggattgagaaagctaaaattggtttcatccagttctgtatttcacctccaaaaacagatatggaccacaatgtcattgtatctgattacgcggctatggatagagtattaaaagaagagagagcatatattttgaatattgtcaagcagataaagaaagctggatgcaatgtacttttggttcaaaaatcaattttgagggatgcagtttcagatcttgccttacactttttggataaaatcaagtgtatggttattaaggatattgaaagagaagatgtcgaatttgtatgtaaatctttaggatgccgccctattgcatctttggatcattttgttgctgaaaacttggttactgctgatttagttgaagaggttggattggcaggaaatagaatggtcaaaattacaggtgcacaaaatgcaggcaggacagtaactctgctggttagaggatccaacaaattagttcttgaagaggctgatagatctcttcatgatgctctatgtgtaattcgttgtcttgttcgcaagaaggcacttattgccggaggaggagcaccagaggttgaggtggctcttaaactagcggctatggccaacaaactggaaggcattgatgccatttgcacacgggcatatgcgaatgccttagagattataccatttaccttgtctgagaatgcaggattaaatcccatacagaccgtcactgaactaagaaacagacacgccaaaggagagacgtctgctggaataaacgttcgtaaaggagctattacagatattctcgaagaaaatgttgttcaaccacttttagttagcacttcagcattgagtttagctacagaaactgtgagatcgatcttgaaaatcgatgatattgttaacacattcacataa

SEQ ID NO: 355 - DNA, 1116 bp, Diabrotica barberi
atggaggctatggatattgttataccagaaaaagaagaaggtagtccttcggaagtaaaacaagtgctgcaggatgtggatactgaagatttatacactaaatataaaaaacttcaacagcagttagagttcttagaggttcaagaagaatacatcaaagatgagcaaaggaatctcaaaaaggagtatttacatgcccaggaggaagtgaagcgtatccagtctgtcccgttggttattggacagtttttagaagctgtagatcaaaacactggtatcgttggctcaactacaggttcaaattattatgttagaatcttatcaacaatcgacagagaactcttaaaaccttctgctagtgttgctcttcataaacacagcaatgccttagtagatgttctacctccagaggcagattcttcaataagcatgctccaggctgatgaaaaaccagatgttcaatacagtgacattggaggtatggatatgcagaaacaagaaatcagggaagcagtagagttacctttgactcacttcgaattgtataaacagattggtattgatccccccagaggtgtgttgatgtatggacctcctggatgcgggaagactatgttggccaaggctgttgctcatcatactacagctgcctttattcgtgtagtcggatcagaattcgtacagaaatatcttggtgaaggtccgcgaatggtgagagacgtgttccgtctagcaaaagaaaattctccagcaatcatctttattgacgaaattgatgcaatcgctaccaaacgttttgatgcccagacgggtgctgatcgtgaagtccagagaattttattggaactgcttaaccagatggatggttttgatcagacaacaaatgttaaggttatcatggcaactaacagagctgatacattagatcctgcacttctgagacctggtcgtctggacagaaaaatcgaatttcctttaccagatagaagacaaaagcgtttgattttcagcactatcacatctaaaatgaatttgtcagaggaggtcgacttggaggactgcccttttgagacctggtcgtctggacagaaaaatcgaatttccgttaccagatag

SEQ ID NO: 356 - DNA, 432 bp, Diabrotica barberi
atgccaaatataaaattgcagtcgtctgatggcgagaccttcgaaatcgatgttgaaattgctaaatgctccgtcactatcaaaactatgttagaagacttaggaatggacgaggaagaagaagaagtggttcctttaccaaacgtaaattccgccatactcaggaaagtcatccaatgggcgacttaccacaaagatgatccaccaccgccagaggatgacgataacaaagaaaaaagaacagatgatatttcctcatgggacgcagacttcctgaaagtcgaccaaggaactctcttcgagttgattttggctgctaactatctggatatcaaggggctcttagatgtcacatgtaagactgttgctaatatgatcaaaggtaaagctcctgaagaaatcagaaagactttcaacatcaagaatgacttt

SEQ ID NO: 357 - DNA, 930 bp, Diabrotica barberi
atggacgataaggcgtcgtgtaaggagctagatggatggatagaacagttaaatgaatgcaagcaattaacggaaaatcaagttaaaacactatgtgataaggctaaagaaatattgtcaaaagaatcaaatgtacaagaagtgaaatgcccagtaacagtatgtggagatgtccatggacagttccacgatctgatggaactgtttaggataggaggtaggagtccagatactaattacctgttcatgggagattatgtagatcgtggatactattctgttgagactgtcaccttactggtagcactgaaagtcaggtacaaagagagaattacaattttgagaggcaaccacgaatcaagacaaatcacacaagtttacggattttacgatgaatgtctaaggaagtacggaaacgcgaatgtatggaaattcttcaccgatctgttcgattatttgcccctaacagcgctcgtcgatagtcaaattttctgtctgcacggtggattgagtcctagcatcgacaccttggatcacattagggcgctagatcgtttacaagaggtacctcatgaaggccctatgtgcgaccttctctggtcagaccctgacgaccgcgggggctggggcatctccccccgtggagccggctacaccttcggacaggacatttcagaaacgttcaaccataccaacggtctgtctttagtatctagggcacatcaactcgtcatggaaggttacaattggtgtcacgaaagaaatgtagtgaccattttcagcgcccccaattattgctaccgatgcggtaaccaggcggccattatggaattagatgatgccctgaaatattcattcttacagtttgatccagcaccaagacgtggagaacctcatgttacgcgtagaactccagactatttcctttaa

SEQ ID NO: 358 - DNA, 948 bp, Diabrotica barberi
ggtatgcaaatctttgtaaaaactctcactggtaagaccatcaccctcgaggttgaaccatcagataccatcgagaatgtcaaagctaaaattcaagacaaagaaggtattccaccagatcaacagagattaatcttcgctggaaagcaattggaagatggccgcaccctctcagactacaacattcaaaaagaatctaccctccatttggtgcttcgtcttagaggagggatgcaaatttttgttaaaaccttaactggaaagaccatcacccttgaagtagaaccttcagataccattgaaaacgtcaaagccaaaattcaagacaaagaaggtattccaccagatcaacagagattaatctttgctggaaagcagttagaagatggccgtactctctcagactacaatattcaaaaagagtctaccctccatttggtacttcgtcttagaggaggtatgcagatttttgttaaaacactcactggtaagaccatcaccctcgaggttgaaccatcagataccatcgagaatgtcaaagctaaaattcaagacaaagaaggtattccaccagatcaacagagattaatcttcgctggaaagcaattggaagatggccgcaccctctcagactacaacattcaaaaagaatctaccctccacttggtgcttcgtcttagaggaggtatgcaaatctttgtaaaaacactcactggtaagaccatcacccttgaggttgaaccatcagataccatcgaaaatgtcaaagccaaaattcaagacaaagaaggtattccaccagatcaacagagattaatctttgctggaaagcagttggaagatggccgtactctctcagactacaacattcaaaaagaatctaccctccatttggtacttcgtcttagaggaggtatgcagatttttgttaaaacactcactggtaag

SEQ ID NO: 359 - DNA, 966 bp, Diabrotica barberi
atgatgcaaccacagatattactcttaaaagagggaactgactcatcacaaggaaaacctcagttaatctcaaacataaatgcctgccagaatgtgacggatgctgtaagaacaacattggggcccaggggtatggacaaactcatagtacagaggcaaggacatgctactatatcaaacgatggggcaactattttgaaattattggacatcgttcaccctgctgcgaaaactttggtagatattgctaagtcacaagatgcagaggtcggggacggtacgacaagtgtagtattactagcaggagagtttttaaagcaaataaagccttacgttgatgagggtgttcacccaagaataataatcaaagcagtcagaagatcgttccaaatttgcctcgagaaaataagtgaaatctctgttaaaatcaataaatcaaatgctgacgaatttagatctctattggaaaagtgtgctgcaacagcgatgagctcgaaattaattaatcaacaaagatctttcttttctaaaatggttgtagatgctgttctattactggacgatttactacctctcaatatgattggtatcaaaaaggtacaaggtggagccctagaagagtcacttttggtagccggagtagcctttaagaaaactttttcttatgctgggtttgaaatgcaacccaaggtatacaaagattgtaaaatagctctgctgaacattgaattggaacttaaagctgagagggataacgcagaagtaagagtagataatgtaaaagaatatcagaaaattgttgatgcggagtggacgatcttgtacaataaacttcaaaaaatttatgagtctggagctaatgttgttttgtccaaattacccattggagatgttgctactcaatattttgctgacagggatatgttctgtgctggtcgtgttcaagaagatgatatgaagcgtaca

SEQ ID NO: 360 - DNA, 3645 bp, Diabrotica barberi
atgatggtcggcccaagcggttccggtaagagttcggcatggagagttcttcttaaagctcttgaaagattcgaaggcgttgaaggagttgcacatgtcatcgatccaaaagctattagcaaagaagcgctgtatggtgttttggatcccaataccagggaatggacggacggtctcttcactcacatattaaggaaaattattgacaacgtcaggggagaaattaacaaacggcaatggattatcttcgacggtgacgtcgatcctgagtgggtagaaaacttgaattcagtacttgacgacaacaaattgttgactctgcccaacggtgaacgtctttccctacctccaaacgttagggttatgttcgaggttcaagacttgaaatatgcaacactggccacggtttctcgttgcggtatggtctggttctctgaagatgtcttgtcaactgacatgatcttcgaaaactatatccttcgtttgaggaatatccctctggaagaaagcgaagatagcggctttggcaagaaaaacgacaaagacgatatgctttctcccactcttcaactacaagtcgacgttgtcaatctactacaaccgtacttatcacccgatggtcttgtcgtacgttgtctggaatatgcgatggaacaagaacatattatggacttcacacgtcttcgagcgctcagctcgttattctctatgttaaatcaagccgtaagaaacgttctccaatataaccacatgcatcccgactttccattaaccaatgatgtcttagacaaatatatcccaaaatgtttgatatattccatcctttggagtttcgctggtgacgccaaactgaagattcgttccgatctaggagattttatcagatctgtaacaacggtacctcttcctccagacaacaacatgcctataatcgactacgaggtcaccatcgagggcgaatggtcgctttggtcaaataaagtaccacaaattgagattgagacgcataaggttgcttcacctgatgttgtagtgcccactttggatacagtaagacacgaatccttgctttacacttggttggctgaacataaaccattagtcttatgcggccctcccggttctggtaaaacgatgactctattctccgctttaagggcgttacctgatatggaagtggttggcttgaacttttcatctgctacaactcctgaattgctgctaaagacattcgaccactactgtgaatacagaaaaacgcctaatggtgtagttttgtcaccaatacagttgggcaaatggttagttctattctgtgacgaaataaatttaccagacatggacaactacggcactcaacgtgttatcatgttcttgcgtcaaatcgtggaacagaaaggtttttacagagcctcagaccaatcctgggttgcactagaacgtatccaatttgtcggtgcctgtaatcctccaactgatcccggcagaaagcctctatcccaccgattcttgcgacacgtacccgttatttatgtagactaccctggagagacatctttgaaacagatctacggtactttcaccagggctatgctaagattggcgcctggtctgaaaggttatgccgaaccattgactaatgctatggttgaattttatttggcatctcaagatagatttactcaagatatgcaaccacattatgtttattctccaagagaaatgaccagatgggtaagaggaatttgtgaagcaataagacctcttgataatcttgctgtggagggtttggtaaggctttgggctcatgaagctctccgtctcttccaagacagattagtcgaagacaccgaaagacggtggactaacgaaaacattgatgctgtagctttaaaacacttcccgtcagctaactgcgagaaagctttggaaagacccattctttacagcaattggttatctaaggattatgtacctgttggaagggaacaactaagagaatatgtaaaggccagactgaaagtgttctacgaggaagaacttgatgttcctttggtgctgttcgatgaggtgttggatcatgttttaaggattgaccgaatattcagacaacctcaaggtcacttactactgatcggagtttctggtgccggaaaaacaactctgtccagatttgtagcctggatgaatggtttatctatattccaaattaaagtacacaacaaatacacagcggaagatttcgatgaagatctaagatcggttttgagaaggagtggatgcaaacatgaaaagattgctttcattttggacgagtccaatatgttagattccagtttcttggaaagaatgaacactctactagctaatggtgaagttcctggacttttcgaaggggatgaatatactactcttatgacccagtgtaaggaaggagcccaaagggaaggtttaatgttggattcaaatgacgaattatacaaatggtttacacagcaagtaatgcgcaatttgcatgtggtcttcaccatgaatccctctaccgatggtctgaaggatagggctgccacttctccagctctgttcaacaggtgcgtcttgaactggttcggtgactggtcagatggagctctcttccaggttggtaaagaattcacgaaccgtttggatcttgaaaaacaaagctggagatgtccagacttcttcccggctgcttgccatcacatctcagcgtctcctactcatagagaagctgtcatcaatgcctgtgtgtatgtacatcagactcttcataaagcaaacagtagattggttaagagaggaagccgtaccatggcgatcactccaagacattacttagactttattcatcatctcgttaaactgtacaatgagaaacggtcagatctggaggagcagcagttgcatttgaacgttggtctgaataagatcgccgaaactgtagaacaggttgaagaaatgcaaaagagtttggccgtcaaatctcaggagcttcaggccaaaaatgaagctgccaacgctaaactcaggcagatggtgaaagatcaacaagaagctgaaaagaagaaggtgcagagtcaagaaattcagcagcagttggctgaacaaacgattcatattgaacagaaacggtcagaagtaatggctgatctagaacaggtcgaacctgccgttattgaagcccaattagctgtaaaatccatcaaaaaacaacagttggtagaaatccgtactatggctaacccaccagctcttgtgaagttggctttggaatccatttgtttactgctcggtgaaaatgctagcgattggaaatctattcgtgctgtaattatgagagacaacttcatcaataccgttgttaacaacttcaacactgaagatattagtgatgatgtaagggaaaaaatgaagaaccgctacctcagcaatccagattacaacattgataagatctaccacgccagtaacgcttgcggtccacttgtcaaatgggcttgtgcgcaagttcaatacgcagacatgctgaaaaaggtcgagcctctccgtgaagagctcaaatctctagaacaacaagctgaaaccaaccaaaagagaggtgaagatgttaaagcactcattagc

SEQ ID NO: 361 - DNA, 2679 bp, Diabrotica barberi
ttcagaatggatcgaccgagtacaagtaagcgaaatgtctttgactccgattcagatagtgtcgacagcactgaagaagctcgccgaagagatctgaaggaaagagatgaattcgcaaataggctcaaaaaacgcgatgaagaacgtactagaaacgttgccagtacttctgataagcgtgcttatgaagaggctgctaaaagacttaaattggacaatgcagaaaaagagaaacttattcctgctctcagagttgcttccaggaggaagtatttggaaaaaagaaaagaggacaaactacaagaattggaagctgatattgccgatgatgagtacctttttgaggaagatgttttgactgaaagagagaaaaaagatcgtgtacacaagaaagagctgttaaaattggcacaggaacatgaaaaggccagggaacttgagcgggttcaaaggtatcacatgcccagagatttgggcaaggactccactgctgattacattgaagttgatgacttggagaaggtaccacaatctgaacagaagaaatgggaaaaagatcagatggcctcggcagtgtttaagtttggagcaaaagatggaattaaaaaagaagagtatgagttagtattagaagatcaaattcagtttatacaagcactacaaatgccaggagtgtctgataagaaagaaccccaactaacggaaacagaaaagaaaaaacttactatagaagaaacaaagaaaagccttcctatatacccttttaaagacgacttaatacaggccattagagaacaccaagttttaattatcgaaggtgaaacgggctccggcaaaaccacccaaattccgcagtatttatacgaagctggtttctgcgaagacgggaagaagattggttgtactcaaccaagacgagtagcagctatgtcagtagccgctagggtagcacaagaaatgagcgttaaattaggtaatgaagtaggatatgccatcagatttgaggattgcacctctgaaaggacagttattaaatacatgacagatggtaccttacatagagagttcctatcagaaccagatttagcgtcttatagtgttatgattattgacgaagctcatgaaaggactttacacactgacatattgtttggtttagttaaagacatagctagatttagaccagacttaaagctcttaatatccagtgcaacacttgacgtaacaaaattttctgatttttttgacgatgcgcctgtttaccaaataccaggaagaaggtttccagttgacatttattacacgaaagctcctgaagccgactacgtcgatgcttgtgtagtatcagtacttcagattcatgtgacacaacccttgggtgacatactagtatttttgactggacaagacgaaatagaaacgtgccaagagcttttacaagataaagttcgtaggctagggtcaaaagttaaagaattacttatattgccactatatgcaaatttacccagcgatatgcaaggtaaaatttttgaaccaacgcctccaggcgctagaaaagttgttttggccacaaatatagctgaaacgtctttaacaatagacaatattatatacgttatagatcctgggtttgcgaaacaaaatcatttcaattcgaggacaggaatggagagtttgatggtagtaccaatatccaaagcttctgcaaaccagagagctggcagagctggtagagtagcagctggaaaatgttttaggctatatactgcttggtcttataaacatgagctagaggacaatactataccggagatccagcggataaatttaggaaacgccgtactgatgttgaaggcgctaggaataaatgatttggtacattttgattttttggatccgcctcctcatgagactttggtgttagcattagaacaattatacgctttgggggctttaaatcatcacggagaattaaccaaattgggcagaagaatggccgagttaccggtggatcccatgatggcgaagatgatattagcttcggaaaaatacaaatgctctgaagaaatagtcaccataggagccatgttatcagtaaatggtgccatcttttaccgaccaaaggataaaataattcacgctgatactgctcgaaaaaatttcagtcacttagcaggagatcatctaagtcttctaaatgtttataatcaatggagggattctgattactccctacagtggtgttacgaaaatttcatacaatacagatcgatgaagcgagcccgagacgtcagggaacagctggttaacttgatgacaagagtagaaatagaaatcgtttccaacgtttctgaaaccgtggacatccgcaaggctatcacctccggttatttctaccacattgctagattttccaaaggaggaagttacaagacggtgaagcacaaccaaagtgtcaccatccaccctaacagtgcacttttcgaatcattacctaggtgggtcctctaccacgaattagtttttacttcaaaggagttcatgaggcaagtgatagagatcgagagtaaatggttattggaggtagctccacattattataagcaaaaggaattagaagatccgacgaataaaaagatgccgaaaacggtaggcaggagtaccagaactgattag

SEQ ID NO: 362 - DNA, 1371 bp, Diabrotica barberi
atgaaggtagaggaggtgaaaagtactgtaaagacacaaagaataagtgctcatagtcatattaaaggtttaggtttggatgaagcaggttttgcaattccatcagctgccggcttggttggacaagaacaggcaagggaggctgccggcatagtagtggacatgataaaaagtaaaaaaatggctggaagggctgtgcttctagctggtccaccaggtactggtaaaacagcaattgcacttgcaatagcccaagagttgggaaataaagtacctttttgcccaatggtaggatctgaagtctacagttctgaaataaaaaagactgaagttcttatggagaactttcgaagagcaattggtttgaggattagggaaaccaaagaagtttatgagggggaagtcagtgaattgacaccggtagaaacagagaaccctgctggaggttacggaaaaactgtaagtcatgttatcattggtctaagaactgcaaaggggagtaaacagctcaaactggatcccagtatatatgaagcactccaaaaagagaaagttgaagtaggagacgtcatttatattgaagccacaagtggtgcagttaaaagacaaggaagatctgatgcttatgccaccgaatttgatttagaagctgaagaatatgtgccattaccaaaaggagatgtacataaaaagaaagaagttattcaggacgttacattacatgatctagatgccgctaatgctaaacctcaaggtggacaagacgttttgtcaatgatgggccaacttctaaaaccaaagaaaacagaaatcacagataaacttagaaaagaaatcaacaaaatagtagataaatatattgatcaaggtattgcagaattggttcctggtgtactatttattgatgaagtgcacatgttggatatagaaacattcacttatctacacagagctttagaaagtgccatagctcccattgttattttcgcaacgaatagaggtcgttgtctaattagaggaacagacgatgtttattctccacatggtattcctttagatctgttagataggctgttgattattcggacaattccttacggtagaaatgacatggaacaaatactgaagctgagagctaccacagaaggtttagaaattgatcatgaagcaattgcatcgttaggcgaagttggggcaaaagcaactttaagatatgcagttcagttattaactccagcacatttaacggcaaaaataaatggaagaaacaatatacttcacagtgacattgaagaagttggttccctatttttagatgctaaagcttcagcgaaagttttatctgaaaataaggagaagtttatgacgtaa

SEQ ID NO: 363 - DNA, 2199 bp, Diabrotica barberi
atgacttcaattataaaactgcaagctttgtcaggagccaaagatgaatctcccccatgctatattcttcaaattgacgaagtgcgaatacttttagactgtggatgggacgaaaaatttgacatggaatttattaaggaaataaaaaggcatgttcatactatagacgcagtgttactgtcttatccagacatatatcatttgggagcccttccgtatgtagttggaaaactgggtttaaattgcccaatttatgcaactatacctgtatacaaaatgggacagatgtttatgtatgatttatatcaatctcagtacaatatgaaagagttttgcattttttcactggatgatgttgatactacatttgaaaaaattattcaattaaaatataatcaaaatgtaccattgaaaggtaaaggttatggtttaacaattacacccttaccagctggtcatatgattggaggtacaatatggaaaataatgaaaatggaagaagatataatatattgtaatgatttcaatcataagaaagagcgacatttaaatggttgtgagctcgatagactgcaaaaaccttccttacttattactgatgcgtttaatgctacttatcaacaagccagaagaagggctagagatgaaaaactaatgaccaatattcttcaaactcttcggaacaatggtaacgtacttatagcagtagacacggcaggcagggttctggagttggctcacatgttggatcagctatggcgtaacaaagaatctggcctattggcctactctttagcgtttttaaacaacgtcagttataacgttatagaatttgccaaatcccagatagaatggatgagtgataagttaatgagaagttttgaaggcgccagaaataatccctttcaatttaaacacttgcagtggtgtcacagtttagcagaattaagtaaagttcctagtccaaaggttgttctggcaagttcacccgatttggaaagtgggttctccagagagttgttcctgcagtggtgttctaattccaataacagtattatattaacaacaagaacatcccctggtactttagctagagacttaattgacaacggagcagaaagaaatatagatttaacggtagaaaggcgagtaaaactcgaaggcgtagaacttgaagaatatgaaaaacgacaacgagcgcggggtcaaaatgtagaaaaggaagatgcagattcggactctgattctgacatagaaatgtctgttatcaccaaaggtagacatgacatagttattaaacaagagggaaaaataaatgccggtttctttaaggtcacgaaaaaaatgtatcccatgtatcccttccacgaagaaaaaattaagagcgatgaatatggagaaattataaaacctgaaaattacaaattggcagatgtggctgtagaaggagaggacaataaagaaaatgtattgataaaaaaggaagtggaggaagaaatcactgaaatacatgaacagccaacaaagtgcatagtacttcagagaactgtacaagttaattgtcaggtacattatatagattttgaaggtcgctcggatggagaatcccttatgaaaattttatcgcagctcaagcctagaagagtaatagtcgttagaggtgacgaggaaaatacatctgtcatagcaaaacattgtgaaggtataaaagccagagtttttacgccatctcgaggggaaattgttgatgctacgagcgaaacacatatttaccaagtcagattaacagatgcactagtatcgcagttaagctttcaaaaagccaaagaagcagaggtagcttggattacagcgaacgtagttcttaaagagagtcaagcagacgctaagcgtgtttatgtggatgatgaaccaatggaagtcgaagatgtggacacaaggattttgacgctggaacctgtactagaaggagattgtcacgatccagtttttataaacgaattaaaattatctgaatttaaacaagttttaggaaggcacaacattagttcggaattttcaggtggtgtcttgtggtgttccaatggaacaatagccgtgcggagggtggagtctggaaagattatgctagaaggctgtatatctgaagattattatagagttaaggatttattgtatgagcagtatgctatattgtaa

SEQ ID NO: 364 - DNA, 2283 bp, Diabrotica barberi
atggctcctttagagtcaactaataacaacaacaatgaggaacctggcccaataaatccaattgtgggaattatttatccaccaccagaggtgagaaatattgtcgacaaaactgcaagttttgttgctagaaatggtccagaatttgaagctcgtattagacaaaatgagttaggaaaccctaagtttaattttttaaacagtggggatccttaccattcctactatcaacataaagttaaagactttagggaaggaaaaggacaagatcctacccctggattaactcaagccgtctcaaaactttctgtcactgcatcagctcaacagaaacagcaagaaattttaaagcaagtagaacagccctttatacccaaggaaacaccttcagaatttgaatttatagctgatcccccatcaatttcagctctagatttggatattgttaagcttacagctcagttcgtagctagaaatggtagagcttttctgacacaattgatgaatagagaacagagaaatctgcagtttgattttttgagacctcagcactctttatttcaatacttcaccaaattactggagcaatatacaaaggttcttattcccccaaaaagtatgcatgaaagcctgcgaaacgaggctaatagtccgaagaatgttttagagcaagtcaaatatcgtgcagaatggttaaagtatcaagagcaacaaaaagccaaggaggaggagcttttagaacgagaaagggttgcgtatgcacaaattgactggcatgagtttgtagtcgtcgaaactgttgactaccaacccttcgaaattggaaattttccggctccaactacccctgaagaagtcggagcccgtattttaattcaagagaggatagaagaaggggaagatatcgaaatgcaattagagagtgatgaggaagaaccaccagttacggaagctggtttaagtagcatgcaggacaaaaccaatcggaagacacgcgacgataccagaattcaagatatggaagaagaaagctccgatgaagaaaaagaagaggaagaggaattagctttacctccaccaccaccatctattcaaccaccgttacctcctattcctgataaagttgtcgtgaaaaaatatgatcccaaacaagctgtcaatgttagccggccaacaattggagatgactatctcgtctcacccattactggagagaaaatacctgcgaacaaagtccaggaacatatgcgtattggtctgttggatccgcgttgggtagagcagcgcgacaaacaaataacggacaaaatgaaccaagaaacagtatatgctgctggtagtgccatcgatgcttcattgaaactgctcgccgagagacgtactgatatttttggagttggagatgaagaaacagctattggtaagaagattggtgaagaagatgttagaaaagacgagaaggtaacttgggatgggcatacgagtagcgttgaagccgctacaagagctgccagagccaatataacattggaggaacaaattcatcaaatacacaaggtaaagggtttgcttcctgatgaagaaaaggagaaaatcggtccaaagaatattggttcaaaatctggtaaaatcaacattcaaagcgtaattactacgaagccgcctacttcacttcaaccaaaaccgccagtctctttaattcaaacccaagcaactgcgtcgctaatatcggtaccaccacaacctatgttaccacctcaacctcccattatgatgatgtcagctacatctatgcctcccattagaccacctccaataatgatgacaggacctcctccaataccgggttttcctgtagcaccaatgtcctcacctatgggtccacctatgaatctgcccccaatgaaacatcaggctgaagcacctcacgaagatgaaccgagtaacaaaaaaatgagaaacgaagattcgcttataccggaaaaagtatttttagcaagacatcaaagccaagtagctatcaagatttcgattccacatatgccagaaaaatcagaatggaagctgacgggtaagatgatttcgtggaccgtaccacttgccgaatctgtagcgaatttgaaggcgaaactacaagaagaaactaacatgcctccagctaaacagaagctcttttttgatggtatgttctttaaggattccaacagtttagcatactacaacgtgactactggttcaatcattcagctacagattaaagagagaggaggaaggaagaaataa

SEQ ID NO: 365 - DNA, 969 bp, Diabrotica barberi
atgccgagtcaagaattaacaactaataaagtaatagtccaccctttggttcttctaagtgtggtggaccattttaatcgcatgggcaaaatcggcaatcaaaagcgtgttgttggtgttcttcttggctgctggcgtgctaaaggagtcttagatgtttctaacagttttgcagttccttttgacgaagatgacaaggataagtctgtgtggttcttggaccatgattacttagaaaacatgtatggaatgttcaaaaaagttaatgccagggaacgagtagtaggttggtaccacaccggccccaaactgcatcaaaatgatattgccattaatgagttaatcagaaggtattgtccaaattccgttctagttatcatagacgctaaaccaaaagatttaggtttaccaactgaagcttatcaagctgtagaagaagtacacgatgatggttcacctacgtctaaaacatttgagcatgttcctagtgaaatcggagctgaggaggctgaagaagttggtgttgaacacttattgagagatattaaagacacaactgttggtactttgtcccagagaataacgaatcagcttctagggttaaaaggtctccattcacagttacgtgatattagggactatttggtgcaagtctgtggtaaccagcttccaattaatcaccaaatcatctaccaattacaagacatatttaaccttttgcccgatataaatcaggatgcatttaatacatcgttttacgtgaaaaataacgatcaaatgttagtcgtttatctagcagctttagttagatctattgtcgctctacacaatcttattaacaacaaactaacaaatagagacgcggaagaaggaaaaaaggaggatagtaagaaagaaagcaaagataaggacaaggataaagagaaggaaaaggataaggatgctaagaaggatgagaagaaaaagtaa

SEQ ID NO: 366 - DNA, 1587 bp, Diabrotica barberi
atgtttggtggaggacgtgcccctattttggtgttaagtcaaaataccaaacgagaatccggtcgaaaagttcagctggaaaacatcaatgccggaaagcaaatcgcggatgtgataaggacatgccttggtcctcaagctatgttaaaaatgcttatggatccaatgggaggtattgtgatgactaatgatggcaatgctattttacgtgaaattacagtacagcatccagctgcaaaaagtatgattgaaattgcaagaacacaagacgaagaagttggagatggtaccacctcagtaattgtcttagcaggagaaatgttagtggcagctgaacagtttttggaacaacacattcatccgacaatcataattcgccagtacagacaagcactcgaagatatgatccagttattggaaggtccattaagtataccagtcgatagaaacgataaaaatgctcttgcccaagtcgtaaaaggctgcatcggcacaaaattcataagtaaatggtcagatttggcagtaaatattgctttagatgcagtaaatacagtattattagaagaaaatggcagaactgaagttgatattaagaggtatgccaaagtcgagaagattcctggaggatccattgaagaatctaaaattttaagaggtgttatgcttaataaagatgtaacccatcccaaaatgaaaagatatatacagaatccgagaataattcttttggattgtgcattagaatataaaaaaggggaatctcagacaaacgtagaaatttcagcagaaacagacttcaccaaactattagaactggaagaggagcatgtcaagcgtcaatgtgatgagattattgcactcaaacctgacgtcgtcttcacagaaaaaggagtgtcagatttggcccaacactttttactgaaagctggtattaccgctatcaggcgtgttcgaaaatctgataataacagaattgccagagcctgtggagccacgattgttaaccgaacagaagaattacaagaaagcgatgttggtttaggagctggactcttcgaaatcaagaaatttggtgatgagtatttctgctttgtggtcgaatgcaaaaatccaaaggcttgtacaattttactcagaggtgccagtaaagacattcttaacgaaaccgaaaggaatctacaagatgccctacaagtcgccagaaatattgtcctatctccccgtttagtgcctggaggtggcgctgtagaaatggctgtagcccagcgtttgatgcagaaggctacgcacggaccttatagagctcttgcacatgctttagaaattattccaaaaactcttactcagaactgcggagcaaacacaatcagaacattaactgctttgagggcgaaacacgccaaccacacggacgttaacaaaccatgcctttggggtattgatggcgaaactggagagctcgtggagatggacaagaaagaattgtgggaacctctagctgtcaaactacaaacatacaaaaccgctatagaaactgccattctcttacttcgcattgacgacattgtatctggctccaaaaag

SEQ ID NO: 367 - DNA, 702 bp, Diabrotica barberi
atgatgcaaacagctaataatgcatattatcccgattattccactgctccaatgcaacgtcaaattaacccctatgcagataatggagggagtgtagtagcaatcgcaggtgaagactttgtaataattggtgcagatacacgtttgagtactggattttccatctataccagagaacaaaacaaacttttcccactatcaggcactacagttttgggttgcgcaggatgttggtgtgacactctaacattaaccagaatccttaaatctcgcatgcagatgtaccaacaagagcataacaaaacaatgtctacaactgcatgtgcccagatgttgtctaccatgctctactacaagagattctttccttattatatatcaaacattctagtaggtttagataatgaaggaaagggctgtgtttacagctatgatcctattggacattgtgaaaaagctacgtatagagcaggtggttcagctggagctcttcttcagcctctgttggacaatcaaattggacagaagaacatgcttaaaacatctggagaacctcttagtcaggagaaagctttgtctacccttaaagatgtatttatttctgctgctgaaagagacatctacactggagatagcgtacttataaatattattactaaagatggagtaaaggaagagtccttccagttgagacgggattag

SEQ ID NO: 368 - DNA, 897 bp, Diabrotica barberi
atgtttcaatttggattcaacatgtttcctgaggtccccaggccttttaatatgacttataagtgctactcagtggctatgtttcctggcaatgaacgagaagacgttgaaagaggtggaaaaattattatgcccccatcagccttggaacaattgactaggttaaatatcaactatcccatgttgtttaaacttgtgaataaaaagacacatcgcacaacgcattgtggagttttagaatttgttgctgatgaaggaaaagtttatttgccactttggatgatgaacaacttggtactgactgaaggagatttggttcaaatggaaagtgtttcccttccagttggcaccttttcaaaattccaacctctcaatccagacttcttggacattactaatcctaaagcagtcttagaaaatggtttgagatcttttgcctgccttacaacaggagatgtcattgcagtaaagtacaatcaaaaggcttatgagttgtgtgttctagaaaccaaacccggagatgccattagtatcattgaatgtgacatgaatgtggaatttgctgctcctgttggatacaaagaacccgaacaagtcaaaaaggaagaagaagaaatggctatagatcctgcagatttaatgccagaaccttctggatttgtagcattcagaggtgcaggaaatcgacttgatggcaaaaagcgtaaagatacttcaggagctgatagttcagtgggcaaaccaacttatgtcagaggaattccagattatgattaccaaataggcaacttaacatttatcaggagaatgatcaagcagaaatctaacgattatgcagaggacagcgaattcaaagcatttagtggagcaggatttagtttaaaatcgagaacgtaa

SEQ ID NO: 369 - DNA, 1623 bp, Diabrotica barberi
atgagtgctataccaggaagtattgcatttgatgaatatggacgacccttcataattcttagagaccaagataagcaaaagaggttgaccggggtagatgcactgaagtcacatattttggcagcgagacaaatcgctcaaactataagtacttctttgggtcccaaaggtttagacaagatgatggtgtcacctgacggtgaagtaacagtcactaatgatggtgctactattttgaaaatgatggatgttgaacatgaagtcgctaaattgctagtacagctatcacagtcccaagatgatgaaattggtgatggtaccacaggtgttgtagttttggctggtgccctgttagagcaagcaggatctttattagacagaggtattcatcccataaggattgctgatggttttgagctagcttgtcaaacagctgtagctcatttggaaaaaattgcagagctatttccagtatcagcagaaaacactgaaccattaataaaagttgcaatgaccactctgggatctaaaatcattaacaagtgtcataaacagatggcagaaatagctgttaatgctgttttagctgttgcagatttagaacagaaagatgttaattttgaacttattaaagttgaaggcaaggttggtggaaaattggaagacacaacattagttaaaggtgtagttattgacaaaacaatgtcccatccacaaatgcccaaagaactaaaagatgtaaaattggctattctcacctgcccattcgaaccaccaaaaccaaagaccaaacataagttggatgtcagcagtgtggaagattataaggaactaagacagtatgaacaagaaaagttcaaagaaatagttggtttggtaaagaaagctggagctacattagcaatttgtcaatggggcttcgatgatgaagccaatcacttattgttacaacaagagttaccagctgtaagatgggttggaggtccagaaattgaacttatagcaatagctactgggggtaggatagtaccccgttttgaagagcttactcctgaaaaacttggtcatgctggtttggtacgagaaattgcatttggcaccactaaggatagaatgttggttattgaagaatgttcaaattcacgggcagttacgattcttgtcagaggaggtaatcaaatgttagtagctgaagccaagagaagtctccatgatgcattatgtgttgtcaggagtttagttcaggaaccaagggtagtgtatggtggtggagcagcagaaattgcctgcagtttggcagtcgcggctcaagcagatcaactagcttccttggaacaatacgcctatcgtgcatttgctgaagccttagaaagtataccacttgcgttggctgataacagtgggctgtccgcgatccatacactaggagaagtcaaggctaaacaagcagctacaggagatccagctctcggtatcgattgtatgaatactggaaacctcaacatgagagaacaacatgttatcgaatcactcagatcaaaaagacaacaatttttgttggccacccagttggttaaaatgatattgaaaattgacgatgtacgccaacctgcatcgggataa

SEQ ID NO: 370 - DNA, 342 bp, Diabrotica barberi; identical to SEQ ID NO: 146

SEQ ID NO: 371 - DNA, 1605 bp, Diabrotica barberi
atggtatccctaaatcccgtaagaattctcaagcaagaagccgaggaagaaagggcagagattgctcgactgagtagttttgtaggtgctatagctataggagatttggttaggagcaccttgggaccaaaaggaatggataaaattttagtatccagtggtagatctgcaggatcagttgaagttactaacgacggagcaactatcctaaaatcggtgggtgttgataatcctgctgctaaaattttggtagatatgtcaaaagtccaggatgatgaagtaggagatggcacaacatcagtgacagtattagcatctgaactacttaaagaagcagaaaaacttgtagaacagaaaattcacccacaaacaatcattgccggttggagaaaagcagtagatattgccagaaaagctcttctagaaactgccaaagataacagctctgattcagaaaagttcagagaagatctgatgaacattgccagaactacactcagctcaaagattctttcacaacataaagaatattttgccaaactggcagtagatgctgtgctgagattaaaaggtacaggtgatttacaatccatccagctgattaagaaaactggtggtactttggaagattcctttttggatgaaggtttcttattggacaaaaaacctggtgtacatcaaccaaagagagtagaaaatgcaaaaatcctgatagccaacactcctatggacacagataaaatcaaagtatttggttctcacattaaggtagattcaatggctaaaattgcagagctggaatctgcagaaaaggaaaaaatgaaagataaagtgaacaaaattcttaaacataatgctaatgtatttattaatagacagttgatttacaattatcctgaacaattgtttgctgatgcaggagttatggctattgaacatgcagattttgatggaattgaaaggctagcacttgtcacaggaggagagattgtctcaacatttgaccatccagaattagtaaaacttggaacttgtaagcttattgaacaaatcatgattggagaagatatcctgctccgtttcagtggtgttgctcttggggaagcttgcacaattgtcatcagaggtgctacacaacagatcattgatgaagctgaccgttcccttcatgatgctttgtgtgtattagcagccacagtcaaagagagtcgaattgtgtatggaggaggttgcagtgaaactctaatgtccacagcggtatcaagagctgctgctaacactccaggaaaagaagctgtagcaatggaagcttttgccagagctttgttgcagttgcccacaattattgcagacaatgcaggttacgactctgcccaattggtcagtgagcttaaggcagcacataacagtggccagagcaccatgggacttaacatggaaaagggtgaattgggggatatgaaaaccttgggaatcacagaatcttttgttgttaaaagacaagtattagtatcggcatctgaagcagctgaaatgatcttgcgtgttgataatattatcaaagctgcaccaaggaggagaacagaagacaggggaatgtgctag

SEQ ID NO: 372 - DNA, 852 bp, Diabrotica barberi
atgtttcgaaaccaatacgatagtgatgtgacagtgtggagcccccagggccgtctgcatcaggtagaatatgccatggaagcagttaacctaggttcagccacagtgggactgaaaagtaaaactcatgctgtacttatcgcgttgaagagggcttcttcagaactgtctgcctaccagaagaaaattatcaacatagacgatcacattggtatcaccatctcgggacttacagctgatgctaggattcttagtagatatatgcgaaacgaatgcttgaattataagtactctttggatacttatatgccattgaataggcttatcagtattttaggtaacaaaatgcagacatgtacccaaagatatgaccgtagaccattcggtgtaggtcttctagtagctggttatgacgaatctggttctcatatctaccaaacgtgcccttctgctaatttttatgattgcaaagctatgtccattggagcccgatcccagagtgccaggacatacttagaaaaacatctggatgaattgccatccagttctttggaagaacttatcaaacatggattgagggctcttagagatactctacctccagaggttgaccttacaaccaaaaatgtctccataggctacactggaaaaggcgtgaccttcaaaatccttgaagaagaagaaactgccccctacttgtcccttattgagggtgaagaacgcagaggaggaggagctgcagctgccgcaattgaggatcttcctgcagatccattgagagatgatgcgggggacgagcccagggatgcagtccctgcagtggaaatgtctgccatggataccacagaatag

SEQ ID NO: 373 - DNA, 2547 bp, Diabrotica barberi
atgcccataaagcctggacatgaaacggaaaatatagaaataacctttagtgatgaagatctcccatatgaagaagaaattttaagaaacccttattcagttaaacactggctaagatatatagaccacaaaaagacagcaccaaataatggcgtcaatataatctttgaacgagccctgaaggaattaccaggatcttacaaattatggtataattatttaagaactagaagaaatcaaataaagagtaaatgtataacagacccaggttatgaagaagtgaataatgcatttgaaagatcattagtgtttatgcacaagatgcctagaatatggatggattattgcacatttttgacagatcagtgcaaaatcactaggacaagaaaagtatttgacagggctttgagggcattgccagttacccagcacaacagaatttggcctctgtatttaaaatttgttcaaaaacatgatataccagaaactgcagtaagagtttttcgaagatatatgaaattatgtccagaaaatgcagaagaatttatagattacctcacaggtattgaaaggctagatgaagcagctcagctgatggcaaagattgtgaatgatgagggttttgtttctcaacaaggaaaatcaaaacatcagttgtggaatgaactgtgtgaattgatctcaaagaatccggaaaaggtacattctcttaatgtggatgccataattaggggtggtttgaggagatatactgatcaactaggccacctatggaattctctagccaattactatgttcgaagtggtctatttgaaagagctcgtgacatgtatgaagaagctattcaaacagtgaccactgttagggacttcacccaagtctttgatgcttatgcccaatttgaggaactgagtttaagcaaaagaatggaagaagttgctaacaagtctagtcctactgaagatgatgatactgaattagaattgagacttgcaaggtatgaatatttgatggagagaagattgttgctgctgaattctgttttgttgaggcagaatccacataatgtgcaggaatggcacaaaagagtacagctttatgaaggaaaaccagtagatataatcaacacctacacagaagctgttcaaactgtagatccaaaactggctgtaggaaaacttcataccttatgggtggactttgccaaattctacgaaaccaatggtcaaatagaagattcacgcctcatctttgaaaaagcatcccaagtttcttacgtcaaagtagacgatttggcaacagtgtggtgtgaatgggccgaaatggaaataaggaacgagaattatgatgaagctttaagactcatgcataaagcaacttttatgcctagtcgaaaagtagcatatcatgatgacactgaaacagttcaaagtcgactgtataagtctctcaaagtttggtctatgtacgcagatttagaagaaagtttcggcacctttaaatcttgtaaagctatttacgacaaaataatagatttgaaaattgcaacacctcaaattattataaactatgggatatttctagaagaaaataattattttgaagaggcattcagagcgtatgaaaaaggaatatctctatttaaatggcccaatgtatacgacatatggaacacctatttgacgaaattcctaactcgttatgggggatcaaaactagaacgtgccagagatctgttcgaacaatgcttggatggatgtccacaacagtttgccaaacatctttacctgctctacgcgaaactagaagaagaacatggaatggctagacacgctatggctgtatatgaaagatcaaccaaagctgttccagagcaagaaatgttcgacgtttttaatatatatatcaaacgagccgccgaaatctatgggattcccaaaacgagacagatctacgaaaaggctatcgaggtacttccagaggataaaactagagaaatgtgtcttagattttctgatgtggaaacaaaactaggtgaaattgatagagcccgagctatatatgctcactgtagccaaatttgtgatccgaggataacggcagagttttggcagatatggaaagagttcgaagttcgtcatggtaatgaagataccatgagagaaatgttaagaataaaacgtagcgtacaagctgtttacaacacgcaggtgaatatgatgtcggcacagatgttgagttcggcgggcagcatgagcggtacagtagcggatttggcgccgggagttaaagacggtatgagactcttggaagccaaagccgttgaaatggcgggaacttcacaagtcgccaaacctggaggtattatgtttgttaggggagaaactcaaggagctaataaagataaggttgttaatccagacgaaattgatatagacagtgaagaatcggaagcggaagaagaagtaccagtcgaaaagcagaacgtaccgtcagaagttttcggaagtcttaagaaacaaggacagggagtcgatgacgattag

SEQ ID NO: 374 - DNA, 1176 bp, Diabrotica barberi
atggccaacggaccgatagcagaaagaaatcgagatgccactatttatgtgggaggcctagatgataaagtttcggagtccctattgtgggagctctttgtacaagcagggcctttagtcaatgtacatatgccaaaagatcgagtaacaaccatgcaccagggctatgggtttgtagaatttatgggagaggaggatgcagattatgctattaaaattatgaacatgataaaattgtatgggaagcctataagagtcaacaaagcttcggctcatcagaaaaatttagatgtaggagctaacatttttattggaaatttagacccagaagtagacgaaaagttactctatgatactttttcggcatttggagtaatattacaaacacctaagattatgagagatcctgatactggtaactccaaagggttcgctttcatcaattttgcaagcttcgaagcatcagatgcctccatcgaagccatgaatggccaatatttgtgcaatagacccatatcagtatcttatgctttcaagaaagactcaaaaggagagagacatggatctgcagctgagcgtcttcttgctgctcagaatccattatcacaggctgataggcctcatcaactgtttgctgatgcacctccaataggtttgatgcccatgtccatggccccacctcctccaccagtcataatgacaggaatgatgcccccaccgcctccaacactatcaaacttgccaccgcctcctccacctgtaccaccaccaggaatgggaagttccttcccagcaggaataccacctcctccattacctccctcccaaccacccttaccacctggtgcaccaccaacgatgccaactgcggcaggagcccaagccagaccccctttaccaccgcctccagtggcacctcatggactgatacctccacctccaacgtggacaggtgcagctcctgggagcttgcccattcctccaggtccacctgctcctgcgggaggtgctgcatttggtggaatgttcccgcctcccccaccacctggaggaagaccaccaccgcctaactggaggcctcctccaccaccaccaccaggttttgccggaagtagaccagctttccctgtaaggggacctccaccacccccacctacttttgatactaaaatttga

SEQ ID NO: 375 - DNA, 774 bp, Diabrotica barberi
atgggtcgtgtaattcgtgcacaacgtaaaggtgcgggatctgtattcaaatcccacacaaaaaagaggaaaggagcacccaaactacgttatttagatttctcagaaagacatggttacattaagggtgttgtaaaagatatcatacatgaccctggccgtggtgctccattggcagtagtacatttcagagatccctacaagttccaaactaggaaggaattgtttattgcccccgaaggaatgtacactggacaatttttgtactgtggaaagaaagctaacctccaaattggaaatgtattgcctgtaggaactatgcctgaaggtaccattgtatgcaacttagaagaaaaaactggtgaccgtggtcggctagctcgtgcatctggaaactatgctaccgtaattgcccataatcacgatacaaagaaaaccagagttaagttgccttctggagccaagaaagttattccatcaaacaacagggccatggttggtatcgttgctggaggtggtcgtattgacaaaccaatcttgaaagcaggtcgtgcttatcacaaatacaaagttaaacgtaactgctggcctaaggtacgtggtgttgctatgaaccctgttgaacatcctcacggaggtggtaaccatcaacacattggtaaagcatccacagttaagagaggaacatctgctggtcgtaaagttggtcttatcgccgccaggagaactggtaggattaggggaggcaaagttgatgccaagaaagaggattag

SEQ ID NO: 376 - DNA, 417 bp, Diabrotica barberi
gaaataatggcacgtacaaagcaaacagcccgaaaatccactggtggtaaagcaccacgtaaacagttagcaactaaagctgctcgcaagagtgcacctgctactggaggagttaaaaaacctcatcgttataggccaggtaccgtagcgcttcgtgaaattagacgttaccagaaaagtactgagctgcttatcagaaaactacctttccaacgtcttgtccgtgaaatagctcaagattttaagacagatttacgttttcagagttcggcagttatggctttacaggaagcgagtgaagcatatttggtaggtttattcgaagataccaacctatgcgctattcatgctaagagagtgactattatgcctaaagacattcagttggccagaagaatcagaggagaaagggcataa

SEQ ID NO: 377 - DNA, 1593 bp, Diabrotica barberi
atggctatcagtttgttaaatccaaaagctgaagtggctagagctgcacaagccctagctgttaatatatcagcggcaaaaggcattcaagatgtaatgaagtcaaaccttggtcccaaaggaacagtgaaaatgttggtatctggtgccggcgatataaaaataaccaaagatggaaatgttctattgcacgaaatgcaaattcaacaccccacagcctcccttattgctcgagcctcaactgcccaagatgatatgaccggcgacggcactacatcgactgtgttagtcataggtgaactattaaaacaagccgatatttacatagcagaaggtctccaccctagattgttaacagatggctttgataaggctaggacaaaagcgttggaagtactggagaaaatgaagattccagttgaggctaacaaagaaactttgacagatatttgcaggacgagtttaagaacaaagttgcatcaaaaactggctgatgttttgacagacgtttgtgtggatgctgttctagctataaagaaagatgacaaacctgttgatcttcatatggttgaattaatggaaatgcagcacaaaacagaaacagatactcagttaattaagggtttagtcctggaccatggctcccgtcatccagatatgcctaaaagtctcaacaactgctacattttaacatgtaatgtcagcatggaatatgaaaaaagtgaagtcaattcaggattcttctacaaaactgcagaagagagagaaaaattagtgactgcagagcgtgaattcattgagcagagagttaagaaagtcattgaactgaaaagatcactctgtaatggaactgataagacttttgttattattaaccaaaaaggtattgaccccatgagcctggatatgcttgccaaagaaggaataatagctctcagaagagctaagagacgtaacatggagcgtctatcattggcttgtggtggagtagctatgaacagctttgatgatctgcaagaatctcaacttggtagagctggacatgtatatgaacatgtgttgggagaaaataagtatacatttgtggaagattgcaaaattcctcaatcagttactattttaataaaaggacccaataaacatactttgactcagattaaggatgctgttagagatggattaagggctatcaataatgccattgacgataaagcagttattccaggtgctggtgcatttgaagtcacagccaataaagaattgctagcatttaaagacactgttaaaggtaaagctcgtctaggagttgccgcttatgcagaagctttactggtagttcccaagactttggctgttaactctggatttgatgcacaggacaccattctaaaactacaagaagaatcccgtttgaatccagacccaatcggtttagatctaacctctggggaacccatcaatcctaaagatgccggcatctatgacaactatattgttaaaaaacaaataatcaattcctgttcggtcattgccagcaacctcttattggttgatgaaattatgagggctggaatgagcagcttaaagggataa

SEQ ID NO: 378 - DNA, 3285 bp, Diabrotica barberi
atgtctagtggtagtttagcagacaactccatcgatcctccagccaaaaagcggaagcttgaatcaaagattgctaccctcgaaatggcgaacaatgaagcttcaggatcctccaccagtgatattgatgagggactttactcgagacaactgtacgttttggggcacgaagctatgcgccgcatggcaaatagtgatgttctaatatcaggtttaggtggtttgggtgtagaagtagctaaaaatgtaattcttggtggtgttaaatctgttacccttcacgatgaggctctttgtactattaaagacctgtcatcccaattttatttaacagagggggacattggtaaaaaccgcgcagaagcctgctgtaagcagttatctgaactcaacacctatgtccccacaaagtcttacacagggcctcttgatgaagcctttatcttaaagttcagtgctgttgtcttaaccacaagcaatcgtgaagagcaactaagaatcagcgagataacacacgacaacaacattgcattaattatagcagacacgaaaggccttttcggacaagtattttgtgatttcggaaaatcctttactgttgtagatgtaaacggagaacctttagtctctgcgatgatagcagacatttcaaatgatgtcgaaagtgtagtcacttgcattgacgatacaaggcatggtatggaggatggagactatgttaccttctcggaagttctgggaatgactgaattaaataactgtgaaccaatcaaaatcaaagtattaggaccatacacctttagtattggtgataccaccaagttttctaaatacaccagaggtggtattgtaagtcaagttaaaatgccgaaacatctggaattcaaatcgtttaaagattctcttgaaaatcctgagataccaattactgatttttcaaaaatggattttcctacgcagcttcatctagcttttaccaccttacataagtttgtagagaagtctggaaggctacctaaaccatggaacaatgatgatgcaacggaatttgttaatttagctaaatcattagctgcgaagggtgattctgaagcagaagttaacgtagacctcctagacacatttgccaaggtatcagctggagatttgaatcctataaatgccactattggtggtattgtcgcccaagaagtaatgaaggcatgttctggaaaattccatcctattttccaatggttctattatgatgctatagaatgcctaccacaagataaatcagaaatcactgaagaactagctgcacctactggaagcagatatgacggccaagttgctgtttttggtaaagaattccaaaagaagatagcatcactgaaatattttattgttggtgctggagctattggttgtgaattgttgaagaactttgctatgatgggtgtaggaacacaaggagaagttactgttactgacatggatttaattgaaaaatctaatttgaacaggcagttccttttcagaccacataacgtccaacaaccaaaatctgccacagctgcaaaggccattaaaaagatgaatcctgatatcaatgttgttgcacatgaaaatcgtgttggacccgaaaccgaaagtgtctacaatgacgatttctttgaaaagcttgatggagttgccaatgcactcgataacgtagatgctagaatttatatggacagaagatgtgtctactaccgcaagcctcttctagagtctggaaccctaggaactaagggaaatactcaagtggtggcgcctttcctctctgaatcatacagttcttctcaagatcctccagagaaaagcattccaatctgtactttaaagaatttccctaatgctatcgaacatactctacaatgggcaagagatatgtttgaaggattgtttaaacaaaatgccgagaatgcttcgttgtacataacagaccctgatttcctcgataggactgttaagctacctggggtacaacctttagaggtattggaatccgtaaaggctgccttaattgatgagagacctaaagatttaaatgattgcatcgcttgggcacgtaatcattggcaagaacagtattccaaccaaattaggcagttgttgttcaactttcctcctgatcaattaaccagtacggggcagttgttctggtcgggaccgaagaggtgtccagaagcgcttacttttgacgtcaacgatcccctgcacttggattatgttattgccgcagctaatttgaaggctgaagtttatggtataccaactagtagaaatagagaacaaatcgcagaagtggttatgcaagtcaatgttccagaattcatccctaaatctggcgtaaagatagcagttacggattctcaaatggctatgaatggtaataatgtggatttggatcgcgtttcccaaattaaagaagaactaccctcagtagcagaactaggtggactacgtcttactcctttagaatttgaaaaggacgatgacaccaatttccacatggactttatagttgctgcttcaaatcttcgtgcagctaattacaaaatacctcccgctgatagacataaatcaaaacttattgctggtaagattattcccgccatagcaacaacaacctcagtagtcgctggaatggtttgcttggaactttacaaactcaccagaagttacacatccctaactccattcaaaaataattttattaacctcgctctgcctttcttcagttgctcagaaccaatcgcagcccaacaaatggaatactgtggtaacaaatggacactatgggaccgcttcgatgttcagggagaaatgacgcttagtgaatttttggaatacttcaaggaaaaacacggtcttgaaattactaacctcgctctgcctttcttcagttgctcagaaccaatcgcagcccaacaaatggaatactgtggtaacaaatggacactatgggaccgcttcgacgttcagggagaaatgacgcttagtgaatttttggaatacttcaaggaaaaacacggtcttgaaattacgatgttgtcccagggcgtttgcatgctgtattcgttcttcatggcaaaagctaaagctcaagaacgtttcggtctttcaatgtcagaagtcgtcagacgagtatcaaagaagaaaatcgaacctcacgtaaaagcattggtattcgaactgtgctgcaacgattccactggtgaagacgtggaagttccatatgttaaatataatttatgttga

SEQ ID NO: 379 - DNA, 1008 bp, Diabrotica barberi
atggcagacgctgatgatctattagattatgaagatgaggaacagacagaacaaaccgcaactgaaacggcaactacagaggtacagaaaaagggtgtcaagggcacatatgtatcaatacacagttctggatttagagattttctattaaaaccagcaattctcagagctatagtggactgcgggttcgaacatccttcagaagttcaacatgaatgtattcctcaagctgttattggcatggatattctgtgccaagctaaatccggtatggggaaaactgctgtttttgtattagctacactccaagtaatagatcctacagaaaatgttgtatatgttctcgtcatgtgccataccagagagttagccttccagataagcaaagagtatgaacgtttcagtaaatatatgcccaatattaaagtaggggtcttctttggtggcttgcctatccagaaagatgaggagacgttgaaaaataattgtccgcatattgttgtgggtactccaggaagaattttagcattggtcagatcgaaaaaacttaatctcaaacatctaaagcattttattttggatgaatgtgataaaatgttggagttattagacatgagacgtgatgttcaagaaatatatcgtaacactccccacgaaaaacaagtcatgatgttcagtgccaccctaagtaaagaaattagaccagtttgcaagaaatttatgcaagatcccatggaagtatatgttgatgacgaagctaaattaacattgcatggtctacagcaacattatgtaaaactaaaagaaaacgaaaagaataaaaagttatttgaattactagatgttttggagttcaaccaggttgtcattttcgtaaaatccgtacaaaggtgtgtggccctggcacaattactgacggaacagaacttcccagcgataggaatccacagaggaatggaccaaaaagaacgactgtcccggtatgaacaattcaaggatttccaaaag

SEQ ID NO: 380 - DNA, 1470 bp, Diabrotica barberi
atggtaactctcgaagacgttgaaatgaaaaatgcagacagtcctccaggattagaagctggtgatacaaagaaagataccgacctacaaagtgtaatagaaattcgtgaacatgcaagacaaatagaaaaatcagtcacaagtaaagaaaaccgtttcatcttaagagttttacgttgcttgcccaacactagaaggaagcttaatggactggtgttgagaagtctcattactcaaatatatcctgtagctgaacgtgatgccctcattagtttcgtcgaggaagcttctggagaactcgacgccacccagtcaagagcaaggtcagctgttaagtcacccgttcccgaggtagatacatatataaatcttttaatactagtacgtttaatcgacaccaataagttagttgaagcagagcgatgttcccaagctctcatgaataaaataactaaccaaaacagacgtactatagatcatattgctgccaagtgttatttctatcactccagggttgctgaattaaccaacaaattggattcaattagaggctttttacattctcgtctacgtaccgctacactcagaaatgacttcgaaggccaagctgtgcttataaactgtctgttgagaaattatttgcattattcattgtatgatcaagccgacaaactagtgagtaaatgtgtatttcctgaaactgcaagtaacaatgaatgggcaaggttcttatactacttgggcagaattaaggcggcaagattagaatacagtgtagcgcataaacatcttgtgcaggccttgagaaaagcaccccagaatgctgctattggtttcagacaggttgttcaaaagcttactgttgtagttgaactactgctaggagatattccagaacgacagatttttaggcaatctagtatgaggcactcccttgccccatactttcaactaacacaagcagttagaatgggcaatttgcaaagatttggtgaggtgttggagaacttcggcccacaatttagacaagatcatacatttacactaattttgagactgcgccacaatgttattaaaacagctataagatccataggattatcatactccagaatatctccccaagacatagctaagaaactgggactggattcagctgaagatgcagaatttatagtagcaaaagcaatcagagatggggtgatagaagctacacttgatccacagggaggttacatgaggagcaaagaaagtactgacatctactgcacaaaggaacctcaactggcgtttcatcaaagaatatcgttttgtttagatttgcacaatcaaagtgtcaaagctatgagatatccccccaaggcgtatggcaaagaacttgaatcagctgaagagagaagggaaagagaacagcaggatttggagttggccaaggaaatggctgaagaagatgatgatggttttccttaa

SEQ ID NO: 381 - DNA, 1668 bp, Diabrotica barberi
atggctaccaatcaccaaaaccttccaatttcgagtattcttaaatcaaaaagtgaagttgatgatgaaccaaaaaagaaatcaagagaagattggcgtaaggccaaggaacttgaagaagccagaaaagctggtacagctccggctgcagtcgatgaagaaggaaaagatatcaacccccacattccacagtacatttcaaatgcaccttggtattatggcacatctggacctacccttaaacatcaaaggccccaagaagagaaacagaaggagtactcaaacatcgacgaatggtacaaacggggtgttgacacttcaaaaatagttactaaatatcgtaaaggtgcgtgtgaaaattgtggagctatgactcataaaaagaaagattgtatggaaagacctcgcaaagttggagccaaattttccggagcaaatattgcaccagatgaatttgcccagaaaaacttagcgttgagctttgatggaaaaagagatcgatggagtgggtatgacccatctgagcataaagcagtaatagaagagttccagaaagttgaggaagctaaaagacaactgaaggctgacaagttaaatgcaaacgaatcttctgacgatgaagaaaaagatgaggacaaatatgtagatgaagttgatatgcctggtactaaagtagacagcaaacagagaattactgtaagaaatttgaggataagagaagacaccgccaaatatttgagaaatcttgatttaggttctgcttattatgatcccaagacaagatctatgagggaaaaccctaatcctgaaaaagatgctacgtacagtggagagaatttcgttcgttttactggtgataccaccaatcatgctaaggctcagttatttgcttgggaagcatatgaaaagggtgtggatgttcatctcttagctgaaccaacaaaactagaactgctcaaaaaagaatatgagaaaaagaaagaagaggttaaatcaacaattcaaagcagcgttctagataaatatggtgggcaggaacatttagaagcaccacctaaaagcttattgttggctcaatcagaagtttatgtggaatattcgagatctggtaaagtcattactggggcggaaaaagaagtcattagatccaaatatgaagaagatgtgtacataaacaaccacacatcagtgtggggatcatattggagaggaggacaatggggatacaaatgttgtcactctttcataaagaattcctattgcctaggcgaggcaggaaaaacggttaacgctcctgtaacccaagatattccaaaagatcaagacgttggtgaagcaagcagtacaaaggaagctgggatatcagacggtgaaagcgaagatagtagttccagtaattcatcagaaggcgaaaaactgaagaagaaacagagaagattaaagaaaaaggaaaagaaggcaaagaaaaaggagaagaaagcaaaagaaaaattaaagaaaaaacaggagaaagaaaaggccccagaaatagacgaggaaataatgttggacgatagaaaaaggccgtacaatagtatgtttgacgctaaaaaacccacagaggaagaaatggaggaatattataaaaagagaaagagggatgaagatcctatgaacaactttatgtaa

SEQ ID NO: 382 - DNA, 717 bp, Diabrotica barberi
tatttgcggctggacgtcctaattcgaacttcctcttcttacggagaggcttcctcttgcctcctgtggattttagtttattcgttcagaatgggtattagtagagaccattggcataaacgaaggtccacaggaggcaagaggaagcctctccgtaagaagaggaagttcgaattaggacgtccagccgcaaataccaagcttggagcacgtagaattcactatgtccgtacacgaggaggtaacttgaagtaccgcgcattgaggattgaaaaaggaaatttcgcatggggcagcgaaggtactgctcgtcaaacacgtattattgatgtcgtttacaatgccagtaataacgaattggtacgtaccaaaacattggtaaagaatgccatcgttgttattgacgcaacccctttcagacaatggtatgaaagccactatattttacctttaggacgcaagaagggggcaaaattgacagcagacgacgaagaaattttcaataagaaacgtagcaaaaaagtacagaaaaaatatgaaactaggcaaaaaacagctaaagtagaacctgcgttagaagaacaattctcaactggaaggttattagcttgcttagcgtcaaggccaggacaatgtggtagagctgatggttacgtcttggagggtaaagaactggaattctacattcgtaagattaagtctaagaaagctaaataa

SEQ ID NO: 383 - DNA, 936 bp, Diabrotica barberi
atggatagacttcttcgattaggaggtggaatgccaggtttaacccaggcaccgccgccttcagatgctcctgttgtggatactgccgaacaagtatacatatcctccttagcactattaaaaatgttgaagcacggccgagctggagtacccatggaagtaatgggtcttatgttaggagaattcgtagatgactataccgttcgtgtaatcgatgtatttgctatgccccagactggtaccggtgtcagtgtagaagctgttgatccagtttttcaagcaaaaatgcttgacatgttaagacagactggtaggccagaaatggttgtggggtggtatcattcccatccaggtttcggatgttggttgtctggagtggatatcaatacccaacaaagttttgaggctctctcggaaagagctgtagcagtagtagttgatccaatacagtcagtgaaaggcaaagtcgttattgatgcctttaggttaataaatccgaatatgatggtattgggccaagaacctcgacaaactacatccaacttaggacatctacagaaaccatcagtccaggctttgattcatggtctaaatcggcattactactctatcagtattaattacagaaaaaacgaattggaacaaaaaatgctactaaatctccataaaaaatcctggatggatggtctaactttagcagattactctgaaaattgtagtgtgaatgaaaagactgttgctgatatgttagaactagccaagaattacaacaaggcattagaagaggaggagaaaatgactccagaacagctcgctattaaaaatgttggcaaacaagatcctaagaggcatttagaagaaaaggttgatattttgatgaccaataatatcgtccagtgcttgggagctatgctagatacagttgtttttaagtaa

SEQ ID NO: 384 - DNA, 1098 bp, Diabrotica barberi
atgacggtaattaacaagatggaggtggacggcggtccgaagggggaaggttttcggtcgtattatattacaaagattgaagaattgcagcttatagtggccgaaaagagtcaaaatcttagacgtttgcaagctcagagaaatgaactcaatgccaaagttcgtatgttgagagaagaattgatgttacttcaagagcaaggaagttatgttggagaagttgtaaagcccatggataagaaaaaagtccttgtgaaagttcatccagaaggaaaatttgtagttgacattgacaaaaacatagacataaatgatgttactccaaattgtcgagtagccctcagaaatgaatcttacacattgcacaaaattcttccaaataaggttgatcctttagtttccttgatgatggtggagaaagtccctgattcaacttatgaaatggtaggaggacttgacaagcaaattaaagaaatcaaagaagtaattgaacttccagttaaacatccagaactgtttgatgcccttggtattgcacaacctaagggtgtgttgttatatggaccaccaggtactggaaaaactcttctggcacgtgctgtagctcaccatacagagtgtacatttattagagtatctggttcagaattggtacagaaattcataggagaaggatcccgtatggtaagagaactcttcgtaatggccagagaacatgctccttcaattattttcatggatgaaattgattccattggatcttcccgtattgagtcaggatctggtggtgattctgaagtccaaagaaccatgttggaacttctcaatcaattggatggttttgaagctaccaaaaacatcaaagtaattatggctaccaacagaattgatattttggatcccgctttactcagaccaggaagaattgacagaaaaattgaatttcccccaccgaatgaagaagctagattggacatcttaaagattcactccagaaagatgaaccttacaagaggaataaatcttagaaaaatagctgagttgatgccaggtgctagtggggctgaagttaaaggtgtgcagaccaggaagaattga

SEQ ID NO: 385 - DNA, 600 bp, Diabrotica barberi
atggtgaaaatatattgtctcagtgttttatacaaaggacctacaactgcgacctggttgaaatcagcttttgaacttcaaagcttcagttttttccaaagagggtcaatacaggagttcatgtcattcttttgcaaaaccatagtggaaagaacaataccagcctcaaggcagagtgttaaagaaggagaatatttgtgtcatgtatatgtaagagctgataacttagctggcgttatcataactgaccatgaatacccatcaagggtatctcacactctaataacaaaaatactagatgaattcggtgccaaaattcctgcagctaactggcccaaccttgaagagagagatgtagcatttccacaattaaatacctacttagcgaaatatcaaaatcctagagaagcagatgctattactaaaattcaagaagatcttgatgaaacgaagattattttgcataataccatacaagcagttttggaacgaggcgagaaactagacgacttggtgagcaagtcggaaggtttaagcatacagtccaaggcattctacaagacagcgagaaaaacgaatagttgttgtagttttacatag

SEQ ID NO: 386 - DNA, 606 bp, Diabrotica barberi
accagtggtggagtagtgcttgctgtagaaaaacgtattacttcccccttaatggaacctactacaattgagaaaattgtagaagttgacaaacatattggatgtgccgtttcaggacttatggcagattcaaggactatgatagatagagctcgtgtggaatgtcagaatcattggtttgtctacaatgaaaatataagtgtagaatcctgtgcacaaggtgtatcaaatttggctattcagttcggagattctgatgaagatggtgcagccatgtctagaccttttggagtagcaattttgtttgctggtatagatgaaaaaggacctcagttgtaccatatggatccatcaggaacatttgttcagtttgacgcaaaggcgataggatcaggatccgagggtgcacagcaaagtttacaggaggcatatcatcgcagtatgaccctggaagaagctaccacaactgctttaacaattctaaaacaagttatggaagaaaagttgaattcttcaaatgttgaggttatgactatgactccaaaagatatgttccacatgttcacaaaggaacaagtggaagaggtaattgctaaattgtcttaa

SEQ ID NO: 387 - DNA, 930 bp, Diabrotica barberi
atgaagatgggtgttcaggttttgattactgatccaaatcaactggaagcaatccgcacaagagagctcgacatcaccaaagaacgcatccaaaaaatcctctctactggtgttaatgttattcttgcgagtggtggtatcgatgatctttgcttgaaatacttcgttgaaaatggagcgatgggtgtaagaagagtaaagaaagctgacttaaaacgcattgccaaagcaactggtgccactttcctaacttctcttagtaacatggagggagatgaaagttttgattctagcatggtaggagaggcagcggaagttgttcaagaaagaatttctgatgatgaattgataattattaaaggaccaaaagcacgtacagcagcctctatcatcttgcgaggacccaacgatttctattgtgatgaaatggaaagatctgttcacgacgcgttgtccgttgtaaaacgcgtactcgaatcgaaaagcgtcgtagtcggtggcggcagtgttgaagcagcactttcgatatatttggaaaacttcgccaccacgctaagctccagagaacaattggctatcgccgaattcgccaggagcttactggttattcctaaaacgttggcagttaatgcagcgcaggacgctacagatttagtagctaagttgagggcataccataattccagtcaaacgaaaaaggatcatgcgcatttgaaatatgtaggattagatctcatggaaggtaccgttcgagataaccgaaaagccggagttttggaacccaccatgtccaaaataaaatcccttaagtttgcaacagaagctgccattaccatcttgagaatagacgatatgatcaaattggattccgaacaaagaggcggaaagagctaccagcaagccatggacagtggagaattatatgattaa

SEQ ID NO: 388 - DNA, 993 bp, Diabrotica barberi
atgtttaattctgctgcccctcctttgtggcataacggccccgtacctggagaattttataattttcccggcaaacagaccagctattccaaccctataacacatacacagtctcccgttacaacatcaacttctgtattagctattacttacgataaaggagtattgatagccggagatctggttgcttcatacggatctttagctaggtacagaaattgcccgagggttattaaagtcaatcagaatatcatcttgggagccggaggagactatgctgatttccaatacgtcaagagtttcattgagcaaaaaataattgatgaagaatgcattgacgatggactaaaaatgaaaccaaaatcattgtactgctggcttacaagagtaatgtaccaacgcaggagtaaattagaccccttttggaataatttggttataggaggaatccaggatggagtcccgttccttggaactgtagataaattgggaactgcatatacagacaaagttatctgtacaggttatggagcccacatagccttgcctcttctgagagactcgttagataaaaatggagctcttaacttggctgatgccaaaactctgattcacaaatgcatggaagtgttgttctacagagatgccagaagttttcccaaatatcagcttggtgttattgataaggatgatggcgtcacgatccagggaaccatagataaattgggaactgcatatacagacaaagttatctgtacaggttatggagcccacatagccttgcctcttctgagagactctttagataaaaatggagctcttaacttggctgatgccaaaactctgattcacaaatgcatggaagtgttgttctacagagatgccagaagttttcctaaatatcagcttggtgttattgataaggatgatggcgttagtattgagggtccgatttcagtcgaagaaaactggagtattgcccatatgacataa

SEQ ID NO: 389 - DNA, 1698 bp, Diabrotica barberi
gtggaaggatgcaaggaattgctagaagtaccgggaagaaaatttctatatgaaggagatttgttagaaattgatccaacagaaaatacatctttgaaaactgttcatgtgtatttatttacagatggatttatgataacaaacagaaattccaatagtcgaggtttgatgaaatacatttatgaaataatgtatgatttaagtagtctagcagtggtcaacgtgagagatttaggaaacgttaaacatgcgtttaaattgttaatttttccggatacgagagtttttcaatgttcttctaattccaacaagaaagagtggttggacaagtttgaccaagcaaagaagactagattagcccaagagcaacataagagggagtcaatttcggaaaaatcaccctctcgatcagcttcgatagagtctcctagttataacccttttgacgaagttgaagacgatgtaggaatggtgcacccagaatggtttttggacattccagaggaacttgatgtgtgtgtagctcaaagacacttcgaagaggctctttcattgttgcaaaaagctaaggaatatattagccaaatgacggctggtaatgagaaacacgatcatgtgttcctcgatattcaaagaaaggttgaacaacgacaaaatagtcttaccgaagttttaatgaaagaactggaagttaatcctgataaatctttgcaaggtggattgagggctgctagaagagcagtaaggttattaaatcaattaggaagagaaaaccaatcatgtaacttattcctgaaattgtgtagcagtatgttgaggacacagtgtaagcgtgtaaaaagagaaggatccaccacaacatacatacgaaatttggcgagtgtagttttcactaacatgtgtcatatgtcggatgagtttctaagggcctttcccgactcaccaacttgtgcttcagcttatgttgtttgggccagcaacgaattgcttctttttactggacattttataaaacaagtatttatgccccagacttcgctgtcaactgtgacagaatgcatagtattagtccgaacgcaatgtgaaaggttatacagttatggtctggatttatgttaccaattggatggtgctttacggtcttccttagtcaaagctttaaaagacgcaagagataaacttatagattcgatcaaacttagagccctagaagataaatggatcccgattaacttgcattccaagtccgctttgggaagatttctacacgaacattcgcaaatgggattaaatttggagagttatgtttcaggtgacacttggattcaactaacagcaagtactttatcatttacaaaaatgtttttccaattgttaaatgactgtatgaagttaaaaacgactgaattggtatacaccatagacgaaactttgtataatgtgttcgacgctcaattgaaacacaatgaaaatgctcttcgcaatgagttaaatcaggatcaaagaagctttctaactaaaaatgctgaatttttactggtcaatgtagtcgaagtatcgcagaaaatatacagtcaaaatgtgggctatgagtgtgcaacacttaaaaaactacaaggcgaatatgtggctttaaaaaagggcgtttctccaacaaccagaagtactaaaacaaaatactcatctgaatttttgtaa

SEQ ID NO: 390 - DNA, 3105 bp, Diabrotica barberi
atggatgaattacagaaattggaatatctttcattggtttctaaggtttgtaccgagttagaaaaccatctcggtatgaatgataaagatttggccgaatttattattcatctttccgagaagaatggtacatttgaatctttcaaaaaggcacttatagaaaatggagctgagttttcagattccttcatctcaaatttgctaagaatcattcaacatatgaaaccgaagaaaaataaatcgaaagttgaagctgatgtgtatcaaaaagaaagtctggctaccaaatttcctggtttagctttaccaaacgaaaaacaaaaacctttgtttatagatgaagaagcacctgctgaaaaaaatgaagatgatgacattgtagctgacctaatgaaacaatttgaagcggacgctccctcaaacagtcaaatccaaacaacaactaaatctggaagtgcaagccctatagaaagaaaaagatcgtcaagaagtaggtctagatctaaaccaagaaaaatacggaaatctagatcaagggacagggactctagaaaggacaaaagacgaagtagatccagagaccagaagaaaaacagaagagatagaagtggttctaggagcaaaagaaataaagaaagaagtaggtctaggaataggagaagcagatcaagggatagaagaagtagatcgagagacaggagaaacagatctaaggatcgaaaatacaaaaattattctagagataaagataggagagaaagaagcaattcgagggatataaaacgggatagaagtactgagaagaagttcaaaagtgaaaaagataatccagagttcgaagatgatcctaacccaggaaaaatatataatggaaaagtatcaaatattgtaccttttggatgctttgtccagctggagggacttaaaaggagatgggaaggcttggttcatatttcacagcttagagcagaaggcagagttactaatgtatctgaagtaacatctagaggagctagagtaaaggtgaaagtattgacagtaacaggtcagaaggtgtcattatctatgaaagatgtctgtcagattactggtaaagaccttaacccacattcccacgctccgactgaaagagaagatagagatagaaatcctgacaggcctgtaaacagcagtacatctgtattgagactgccagtaaatatagatgaaggagaagaagactctcggaaacgagtaacaaggatttcaagtcccgagagatgggaaataaaacagatgatttcatcaggatgtattgctaagagtgagttgcccgattttgatgaagaaactggattgttacccaaggatgaagatggagaggctgatattgaaattgaattggtcgaagatgaagccccatttttgcaaggtcacggtagggccttacatgatcttagtcctgtaagaatagtcaaaaatccagacggatcattagctcaagctgccatgatgcaatccgctttggctaaggaaagacgggaacagaaaatgattcagcgggaacaggaggtcgattcccagccttccggtaagaataagagttggatagatcctcttccagaagatgaatcaagaatgatgggcagaggaataggattacaagttcaagatttaccagaatggaaaaaacacgtaataggtggcaaaaaatcatcatttggcaagaagactaacttaacaataatagagcaacgtcaatccttaccaatatataagctcaaagaagaattacgaaaagccgtaaccgacaaccaaattcttatcgttattggtgaaactggttcaggaaaaacaactcaaataacacagtacttagctgaagccggatttacgtcgagaggaaagattggttgcacccaaccaagaagagtagcagctatgtccgtagctaaaagagttgctgaagaattcggatgtcgtttgggacaagaggttggttacactattcgtttcgaagattgtactagtcccgaaactatgataaaatacatgacagatggtatgttactaagagaatgcctcatggaccttgacctcaaacaatactcagtaataatgttggatgaagctcacgaacgaactatccatacagatgttctctttggattactaaaacaagcagtcatgaaacgagaagaattaaaactgatagtaacctcagctacgttagatgctgtaaaattttcgcaatatttcttcaaggcgcccatctttactatacctggtaggactttccctgttgaggttctatatacaaaagagccagaaactgattatttagatgctagtttgataacggtgatgcagatacatttgagagagccgccaggagacattttactttttttgactggtcaggaagagattgacactgcttgtgaaattttgtatgagagaatgaaatctttaggtccagatgtacctgaacttataattctccctgtatattccgcgttgccttccgagatgcagacaagaatctttgaaccagcgccacctgggagcagaaaagttgtgatcgctactaatatagcagaaacgtctttaacgatagatggtatctactacgtagtcgatccaggcttcgtaaaacaaaaagtctacaactccaaaactggaatggattccttggtagttacaccgatttcacaggctcaagcaaaacaacgagcaggtcgagctggtagaacgggacctggtaaatgttacagactatatacagagagagcatacagagatgaaatgcttccgacgcctgtacctgaaattcaacgtaccaaccttgcaacaacagtcttacagcttaaaactatgggtatcaacgacctgcttcatttcgatttcatggacgctccgccggtggagtcgttaattatggctttggaacagttacattctttatcagcgcttgatgatgaagggttactgacacggttaggaaggaggatggcagaatttcccttggaaccaaatctttcaaagatgttgataatgtcagttgccctacaatgctcggacgaaattcttacaatagtcagcatgttatcagttcaaaatgtataa

SEQ ID NO: 391 - DNA, 1248 bp, Diabrotica barberi
atgtcgtcgaaaagaaaaagtaaagaaagcataattgctagggttaatttccctctatatactcttcagatgttaacgtcaaggcatgtaatcgtaggtggtggaggagggacatccaaaactggtgtacacaatggttttgaaatatttgagatttttcatgatggaacacgcttcgcagcaaaagaagtaaccagacatgaaactggaggcaatgttgttatgaactgttctgtttacagtgatagaaaatattctcttttggtagctggacaagaaagtgagtgtcaattgtacaaactgaatcctaaactagtcgaggaagtggaaaatatcggtaataatactcatctcaggcaacggaatacaaaaaacaaagaagttacagatgacaacaagaatgtgacaaaagagttatattttgatgttaacgcaatagaaaatgttcaaactgactttaatgggagtgaaccgttatcaagggtagtaaaaattaatcacgacggtacattattagctacaggtggcactgatggagatgtacgaatatggaagttccctagtatgcaacctttatttattcttaaggcacacacaaaagaaatagatgatatagattttagtaggtatgacaattatgtgattaccatagccaaagatggtttagcagtattgtgggattgtatgacaggaaaagaaagaacaaaactgacatggaaacagcctgaaggatcaaaatatttatataaacgttgtagatttggtgtaatagaaggactagacaagaaatgtgcactatacacaatatccaatccaataggagtagctaaaaaacaaaaatcctacctccagcagtggatacccgaggaaaacatgttaagaaggtgtatagaatttgatgagagtttggctgctttagctgttcgtgatgatggtagatttgttgcggttggtacaatgttcagtggatcagtgtccattcttgtagcatttaatttacagaaaattttaaccattgttggagcacattccatgttcgtcacagggctcgagtttctgcccacccagaacttaaaccattccattagtagtgtagtagaagccgcagtcttgtcaatttctgtagataaccaactatgcatacatacagtgccatacagaaaaaccatacctctgtggattgctatcgcacttttagttttaactttatttttgactttcttactatgttcatacttaggtttgtga

SEQ ID NO: 392 - DNA, 1242 bp, Diabrotica barberi
atggccggagcaatgttatttgaaagagccccgtctgtttcttctcaacacgagaagcttttaaaattatccagagattcagatgatgaagatcaaaatattgtcaataaagaacaagacatccttaatcttggtgagaaatataaaaaggagggcaaggcaaaggaactcgcagagcttataaaggccaccaggccttttttgagtttaataagcaaagcaaaagctgctaaattggtaaggtctctagttgactacttcctagatttagaagctggtattggtatcgaagtacaactctgcaaagaatgtatagaatgggcaaaggaagagagaagaacttttctacgtcagtcccttgaagccaggctgattgctctttattttgacactggaatgtacagcgaagcgctacaactggaatcgaccttactgaaagagttaaaaaagttggatgacaaaaacttgttggtggaagtacaactacttgaaagcaaaacatatcatgctttaagtaatttaccgaaggctagagctgcactaacttcagcacgaaccacagctaacgctatctattgccctccaaagatgcaggcagctttagatttacaatccggagtattacacgctgcagatgagaaggatttcaaaacagcttattcttatttttacgaagcttttgaaggttttgatagtgttgaatccccaaaagccctcacagcccttaagtacatgcttttgtcaaaaatcatgataaacagtcccgaagacgtccaacaaatcgttagtggtaaattagcctttaaatatgctggtcaagatatagaggctatgaaatcagttgcacaggctgcacacaaaagatcactagcagatttccaacaagcagtaaaacagtttaaacacgaattagaagatgatgttattgttagagcacatttaggaacgttgtatgacaatatgttggagcagaacctttgcagaattatcgaaccatattctagggtacaagtagagtatgtagcaaaaaccataaaactcccagtactacaagtagaaaagaaattgtcgcagatgattttagatgccaagtttcatggaattttggaccaaggcgaaggtgtcctcatagtattcgaagaaagtgcagtagacaaaacatacgaaatggccctagaaacgatccagagtatgagcaaagtagtagatactctttatcaaaaagcaaagaaattgtcatag

SEQ ID NO: 393 - DNA, 1767 bp, Diabrotica barberi
atggcatcgaaatcaaaaaaagggtcaacaccgttagcttcacagcggccggcgagccccttaagtcctaccagacattctagattacaggagaagcatgaacttcagaatcttaacgaccgtttggcgggatatatagatcgagtaaggtatttagaaggtgaaaacaacagattaacgagggaaatacaaaccactcaggaaacggtaacaagggaagtttcaaacattaaatctatgtatgaccatgaattatcagatgctagaaagctattagacgaaacccaccgtgaaaaagctcgtttagagatagatgttaaacgtcttttagaagagaatgacgaactcaagtctgagttagcaaagaagaacaaggatttggctctagctgagaattctgccaggatatacgagacgagatgtaatgagttacagctcaaagcaaatcaagcagctgctgatgctaagaaagctattgcagatgctaaggaacttgagaaagaacgtgataagctacgcaaacttcttgataaccatcgtaaacagttggaagaagaatcattggcgagagtggaagtcgaaaatgccaaccaaagtcttcgagaagagctgtcctttaaggatcagatccatcaacaacagttgacagaaactcgtactcgtcgtcaagtagaaatcagcgaaatcgacggtcgcctggcagaaaaatatgaggctaagcttcaagaggctctacaagaactcagagatcaatatgaaagtcaaatggccaacaaccgtggcgaaatcgagttgctttacgaacagaagattaagaacttgcaatccgctaatgacagacattctgcctctgcttccggtgctcttgacgaattgagacaagttagaaccagaatcgatactttgaattctcgaattagcgatttagagaaccaaaacgctggcttagcagctcgtgctagagatttggagaagttgttagagaacgagcgcatgcgccatgtggaagacctcgcaatgttagaaagagaattacatagactccgagaagaaatggctaaccaacttcaagaataccaggatcttatggacattaaggtttctcttgatttggagatagctgcttatcggaaactgctcgaatctgaagaagctcgtctgaatattaccccaacgggtagtgaagttcatgaagtaactcacagtaggagccaacgcagctcgtcgcaacgtcgcactccagtcagattgggagccaaaagaaagcgaacactactcgaagaaagccaagagtcgagcatgaatgactattcggtgaacagctcctcaaaaggtgacattgaagtcgcagatgtcgatccagaaggacactatgttaagttgcacaacaaaagtaatcaagaagtcgctcttggaggatggcaagtcattagacgtgtcggtgaggaggaaaccacattcaaatttcacaggtcactaaagcttgaaggtaatggatatgtaacaatatggagctctgacctcaacaaagatcatgaacctccaactaatttagttatgaagagtcagaaatgggttgtaggtgataacatggtcaccacattattgaataataacggagatgaagtagctgtctccgaaagggttaaaaggcaattaacaagctcccatctaagacacagagaactagcagctggctacctctcagaagaactccaccatcaacagggtgatccacaagtagatgaaagatgtaggcttatgtaa

SEQ ID NO: 394 - DNA, 2055 bp, Diabrotica barberi
gaggatttggccaccgcaattctccgtaagaaagatcgtccaaatagacttttggtagaagaagcagttaacgatgataactccgtggttgctttgtcacaagcaaaaatggatgaactacaacttttcagaggagacacagtcctactgaagggcaagcgaaggaaagaaactgtttgtatagtattatctgacgatacatgtagcgatgaaaaaattcgtatgaatagaaatgttagaaataatttaagagttaggctttcagatgtagtttctatccaagcttgccctgatgtaaagtatggcaagagaatacatgtacttcccatagatgatacagtggaaggactcacaggaaatctcttcgaagtatacctgaaaccctatttcctggaggcctatcgaccaatacacaaagatgacgtattcgttgtacgtggaggaatgagagctgttgaattcaaagtcgtcgagaccgatccagccccgtactgtatagtggctccagacaccgtcattcattgtgatggagatccaatcaagcgtgaagaggaggaagatggaggaatgagagctgttgaattcaaagtcgtcgagaccgatcccgctccgtactgtatagtggctccagataccgtcattcattgtgatggagatccaatcaagcgtgaagaggaggaagaagctcttaacgcagttggatacgacgacatcggaggttgtagaaaacagctcgctcaaatcaaagaaatggtagagttaccactgagacatcctagtcttttcaaggctattggagttaaaccaccaagaggtatcttactttacggtccaccgggtactggtaagacactcattgcacgtgcagtagctaacgaaactggagcgttcttcttcttaattaacggtcctgagattatgagcaaattggccggtgaatccgaaagcaatcttcgcaaagccttcgaggaagccgacaagaattccccagctattattttcattgatgaattggatgccatcgctcccaaaagagagaaaacacacggagaggtggaacgccgtatagtatcccaacttctaactttgatggacggtatgaagaagagttcccacgttatcgttatggccgctactaacagaccaaactcaatcgatccagctttacgtagattcggaagattcgacagggaaatcgatatcggaatacctgatgcaactggcagacttgaagttttacgtattcacaccaagaacatgaaattagccgatgatgtcgacttggaacagatcgctgcagaaactcatggtcacgtaggtgccgatttagcttcactgtgttccgaagcagcccttcaacaaatcagagaaaaaatggacctcatcgacctcgaagacgaccaaattgacgcagaagtcctaaactcactggcagttaccatggagaacttccgttacgccatgacgaagagcagcccaagtgctttacgtgagaccatagtagaagtaccaaatgtcacttgggacgatatcggtggcttggctaatgtcaagaaagagttgcaagaattggtgcaatatcctgtcgaacatccagataagttccttaagttcggtatgcaaccgtccagaggagtgttgttctatgggccgcctggttgcggtaaaacgttattagctaaggctattgcgaatgaatgccaagccaactttatctcagttaaaggaccagagttgcttactatgtggtttggtgaatcagaagcaaacgtcagagatatcttcgacaaggctagatctgcggcaccttgtgttctattcttcgacgaattagattcaattgccaaatcgcgtggtggaaatgtaggtgatgccggtggagcagccgacagagttattaatcaaattctaacagaaatggacggtatgggagccaaaaaaaaacgtgtttattatcggtgctacaaacagaccagatatcatcgatcctgcaatattgcgtccaggtcgtctcgatcagttgatctacatccctctgcccgacgagaaatctag

SEQ ID NO: 395 - DNA, 825 bp, Diabrotica barberi
atgggagaccagtttgattgcgctttggacttaatgaggaggttgcctcctcaacaaattgaaaaaaacttaagtgatcttattgatttagttcccagtctatgtgaagatctactatcatctgtggatcagcctttaaaaattgcaaaagataaagaaactggaaaagattatcttctttgtgactataatagagatggagattcctacaggtcaccatggtccaatacatactacccgcccctagaagatggttcaatgccatctgaaaaattaagaaaactagaactagacgccaatcttgcatttgatcaatacagggaaatgtattttgaaggaggtgtatcttctgtttatttttgggacttagaccatggatttgcaggagtcattctaattaaaaagactggagatggtagtaaaaagattaaaggatgttgggattccttacatgtagtagaagtgcaagagaagagttcaggaagaaactcccattataaaatgacttcaactgctatgttatggcttcaaactaataaacagggatctggaactatgaacttgggtggaagtctaactcggcagatcgaacaagatgcagctgtaaacgatatcaaccctcacatagccaacattggaagaatggtagaagatatggaaaacaaaattcgcaatacattgaacgaaatttacttcagcaaaacgaaggacatcgtcaacagtctacgatcagttcaaccactgaccgaaagccgggcacaacaggcacttaagcaagacctcgcggcggcccttcaacgtagacaaaacaaaactgagaactga

SEQ ID NO: 396 - DNA, 4002 bp, Diabrotica barberi
atggaacgcccaccccgaaacgaacccactgtggaaccagtgaatggagtggtccaaccactagtccagccacctccagagagtccgggccgcgtcaccaatcaacttcagtttttacagaaaactgtgttaaaggctgtctggaagcaccaattcgcttggcctttccagcaacctgtcgatgctagaaaactcaacttgcccgactatcataggataattaaacagccaatggacctgggaacaattaagaaaagactagacaacaactactactggtcgggcaaagagtgcatccaagacttcaacacgatgtttacaaactgctatgtctacaacaagcctggagaggatgttgttgtcatggctcaaacgttagaaaaggtatttttgacaaaagtggcggatatgccaaaggaggaatttgttgttgaatcgcctggtaaagcgggagcggcaaaaggaaagaaggggcggaccagtacagcgggcgctgccagtgcacccccaacaccaactacagccaccgctggttcgggaggcaggggtaggcctcccgccactgtctcttctacaagcgccactccagttgctaccactacaggatcttcagggttacctttaggcactcaagcaccggctacagtacctggcagcaccgcaaccaccaccatagccgcggctagcaccaacaacagctctctgtcgaatcagcaactgaactcttcttccagttccattcacggaagcggctccagtataggaaattccttagattccagcagcgtcatgcctgccaacgttatacctccggcacaaccagccaaggtaaaaaagggcgtgaaaagaaaggccgatactacgacgcctgctacagcctacgattatccgccaactttggagtcgaagtccgcaaagatatcgacgcgccgagaatccggtaggcaaatcaaaaagcccaccaggccagaactggacggtcatccgccacaaccccctccacttaaaccaaaagaaaaactaccagaatcactgaaagcctgtaatgaaatcctcctagaattgttctctaagaaacattctagttacgcctggcctttttatcaacccgtagatgcagaattactcggtctgcatgactaccacgacatcataaagaaacccatggattttagcactgtaaaaaataaaatggaaaaccgagagtatcgcactcctcaagactttgccgccgacgttagactgatttttagtaattgttacaagtacaacccttctgaccacgatgtggttgctatggcgaggaagttgcaggatgtgtttgaagtgaaatatgcaaagattcccgacgaacctgtcaatagggtaggagcccctgccgttaataatatacctgccaaatcagaaacgagtacatccggttccagctctgattcttctagcgacacggaagattcggaggaagaaaggcgaaacaagcaactgaagctgctagaaaaagagttgacggcgatgcaagaaaagatgcgtaaattggtagacgagagctcgaaaaagaaaaaagaaaagaaaaaggacaaagtgaaaaagaaaccggcatcaggtgggtctatggcgaacgcctcactatcaactctaccgaacagcagcagcgcgggcttgggtaagccgggtgccggtggtcacggggctctaaacaagtcaaacaacaacaactcaatagcggcggacagcgttgacgacagcatcgccagtgttgtgtcgggggccgatctaaagatggccgagtcgcaccatccgcaaactggaaccggcgctcaccatccgccggcaggcaaatccctgaacatgcatcacaacatgacggctaacgctggcgccaacgcttccgcgcaggctaaaacacctaaaagtaaaggacttcgcggcaataaacccgctgcagctaccaatgcggctcccaacaagagggttaaagccaacaataaagctggcgcgggtaggaagaagaacgcagcacaaccaccacctatgcagttcgattctgaggacgaagacaatgccaaaccgatgtcttacgacgagaaacggcagttgtctttggatattaataaattaccaggtgacaagttgggtagagttgtacatataatccaatccagggaaccttcgttgagggattccaatcctgacgaaatcgagatcgatttcgaaacgctgaaaccctcaacactcagagaattagagagttacgttgcgtcgtgtcttcgcaaaaagccacataaaaaagtagcgggcaaatctaaggacgaacaaatagcggagaagaagcaagagttagaaaaaagactaatagacgtaaacgataaaatcggcaactccaagaaggcccccaaaaaagatgaagccaacaaggtagacccaacgggcgcgggaggtccctcaggccgcctatcctctagttccagcagttcggactccgacagcagtagtagcagtctgtcctctagttctagcgactccagtgacagtgaagcaggtgggacggcgaaccggcaggccaaaaagaaagcgaataaaaagtcacccaatccttcactaggaagttccgccaccactacgactataaaagtgccgccgcctcaaacgacggcaacgcctgcaccgccgtcacaagccgcaccagctatcacaacagcagcaaccgctaatttaacaacaactgtaaccgtaccaccacttactaccacaacgacaagtacgatagcgccaccaatccaaccggcgccagttccaaacgtcgtcgttcccgcgcaaacgacgccagccgcacccgcctttacgccgagcataaccgtcaaaccatcactccaggccgcccctatcgctccgacggtgccgcctcttatcaagtcgatcgagaaactgcctgttacaactcttttacctccaaccgttcctacgataacgcctccaacgatcgagaaactgcctgtcacaactcttttacctccaaccgttcctacgataacgcctccaacagtacctcaagctcccaagtcggtagcgctaccgactccttcgcctgataaacccaaacctaacattatttctcccattggtacttttaccgaccctatcgaacaatcattggctagtcttgaacacgatattaagcagaatgatcctatggacgtcattacggcgtctactatgatgcaaatgcctactacgctaaccaatcctatcgtgtcacatccacatcctaacttaaacttaaatcccaccattaaccatcctattttacagcctagcacacttagtatggacttgaaagcgcctattatgggcactatggcgccgagcaataccatgttgcatcacggattgcaacaagcaatggaaacagatatcagtatacctccaccacccaccaacatgctacatggacagaacaacggttttggcatgaaacacaattttgatctgactacaaacaacaacggtctttcctcgatgggtctgcccatggaaatgtcgatatcgtcaatgtttgatccaattccacaaaatattaatcccatgatgaagaacgattcccaactcaagatggacgatcgcatggataccttaggaggacttttgaacgacaagaagtccaatctcctcatacaaaagccgatgtcgcagtcgtttggtttcaagaatgacaaaccagatcacaacgtcaaaaacgctagttcctggtcgagtttggccaaaggaaaatcaccacaaaacaatattccgggcggcagcagtaaacaacaagttatggatagttttaaggcattccaaaataaagctaaagaaaaggccgatagagagaaacaaaggctggagaacttagaaatgaagcggcaacagagggaacaagcggagagggagaggttacgggctgaaaacgaaaggcgaagggaacgagaagaggaagatgcgctcgagaaagcgaggaaagctgta

SEQ ID NO: 397 - DNA, 1224 bp, Diabrotica barberi
atgtcgttatccaccgctcgcccattagtgagcgtatacaatgagaagtcggaagaagtaaagggctcaaatatttcacttccagcagtttttaaggccccaatcagacccgatgtagtcaacttcgttcaccaacaggtttctatgaaccatcgtcaaccctacagcgttagtgacaaagctggacatcaaacatctgctgaatcatggggtaccggacgtgctgttgcccgtattccccgtgtaagaggaggtggtacccaccgttctggtcagggagctttcggtaacatgtgtagaggtgggcgcatgtttgccccaaccaagccatggcgtcgctggcacagacgtgtaaacatcaatcaacgccgttatgctttggcatctgctgtagctgctagtggtgtaccagccttagttatgagcaaaggacatgtcatcgaccaaatccctgaattaccattggttgtcagtgacaaggtacaagaaatgagcaaaactaaacaggctgtccagttcttgaggagaatcaaggcatgggctgacattcaaaaggtttacaagagtcaacgtttccgtgctggtaagggaaaaatgcgtaataggaggcgcatccaacgtaaaggaccattggttgtttactacaaagatcaaggtcttcgtcgtgctttccgtaacatcccaggcatcgacctcattagcgtacagaagttaaacttgttgaaacttgctcctggtggtcatgtaggtcgctttgttatttggaccgaatcagctttccaacggttagataaattgttcggcacatggaaaacagcatcattggaaaagaagggttacaatctaccccaacctaagatggccaacactgatctatctagattgttgaaggctgatgaaatcaaagctgtattacgtgctcctcaaaagaaggttgtacgtcgtgtacgtcgtctcaatccattgaccaacgctaaggccatgcttaaattgaatccatatgctgctgtactcaaacgtgaagccattttgaagaatcaaaagagacagttaaacagggaagaacttttggccaagaaacgtggtattaccttgagtgccgacaacgtcgtgattagatccagaaaattgcaagaaaggagaagggcacaaatcttgaaagataaaaaatcgaagcctaagaaggccaagaaggctccagccaaggccacaggaaagaaataa

SEQ ID NO: 398 - DNA, 5709 bp, Diabrotica barberi
atggcagacttcataaattctgaagcagaagaaagtagtgaggaggaggaattagatcatagggatcgtaagaaagcccaaaaagccaaagttgtagatagttcagatgaagatgatgaagatgatgacgaaagactgagagaggaattaaaggatttgattgatgataatcctattgaagaaagtgatgcggagtctgatgcttcaggaagggaaaaacgtaagaaatctgacgacgaggatttggatgatcgactggaagatgaagattatgatttgcttgaagaaaatttgggtgttaaagttgaaagaaggaaattcaagcgactgcggcgttttgaagatgaggaaagtgaaggagaagaagaacatgatcctgaacaagatagggaacaaattgctatggatatattttcagatgatgacgatgaaagacgatcagaacggagtcacagacctgccgtcgaacaagagacttatggtgtaggcgaggaagaagaggaaggggagtactcggatgccgatgattttatagttgacgatgacggtagaccgatagctgaaaagaagaagaagaaaaaaccaatatttactgatgccgctctccaagaggctcaagaaaccttcggtgtcgattttgattatgatgaatttagtaaatacgatgaagatgattacgaagatgaagaggaggaggatgacgaatacgaggaagatgatgtagagaaaaggaaacggcctaaaaagacttcaaagaaaaaaccgacgaagaaatccatttttgaagtgtatgaacctagtgaacttaaaagaggtttctttaccgatctcgataatgaaatccgtaacaccgatattcccgaaagaatgcaacttcgtgatgttccaatcaccgctgttccggatgactcaactgaacttgatgatgaagcagaatggatttacaggcaagcgttttgtaacagaactgtttccaatgtggattctcatttatcatcagaggcaagagagaaattgaagaagactcatcatgccatcggaaagatcagaaaagcattagattttataagaaatcaacaattagaagtaccgtttattgctttttataggaaggagtatgttcaaccggaacttaatattaacgatttgtggaaagtatataaatacgatgcaaagtggtgccaactgaaaacacgcaaagaaaacctcttaaagctttttgaaaaaatgaggtcatatcaaactgaccacataatgaaagatccagatgcaccaattccagacaaccttcgtatcatgactgagtccgacattgagcgattgaaaaatgttcaaaccgccgaagagttaaatgacgttcacaatcatttcgttttatattatgctgcagatttgccagccatgcatgccgcgtggagagtcaaagaaagagaaaggagaagacaggaaagaaaggaggctagactgaagctcatcgctgaaagtgaagaaggtgctgaaattcctgaagagcctgaggaaattgacgatgacgaaccagaagctgaaaccttaaaatacgccaatagatcaggcagctatgcactatgtaataaaggaggtttgggtcctctagcgaagaaatttggtttaacgcctgaagaatttgccgaaaacctgagagataattatcagaggcacgaagtagatcaagaacatatagaacctgtagaagtcgctaaggaattcgtatcgccgaaatttcctacagtggaagaagtgttacaagctactaaacacatggtagctttacaaatagcaagagaaccattagtaaggaaatgcgtaagagaaattttctttgaacgagctagattaaacgtttatccaaccaaaaagggtgtgaaagttatagatgaagctcataattgctatagtatgaagtatgtaaaaaataaaccagtaagagatcttgcaggcgaccaatttttaaaattatgtttagccgaagaggagaacctccttactattaccatcaatgaccatattcaaggaaacactactaacaattacatcgatgaagtcaaacaattatatataaaggatgaattcagcaaacacgttcaggattggaatgcgctaagaatggaatcggtagaaagggctttaacgaaaagtgtcttaccagatttaagatctgaattaaaacgaacgttgctcacggaggctaaagaattcgtattgaaagcttgctgtagaaaattatataattggataaagattgctccatacgcaataacgtttcccgatgaagacgaagatgattgggatacatccaaaggtgttagaactatgggtgtagcatacgtaccagagcacacagtatcagcttttacctgtatttcagcaccagacggagatataactgattatctcagattaccaaatattctaaaaagaaaaaatagctttcgaactgaagaaaaacttatgaaggaagctgatcttcaagcactgaaaaatttcatattccttaaaaaaccccatgtgatagcagtagggggtgagtccagagaagccttaatgatcgctgatgatatcagagcccttaaaaagcctcatgtgatagcagtagggggtgagtccagagaagccttaatgatcgctgatgatatcagaggagtaataagtgaactaatagaatccgaccaatttccacagattagggttgaaattattgataatgaattagcaaaagtgtacgcgaattctattaaaggttcaactgatttcagagattatccagagttgttaaggcaagctatttcattagctcgaagaatgcaagatcctttggttgaattttcccaattatgtaatagcgatgaggaaattttgagtcttaggtttcatcctttacaggaacaagtccagaaagaagaattactagaagctctctgtttagaatttgtcaacagaacaaatgaagtaggtgtagatataaatcttgctgttcagcagattcataaaagtagtttagttcaattcatatgcggtctaggaccgcgtaaaggtcaagcgttacttaaagttctgaaacaaactaatcagaggcttgaaaacagaacccaattggttacattttgtcatatgggtccaaaagtttttattaattgttctggattcataaagattgataccaatagtttaggagacagtactgaggcatatgttgaaatattggatggctctcgagttcatcccgaaacttatgaatgggcacgaaaaatggctgtggatgctttagaatatgacgatgatgagggagctaatccggcgggagctttagaagaaattctggaggcgccagagaggttaaaagatcttgacttggatgcctttgctgaagaattggaaagacaaggatttggtaacaagagtataacattgtatgacattagagcagaactgaactcgcgatataaagatttgagacaaacttttcgttctgcaaatcctgaagaactattcgatatgcttactaaagaaactcccgaaacattttatattggaaaaatggttacatctaccgtgtttggcattgcaaggagaaaaccaaagtcagaccagctcgatcaagctaatccggtccgtaatgacgaaactggtttgtggcagtgccccttctgtttgaaaaatgattttcctgaattatctgatgtatggaatcattttgatgcaggagcatgtcctggtcaagctactggagttaaactaagactggataatggtatattaggttatatttatataaaaaatataagcgacaaaccagtcgctaatccggaagaaagagtaggcataggacaattaattcactgtagaataataaaaattgatgtagagaagtttagtgtagattgcacgtcgaaatctagcgatcttgctgataaaaatcatgaatggagacctcaacgagatcctcattatgatcaagaacgtgaagacaaagacaatcgattggaagccgagaagaagaaagagaaacagcgtatgacgtacatcaagagggttatcgttcatccggcgttccataatatatcctacgccgaagccgaaaaatgtatggttaatatggaccagggtgaagttatcattaggccttcgagtaagggtgcggatcatttgaccattacttggaaggttacggatggaatctatcaacatattgatattaaggaacaaggaaaagtcaacgctttttctttaggaaaatcattatggattggaaatgaagaatttgaagatcttgatgaaataatagctaggcacgttacaccaatggcggcgcatgctagagatttactgtattttaggtattacaaagatttccaaggtggtcataaagataaggctgaggaatatctaaaagatgaaaaaaagaaaaatgcttctaaaattcattatgtagttagtgctgctaagaatatacctggtaaatttcttctttcgtatcttccacgcaacaaagttagacacgaatatgtaaccgttactccagaaggctttcggtttagacaacaaatgtttgattccgttgcttcgttatttaaatggttcaaagaacatttccgggagcctccaccaggcggtgcaacaccaggtagcacgccaaggatggcttcaagcagaactggatatggaagtgccacacctgcgtatagtatgaataatgaagctattcaaagagttgctcaaaatttgccaagtcatgtagttcaagcgttgtctgctgccaccaaccaaactccacattatccccacacccctggttatggaggcaattatattaatacgccttacactccaagtggtcaaactccatacatgactccgtacgctacaccccatacgcagcaaactccccgctatggtcatcaaacaccttcccaacacatggcgagctcagcaccacaaggtctcaacaatccctttttacatcctggcgcggtcactccctcccaacgaactcctagttatcgcaatcatccagcacaatctccaatgcttcctacaagccctgtaccaagtccaggttcccagagttcatacagtagtcatttaagtcataatcagcgaagtggaagttacgccgagtccttaagattccagcctcccgaatcaccgagaagcttagtgagttatcgcaaccatccagcacaatctccaatgcttcctacaagccctgtgccaagtccaggttcccagagttcatacagtagtcatttaagtcataatcagcgaagtggaagttatgctgagtccttaagattccagcctcccgaatcaccgagaagcttagtgagtaatagaagctttcaaactgatagatacggcggtgataggtatggtaaaggaggaagtcatagatatggtggaagctcaaacgaagatagatatggtaagggaggaggaggaaatgaaaatacggattggcagaaagctgcagaagcatgggctcgatctagatctactccgagaagtgatggccgtaatactccaagatctgtaggtcaacgaactcctagatacgacaacgacgccgaacgttctagaatgaaacacctcagcaaaagcccgaggtctgttaggtctactcctcgaaccaatacatctccacattctatgtccctaggtgatgctacccctctgtatgacgaaagtatctaa

SEQ ID NO: 399 - DNA, 2448 bp, Diabrotica barberi
atgccagataccaaggatgctaatttgagttctcctgaacgtaaaagacgaaaaaagagtagatctaaatctccagaacgaaaagagaaaaagtcttccaaaaagaaagcccacaatagtagagacagagattcatcagaggaaggttacaaccctaaagattatcagagatactatggggaagatcgcccaaacagtgacaaatattggaataaatatccaaggaaagataacaccaaagttggccaaagatactatgatgcggctcccgaagaatctggcaagaagggcccagatagaaattcagaggagaaggagttaccaaagccagtggagcctgttcctgataaatcagtcatcaaaccaagagaaagaaaaactgtagatatgttaacatcgaggactggtggtgcttatattcccccagctaagctacgattgttgcaagccagtattacagacaaaacctcagcagcctaccagcgtatagcatgggaagccttaaagaaatccgttcatggttacattaataaaattaacacgtcgaatattggcattatcgctagagaattattgcatgaaaatatagtaagaggtagaggtttgctgtgcaagtcaataatacaagcacaagcagcatctcctacttttacaaacgtttatgcagccttagtagctgttattaactctaagtttcctagtataggagagcttttgttgaagaggttggttttgcagttcaaaagagggtttaagcaaaataataagtctatctgcatatcggctactactttcgtagctcatttagtaaatcagagagtggcacatgaaattttggctttggagatacttacgttgttggtggagactcctacagacgattctgtggaagtggccatttcatttttgaaggaatgtggacaaaaactgacagaagtttcaagtagaggtattactgctatatttgagatgttaagaaacattttacatgaaggccagctagaaaaaagaattcagtacatgattgaagttatgttccaaataaggaaagacggatttaaggatcatgctgctgttgtagaagaattagatttagtagaagaagaagatcaattcactcatcttattatgttagatgatgttaaagaggctgatgcagaggatatattgaatgtgttcaaatttgatgagagttatgaagaaaatgaagataaatacaaaacccttagtaaagaaatcttaggcagtgatggtgagtctgaatcaggttctgaaggttcagaagaggaatctgatgatgaaaatgaggaggaagtcaaggaccagggaacaattattgacaatactgaaacgaatttaatttctcttagaagaaccatatatttgactattcagtctagtttagattttgaagaatgtgcacataagctactgaagatggagttgaaacctggacaagaaatagaattgtgtcacatgtttcttgactgctgcgcagaacaaagaacctacgaaaagttttatggtcttttggctcaaagattttgtcaaatcaacaaagtgtacatcgagcctttccaacaaatttttaaagatacctattctaccactcacagactagatgctaacaggttaagaaacgtcagcaaattttttgcgcatttactttttactgatgccattggatgggaagttcttgacatcatgaaattgaatgaagaggataccaatagttctagtaggattttcataaaaatcttgtttcaagaattggctgaatatatgggactaggaaaattaaatgcaaggctaaaggatgagaccctgcaggcttatttttcaggactgtttcctagagataacccaaagaataccagattttctattaatttttttacctctatcggtttgggaggattaactgatgaactcagagaacatttaaaaaatattccaaaaatgatggaaatgaagttagccactaaagaaaaggcaaacagtggtagtagtagttcagaaagtagttctgaggaagatagtagtgacgacagctctgaagattcgtcaagttctgaagacgatagaggcaaaaagaagaaaaaaaccaaaaagctagaagaaaaaaattcgaaagtaaattctaaatctagacctagatcaaaagagaaagaacacgcagacaaacctagagacaaacatagaaaggaagatagacataaatctgacaaaaatcccgatagatcctcgtccaaaaaatattctaaagaagataacaagaggaagaaagactacgaatggatgaagagcagatatgaagatgatattaagcaattaaaaaacgataaaagggtatttgaaaagtcttccaaacgacgatcaagatctagagagagggtaaaagtcaaggaagagcgtagacgtagaagcagagaaagaagaaggagctaa

SEQ ID NO: 400 - DNA, 1875 bp, Diabrotica barberi
atggcgttaaagaaccaagttggtcaaaaaattatgaatgaagtcatcaagcacaagcccaccaagaagaatgggccaactccaggacagcaaccccatggagtagaatggaggatccttgtggtggaccagctcgccatgaggatggtttcagcgtgctgtaaaatgcatgatatatcagcagaaggcattacattggttgaagatattatgaagaaaagggaaccgcttggtaccatggaagctgtgtacttgataacaccttcagaaaagtcagttcatgctctgatgaatgactttgaaccaccaagacagatgtacagaggggcacacgtgttttttacagaagtatgcccggaggaactgttcaatgagcctctgatgaatgactttgaaccaccaagacagatgtacagaggggcacacgtgttttttacagaagcgtgtccagaccaattatttagtaccttgtgccaccaccctgtagcaaaatttattaaaaccctaaaagaaatcaacatagcattcattccgactgagtcacaggtgttctcgttggattcaccagacacgttccaatgtagctacgatccctcattttccgctgctagaaacgccaacatggaaagaatggcagaacaaattgcgacactctgtgcgactctaggggaataccctcacgtcagatatagaactgattgggaaagaaatgttgagctggctcaactaattcagcagaaattggacgcctataaagccgacgaacctaccatgggagaggggccggaaaaggcgagatcacaattaattatcctcgaccgaggtttcgactgtgtatctccccttcttcacgaacttactttccaagcaatggcctatgacttactacccatagaaaatgatgtatataagtacgaagcatcggctggtgttatgaaggaagtccttctggacgaaaacgacgagctttgggtcgatctacgccaccaacacatcgcggtggtctctcagagcgtcaccaagaatctgaagaaattcaccgactccaaacgcatgacccagagcgacaaacagtcgatgaaggatctctccaccatgatcaaaaagatgccgcaatatcagaaggaattgtccaagtatgctacgcatcttcatctcgctgaagactgcatgaaggcctatcaggggtatatagacaagttgtgtaaagttgagcaggatttggcaatgggaactgatgccgaaggcgagaaaatcaaggatcacatgcgcaacatcgtccccatcttgctagatcccaaaatcaccaatgaatacgataagatgcgtattatagcattgtacgccatgacgaaaaacggcatcacagatgaaaatctctccaaattggctacccatgcccaaatcaaggacaaacagaccatcgccaaccttcagttacttggagtcaacgttattaatgatggaggaccaagaaaaaaacaatatacagtaccgcgcaaagaaagaattacagaacaaacgtatcaaatgtcaagatggacacctatcattaaggatataatggaggattgcatagacgacaaactggatcagaaacactacccgtatttgagcggacgagcacagtctacaggataccacgcagcgccctctagtgcccgttatggccagtggcacaaagacagaggtcaacaagccgtgaagaacgttcctcgactgctcgtcttcgtcgtgggtggaatcagtttctcagagatcaggtgcgcctacgaagtgaccaacgcgcagaagaactgggaagtcatcatcggctcgtcgcacatactcactcccgaggacttcctaagcaatctggcaacgttggccggctag

SEQ ID NO: 401 - DNA, 2139 bp, Diabrotica barberi
atgatgcaacaatatatgaaagaattagagcaggaaccatttgatgctgaagaatttgtagaacgtttagcttggaggactttagctgaatctaaaggcgacggagaggaacatgagattaatcctgcccttttacatgagtcttttgtacaagctataaaagatcttaatttactgcatgaacgccaacaaaagaaatgtgaaaagctagaagttgtggtaagggaagatgaagcgacctttttccaagagatatataatttacttgaacaaaataagcaagcaatggacacttttcaagagttagatggcaaaataaatcatgtagcaacaaaagtactgcatttaggtgaccagttggacagtgtcaatgggcctagatctagagtagtagatgctttaaagttaatgatacatttaacagagttcttgtctgaggaatcagtattatcgcctatctttacaagaccagaattgatagatgatgctgctgatgtgattcaaaaattataccttatatctcaagatttacctcccaaatttgatgttgctaagagaaaaattgaaagaaaatactcggatatagaaaaatctttaatagaagaattcgttctagctatggataacgaaaatttaaatagaatgaaagaaatagctaccgttttatcacagtttaaaggatattctcagtgcgtagatgcctacatcgatcacagtcaaatgggatgtctgtcgagtaaggacgtatttgctaactttttaactctttgtaaatacaatcatgaaataattgtcaaggtttttaataatccggaacaagtgatggcaaaatttgtactgaacatatttcaactcaaactcgtcgaatacatcgatcagagattaaactctaagttaggaacctatggctatttacaagtattatatgaattatattacaagactaatcagttatctaatgatttgagcatatttaacatgggaaatgacaagaactttttatcgaagttaacgacaaatatttttaacaaatatattagtgactatatcacgatggaattaaaaggtctgaaagataggtgttctgcaaatttacaaaaatattatgaatccaaaggtcatcaaaagaagcagattcagtcaggaggtttccaagatcttcgaagagaccttcaagctgttataggaactcgagcaaatattaacattgcccagatcgaaaattatggtggagaaacttttttatctgaagaattagctattacgatattgcaagacacaaagcacgcttttcaaagatgccagttgttatccaaacccacagacagagcatcaaacgcaactcaaattttggatagactgataaacagcttattagtagaacatgtcgactatgcagtagaattgggcttgcaagctgttcctgttgtagaaggggccaaaactcctccagcgctatattttttcagtgtcgtccaccacagtaataacattatacatcttgttgagaaacagttcatggatttgttggttccattagttgaaaacaccccgaggcataatgattgtgtacagaagaaaaagtttgtactggaagatatagaacggaagattaacacaggactagataggtgtctcaatgctatttcgagctgggttaaactttatcttcaaacagaacagaaaaaatccgacttcaaacctgaatctgacgacttcgacacagtggcgtcaaacgcttgtaaaaacgtaattaactacgtgaatagtattgtaaaagaaataaaagcgaacctggatggtaacaatgtcacagccatattgcaagaacttggcataagattacaccgagtggtgtatgatcacatgttgcagttccagtataacacagcaggtgcgatggtggccatctgtgatttaaacgattatcgccattgtacaaaagccctcggcccattagtgattgaactttttgatacactgcatgccctctgcaatcttttgcttgttaagcctgaaaatttacagcaagtgtgttctgaggattctctagtaaaactggatagaacaatccttcacaattttatccaacttagaagtgactttaaggtacaaaaacaaatgattctaaaagtgtaa

SEQ ID NO: 402 - DNA, 813 bp, Diabrotica barberi
atggatttccaaaacagacctggaggaaagaccggtggaggcggggtcgcctcttggtcggaaactaacagggatcgtagagaaaggctccgacaactagctttagaaactatagatctacaaaaagatccctattttatgaaaaaccacttgggctcatacgagtgtaaactttgtttgacgttgcacaacaacgaaggaagttacttagcccatactcaaggtaaaaaacatcaggctaatttagctaggagagcagccaaagaggctaaggatgctcctacgcttttgcaaccagagaaacccagagtagaacctaagaagtttgtgaagattggtaggcctggttatagagtaacgaagcaaagagatgccgaaagtggacaacagagtcttctgttccagattgattatccagaaataagtgatatgattctgccccgtcaccgttttatgtcagcttatgaacaaaaaatcgaaccaccagatcgtaaatggcagtatcttctatttgcagcagaaccgtatgaaacaattgccttcaaagtaccaagccgagaagtagagaaaaccgacagcaaattttggactcattggaacaaggatactaagcaattcttcctacaatttgcatttaaaaatgacaataagagaactgttaacacagtggtccaaagacatacaattgttggtgcagcaccaccacccccaatgctacctgttccaccaccaccaagaccaccgatgttcaatcctattcctcctccacctccaataatgagagctgtattaccagtgcctcctccacattaa

SEQ ID NO: 403 - DNA, 405 bp, Diabrotica barberi
atgtccattggtgtacctattaaagttctccatgaagcagaaggtcatgtaataacctgcgaaacaattaccggcgaagtatacagagggaaactgatagaagccgaagataatatgaattgccaaatgactcaaattactgtaacttacagagatggaagggtcgctcaattggaaaatgtttatattagaggatcgaaaattagatttctggtattgccagatatgttgaaaaatgctcctatgttcaaaaaacaaactaaagcgggaacggcaggccgaggaaaatctgctatactgcgagcccaagctcgggggagaggtagggggcaacaacaaccgatgcgaggtagaggtaattggcaacagaaccaacaacaagcacctgcaggaaggggtagataa

SEQ ID NO: 404 - DNA, 1254 bp, Diabrotica barberi
atgctgtcagcattgagaagtatggcttctactcttacaagaactccaatcttgcgagcaatttccgcaagaagctattctcaagccctgccagtatcaggtaatccaagtgctgacctcagaactagtactcttcccaacaaactagttgttgcagcagtagataatgacgccagtcttaccagagtttcaattgtattcagagctggaagccgtaatgaaaaagccgataatttaggtgccactcatattgtacgaacagcagcaggcttgtccactaaaaatgcatcccagtttgccataatccgaaacattcaacaagttggtgcaaatcttacagccacatctgatagagaaaccatttcctataccttagaaggaacgagaagtgctgttgaaaaggctctaccatatttagcagaagtagctacccaccaagaatttagaccttgggaagtgtcagaactatctaacagattaattttggatattttaaccagacctttacagttaagagccatcgatttgcttcacaatgctgcctaccgtagcaaaggtttaggtaactcactcttcattccaaaatcccaagtaggtaaagtttcatcagaaacgttacaacattacgtagccagcaactttgtagctggccgtgctgcagttgttggtacaggtgtaagcgagagtttgttgaatcaattcgctgctagtttgggaattggaaatggcgaaggcagcaccaatccatctccttacaagggtggtgaactcagatcaaacaaaggtggtccacttgcttttgttgcagtagggggagaaggagctccattgaagaacaccaaagaagctcttgcgtttgcagttctacagaaagctgtatgtgccggccctcagatcaaatatggcgtacttgatcatggagtctacagcaaagctcttggtggctcatcagatgtatctgcgtgcgctgttaatgtgagctattcagacagcggtttgtttggtattttgctcgctgcacctgctggatctgtaggcaaagcagttcaatcagctgttaatgtcttgaaatcaggctccgttacagatgctgatgttcaacgaggcaaaaatcaattgaagacatccatccttcttaatgctgaaagtggagctgacgttgtaagggaacttggaacccaagcagttttggctggtgctccacaaagcgccaatgctttagccgctgctgtagactccgtcaagtggagctga

SEQ ID NO: 405 - DNA, 333 bp, Diabrotica barberi
atgaggagagcccacgcaggtaattattacgagccattacctcaagcttccaacgaaatcgaagatgaaaatgatagaatgactaatgatctgcaagaaaagattggcgtcttaaaatcgttgactatagacattggaaacgaagttaaataccaggacagaatgctcagagatgtggacgacgatctagataagactggaggcttcttgggcaccaccatgtcaagagtactgagattatctaaaggatctcataattacctcatcctgtatttatttgtgttttctgtagtggtgttttttgttctgtatctagttattaagtttaggtag

SEQ ID NO: 406 - DNA, 1290 bp, Diabrotica barberi
atggcttcgacgttatcagcaagacaggctaacagagaacatgttttggccgtatccagagacttcatatcccaaccaagactcacttacaaaactgtatctggtgtcaacggtccactagtaatcctcgaagatgtcaaatttcccaagttcaacgaaattgtccaactcagattatctgacggaagtttaagatcaggtcaagtacttgaagtcagcggttccaaggctgtagtacaagtattcgaaggtacatcaggtatcgatgccaagcacactgtgtgtgagttcacaggagatattctcaggacccctgtctctgaggatatgttgggaagagtattcaatggctctggaaaacctattgacaaaggtcccccaattctggctgaagactacctagatatccaaggacaacccatcaacccatggtcccgtatctaccccgaagaaatgatccaaactggtatcactgccatcgatgtgatgaactccattgcccgtggtcagaagattcccattttctcagctgctggtctgccacataacgatattgctgcccaaatttgtaggcaagccggtcttgtcaaaatcccaggcaaatcagttttggatgaccacgaagacaactttgccatcgtgtttgctgctatgggtgttaacatggaaactgctagattcttcaaacaagatttcgaagaaaatggttctatggaaaacgtatgtctgttcttgaacttggctaacgatccaaccatcgaaagaatcattaccccacgtcttgctctaacagccgctgaattcttggcttaccagtgcgaaaaacatgtgttggtcattttaactgacatgtcttcatacgctgaagctttgcgtgaggtatctgctgccagagaagaagtacccggtcgtcgtggtttcccaggttacatgtacaccgatttggccaccatctacgagcgtgccggtcgtgtcgaaggccgtaacggttccatcacacaaatccccatcttgactatgcctaacgacgatattactcaccctattcccgatttgacgggttatattaccgaaggacagatctacgtcgatcgtcaattgcacaacaggcaaatctacccaccaattaacgtactgccatctctctcacgtttgatgaagtctgccatcggcgaaggtatgaccaggaaggaccactctgacgtttctaaccagttgtttttggaaagaaatcaacctttccttcttcggaaacctaagcctcacgcaccaccggtgatgcaactttaa

SEQ ID NO: 407 - DNA, 336 bp, Diabrotica barberi
atgagtcgcggacacgcaggaccccgtattcacgttccagacgaattaagagaagtactcctcgaatttacaattagttatttactggaacaacctggagatgttattagttacgccgccgaatattttacgcgcttgagggaaacccgggtgacatccagagtgtatgatgaagctgctgcctcgcaggaggaattggtatcacctgacgaatccgtaatgtccaaagatgaagaaccttcaatccggtttgctggtaggcgtaaatcagtgttcgcagaaacttacgatccagaagaagacgacgacgatgatgatggcgccaagttggtgtat

SEQ ID NO: 408 - DNA, 2421 bp, Diabrotica barberi
atgagttacatgcagtctaaccaaaatagaccaatgtctcaaagctaccatcagggtcctaatgacctgcccatgcagtcttctaaagaacagaccttactatggcagcagaattcatacatgggagactctggtattcagtctggggctgctacacaggtaccatcactgacaggtaaagaggaggaagaaatggatctgtttgatttggatcaaccatatcagggttttacacaagagcaggttgatgacatgaataatcaactgaatcatactaggtcccaaagagttagagctgccatgtttcctgaaactttggatgaaggtattgaaatcccttccacacagtttgatcctaatcatcaaacagcagttcaacgtctggcagaacctagtcaaatgctcaagcatgctgtagttaatcttattaactatcaagatgatgctgaccttgcaaccagggccataccagaattgatcaagcttcttaatgatgaagaccaagtagtagtatcccaggcagctatgatggtccaccaactatctaagaaggaagcatctagacatgctattatgaatagtcctcaaatggtagctgccttagtgagagctatatcaaactctaatgacttggagactaccaaaggagctgttggtaccctacacaagttatcacaccacagacaaggtttacttgctatttttaaaagcggaggtattccagcacttgtaaagttgctcagttctcctgtagaaagtgttcttgtctatgctataaccactcttcacaacctgttattacatcaagatggatctaagatggctgttagacttgcaggtggtttgcaaaagatggttgcactactccaaagaaatcatgtcaaatttttgtcaattgtaactgattgcttacaaattttggcttatggtaaccaggagagcaagttaataattttggcaagtcaaggacccattgaattggtccgaatcatgagatcttacgattatgagaagttgttgtggactacttctagagttctgaaagttctttcagtttgtgccagtaacaaacctgctatagttgaagcaggaggaatgcaagctttggcaatgcacttgggaaatccaagcacaagattggttcaaaattgtctttggacattgagaaatctttcagatgctgctacaaaagttgatggtctagaaagcttattgcaatctttggtacaagtattagcatcttctgatgtcaatgtagtgacatgtgctgctggtattctttccaatctgacttgtaacaatcagcgcaataaagtaactgtgtgccaagtgggaggggttgatgcacttgtgcgcactatagtcagtgcaggagatagagaagaaatcacggaaccagctgtttgtgcactgcgtcatttgacatccagacatgtggaatcagaaatggcacagaatgctgttagactcaactacggcatgcagattatagtaaaactgttgaacccaccttcccgttggccattggtgaaagcagtgattggtttgatcagaaatttggctttatgtcctgccaatcatgccccattgagagaacatggtgccatacatcatcttgtacagctgctaatgagagctttccaagatacacagagacaaagagcaagtgttgcgagtggcggcagccaaccacctggcacatacgcagatggtgtgagaatggaagaaattgtggagggtacagtgggagctcttcacattctgtcaagagagtcccataatcgtgccataataagacagcagatggttgtacccatatttgtgcagctactctttaatgatattgaaaacatccaacgtgttgcagcaggagtactttgtgaattagcagctgataaagaaggagctgagatgatagaacaagaaggagccactgcacccttgactgagcttttacattcaagaaatgaaggtgttgctacatatgcagcagctgttttattcagaatgagtgaagataaaccgcaggactataagaaacgactgtctatggagttaacgaactctttgtttagagaagagaacctctggaatccagacctagggatgggccctgatttacaggatatattgagtccagatcaagcttacgacaatatgtatgcacaaggtccccctagtgttcacagcagccacggcggtaggccttaccagcaacaagggtatgaccagatacccatagatatgcaaggtctagatattggctcccatggaggcggaaatgggtcgacctatagcgcaatcgacgccatggatgttaccagcggggatccggatcttaacttcgatactattgatcaacttcccacccctcctcaagataataaccacgccgcagcttggtacgatacagacctgtaa

SEQ ID NO: 409 - DNA, 819 bp, Diabrotica barberi
atggcccgaaacgccgaaaaagcgatgacaacattagctcgatggagagcagcccaactgggtgaaatagataagcacaaaaagcgaagaccttaccttgcatcagaatgtaaaaatttacatgcttgtgaaaaatggagaatgcagataataagagaaattgccaagaaagtagctcaaattcaaaatgctggacttggagaatttaggataagagacttaaatgatgaaataaataaactactgagggagaaacggcattgggaggatcaaataaaggaattaggtgggcctgactatcagagagttggtccacggatgttggatcatgaagggaaagaagtacctggaaatagggggtataaatactttggggcggctaaggaattaccaggtgttcgagaactttttgagcaggagccgcctcctcctccaaggaaaagtagagcagaactaatgaaagacattgatgcggactactatggatacatggacgacgatgacggaattttgattccattggaagttaaagctgaaaaaacagccgttcaaaatgcagtagctgagtgggttagtaaaaaagaacaaaatttggagaacgcagagaaccaaacagaagaagaaagtatatatgcagttcaggagtctgacgatgaagaaagtaaagaaactgtacaacagttagtggatggatcacagcaaagatttgttgcacatgtacctgtaccatctcaacaagatatcgaacaggccctactgaggcgaagaaaacttgaacttatggaaaaatacggtgtagaagaggaaccgaaatcgtag

SEQ ID NO: 410 - DNA, 648 bp, Diabrotica barberi
atggctggcgaacaagatatgcccaccttcaaatgcgtcttggtcggagacggaggtactggcaaaactacctttgtaaaaagacacatgactggtgaattcgaaaagaaatatgtagccaccttaggagtagaagttcaccctttagttttccacacaaatagaggacaaattcgttttaatgtatgggacacagcaggccaagaaaagtttggtggtctgcgtgatggatactacatccaaggacaatgtgccataattatgttcgacgttacatctagagtcacttacaaaaatgttccaaactggcacagagatcttgttagagtttgtgaaaatatcccaattgtattgtgtggtaacaaagttgacatcaaagataggaaagttaaggcaaagagcattgtcttccacaggaagaagaatttacaatactatgacatctctgcaaaatccaactacaacttcgaaaaacccttcttgtggttggctaggaaactcattggagatcccaacttagaattcgtagctgcacctgccttgcttcctccagaagtccagatggatccccaatggcagcaacaaatcgaaaaggatcttaaagaagcctcagaaactgcactgcccgatgatgacgaagatttataa

SEQ ID NO: 411 - DNA, 2508 bp, Diabrotica barberi
atgcctagaataatgataaaaggtggtgtttggagaaacaccgaggatgaaattctcaaagctgctgttatgaaatatggcaaaaaccagtggtctaggatagcttcgctacttcacagaaagtctgcaaaacagtgtaaagcccgttggttcgagtggttagatcccagcattaaaaaaactgaatggtctagagaggaagatgaaaaactgttacatttggctaaacttatgcctacacagtggagaacaattgctcccattattggaagaaccgcagcacagtgtttggaaagatatgaatatttactggatcaagcgcaaaagaaagaagaaggtgaggatgcagtggatgatcccaggaagctgaaacctggagagattgacccaaatccagagacaaagcctgcaaggcctgatcccaaagatatggatgaagatgaattagagatgttatctgaagctagagctagattagccaatactcaaggcaaaaaagctaagaggaaggctcgtgagaaacaattggaagaggctagaagattggctgctcttcagaaacgcagagagctgagagctgccggaatagaagttacatctcgtagaaagaaaaaacgaggagtagactacaatgctgaaataccgttcgaaaagaggccagcgattggattttatgacacgtccaatgaagtattagatcctatggctcccgatttttcaaaaatgaggcagcaacacttggatggggagctgagaagtgaacaagaggagagagaacgtaagaaagataaacagaaactaaagcagcgcaaggaaaacgacattcctcaagctatgttacaaaaccaggaaccagctaagaaacgatccaagttagtgcttccggaaccacaaatttcagaccaggaaatgcaccaagtggtgaagttgggcaaagcgagtgaagcagctagggaaatagttacagaaagcggtgttgaaaccactgacactttgttgaatgattatactttcaatcctcaagcggctgctacaccaaggactccggcgccccagactgataggatattgcaagaagctcagaacatgatggcgctcacacacgtagatacgcctctcaaaggcggcattaacactccgctacacaattcagatttcagcggggttctaccccaagctcagaccgtcagtaccccgaataccgtgcttgctacgcccttcagatccagtaggagtgacggagctggcactcctggcagtagcgttggatttatgacgcctagaagtggcgctttggtgcctgtggggaagacgccggtaggaatgacgccttcggttagggataaacttagtattaatccagaggaagcaatggacgtaggaagcacaccagccgagcacagaatgtaccaaatgtcgatgaaagatcaattaaaaatggggttgagcagtctaccacaaccgaaaaacgactatgaaatcgtggtgcccgaaaatgaagaccaggaggaacccgagcaagctcagtcacaaatgatcgaagatcaagctgatgtagatgcgcggaaacaagaagagctcaaggctaaagcagccagggagctggcgctccgttctcaagtcatccaacgtgatctaccgagacctcaagaagtgaacatgaccgtccttcgaccatcccacgagagctattccttatccgatctgcagcgagccgaagagctcatcaaacgcgagatggtgactatgttacatttcgataaccttaagaatccggttccgacgcagagtaagaggtccaatatgtcgcaggctcatcaattggcctttttggagcagcatccgtatgagtcgttcaggaaagaagatttagaggcggccaaggggatattgaagagggaaatggaggtggttaggaatggtatgaatcacggggagttgcctatcgaagtctacactcaggtgtgggaagaatgcttaagccaagttctgttcctcccgaaccaaacgagatacactcgagccaacttagctagtaaaaaagacagactggaatcggcggaaaaaaggctcgaacagaacagatctcacatggcgaaagaagccaaacgagctgccaaaatggagaaaaaattgaagattttaacaggcgggtaccagtccagagcgcaggtgttgatcaaacaattacaagattgttatgagaacctagattcgactaatttagaattgaatacgttcaagtttctgcaagaacaagaaaaatctgctctaccaagaagaatacagtctctcactgaagacgtcagtcgacaaacagaacgagaacgaggcttgcaaaagaaatacggcgatcttcaagcagaaataaaatacttacaagaatcatacctgagtcagcttcaaaaagaacagagaaaggaagctgataatacagctaacgaggtttcttccactaccaatggagaactcaacgcagaagcagccgatgatgatgaagatatgtag

SEQ ID NO: 412 - DNA, 474 bp, Diabrotica barberi
atgatgcaattcatgttattattcagtagacaaggtaaactaaggttacaaaaatggtatgtggctcatccagacaaactcaagaaaaaaattacaagagaattaatcacaaccattttagctagaaaacctaaaatgtgtagttttctggagtggagagacttaaaaattgtttacaaaagatatgcaagtttgtatttttgctgtgcaattgaacaatgtgacaatgaactcctaaccctggaaattatacaccgttatgtagagctccttgataaatattttggaagtgtttgtgagttagatataatcttcaactttgagaaagcctactttatattggatgagctgatgctagggggtgaagttcaggagacaagtaaaaagaatgttttgaaagccattgctgcccaggatctattacaagaggaggaaactccgcagggatttttcgacgaccatggtcttggttag

SEQ ID NO: 413 - DNA, 1251 bp, Diabrotica barberi
atgtatggattacagagaatttcataccgaatctatattcgcaatgggtttcgacattattcccaacaacctgcaaagaggaattcctttatcggccggctctttgaaaatttcaaagatgagatggccaagaacaaagaaatgaaagaatccctgaaaaaatttcgagaggaagctcaaaaattagaacaaagtgatgcactaaaagcagctagacagaaatttgaaagtgtagaaaaagaagctagtaaaggtagcgaagtttttaaagaaagtttaggttctgttaaggaaaggcttaaaggagttatagatgaagctagtaagtcagatttagcaaagaaggctggcaaattcacagaagaagttggtaaaactacacataaaattagtgaaacagctcaagaaattagtaaaactggagcgtttcaaagtatatctcaagctactaaggctgttaaacaagaaatagacaatactagtatagaaggtagagtatatgttagtcctaaaatactacggaagagaacagaaacaagtgcagttgtccatcaaaaatattatgaaccaaacacagatgctacaggtgttgaactacacaaagattctaagttttatgaatcttggcaaaatttcaaagataacaatccatatgtacataaagttatggactggaaattaaaatacgatgaaagtgaaaatcctgtcatccgtgcttccagagctctaacagaaaaagttggtgatatcatgggtggtttatttcagaaaacggaactatctgaaacacttacagaaatctgtaagatagatcctgcgtttgataccaaaagatttctgaaacaatgtgagacagatattattcccaatattcttgaagccatgacgagaggagagttagaagttcttaaagattggtgtcatgaaggcccattcaatctttttgctgttcctataaaagaagcctataaaaagggatacaaaattgaatcaaaaattttagatatcgatcatgtggatttagtcttgggcaaagtgatggaccaagggccagttttgataatatcttttacatcccagcaagttatggctgtccgagatgccgcaggtggagttgtcgagggagatcctgacaaagtaatgagagttaactatgtatgggtactatgcagagatgtcacagaacctgatcctagagcggcatggaggctgcttgatctttcagccagcagcaacgaacaactggtttaa

SEQ ID NO: 414 - DNA, 930 bp, Diabrotica barberi
atgagttctgattcagaactaagtgatagcgacattgagctccaacaagcatttgcagatggtaagcttcaacctggcttaaatactgtggaagaaggaccaaaacagttcacaaataatgtgagtggtttaaaacaaaaattagaagaaataaaactgaagttaccatggatagaacgactggactgtgtaaatgcacaagcccctttagcacctgaattagcagctcaaatgttgacccacgaggaaaaaagaagtaatgagcttaaaaataataaaaagctcacacagtttactccaagtgaagacccggttttaaacgactttaaaagagaaatgatgttccacagacaagcccaggctgccattctagattctataccaaagctaaaagatatgggaatactaactaaaaggcctgacgattactttgcagaaatggcgaaaacggatgcccatatgcagaagattagggaacatcttatgacgaaacaggagcaacagaagagaagtgaacgagtcaaacaacttagacagcaacgaaaagaaggtaaaatgttacaagttcagacaaaacttcaaagacaacaagaaaagaaagatatgcttgctcaggttaaaaaagtaagaaagggaatgtccaaagatcttgacttccttgacggaaaaaataaatctgctgccaaaaaaatggcagaaaaacggaaaatgaaagacaaaaagttcggtttcggtggcaagaaaaagggaatgaaaaggaacacaagagatagtgctgcagatataagtgaatttaaaaatcctggtaaacctggaaaaaaatttaacaatagtggaaaaggggtaaaaggtggtaaaatgggccaaggggcgaaacaaagaatgggtaaaagtaaaaggattaaaatgagatctaaaggaaggaagtga

SEQ ID NO: 415 - DNA, 2052 bp, Diabrotica barberi
atgaatccaggcgccccaaattaccccatggcgtctttgtacgttggggatttacactctgatattactgaggccatgctttttgagaaattttcaactgcgggccctgttctttcgattcgcgtttgcagagacttgattacacgtagatccttgggttatgcgtacgtaaatttccagcaacctgctgatgctgagcgtgcgctggatacaatgaactttgacttgattaaaggacgtcccatcagaataatgtggtctcaacgagatccatcattgagaaaatctggtgttgggaatgtttttattaagaatttggatcgttccattgacaacaaggctatgtatgatactttctcagcttttggtaacattcttagttgtaaggtagctcaagatgaaaacggctccagtaaaggatatgggtttgtacattttgaaactgaagaagctgcaaataaatctattgaaaaggtaaatggtatgttgttaaatggaaaaaaagtatatgttggccgctttattccacgcaaagaaagagaaaaggaactgggagaaaaggccaaacttttcacaaatgtatatgttaaaaattttggtgaagatttatctgaggaagagttgcggaatatgtttgaaaaatatggtaaaattaccagctacaagataatgagtaaagatgatggtaaatctaaaggctttggctttgttgcatttgaaaatccagaggcagctgaaacagcagtagaagcattgaatggaaaagagttgatggaaggaaaacctttgtatgtaggaagagcccaaaagaaagctgagcgccagcaagaactaaaacgtcgatttgaagcccttaaaatggaaagacttaatcgttatcagggtgtaaatctctatgttaaaaacttggatgatactatagacgacgaacgtctccgtaaagaattctctccgttcggaaccataacttctgccaaagtaatgatggaagaaggtagaagcaagggttttggtttcgtctgcttttcctccccggaagaagctacaaaagcagtaacggagatgaacggcagaattgtcggtacgaagcctttatatgttgccttagctcagcgtaaagaagatcgcaaagcacatttaacatctcagtacatgcagcgcatggccaatatgcgcatgcaccagatgggtcagttcattcaaccaggtgcgtctagcggctatttcgttccaaccattcctaccgcacagagattctatggaccagcccagatggctcagattcgtaccagtcccagatggcctgcccaaacacctgtaagaccaggtgctcaaggaggagctactgcctacactggcatgccaaacacttacagagcggctactcgtccaccaaaccagtcaacaacaatgcgtagcaacatcagtgtacctagaccaattactggacaacaacctcaaagtggcgtcgtaccttcaactggtcgaacagcaaacttcaagtatacttcgaacatgagaaatccaccacgagctactgcctacactggcatgccaaacacttacagagcggctactcgtccaccaaaccagtcaacaacaatgcgtagcaacatcagtgtacctagaccaattactggacaacaacctcaaagtggagttgtaccttccgctggccgcacagcaaacttcaaatatacttcgaacatgagaaatccacctcaatccatgggaggtataccaggaactgcggctcctgtacagcaagctgtacacatccagggtcaagagccacttacagcaacaatgttggctgctgctcccccccaagaacaaaaacagatgttgggtgaaagattgtttccacttatccaacgcatgtatgcagatatggcaggtaaaatcactggtatgttgttggaaattgacaatactgagttgttgcacatgttggaacaccaggagtcgcttaagaataaagtggaagaagcagttgctgtactacaagcccatcaagccaaacaggctgctacacagattaaaaaagattag

SEQ ID NO: 416 - DNA, 2556 bp, Diabrotica barberi
atgaccgactcaaaatattttactactaccaaaaagggagaaatatttgaattaaagtcagagctaaataatgataaaaaggagaagaaaaaagaagctgttaaaaaggttattgcctctatgacagtaggcaaagatgtttcagctttatttccagatgtcgtaaactgcatgcagactgataatttggagctcaaaaagctagtttatttatatttaatgaactatgctaaatctcaacctgacatggctattatggcagtaaatacttttgtaaaggactgtgaagatcccaatcctctaataagagcacttgctgttagaacaatgggttgtattagagtagataaaatcactgaatatctttgtgagccattgaggaaatgtctaaaagatgaagatccttatgtaagaaaaacagcagctgtttgtgttgccaaattatatgacatttcgtcaggtttggtagaggatcaaggctttttagaacagctaaaagaattgttaagtgattctaaccctatggtagttgctaatgctgtcgcagctttatccgagataaatgaaagcagtcctactggtcaacctctagttgaactcagtacaaacactattaacaaacttcttaccgccctaaacgaatgtaccgaatggggccaagtattcatcctcgattccctttcaaattacacccctcgtgatgagcgcgaggcccaaagtatttgtgaacgtattactccgagattagcgcatgctaatgctgctgtggttttgtctgctgttaaagttttgatcaaaatgatggagattctagctggagatactgatttctgcaatactttaagcaagaaactagctcctccactggtgacgttgcttagttctgaaccagaagtgcagtacgtggcattaaggaatatcaacttaattgttcagaagaaacctgacatacttaaacatgagatgaaagtatttttcgtcaaatacaatgatccaatctacgttaaattggaaaagttggacataatgatccgtctagcatctcaagtcaacattgctcaagtcctcagtgaactaaaggagtatgctactgaagttgatgtagatttcgtcaggaaggcagttagagctattggtagatgtgccatcaaagttgaaccttcggcagaaagatgtgtggctacacttttggatcttattcaaacaaaagtcaactacgttgttcaagaagctattgttgttatcaaggatatatttagaaaatatcccaataagtatgaaagtattatcagtacactttgcgaaaatttggatacccttgatgagcccgaagctagagccagtatggtatggattattggagaatatgcagaaagaattgacaatgctgatgaactattggacagttttctggaaggttttggagatgaaaatgctcaagtacagttgcaattattgacagctgttgtcaaactgtttttgaaacgccctcaacatacgcaaggtttagttcagcatgtgctaagtttagctacacaggattccgataacccagatctaagagaccgtggttttatctattggaggttgttgagtactgatcctgcagcagccaaagaagtagttctagcagacaaacctctgatttctgaagaaaccgatctactagaacctacacttcttgacgaactgatctgccatatatcttccctcgccagtgtttatcacaaacccccaactgccttcgtcgaaggaagatctgcaggtatccgcaagtctttgccagctagacaaggatctgctgaagacactagtagcgctccagaaccaaccgttattcctaatcaagagagtcttatcggtgacttgctatcaatggatcttaatgctccagctcctgcggctgcacaagcagctgtaccagccagtaatgtagatctcttaggtggaggattggattctttgttggatattggtaccactcccgcacctcccacttctacgggacttcttggtgacatttttggaataccaactgctccaaccatgtatacaccacccaaaactatatggttaccggctgaaaaaggtaaaggattggaaatacatggagcgttttcaagaagagctgggcagatgtcaatggatttgacattcaccaataaagccatgcaggcgatgtctgccttcgctattcagttcaacaaaaacagcttcggtatagttcccggctcaccactcaccgtgcctgcgcttcagcccggacagagcttggaatacaatttagcgttggccactactggaccagtacaacgtatggatccactcactactctccaagtggcaatcaaaaacaacgtcgatatcttctattacgcctgccaaattcccattcagattctgttcaccgaagacggcactttggataagagggtgttccttactacttggagagacattccggcagctaatgaggtccaatacactgttaatgatgtcaaaggaaacacagatggagtttctagcaaaatgacactgaataacatctttaccata

SEQ ID NO: 417 - DNA, 498 bp, Diabrotica barberi
atgccacccaagttcgatcccaccgaaattaaatatgtttacatgagatgtgtcggaggagaagttggagctacctcttctttggctcctaaaattggtcctctaggtttgtctcccaaaaaagttggtgacgatattgccaaaggtactgctgattggaaaggtcttaaaatcacagtacaattgaaaatccaaaatcgtcaagctaccatttctgtagtcccatctgcctcctccctgatcattagggctcttaaagaaccaccacgcgataggaagaagcaaaagaacattaaacacactggtaacattactttcgatgaaataattgctattgccagacagatgaggcccaggtcgatggccaaacagttatccggaactgtaaaagaggttttaggaacagcccaatcagttggatgtacaattgatggtaaagcagcacatgatgttattgatgaggttaatgaaggaaccatagaagtaccagatgaataa

SEQ ID NO: 418 - DNA, 1095 bp, Diabrotica barberi
atgccagaagaaggaaaaagggcattaattttggttggaggttatggtaccagattgagacctctaactttgagtagacccaaacctcttgtagaatttgcaaataaacccattctccttcatcaaatagaagcacttgtagatgctggagttactgaagttatattagcagtatcatatcgtgctaagcaaatggaagaagagttgacagtggaagccaaaaaattgggaattaatataatattttcccatgaaacagaacctttaggtacagcgggaccaattgcattagccagggatcatctttctaaaagcactaaaccattctttgtgttaaattccgatattatttgcgacttcccatttaaagccttggccgaattccataaaaaccacggaaaggaaggtacaatagtggttactaaagtggaagaaccgtcaaaatatggtgtagtagtttatgataaagacaacagcatccaaagttttgtagaaaaacctcaagaattcatttctaataaaattaatgctggtttgtacattctaaatccaagtgtcattaacaggatagaattaaaaccaacttctattgagaaagaagtatttccttacatggctgctgataaacagttgtatgcatttgaattggaaggtttttggatggatgttggtcaaccaaaagattttctgacaggaatgtgtttatatctcaaacatttaaggcagacaaatgaagacaaactttataaaggaccaggtgtcgttggcaatgtattagtagatcctactgctaaaattggaaacaattgtcaaatcgggcctaatgttacaataggaccaggtgttgttatagaagatggggtatgtataaaaagatctacaattcttaaagatgctaccattagttcaaattcttggttagaaagctgtattgttggatggaagtgttgtgttgggagatgggtaagaatggagggttccacagtactaggagaagatgttatagttaaagatgaaacgtacattaatggaggtcaagtgttgcctcataaaaatatcgctacttcagttccagaacctcagattattatgtga

SEQ ID NO: 419 - DNA, 915 bp, Diabrotica barberi
ctaaacatggcgtcagacggggacgacgttattagtgaccaagaaaaagtgaaaatagtatcggattttattctccattcgccacccggtgaatttaatgaggtatttaatgatgttagaaaacttttaaacgacgatgacctcttaaaagaaggtgccagcggggcattcgcccagtataacaaagatcaactgacccccgttaaaatagaaaacgccgatcatttagtgcttattacggaatacaacgatttagggaataatagattcttcgaccccaggagtaagcagagttttacctacgatcacctgagaaaagaagccttagactaccaagtctatacccccgatagcgcttctgagccttggcgggcagccttagactcagagttcattcagtacactaggaaccattacaaagatggagtatgtagtgtggtaggccgcaaccagagcggggttgttaacttaacggcatgtatcgaagaccatcagttctctccgaagaactactggaatgggagagaagaccaccagttctctccgaagaactactggaatgggagatggagatcgcagtggtccattagtctaactgatgattccactgctgaggtgagaggtgtactcaaagtacaggtccattattatgaagagggtaatgtacaattagtaagtactaaagaaataaaagaaactgttcctgtttcatctgaggcacaaactgctaaagaaatcatccaagtaatagaagccgctgaggatctctatcagacggcaatttcagaaaactaccagaacatgtcagatacaaccttcaaggccctacgaagacttcttcctgtcaccaggacaaaaatggattggaataaaatcgtatcctatagcattggtaaagaactcaaaacgcaatga

SEQ ID NO: 420 - DNA, 4068 bp, Diabrotica barberi
atgtggttaaagtactttgttatttttgttttgtttagtgttagcgttaaaggactagatggtgatcttccaccagatgttgaaactatcgatgtggagcctaccaatgtaagtaacgcggatccagatgcagggaaacctattccggtggaagatacacctaatggagccgctccagttaatccaaactatgaagtagataaatccttagttaatgtaaccaatagtttggtaaatgtgactaaaaatcccagacggacttatcagacagttaacaaactgggcaaatattcgacattttatgctgcagattacgatcctatgacctcagacacagctccaccagacactgaccaacgaggaggaggaactccatacactataacagaaacaagactggcagaaataaggaaacattttatgtacccatttttcgataaaggaggcagtgataataacttgggagatttccaaaaggacattcaatcttccattcctcaggtgcacaagaatttaaacttccagttgcctttctttggattcagatataattacacgagagtttcagtgaatgggtatctggaattcagcgatccacctccaaattatgactatccattagtatttccaattaaagaatggcccaaaaagaatgatcctgcctttattggtattttcttcagcagatgcagaatcggtaatctgcgtgatggagacattgaccaaagaacacccggggtctattttagaatggaaagagatttaagaacgaggcaagacagaatgggtgtagaaattagagaaagacttaagtgggacatcagaacaggagtcattggatcagaaacattcgatcctaagcacgccgttattgtcacttggaaaaacgtttctttcactggaggattcgctaatgctaaatacaagacaaacaccttccaaatggttcttgcaactgacgaagtcttcacttacgcgatgttcaactacctcaacttggactggacctcccacactgaagcgggtggtgattcccaaaacggagaaggtggtgtcagtgcctatgttggttttaacgctggaaacggtaccagaagctacgaatacaatccttacagtcaagcttccgtcattcgagatctcactgcagttggatttggaaatggttttaagggaagacatattttccgtatagacgaagacattttgcttggatcatgcaacaaagatatagatggtgccaaccttcccctgaaattcgctcctgaaagtggtaacatgttgggtggaacagtggtaaatataactggtccatgcttcaatttgaatgataggattcgatgcaagtttgacgtatcaaatgaagtatttgggtatgttgttgataaaaacagagcgatctgtgtacaacctcaactttatgccgaaggatgggtgaatcttcaaattgctgttaattccgaagcattcaagtggaaggggaagtattatgtagaatctcctgctagtgcgactcaaaaaatcttcttcaaggacatgaaattacacgaaaaatctccgagcgaattaaaaatcacttgggagaagcagaatttgaccacaaacgacaacgctaatattcgaatttctctctggggttacagagaaacaactatgaaaccagtgtttgtttatatcaccgatatcgcagataatgttcaaaacattggagaatacacgattgttccttctcagtttagaactaaagtgaaccaatatttgactgatattaagtttggattcctccaaattaatttaactgagtctatcaaagttaatacatatactacaagccagagcagcatagaattaacaccggtagtatggagccgacccattccactcggttggtacttccagttccaatgggaaaaccagtacggtaaaaattggcccaaatatttatgtgacgattggctgagaacggacagatatctaaagaacttcgctcacgaacttgctcaatgtccctgcaccgtcgaacaagctctagctgacaagggcaggtttatgccagacttcgattgcgacaaagattcgaacccgatttgttactataacaaccaagcacttcattgtgtgaaaactggatctcccactttagaaggctccgaacaacaatgttgctatgataaaaacggctttttgatgctctcttacgatcaacaatggggttctagtcccagacgttgccacaacttgggtaaaatgccttacaacgaagcgacaaaagtgcctactctctcacaatggtttaatgacatggtacccaaatatttgtgttgtctttggcaagacgagcaagctgtgggatgtgaaacactgagatttgaacgtagacctacacaggattgtgtagcttaccaagcaccaggtgtagcaggagtctacggtgatccacactttgttactttcgacgatgtagaatatacgtttaatggaaaaggagaattcgcattggtgaaatcagttacgcaaacggacaatctggaaatccaaggaagatttgagcaaatggaccctaacacttatggtgaggttagagctactcagctgacttctgtagtagctaaaggtaataacacaatagcaattgaagtcagaaggagacctctagattctagatggagatataggttggatgttatagcagataatagaagactttattttgatagaccctcactaaaattccagcacttccaaggtgttactatttacactccaacctacattcttaatcaatcagaagtcatcattatgtttgacaatggagctggaatggaggttgtcgacaatcaaggattcatgagtgcaagagtatttttgccttggtcgtttataaataaaaccataggcctttttggaaattggagtttcaacaaagaagatgacttcacacttccagatggttctagagcagcaatagtcaataacataaatgacatggaaagggtttacaatgattttggttccaaatggatgttggaggatgtgttagatcctcaaaagggtagagcgctgtttcacagggaattcggaagaacttcagcgacttacaacaacaaaacgttcaagcctcaattcctaatgaatccggaagatttcctaccaaccaacagatctacagatcttaagcgaatatccgaaatatgtcctctaaagttgtacgaatgttactacgattacgctatgacggttgacagggatttggcgcattacaccaagaattataaagccacgatctatcaatataaagaaacgacaaggaggaaagttgtgtcttgcggagtactagaaacaccgagattcggacgaaagagtactttcctgttcgtgcccggtacgaaggttacctatgaatgcatccaagagttcgtgttggtaggtgatcagcggagagagtgtcaagcggatggaacatggaatattcctgaatacggatacacatattgcttacgtcaagaagaatattcttcgcgtcaagctgccatcacttcaggtataatcctcgcaattatcataccattggttcttctaataggttacggtggctacaaagtatatcaaagactaacaagtaacaatcaaaactatgactacgacaccgtacaaaagactcaaaatctccaacaattcagtcgaactttaagtccatacagagaagaagacgaggacgaaaagtatcctcaaagcgacactgactcgcttagcaagaaacgaagaagttacgacaagtcctacagaactcacgaacctttgcccaatagaccgaattctgagttcgaggagaagccattggacccttacgatcaaaccttcgaagacgatagggtttctagaacgcctaccggaagtccaactagtcctacttctagtattcaatatacaacgccttatagtcgaccagacattattagagggaacagctcaaagaatttgaactataacgacatgtatgcagaaccaataaagaaacctaaagaaaggattagcgctagtcagagtagtatagtgacagacgtttag

SEQ ID NO: 421 - DNA, 462 bp, Diabrotica barberi
agattttttcaagatctgcagcattgggagaggctttgccgcccaaaacggccaataagtaagcagccacgtaacgcatttttaagtcggtatacacgtttcgtgtctcaagacttaaaaatgcgttacgtggctgcttacttattggccgttttgggcggcaaagcctctcccaatgctgcagatcttgaaaaaatcttgggatctgtaggtgttgaagctgaaggagaaagagtaaagaaagtcatcagcgagctcagtggcaagtctgttgaagaactcattgctcaaggtcgtgaaaagttgagctccatgccagttggtggtggtgccccagctgctgccggaggtgccgctgctgctgctccagctgctgaagaaaagaaagaggccaagaaggaagaaaagaaggttgaatctgaatcagaagacgacgacatgggctttgctctattcgactag

SEQ ID NO: 422 - DNA, 2724 bp, Diabrotica barberi
atgatgactgaccgcttcggtttaaaatgggacccgaaaaacttagagataagaaccatgtctgtggaaaagacattggaacccctagtgcttcaagttaccaccctcgtcaataccaaggggcctagcaaaaagaagaaaggaaagtctaaacgtgccaatgctctggttagtactgttgaaaaagccacggaaaacttcatagaaaagggggagcagatagcctatgagaacccagatattaccgaggaaatgctggcagccgttgacgaagtcaagaaaacgggacatgctatgagcggagctgcaagagaattttcagaagacccatgctcttctttaaaaagaggaaatatggttagggctgctagaaatcttttatcggctgtaactcgtcttttaattctagcggacatggttgatgtccaccttttgctcaaatccttacatgtagttgaggacgacctcgaaaaactaaaaaatgcttcaagcaatggcgaacttttagacaatattaaagcctttggtcaaaatgccaacgaattaatgaatcaggctgctaaaaggcagcaagaactgaaagatccacaacttcgtgatgatctagcagctgctagagctgtacttaagaaacattccactatgttattaactgcctctaaggtttatgtacgtcatccagagctagcagctgccaaagcaaatagagattatgtcttgaaacaagtttgtgaagctgtgaataccattaatgatgtagctcagggaagaactcctcaacctgcttctggaccatatgatggacctggagagttggctgctgctttggatgattttgatgatcacatggtaatggagcctctagcatacaatgaagttcataccagaccttcattggaagaacgtctagaaagcattataagtggcgcagctcttatggcagattctagttgtactagggatgaaagaagggaaaggatagttgcagagtgtaatgctgtaagacaagctttgcaagacttgttgactgaatatatgacaaatatgggcaataaagataaaagtgagagcctagtacgagcaatcgacaatatgggtagaaagactaaggatttaagaagacaactgaggaaagctgttgtagatcatgtatctgacagtttcttggaaaccaacgtacctcttctcgttttaataaaggcagctcaaaatggcaacgaaaaggaggtagaagaatatgcagttgtatttactgaacattccaataagttagtagaagttgctaaccttgtctgcagcatgtctaataatgaagatggtgtcaaaatggttagatatgctgctgctcaaatcgacaatctgtgtcctgaagtaataaatgcagctagaattttagccgctagacctcgcagtaaagttgctcaagaaaatatggacgcattcaagcaatcatgggagaatcaagtgagacttctgactgaagcagtcgatgacattactactatcgacgactttttggctgtttctgaaaaccatattctggaagatgttaataaatgtgtacttgccttgcaagaaggtgattctgacacattggatcgcactgccagtggtataagaggaagatctaatagggtgtgcaatgtagtaacagctgaaatggataattacgaaccttgcatctataccaaacgtgttcttgaagccgtcaaagtattaaatgatcaagtgatgcccaagtttacgcaaagagtgcaagttgcagtccaagctttgggaaatagtcctcccaaagaagtggatgaaaacgattttatcgatgcttctagacttgtttacgatggagtaagagaaataagaagagccgttctaatgaatagagccgatgaagatttagatccagaagatgtcgaattggatgaaaactatctgatagaaacaagaagcaaatcgagtgctcacacaggcgaacatggggttgatgagtacccagatattagtggaattacaacggctagggaagctatgggtaaaatgccagaagaagataaacagaagattttgcaacaggttgagttcttcaggagtgaaaaactcaagtttgaccgtgaggtcgctaaatgggacgacactggcaacgatattatcgttcttgctaagcacatgtgtatgattatgatggaaatgacagattttaccaggggtcgtggccctctaaaaaccactatggacgttattaatgcggctaaaaagatttccgaagctggaaccaaattagataaacttactcgccaaatagctgaacagtgcccagagagttccaccaaaaaagatttgttggcttatttgcaacgtattgctctttactgccaccagatgaacattacatcaaaggttaaagccgatgttcaaaacatcagtggagaacttattgtatctgggttggacagtgctacttctttgattcaagctgctaagaacttgatgaatgctgtagttctcacagtaaaggcttcatacgtggcatccaccaaatacccaagacaaggaactattgcatcgccgattgttgtctggaagatgaaagcgccagagaagaaaccgttagtcagaccagagaaacccgaagaagttcgtgccaaagtacgcaaaggctcacaaaagaaagttcaaaatccaattcacgctctttctgaattccaaagcccaactgagtctgtgtaa

SEQ ID NO: 423 - DNA, 1236 bp, Diabrotica barberi
atgtcgttctcgttcggagccactccaacaccacctcaaaaaaccgttgcctccggttttactttaccttcaaatccaatagtaacttcaactactggatttcaaagcagttttggttcaggagataataaagaccaaagtaaaccgtcattatttgcaactccctcaagtcaacctgtttcatttgggttaactacaaaggccactacagccccaacaaccctctcctttggttttgctactcctacgactgtaccgtttggatcatcaactacaattacacctgcaacaactcctcaatttggattatcgcttccaaaggctagtgctccggccactactactttttcacttctaggatctgccccagccactactgcagcagcacctacaggtatatcatttggtactgccactactacagcaacaacttcagctacaggtttatcatttggaactccaattggaactgctacaactacagcaacaacttcagcttcaggtttatctttcggtcttacaacagcgtcttctacaagttctgctgcacctacacttttgtcatcaacaaccacttcgacaacgtcatcagtgtctgcatctggtgctttgagtagtacaacatcagcaccgacttttgccacctcatcgttgtcttcaacaggcgccttaacattctctcaactcgaagattcgatcaacaaatggaccatggatctagaagaacaaggaaaattcttcatcaaccaggctaagcaattaaatgcatgggatactttacttatatccaatggagagaaaattttaacccttaacagtagcatcgagaaagtcaagcaacaacagcaacagttagaccaagaattagacttcgtgctggcacagcaaaaggaattggaagagctgattgtaccgatagaaaaagaattgctggggatacctgttacggatatcgatagaaatcaaatgtaccaattttcggaaatagtcgattcacaattaaaacagatgtctgatgatttgaaggaagtcattgaacacataaatgaagccaataaagaggaagaagcgtcaaatccactaagccaaatcagtcgcatattaaatgcgcatatgaattcgttgcaatggatcgataggagtacagctcagattagctctcatctagaacaaattggaaaaatgcaagattcaaacagaagaaatcactcgtttaataattccatgaacttttag

SEQ ID NO: 424 - DNA, 582 bp, Diabrotica barberi
atgtttctgtgggactggtttacgggaatgctgggatatctaggattatggaagaaatctggaaaactattattcttaggactggataacgcaggcaaaactacccttctacatatgctcaaggatgacagactggcccaacatcttcccacgttacatcccacatcagaggagctttccattggtaacatgaggtttacgacgttcgatttggggggccacgagcaggctaggagagtgtggagggactactttccagcagtggatgccatagtgttccttgttgatgccaacgacagctcaagatttgtagaaagccaggaacagctaaatgccctcctctcagacgaaactctatcaaactgtccaatacttatcttaggtaataaaattgatctcccaggtgctgcttcggaagatgaattacgaactagattcggcttgtttggccaaaccacaggcaaaggcaaagtagccagaaacgatctacctggtaggcctctagaactatttatgtgctctatactcaaaagacaaggttatggagaaggtttccgttggttggcacaatatatcgattaa

SEQ ID NO: 425 - DNA, 573 bp, Diabrotica barberi
atggaggaaattaacctggatttgttggagaagcgtatagaagctttggaattaaaggtgtttccttcaggagatcccagtaccattgccgacaaaaatcaaacaataacaaatatccttacacaagttcagacattcgttaccacagctctcacttgtagagaaacaataacttccatgttgcagttttatggaactttaaacgactatctcgacccagctggtggagcagatgaactggaggttgaggcaaaaagacattatatattgcagttacaccctgagatcaaagacaccctacagacacatactcgaattttgcagactttacttcccttcgttgaatcggaaaacatttctaaagtggttgaaatgacagctcaattggaagaggcatctgttagtcatctcagtttgtatggagagtggagagatacaatgtacaaaatggtggtagctctacaagatttcactgatataatgagttccattaaagtattgttctctcaattagataataccttgacgaatctggaatactcacttcaacctaaatttgttactgaggaatag

SEQ ID NO: 426 - DNA, 1749 bp, Diabrotica barberi
atgaataacacaaaaacgcaggaagtctacagcgacctaacattatttactactccagataagttcttcttggagcccaaaaatggggaggaattgcttgtgatagagagagtaactgaagagatttcagtttataaaaaccaccgtcacatcataccagcagctagtagtaggaaagatttctgtggcctcctaggtatcattaatctgttgtctgggccttatttagtaattgccacacagagggatatagtgggttatatatcaggttgtgcagtatggaggctagtaaaggcagaactaattcccttcaggagctccttaaacttaagtccagaaaaacaagccgacaatgaagtgtaccttagtatgatagaacaagttttaactacaccctttcagtatttctgttatgattacgacctgacacattcccttcagcgccttcgggacatttcaccggatttctggaaacagtccctgtgggaaagagccgatcaacgatttgtatggaatggattcctattgagccctttcagaaatgtgatcagcaaaaagttttgtctgccattgatcctagggtttgtttctattaacttttgtgttattaatgggcatagcttgaactggatcattgttacgaggaggagtgtttttagagcaggtaccagattattccgcagaggcatagacaaagacggaaacgttgctaattttgtcgaaactgaacaaatcgttgagtaccaaggcgatcatgcgagttttgttcaaattagaggctctattccacttttctggcagcaaaatcccgatttgcgtcttaaacctcctcctaccatgatcgatatggacccacaagagcaacattccacctgtttgaagcatctagaagaagtggcaactttatatggcaaagttgtgttagtcaatctcattgaccaaaagggagctgaaggtaacatggagaaatcctttaagaacgccatgaattcattgtcgtatccttcagcacgatacgaacctttcgacttccattctgaatgtagcaaaatgaggtgggaccgtctgaaaatcctcatagaccgtctagctctggaccaagatgaaatgggcttctttctcttattgcgggatggttccttaagctcgttacaagatggcgtcttcaggacgaactgcatagattgtttggacagaaccaatgtggtccaaagtatgctagcgcacagaaatttagaaatagttttaagaaagttgaatattttacaccaaaaccagaacttggagttccagtattccttcgaggttttgtttaagaatgtttgggcagacaacgcggatattataagtacacaatactcgggaaccggggctttaaaaacggattttactagaacaggtaaaaggactaaggctggagtttttcgagacggagtcaattcgcttactagatactacaaaaataatttaactgacgggtatcgccaggatgccatagatttgttcttagggtatggtaaaccgatatctccactaagagtagacaaatcgtggcgatatattacttacccttcagtgcttttagtcgctgtatccatgtttgtagcttctgctgtatttccttcggaatactcaaccgaatctcttctgtttttgttgttttggggttctatggtctacgccacattgcacaccatattcagatacggcgttgagttcgtggacagacctaggctcacgcagtcttag

SEQ ID NO: 427 - DNA, 1773 bp, Diabrotica barberi
atggcacctacaatacagcaaaacaaccaaaacggaacagccaatggcgttgagaaaagaccagtaaaaactgtagaaaaaaggtcggatttaatatgtaaagtgaagtactgtaacactttacctgatattcctttcgatttgaagtttatagcatatccttttgaacccataaggtttattcaatacaacccaacatcactagagcgtaattacaaatatgaagtgctaacagagcatgatttaggtgttagtattgatcttataaacaaagatatatatgctattgagccaggagctactctagatcctgccgatgaaaaattactagaagaagacattttaacacctcaggactcaaaaagatctcgccatcatgccaagtcagtatcctggttgcgaagaactgagtacatttcaacggaacagaccagattccagcctcagactatggacaaagttgaagctaaggtcggttatagtattaagaaatctcttaacaatgaaacattgtacatggacagagattctcagattaaggctattgaaaagacctttgaagactccaagaatgtcatcgagaagcattacagcaaaccaaatgtcgtagctgtggatattttgcctgtgtatccagatttcagcctttggaagtacccttgtgcccaagttatttttgattccgatccagctcctgttggcaagcaagtaccagctcagattgaagagatgtcgcaggctatgatcagaggtgtgatggacgaaagtggagaacaatttgttgcctactttttgcccacagaagatactcttcagaaacgaagggatgattttgtcaaccagataccatatcaagatgatgaggaatatgagtataagatggcaagagagtacaactggaatgtaaagagcaaggcaagcaaagggtatgaagaaaactacttctttgtggcaagaccagatggaatttattacaatgaactggagaccagagtaaggctgagtaagagaagggtcaaagctggtgctccacctagtaacacaaggcttattgtcaaacacagacccatggatgctaatgagttcagaatgcagaggtaccgagagaaacagctggaaccaccaggtgaagatgatgaggaaatggaggttgatgaaccacaagaagaagaagctactcaagaagaacaggaacaagagaagggggagaaatcaccatctcgctctagatctagatcaaactcatctaacagaagcagatctaggtccaaatcaagatccaagtctagatcaaaatcaaggtccaagtctagatcaaaatcaagatccaagtctaagtcacaatctagatccagatctagatctaaatctcgttccagatctagatctaaatctcgttccagatccccttcaagatcacgatcaagatctaaatcccgttccaagtccagatcccgctctaaatcgaagtctaaatcccggtcccgatcaaaatcccaatccaaatcgccttcgagatcaagatcaaggtctcgttctaagtcaaagtcgagatccagatctgcttcgggttctagatcaccatctggttccagatcgaggtctccttccaaatccaagtcaaggtccagatctaggtctagatcaggttctaaatctgcttccagatctagatcgtcttccaaagcttcttccaaatcgggatcaaggtccagatcaggatctcgatcaggatcaggctcaggatctgggtctggatctgaaagtgactaa

SEQ ID NO: 428 - DNA, 1170 bp, Diabrotica barberi
atgccgattgaaaatttagaagaccagggtcttgagaaaaaccctgatttagaattagcacattgtaagtttctgttaactttaccagaatatcgcagtgataaaaacgtccactccaaaataacagaagctataaagaaagatgatatggccccatggtatgaacttatttgtaaagatgctggttggaaacttgatgctaatctactgagtgcattaaaagctaagaacgctgagaagatcaagcttttggatgaagccatagaagatgccgagaaaaatttaggtgaaatggaagttcgagaagcctacttaagaaaagcagaatactacagccgaattggtgataaagacaacgcagttagtactttcagacaaacatatgataaaactgtatcacttggtcatcgtttagatattatttttcacttgataagaattggtttgttcttcatggaccatgatctcatcacaagaaatattgaaaaagctaaaacccttattgaagaaggaggtgattgggatagaagaaatcgtttaaaagtgtatcaaggtgcatattgtatgtcagtacgagacttcaaatcagctgctaacttgtttttggacacagtaagcacttttacatcatacgaactaatggactataaagcatttgtcaggtatactgtatacacctctattattagtttgccaaggaaccaattacgagataaagtggtaaaaggttccgaaatattggaagtactgcattcagaaccatttgtaaaagattacttgttttctttatataattgtcagtatgctgaatttttcacaaatcttgcagaagttgaaacagttctcagaaaagattatttcttgaatcctcactatcgtttctatgtaagagagatgaagatacttgcttatacacaattattggagtcatataggtctcttactttacaatacatggcagaagcctttggggttactgttgaatacattgataaagaactgtccacatttatagcagcaggaagattgcattgtaaaattgatcgagttgggggaattgttgaaactaatagaccagatttaaagaatgcccaatttaattctgtggtaaaacaaggagatttactgctgaatagagtccaaaaattatctagggtgatcaatatctaa

SEQ ID NO: 429 - DNA, 2358 bp, Diabrotica barberi
atgatgacctctgctgttcgtcctaaaacgttacccaatgtgagccaagttaatttgaattcaccagtaggatttcctccaccatcaccctaccactcagaatatagcaatagccctcagttcagtcctgcttttacggaatctcctaacgcttgggtgggagttcccgaaactcctgaaatagacagtaccaacgtcggagttccttcaacgtacaatcagcgttcctcggaaaagatgaaagccgacgaaagtttgggcaacggtgctaccatctcagccgttctatatgctaatatgaatcatccagaatggaagaaagatttcccggtttggtctgataggtacaagcaaataatcaagaagtggaggacgctaagtcaagaacagaaagctccgtaccttcaacatgccagagataacagaagccaattgagaatgaagaaagcccagcaggatcaagagaagatggcgctgcaacagaaatccgccagggaagcagaacaagaaaggcaatggaagcagcttcaggctatgaggcagcatcagacgcagcaacaacagaatattatacacgagcaacgtgttcaggccatcgcaagagtccaacgatcaatatcggtggatccagctcaacagtttctgtcggaccaacaaagtcccttgcaaccaagtacgcctcaggagcttagcccgtctgctacaccaacaccaagcccaagacagttcataggaatgaaatccccgaccttccctcttccttcaccagtgcctcagacagcaatcagacctcctacaccctcccattctccacatgatgtaagtcaggcaagcacctctgacggtaatgatcactttattcagtcaccttctactcctaaacctagttttcctaatagattacctacagatcaatttatccatcaacctgcaactcctaggccccagtttggaatacaacggccaactttacagaactttggtaatacgatgaggacagaccagcaagatattaatatcaaccgacagttgagagatcttctacagcgacaacaagtcaaaaagttggatgaaatgttaccaggtaaagttcaacaacaaagagtgtggcctccaattgaacaacaagaaaatgaggcctcagcaactactggtacttcggcagttgtggctacaacagcagataccactttcagacaaccgttaccgcccagtattgtacgacctagagtggctctctctttagctggtcgagcaggacctggtactattagggttggccagttagatgcccgaatgcaaggcctggatcctagaatgagattgattttacaacagcaagtcggccaacaacggttatctgcgggaattcaacatcagttcgtacggtttacctcgacgccagcccgccccacgaccttagatcaatatgaacaactgctccacaggcccactcctacccagatccgggcacctgatcagcaaaacgctcctcgaatgactttgaatcaagcgagcgtcattcaaagaccgcaacttgtgcaacctactccaactactcctacaactagtgctgctgatagcaatcccagtgaagaaggtattcccgataacgttactgctgaactggaaaagctggaacaagaaacaggtactatggtagagttacaaggtgtcagtgagatcctcggaggactgggagacgatgacgatgaactgttagctgaaatgggtgccgatttcaacatcctagagtatgccgatcctgagctggaagctttaaccggcggaaagacaaatatattagatctggaactcgaagaagaaccagtgaagaaagagaaaatagtatccagtgcagaaaaccaaccgactaatcaatcagtaaacacaatgtcgagtcctgtgaaacctaaacaagaaccagttgaaacgcctgctccgaaaccagagcctgcttctctaccgccaccacctcctcctttggcgttgcctcaacagcagcaaccggcgcctgttcaacaacatacgccacctgccgctattcaacaaccaactcaacatccgccgcaagtacaacccacaatgcacctgacgcctcaacagattcatcagcagatggtacaccaggttcaacaggcagcagctcaaggcagacccatgccaccggggtcaaagatgcaaactcctgatggatttattggtattgtaatgcctaataatagtgtgcaactacagatacctcaaaactatcaacagcgactattactgttacagcaacttcaaaatcaaaagcttcaaatgcgcgtaggtactacgactccacgagtagcggtggtggcacagagtcagctacca

SEQ ID NO: 430 - DNA, 360 bp, Diabrotica barberi
gtggatttaaaggtgacggtgacggaaaaacctcttcctccacccccgttggtggtaactgctattaacataaggacttgcatcaacaggaaaacttgtggccatgaaattgtgatggcgtcttgcttgacgcataaaaaatatgccgtagatatgcagcctccagatcccccgtttcagcaacatttctgtgtcattgcttctcccggtgaccagacgttgcccttcgacatccacgatgctctcagtaagtacaaagcaaccaaagtacaaaaaatggactcagaaaaaggattgctaaactttttcgtaaaccaattctcctctatcgatcccgatttaatagtaggccacgacttg

SEQ ID NO: 431 - DNA, 1122 bp, Diabrotica barberi
atggctttaagaacctacggagataaaccaataagttttcagctcgaagaaaatggagactactattgtgttggttccgaggtgggaaactatctacgcctctttcgaggttctctctataagaaatatcctggaatgttcaggagatcgattacaaatgaagaacggaaaaggttaattgaacttggtctaagtcaacatgttctagctagtagcgtatcactactgagagcagctgaagtagatgatatcatcgaagggaatgacgaaaaatataaagccgtatctgtccatacttcagaaccaccaatgcctagggaaagtaaatcgaagaaaaatttgcaatgggtgccatctttgccaaattccagtcatttagatgcagttcctcaagccactcctattaataggaacagagtagcatcaaaaaaggtgaggacattcccattatgttttgatgacacagatccacaagtaaacattgaaaattcttgtcagcaagaaatacttgttcctattagacttgatatggaaattgaaggacaaaaactgagagatacttttacatggaataaaaatgagagtttgatttctccagaacaatttgcggaagtcctttgtgatgatctcgatttaaacccattgacgtttgtgcctgccatagctcaagcaatcagacagcagctggaagcttttccaaacgaaccgccaagtatactggaagagaattgtgaccagagagtaattatcaagctgaacatacatgtaggaaatacttcattagttgatcaggtggaatgggatatgagtgaaaaacaaaataacgccgaagagttcgctctcaaattatgttccgagctgggtctaggaggggaattcgtaacagccatagcatactctatccgtggtcaactctcgtggcatcagaggacttacgctttcagtgaagctccgcttccgacagttgaagttccgttcagaactcccagcgagtcagatcaatgggcgccgtttttggaaactttaacagatgccgaaatggagaaaaagataagagatcaagacaggaatacccgaaggatccggagattggcgaatacaacgccggccgtcaaccgatga

SEQ ID NO: 432 - DNA, 4017 bp, Diabrotica barberi
atgaatacaacaacgagagttgataatacacaaaatccagtacaaaaaattgaattaacttctagaagtattgaaaatgccttaatattggataataattcgccaagattgttagattttatgaatatcagttcccaaagtggatctacagctagtggttttgcagatcatgactatccaactatcagtggagtatcacaagttatcaacaatatgacacaagttaaatgtgttaatagcattcctttaccaacggaaattgttgaccacttttcacgggttcaatgccattgcatgatgggcctcttttgtgaaatcaatagagcttggcttactgtggatagtgatatttatgtatggacttacgaacaaaatactgatctggcatactttgatggaataagtgagaccattgtttgtgttggtcttgtaaagccaaagatgggagtcttccatgcttttataaagtatcttctgatcttggcaacttctgttgatattgtggttttgggtgtaacttttactgagaagccaggtgataccacagaggaaattcagttgataccagacccagtttttagtttaccaactgatggtgccactgttactatcatcagtagtactaatgacggaagaattttttatggcacaaaggagggaaagctctttgaaatatactaccaggctgaaagtggttggtttgggcaaagatgtaaaaaggtaaacttgtctacaagtaccctatcttttctagttccttcatttttaaatgctgctcttagcgaagaagatggaatttgtcagatttcaatagatgagagtcggcatatattgtacaccttaacagaaaaaggaactatagaagtttgtgatttgggcgaaaaaggaaatacattttcaaggataacaaaattgggccaaaatactctagtaaatcaagctatgaatactgtcaaaactttagatagtcaaaacttcagaccaatagtcagtatatcagctattgaagcaacagaatctgccaacttgaatctagttgctgtatcccaaacaggagttcgattttacctgacagtagttagtctctccaatctgcaaccaaatcagagaccatatactctagctttagctcatgtacgtctaccaccaggatattctgctaatataacagtaagacctagagctgtccatgtgtcccattataacgataggaatttggtactgatttcgactgttaatgataaagatgtactttggtgcatgagttcagatatgtttccctttggtcagaccttgatggaggcttatagtgttgtaaatctggatggaccagcattagctatatcagaggtgcggcatccgactcctttaccgttaccaccaaaccaagaagcgccacctctggttgtcagacaacacgcggaaccgcctaagaaatatgtggttctaacatctcacagtgttcagatttttattaaactcaggccagttgatattctcaatcagattcttagagatagccaaggcttagatactgaagcgcttaagacattttttacgattcaaaaagaggatcaggcttgcgcaacttgtttgattctggcttctttagaaagtgatgagaacgttgaggttgcagaatacgccacaagggctttctttttgtatggtggagaacctaaactggtgccagctaatatatatgcgggacccagcgtatttgctcctcaaataatatcaacacccgctccacacaattaccagtcgcagcaatatcaaaccgctcaacactttcaacctaataatatgtcacaaacactgccaacagtgccaaatactacaggatatgaattcactggtccgtttgttttttcggcgaaacataatagtttatatttgtatttaagtaggatattgcgaccaatttggaacatgagaacggttgataagctttctgttgacggaaaggtttctacgacgtacagtaccgtatccagtgatgactgcatatttattctaaataatctaactgctctccataatttcctagcacgaaatacacaactgtcaaccatgagcaagaaccaaaatcaattccagaacactacacttaataatacatctttaaatatgacgagaatgaaccataccgtgcaagacgcccaaatggaagaaaaagcatcactgaattctttcaaaattcttgtttcgctttgttgtcaaatactgggtctctggcgaatcctgtgtgaacatcaatttcattcattggtggcgtctcttacggaaaacgaacagcaaattctcgtcaatacaacttttaaagacttgttcctttacagacacgacatttgttcgtcattaatatcagctctagttcaaacctatcttggagacaacgcttctgtcgactctatcagcagcaaattgagagaagtttgtccacaaatgtataaaaccgaagatatggcatattcaaaggcaatcgaaatcctaaaatctgctcgaacaatacaaaatgtcggagaaaaagaagaattgctcaattcagcgctacaaatttgtaaatctatcggacctaatttgaacatcggtgatgtgtgtaaagaattttgtaatcttaaaggatacaaagccgtaactgaactatgttgtcattatgcctcaaaattagacccagaaaatattgcagagatatattacaatgcaccggatagcactggagaccaggaaggttataattactatcaaaacagaatggaaatttataggcatttattgaatatgttaaattccatgtatcaagaactcaatgtaactccagtaccgtgtctcaactacgaccttgatttttcagtaactcaatcaattttagcagatacaccagcacagtcacaaattggatatatgatgaagcaagtgatcactgatattttggaaactcccgatcaaataatgcatataaacctatacgattggctaatatctaaaaatatgactggagatttactaacaattaataatgattccttggagacgtatcttaaaagaacagcagctcaaaatccaaatgatactgttgctttggaccttctatggaaattctatgaacaccgcaatgaccatgccgctgcagctaaaattcttaatagcctggcatcaagaactggtgttaacattcctttaaaagaaagattggcgtacttagcccggtctataatgtgtatgagaagcgacaaaataggatatgcgccatatttaggtgtcttccttagagatttagaggataaattagaagtggccaaggtacaagaacaaattttagaagcagttatgaaccaacaaaatcaaatcgaaaattatggagatattgtcacagctctgaattcaggactatttgaaatatcacagctgtatgaaaatttcgctgagccgttcaaacttctcgaatgtcaactggccattattgattgtgccggatatacagatccagcgttaatagaaactatatggcaacaaatattgaccgacgagctaaagaagactaccggaactggaacagacaaagtatgtcaattattaaacaaagtcaaacatttagccaaatattatgctaaatcaatgaactgttttcctttagattatattatctatgaattagaaatagtgaatgcaaagttaagaggcgatagacaactagtacctacagctctcgagagtatgaatattccatttgacagtctgatctctgtttataataatttgaataccatatcgggaaacgaccatttctggcagttggaagaaaatgaatttcatctttctgaagctacagctactctaattagctgtttcatcagcaaccaagattcgtacagcagtatagaaaagagaaaatacacatcattatctcaggacaccgttgttgcactgctgtctaatttatacagcaaacctaatacagaagcgatagttaataagttacgaaatattcaggccaggttagccagaatttaa

SEQ ID NO: 433 - DNA, 4344 bp, Diabrotica barberi
  misc_feature (34)..(77): n is a, c, g, or t
atgttaatgactttcgccatatgttgttcaaaannnnnnnnnnnnnnnnnnnnnnnnnnnnnnnnnnnnnnnnnnnntttctgtctacataaccgtcaaatatacaaattttttattaagaacaaaatgaccgaatttactttaagttatcgtgaagttataccggatcaaacagtttttgaaaattggaaagaaatctcccttaccacaggtgggacacaaagtactctccaagatataaaagtagctgaacgagccaatggattttcctatgaagattcaacaaagcatcatacacgaaatagatttatttactggagaatcaattatgatgtcttggagttggtagaacatagtctggatatcaatttaacagcaaacagagttagatataagtttacagatactcctattctggatggagtttccattcacgaaacttatgaaaacattattgtgcttgtcccaactgtttgtagtatacaccgtttaatttttccacaccctgataggtttcatagacaggatgatttactaggagtgcatccagatttggctgctccctcaatattttcaaaagcttcacctgtggatgccagaaatccaaatactttttatgtttttaataacccaaccactgccactgaccaactgcccaatttagccagttcttacttgttacctgaaacggaggaagcattttttatactagcttatccatcaacagaactactattgataaaacaaaatcctgacaatggccaagttgtatgtacagagctgaaaggagaatctttgatgcctagatttttgtctggacttgcagaaaagtttagaccaagaaattctgacggtgataccatagtgagtctcttgttttatattgttgattatgaaacttacgttttgacactgacaagagatgcccatctcaagttttggtcatgtactaaaggacaatgtgtcgcagttatagatgtcagagaaaagacaggagatggttcaaaggatcgagtacagggagccatattaaggaaagcagtagatggcaatagtactgaaagtatcttggcggtgtttttaaattactccagtagtggtcaatttcatatcttaaatccaataataaaaggccaggaaataacaattgacagattggttactttatactctcctgagaatgatcttatcgattttgccttacaaaccaatcgcctatggtctgtatggcgatgcgaagatggcgacagcgtagtgtacactgccacactgccagtatcccgttgtgcttcctacaaatcaagcagttggtcacctattattttggaaacattgcccgatgctaaccaatcacctgccaatgatggagacagtgatcctagacaagtgtatttgcaacacattttccatcccggcagatttcctttgcacataataagcaaagctctttccatttacaagaggtctactatattatctgatgcccaaatatcagcctcagctttaaaacagagaatttgtctagctgtggataatgaaatacaaaatacgttaaacggatctaatgtgaatgatgatgaatatttagagtgtgcagattggtgttggcaaaaattctactcttgctgcgtacagtatcacatcgctagcctaaaacctctaggtctgatgttattaccttctgtctctggagcagtatttttgaaaaagtcgacgttttcattcctcagacctttggatccactggaacacatgactctctgctatgaagatgtttacagagaccaatttgtcaatttttctatgttagcggaagatctagatacaacggatgatgtaatgaacttgtttaaagtcatcgtatatttagaacaacaaatgagtgagtcatttgtgcaggcattcgagaaagaaatttttaatctacatgctcctgatgttataatggaaggtttattagagaaaattcagtctgagatggattgccagttcgcatcgcacgtattggaaatgatgaacgacgttaccgacttatacaaaggaatgcacaaaattttagaactcttaagatacgaaaatacattagccagtcctgataacgacataaatcctggagctatgtatcatttcagttccttgctaggtacttcagtagtcgctgaaagcttgcgacaacaagcacaaataagattccaaatatgtagaaatttacttctgatctgcaacattttgttgaacgaaaaaacgttggattggggtgtattagaagccatacgttcagtgtgtacaccggagattgttgtcctcacgcaggctagttatgtagttttatggctgtgcggattaactaccatagttaacttacctttcagtgctcgcgaatcttcgataaatagattggcgccactcaaattagctcctgttttgaatttgagacctcttactacatgtacgtcgttattggaactattcatatcatctaccggtggccaggaagccaggaaatcttttgccagagtaaattgcagcgatgaagctttggcccactggcatatctcacttctaccttatttgaatcacgtgagacatataatttggcccataactggaggtacagttcttgccgagtggctgttaagcagtggacaacatttatggttgcagcaatacgttcgtttacttagcaactggtgtgaatggaatagttgtacaagaaacttcttgctagcttccgcctttttgtcaactggagaatataacaaagcagaagatttgtttgaaacggctgctaaaggggttttaacagatggctttttacaagaacgttgtttaaaggggaatttgcctagtccaactggagcgtacattcactattatttaaaggttattcaactatttgatcttcacaaggccaaagattccgttataagcattgcaaatactgctctgagcattgtagacccagaagatcctttagcggctactttatattccatcaagttcaaacaccacttggcattaaaacactacgaactcgccttcgattcattgaatgcgaatccagatgcggaacggaaaaaagacaatctgagagatttggttaaaacactgttggatgaaaagaaattggatactttattgaacttcacgtacggtagcatggatgagttctttacaaatatactgttgagcagagctagagcaaacgatgcagttaacaacattttctacgacttcttgtattcttatcaaattaaaagaggacctctgtcacacagactagctgcatcagtaatgtacgagcaggctttcagattaaatcatattaacagcgttgaagcactggaaaaacaagtaaaatgttacttggcagccaaaaacgttctacatctgtgtcaaccagaacacgcttgggtagtgagaccagctgatccagatgaagaagatgacgtaataactattcagcctttggcaggatcaaacgaagaaatgaaagtatttagattgagaaaacaacttgaagtggtaaatattgaaactgttgagaaagaacttattttcgcaagtgcaaagttaaaattggcaagatttagctcgagcctatcaccggttaatataacaactcctgtggaattagtaacattattaaatactgctggtttattcaaaactgccttagacatttgcacgacgtttgaattgtcatatgcaagcattttcgaagtcttaacaaagaactgtgtttcattgacggaagaagaaaatcccagtgcttggaactggctggtagaaaacgatttgcaagatcttccagttaatagggatagtgcagcagatgtagtttggcagttcctacaggattgcttggagaaatatgaaaaaccttgcatgaccacgctacattatgtggtttgcaaaaagattataggtatgagagtatattttccccattggcttgttgcttcttacaaggttcgaaatcctgccgagtttttaagattattacatggttccggaagattagaagaagcaattgaatttacaagcgagtatatactatctgcaatgggttacggtaaagaatttttcggttttacacaacctttagcaccaacgtcgcctgctttttgtttacctgtctacgctatccaaaggttaattgacgaattaaaaatacagaattccatgagtctggagcaaccttatctgaaggaatatgaaaatttgaaaacattgtttaccaaatatttagagactgccaccagagtatcgaatcagatgtgtcaaacaaaattaacatcaggatcccttagaacgaatgttttttcaatagatgctagataa

SEQ ID NO: 434 - DNA, 1404 bp, Diabrotica barberi
atggagatgtccgatgaaaatattcaagttttaagtaaatatctacaggagacacttaatccagatccaaatgttcgcagaccggctgaaaaatttttggaaggtgtagaagttaatcaaaattatcctttactaatattaaatcttgtccataaaccagaagtggacatgacaattagaattgctggagctgtagcatttaaaaattatataaaaagaaattggtttgttgaagaagatggagttgataggattcatgaatctgatcgagctgcaataaagaatttgatagtcactttaatgttaagttcacctgaatcaattcaaaagcagttaagtgatgccattagcattattggaaagactgattttcctctgaagtggccagaattaatctcacaaatggttgaaaagttttctacaggagatttcaatgttataaatggagttctaagaacaggtcattccctttttaaaaaatatcgctatgaatttaaatcacaagagttgtggatagagattaagtatgtactagaaaaattggcccagcctctaactgacttatttgtggctaccataaatttggcacaaacccatagcaacgacgtgaatgcattaaaagttatatacagttcattggtgttaatttgtaaagtattttattccttaaattttcaagatcttccagaattttttgaagataacattcagatttggatgtcaaatttccatacgttattaacggcagatgtcaaatgtcttcaaaatactgatagcgaagaggctggtattatggaacaattgagatcccaagtatgcgacaatatagctctgtatgcacaaaaatatgatgaggaatttcagcagttcttgccacaatttgttactgacgtttggagtcttttagtatcaactggtcttgaacctaaatatgatctgttagtttcaaatgctctccagttcctgtcatcggttgcagaaagagttcagtatagacatttatttgaagataacaatgttttgagcagcatctgcgaaaaagtcattatacccaatatggaatttagagtttcagatgaggagttatttgaagataatcctgaagaatatacacgtagagacattgaaggttctgatattgatactaggcgaagagctgcttgtgatctcgtaaatactctcagccagaactttgaacaaagaattatagacatatttggtcaatatttacaagtgatgcttggaaaatatgtggaaaataccaagcagtattggagaagcaaagatgctgcattatatcttgtaacctcactagttagtagaggtgctactcaaagacatggagttacacaaactagtcagctggtcgatatcaatcagttttgccaacagcatatattgtca

SEQ ID NO: 435 - DNA, 609 bp, Diabrotica barberi
atggctaaggtccaattgtgtaacataaccgtgatggacaatcctagtcctttcttgaacccatttcagttcgaaataacttttgagtgtatagaagaacttagagaagatttggaatggaaaatgatatatgtaggctcagctgaaagtgaagactatgatcaaactttagactcagtttttgtaggacctatacctgaaggcaaacacatgttcgtctttcaagcggatcctccaaatgtctcacgtattccagaaaatgatgctctcggtgttacagttgtactattaacgtgttcttatagaagtcaggagttcattcgtgtaggatattttattaataatgaatatactgatccggaacttaaagaaaatctacctagtcctccacaatttgataaggtaacccgaaatattctagcatccgaaccaagagttacccgcttcaaaatcaactgggaagaaaccaaccccacagaaaatatcacaaattcagaccaaagtggagcatcagcacccacgacatcagaagctggaccctctgctcctgtcgaagtacctgcttttaatgaaaattccaattcatgggctacaatggaatgttcataa

SEQ ID NO: 436 - DNA, 951 bp, Diabrotica barberi
atggatcaaatgctccctagtccgggatttagtatcccaagtataggaacaccccttcaccaacctgaggaggaccaactcatcttaccaaatgcccttcaacagcaacagcagcagcaacaacagcagattgcgaccagcagttcccaagtacctcctttggcaccaatgggcggcttgacacctacacttggacttggcatgggccatgccatgtctgtaccacaaaccaaatatgtaactggtttcgcattgcccatgagttctatgaatgcacaaactccccaacacacaatgagccctatggtgaacttagggggttcaataactacaggagctggagtgactccaacgatggcaccttcaactccttcacctatgacgccaatgactcctcattctgctgatcctggcatcattccacagttacaaaatatagtgtccacagtaaatctaagttgcagattagacttaaagaaaatcgctctccacgccagaaacgccgagtacaacccaaaacgtttcgcagccgtcatcatgaggatacgtgaaccacgtactacagccctaatcttctcttcgggaaaaatggtgtgcacgggagccaaaagtgaagaagactcgaggttagcagcccgaaagtacgccaggataatccaaaaactcggattcccagcgaagttcctggatttcaaaattcagaatatggtcggaagttgtgacgtcaaattccctattagactcgaagggcttgtgctaacccatagctctttcagcagttacgaaccagagttgttccctggactcatttaccgtatggtaaaacctagaatcgtacttttgatcttcgtgtctggcaaagtggtgttgacgggtgcgaaagtaagacaggaaatatacgaggccttcgataatatttatcctatcttaaaaagttttaagaaacaatga

SEQ ID NO: 437 - DNA, 390 bp, Diabrotica barberi
atggctgccatcagatctatgtctcgccttcttattaatagatcacttcaaaccactgcaaagaggacctatgccgaccaaatgaacttcacatttgcagctggaaatcaggtttactatactgcaacctcagttaaacaggtagatgtaccatctttctctggtagctttggtatccttcccgcccatgtacccacactggctgtgctaaaacctggagtagtcactgtttacgaagatagtggtaatgttaagaaaatctttgtttccagtggtactgtcaccattaacgatgattcatcagttcagattcttgctgaagaagcccacccagtagaaaacattgatgtcaatgcagcaagagacatccttaccaaagcccagagccag

SEQ ID NO: 438 - DNA, 987 bp, Diabrotica barberi
atgagtggtgacggtagtgacactgaacaatttgatactttatttctatctgtagctcaatatcatccacagggaccaacacagctcctggatacatttgtgagttttttgagtcgaaaaacagactttttcattggcgccaaggaaggagaatgggaaaagttagtgatggacacattcagaaaatatgaaaagtcgagcagggcaaaacacgaggaggaacttaaagaaaagcgagaacaagaagctcgaaaaaaagcagctgctgccaaaaaggcagaagcagaaactgtcaaacctgctcaaatcaccgaattgactgatgaagaagctgaaaggcttcaggctgagattaatgctaagaaaaacacttctgataaggctgaaagttcttcaaatggttcagaagctgcaactacagctaaaaaagtaggagaagacgaggatgaatctgaaaaaggcaagatactgcccaactcgggaaatggatgtgatctagagaagtacaagtggacgcaaaccttaggagatattgagttaaaaattcccctcaaagtaaacttcagggtaaaacagaaagatctcgtagtaaatatgacgaagaaacatttgacgtgtggtatcaaaggtcaaccacctatcatagacgacgattttccacacgaaatcaaattagaagagtcttcttgggtgatcgaagatggaaaggacctattatttacttttgaaaagataaataaaatgaattggtggagccaaatagtcaaatccgatccagaaatcagcacaaagaagatcaatcctgaaccatccaaacttagtgatctcgacggagagacccgtggaatggtggagaaaatgatgtacgaccagcgccaaaaagaaatgggcctacctacgagcgacgaacaaaagaaacaagacgttattaacaagttcatgcagcaacaccccgagatggatttctcacaatgcaaatttaactag

SEQ ID NO: 439 - DNA, 480 bp, Diabrotica barberi
atgcaatcttcgagtggtatgatacatggttatccgggaggccctggattacaatggagccccgataaaaaacatagcgaccgcgaaaggtggatatgtatttaccccgcttacatcaacaacaaaaaaacattggcacagggcagaaaaatagccaaagaaagatgcgttgaaaatcccactcaccaggaaattcgtgatgttttggtcgcggctggcttgaaagtgggtgtcgaaaacaaattgtacagcagagagagaagtaaggaaatgttatatcgtggtagaataaggatacagttaaagaatgacgatggtagtttgtgtaatgacagtttccctaccagagacagcattatgtaccatttaggagacatgattcccaaactgaaaagcaggcaaaataaaagctcgaccgaggctcctcagcaagcatctactggttctaaaggcaagggaaaaggaaaaggacgaagataa

SEQ ID NO: 440 - DNA, 1380 bp, Diabrotica barberi
aaacaattcgaagataatataagaaaaaaccgaactgttatatctaactggattaaatatgctcagtgggaagaatcccaaaaagaaatacagagagctcggtcgatatgggagagagcacttgatgttgaccataggaatattaccatttggttgaaatataccgaaatggaaatgagaagtagacaggttaaccatgctaggaatctatgggacagagccacagttagaagtagacaggttaatcatgctagaaatctatgggacagagccacagttcttttgccacgagttaatcagttttggtacaaatatacttatatggaagaaatgttagaaaatgtaccaggtgccagagcagtttttgaacgatggatggactggcaacctgacgaacaagcctggcaaacctatattaactttgaactccgctataaagagattgatagagccagacaaatatatgaaagatttgtcataacacatcccgaagttaaacactggataaaatacgcccgttttgaggaaaaccatggtttcatacactcatctagacagatatacgagagagcagtacaattctatggtgacgatcatttagatgagaaatctaggcagatatacgagagagcagtacaattctatggtgacgatcatttagacgagaaactctacattgcgtttgccaagtttgaagaaaaccaaaaggagcatgatagggcgagagttatatacaagtatgctctcgatcacatacctaaagatgaaactaaggaactctacaaggcgtatacaatacatgagaaaaaatatggcgacagaagtggtatcgaagaagttattatgtcaaaacgaaaacttcaatatgaacaagaaatactgcaaaatccaaccaactatgatgcatggtttgattaccttcgattagtggaaggagaaggtgatctcgaaattactcgagaaacctatgaaagagctattgctaatattcctccaacgaaaaacaaacagttttggaggagatacatttatttatggattaattatgcgatatttgaagaacttgaggctaaagattatgaaagaactcgtcaggtttataaggcttgtttagaaatactacctcacaagatatttacattttcaaaaatatggttgctgtttgcacaatttgaaattcgtcagaagaacttgactacagcaagaaaaatcctcggaatgtcaattggtatgtgtcctcgagataagctttttagaggatacattgatctagagattcagttaagagaattcgacagatgcagaaaattgtacgagaaatttcttgaatttggaccagacaattgcataacctggatgaagtttgccgaactggaaaca

SEQ ID NO: 441 - DNA, 1431 bp, Diabrotica barberi
atggggattaaatttttggaagttataaagcctttctgcagcatactgcctgaaatagccaagccagaaagaaaaatccaattcagggagaaagtactatggactgcaatcactcttttcatatttttagtatgttgtcagattccattatttggtataatgagttcagattctgcagatcctttctactggattcgtgttattcttgcatcaaacagaggtacccttatggaacttggtatttccccaattgtaacttcaggtctgattatgcagctgttggccggtgccaaaattattgaggttggtgacactccaaaagacagagccttattcaatggtgcccaaaaattgtttggtatggttattactgtcggtcaagccatcgtgtacgtaatgacaggcatgtatggtgatcccgctgaaattggagctggagtgtgccttctcatcatcatccaactgttcgtcgccggtctcatcgtattgcttctcgatgaacttctccagaaaggatatggtttaggttctggtatttccctcttcattgcaacaaacatttgtgaaactattatttggaaagccttctcaccagcaacagtaaacactggaagaggaacagaatttgaaggagctgtcattgccttattccacttattgaccaccagacaagacaaaatcagaggattacgtgaagctttctacaggcaaaatcttcccaatttgatgaacctcttggccacagtactcgtttttgctatagtaatatacttccaaggattcagagtagatctacccatcaagagtgcaagataccgtggacaatattccagctatccaatcaaattgttctacacttcgaacatccctattattctacaatctgctcttgtatctaacttgtacgtcatctcacagatgttggctgttaaattccaagggaacttcttaattaatctattgggagtttgggctgacgttggaggcggtggcccagcgaggtcttaccccattggtggattatgttactacttatctccacctgaaagtgtaagtcacattctagaagatccaatccacgcaatgctctacatcgtcttcatgttgggatcttgtgctttcttctccaaaacatggatcgaagtatctggaagctcagccaaagatgtcgctaaacaattgaaagaacaacagatggtaatgagaggacacagagataactccatgattcacgaattgaacaggtacattcccaccgccgcagcttttggaggtctctgtattggagccttgtcagtactcgctgatttcatgggagccattggttcaggtactggtatcttgttagctgtcaccatcatctaccaatacttcgaaatcttcgtcaaagaacaaagcgagatgggtggaatgggagcgttactcttctag

SEQ ID NO: 442 - DNA, 483 bp, Diabrotica barberi
atgtcgatggtaacctcaccttccgtagaacttagttcttacagagaccaacatttcaagggtactagagccgaacaggacggattattaagactatcaaccacattatacgttggaaatctatctttttatacaactgaagaacagatctatgagctcttttcaaaatgtggagacataagaagagttgtaatgggtttggataaatataagaagacaccctgtgggttttgttttgtagaatactataacagagctgatgcagaaaactgtttaaggtatataaatggtactcgtttagatgataggattgtaagaacggattgggatgcaggatttatagaaggtagacaatatggtagaggaaaaacaggaggacaggtacgtgatgaatataggactgattatgattctggaagaggaggttatggtaaaataatccagcaaaagattggaattgagactccagcttttttgagataa

SEQ ID NO: 443 - DNA, 924 bp, Diabrotica barberi
atggctgcaacaataggacgaatttgtggagctggtcttttaaaaccaacaaacttatcctctgtgggccagttaagttcgtattccacaacaaaagaatggacccgtggaagaaaagcacttttgggaagcttagggcttattgctggtggtactggtgccttgctgtttgctttggatcaatcagttaaagcatctgatcttgaattgcatcctccaaagaatgtttggagtcattctggaactttcaattccttggatcatgctagtgtaagaagaggttatgaagtatacaaacaagtatgtgctgcctgccactcaatgcgcttcattgcttaccgtaacttaattggagtttcccacactgaagcagaagccaaagctgaagctgaagaacaaatgattgaagatggtcccgatgacacgggtaactttttcaaaagaccaggaaagttatctgactatttccccagtccataccccaatgaagaagcagctcgtgctgccaacaatggttcctaccctccagatttgagctatattgtatctgccagacatggaggcgaagattacatatttgcccttttgacgggttactgcgacgcgccagcgggcgtggtcctcagagacggacaatacttcaacccctatttccccggtggtgccatttcgatggcacaagccctatataacgaaaccatagaatacagtgacggaacaccagcaactgccagtcaactcgccaaagacgtcgctgtgttcctaaaatggacgtcagagccagagcatgatgacagaaagaaaatgttaatcaaagtgatcggcatcttttctcttcttattggtatcacttactatgctaagaaactcaaattctcttcgttgaaatcgagaaagattgaatttaggcccaagagtaaataa

SEQ ID NO: 444 - DNA, 1722 bp, Diabrotica barberi
atgttagccctgcagcaatattcgggcagtagtgacgaagacgatatagacaaaaacaaaagtaaagacacctcagtagatataactgaaatccccattaattccgaattttccaccagaaataagcttgccatttgtgccgctccaaatgtactgcctacaggtttagatggagaaaaaaatcatatacatcctgatagtggagaactgacatataatccaaagtatgatatactatttgctcctgtagtaggtcccgcaaatccctttaaaacacaacaacaatctgttgagagaaacatactctcgggacatattgaaacggctcatgtaagtgattttcaatttgaaaaccagagaagaacttttacaagctatggttatgcgttagacccatcgataagtaatgatggagatggacatctaaaagttgttggttcaactgaagaaggtaaagacgtagaaagtgttaagactgtatttgaaacttcaaagataagacccttggataagaggaaaaggaagagaaatgataatccgggtgatatagaaggatttttgggaccatggggtggttttgttgatgaacaaaaagtatctagaccaacggaggaagaacaggctgagttagatgaaataacttctaaaaagaataagaaaggtaaaccaacagaggacaaaccaattgaggaaaagtctgtattgcatatcaaagatccagtggactatcaaggaaggtcttttttgcatgctccacaagatgttggggttaatctcaaatctgatacacctccagagaaatgttttttacccaagtcccatattcatacatggactggtcactccaaaggtgttgcagccatcaggtggtttcccagaacggcacatttgttcctgtctgctagtatggattgtaggattaagatttgggaagtttataatgagagaagatgcattagaacttactatgggcatagacaagctgtgagagacattaactttaacaattctggaaagctttttctctcagctggatatgacaggtatattaaactttgggacacagaaactggacaagtcgtttcaagattcactagtcgaaaaattccatattgtgttaaatttaacccagataaaaataagcaacatttatttgttgctggtacatccgacaagaaaattatctgctgggatactaggtctggtgacatcgttcaggaatatgatagacatttgggagctgtcaacagcattacttttgtagacgaaaaccgaaggtttgttactacctcagatgataagtctttaagggtatgggaatgggatatacctgtcgacatgaaatacattgcagatcctacaatgcacagcatgccagcggtcacaccagcacctaatgggaagtggttagcgtgtcaaagcatggacaataagatcgtgatattttccgccatgaatcgtttcaaaatcaatcgaaagaagacattcaccggtcacatggtggcaggttacgcatgctcgttagattattctccagacatgagctatttggtgtccggtgacgctgatggaaaggtctacgtctgggattggaaaacgacaaaattgtacaaaaaatggaaagcccacgataatgtttgtatcagcgtattatggcatccacacgaagcgagtaagatgatatcggcaggatgggatggcgttattaaattttgggattaa

SEQ ID NO: 445 - DNA, 807 bp, Diabrotica barberi
atggtccaaaagaaacctaagaagaaggtaggaaagaaagtagctgcagctcctcttgcagtcaaaaaagttgaacagaaaaaagaagttaacccactttttgaaaagaggcctagaaattttggaattggccaggatattcagcctccccgtgatttatctcgatttgtaaaatggccaaaatacatccgtattcaaagacaaaaggctgtacttcaaaagagattgaaggttccaccaccaattaatcaattctctcaaaccattgacaaacaaacagccacccaattatttaaagtcttggaaaaatacaggcctgagacagctcttcagaagaaaaataggttaaaggctaaggctgaagctaaggttgccaagaaagaggaggcgcctgctaaaaaaccaaacacattgaaggctggtaccaatacagttactaagctgatcgaacagaaaaaagcccaattggttgttattgcacacgatgttgacccaattgagttggttctgttcctaccagccctctgcagaaaaatgggtgtcccatactgcatagttaaaggtaaagcaagacttggacttctagtaaggcgcaagacttgttcatccgtagctcttacacaagttgactctggagacaggtccaacttcaacaaacttttggaagtaatcaaaactaacttcaacgaccgtgttgatgaaatcaggaggcactggggtggtggtttgcttggatccaaatctgctgctcgtattgctaagttagagagagccaaggctaaagaattggctcagaaacaaggttaa

SEQ ID NO: 446 - DNA, 1002 bp, Diabrotica barberi
atggcaactttaataaaagatgtaacactccaagaaaacattccaacacatatacttcttgacaagcacatagattttattaaggaatatggacaaaaagaaagtacatatgaatatggtatgaccgattatttgagaatatctggcatgtattggggacttacggctctagaacttatgaacgccactccagctcaaagtatagaagagatcacagaattcataaagaattgtcaggatccagaaagtggtggaatcagtgcctgcctataccacgatccccatattttacatacacttagtgctgttcaaattctctgcatctacaataaattagaggcaataaacgtagagggtgttgttaaatatatcgcaagccttcagttacctgatggtagctttacaggagataaatggggtgaagttgatactaggttctcattttgtgcagttatgacattatcgttgcttaataaaatggatgcaattgatgtaaataaagccgtggactttgttttacaatgtaaaaactttgatgggggtttcggatctaggccactttctgaaagtcatgcggggttaatgtattgctgtgttggctttttatctatcacaaataggttagatgccattgatagagacacccttgcttggtggttgtgtgaaagacaactaccatctggaggtttaaatggtagaccagaaaaattacctgatgtatgttactcatggtgggtgttatcatcattaaccatgttgggcaggcttcattggattgatgcgaatgctttgaaaaactttattttggcttgtcaagacacagagactggaggatttgcagataggcccggtgatatcgcagatccttttcatactatatttgggttagcagccttgtcccttttgggacatgattctgtaaagaaggttaatcctacttactgtatgccacaagaagtcattgatagattacaattaaaacctcagaggttagagcaataa

SEQ ID NO: 447 - DNA, 2847 bp, Diabrotica barberi
atgcatcaggaggccatacaactcatccaggtgctagaaaaaacagtttcaccggataaaaatgaattggaacaagcatcgtcgtttctggaacaagctgcagtgactaacctactagaattcatcaaaactctatcagatatattaagacatggcggaaatagccccgtggcccgaatggccgcaggtctgcaggctgcagtgactaacctactagaattcatcaagactctatcagatatattaagacatggcggaaatagccctgtggcccgaatggccgcaggtttgcagttaaaaaatcaactcacctctaaagactccaacataaagactacttaccaacagcggtggttagctttcccagaagacgttcgggggtatattaaaaataacgttgtgtgcgcacttggaaccgaaaccagcagaccatcctccgcagctcagtgcgtagcatacgtcgcagtaacagaactaccacaagggcaatggccagatctcatagcaacgttggtcaacaatgtttgccacgcaaattccacagagatgcaaaaggaagccacattagaagctatcggttacatatgccaagaaatcgactcggacgtattagtatctcaatcaaacgacatcctaacagccatagttcatggaatgcgagcctcggaaccgagcaatcacgttcgtttagcagctacacaggccctactaaactctctagaattcacaaaggccaactttgaccaaccaacggaacggaactatatcatggaagtcgtttgtgaagccacgcagtctccagattcacagatcagagtggccgctttgcagtgtctagttaagattatgtctttgtattatcaacacatggagccttatatggctcctgctctattccctatcactctagaagccatgaagtcggaaaacgatgctgtttctctacagggtatcgaattctggtctaacgttagtgatgaagaggttgatctggccatcgaagatacggaagccaccgaagcaggtcgaccacctacaagatgttcacggcactacgccaaaggtgcgctacaatatatagtaccgatcctgctgcaaaaattaacgaaacaagaagaactggacgacgaagacgattggaatccttgcaaagcagctggagtttgcttaatgcttctcgcaacgtgttgcgaggatgaaattgttccacacgttttgcccttcatcaaagaaaatattaagtctgataattggcgattcagagatgcttctttgatggcgttcggatctattttgggcggtttggagagcactacgttgagaccgcttgttgaacaggcgatgccgaccttgatagatctgatgtacgacaatagcgttatcgtaagagacacagccgcttggaacttcggcagaatttgcgaaatcattccggaagcggccatcaacgaaaccttcctcaaaccgctattggaaagcttaatcacaggcctcaaggctgagcctcgagttgccgccaatgtctgttgggcgttctctggattggtggaggcagcttacgaaaatgccgacgtcaatgaagaaaccggtactccagatacttacgtcttgtcacaatacttcgagttcataatacaaagactgcttgaaacaacggatcgacccgatggcgcccaacacaatttacgacctgcagcctacgaagccctcatggaaatggtgaaaaactcacccaaagattgctatgtcaccgtgcaaaagactacaatggtcattttggacagattacatcaggtcttacagatggaaactcacataagcagccacaacgatagatcgcagttcaacgatctccagagtcttttgtgcgccactcttcagtccgtactcagaaaagttaccccagaagacgcgccaagatcgcagttcaacgatctccagagtcttttgtgtgccactcttcagtccgtactcagaaaagttaccccagaagacgcgccacacatctcagacgccataatgaccgccatgttgaccatgttcaattcgaattcatgtaagagtggaggcgttcaagaagatgctattatggctgtctcgacgctggtcgaagttttgggagaaaacttcataaaatacatggacgccttcaaaccgttcctctacctcggattgaagaaccatcaagaataccaagtgtgcgttacagcagtgggcttgaccggcgacatcttcagagctctcaaactgaaagcgctaccatactgtgatgaaataatgaccttattactagaaaatctccgcgatcagtcggtccatcgtagcgtgaagccagagattctgggcgtgttcggagacatcggcctcagcatcggctccgaattcaagaagtacctcgaggtggttctgtccactctggctcaggcttcgcaggcgcaagtcgaccgcaacgacttcgacatgatcgattatcttaacgacctaagagagggagttttagaagcttataccggcatcatacaagggcttaagggtgacgggcccactccacatcctgacgttttgatacttgaaccccacattccatttatcgttcaatttattactgtcgtagcacaagatacggaacattctgatagtattatagctgccgcagctggtattgtaggtgatatgtgtaatgttttcggagctccaatggttcaattcttagatctggagcctattaatgaaatgttagcacaaggtagacgtagtcgagtaaataggactaagactttggccaattgggccgttaaagaattaaagaagctgaaggcagtaaacaccgcggctgctgctagctga

SEQ ID NO: 448 - DNA, 1503 bp, Diabrotica barberi
atggaaacaattttggaacaacagcgtcgttaccatgaagaaaaagaacgtttaattgatgccatggtaaaagaaatgcttcacaaaaagacaactttcagagaagcaataaactcagaccaccgacaaaagtacctgctggatagatatatggcttcaacagagaaactaatagatctttatgatgatagagacggacagcgtaaggctgaagtagccgctcttacgggccccaacgagttccaagaattctacagtaggttaaaattaatcaaagacttttatagaaggcatccaaacgaaatcagtgttcccatgtcagtggaatttgatgagtttgccaaagccagggaaaatcctaacgaggatatggctaactttgtagaatttacagatgaggagggctacgggaagtatttggatttacatgaatgttatgaaaagtatataaacttaaaaggcatagaaaaggttgattacattacctatttgggtatgtttgaccaactgtacgatattccgaaggagagaaaaagcggtgaatataaaaaatatttgttatgcctaattgaatatttgacttggtttgtgcagcgtataaagcctctaaaggacttagacattgatctacaagaacaagttgagcaggttctgataaactgggataatggaagtgtaccgggatggccaaaagaaacagggtctgcactaacaaatgttggagcccacttggacctctctgcattttcaagttgggaagaattggcatcgttaggtttagacagactgaaatctgccttaatggcgttaggattgaaatgtgggggtactttagaagaaagagctcaaagattattctcaacaaaaggaaaaggttccttggatccttcacttatgacgaaaaataacaaaggcaaagccaacaaagaaaaggagttattgagacaaagagaacttgcaactttagaagcccaagtgtacagactagcagagtgggtctcaccgcagagagctgcaacaaaagaaaatgtgcaaaggaaacaagctcgtactgacggagaaagagacgacagcgaaaatgaagaaagcgaagatgatagtcctgatgaaggcgacgatgatgttccgtataatccaaagaatcttcctttgggatgggatggaaaacctataccgtactggttgtataaactacatggtttaaacatcagctataattgtgagatatgtggaaattacgtttataaaggcccaaaagcattccaaagacattttgcagaatggagacacgcccacggaatgagatgccttggtattcctaacactgcacattttgcaaatgttacacagattgaggatgctttggcactgtgggaaaagctgaaagtccaaaaacaaagtgagcgttggcaacctgaaacagaggaagagtatgaagattctcaaggcaatgtggtaaatagaaagacttacgaggatcttaagagacaagggttattatag

SEQ ID NO: 449 - DNA, 639 bp, Diabrotica barberi
atgacgataggcaaaaataacaaaatggtacaacacataaacttcagagttcgggtaactctgcaagactcccgtaccttcattggaactttcaaagcgttcgacaagcacatgaatatgatattaggcgactgtgaagagtttcggaaaattaaatcaaaattgtccaaagttgaacgtgaggaaaaacgagtattaggatttgttttactgagaggagaaagcatagtttctttaacaatagaaggccctcccccaccagaagaaggtttacccagagtaccaatccctggagcagccccaggaccaggaattggtagagctggaggtagaggaatgccacccggcatggcaggtgtacctgtaggtcttcaaggacctgtaagaggagtgggaggaccatcccaacaggtcatgacaccaggaggtagaggccaagtatctgcacctccacagatgaatcaaggaccaccaaggatgggaggaccaccaccaggtatgatgggacctccacccggtatgatgggcatggctccccaaatgggaatgggacgtggaggaccaccgccaatgggaatgagaggacccccacctggtatgatgagaggtggaccacctggacctccaagacctttttaa

SEQ ID NO: 450 - DNA, 987 bp, Diabrotica barberi
atgaattttgaaagttttgatgaaattttagatctgataaaaaatgacatcaccaaacaacaaacaaattttagggaaccaattgatgccacagaacgactatctgttactttaagatttttagctagcggtgattcatacaaaacgattgggaacagctttcggttaggattttcaaccgttgcaactatcgtggatgaaacatctgaagctatatggaaccggttacaaccgatttatatgccagagccaacagaagaaatatgggaaaaatcaatcctaggcttcaaaaatgtatggcagttccccaattgtttaggaagcatagatggcaaacacgtgaccatcagatgtccccagaagagtggatcaaattacttttcctatttaaaaaaattttccatagttcttatggcaattgttgacccagaatataaatttatttgtatagatgtaggtggttatggtaaaaatagtgacggtggtatttttgagacatcggctatgggcagaaaatttgcaaatgaaactatgaatataccacccaacagaccattagctaatgaaaatgaagagattccatgtgtattaattggcgatgaagcttttacactaagcccttacttaatgaggccgtttccttatagacaggcacgaaatgacaacagaaaagagagatttaattatcatctatgcagagcccgacgcgtagtggaaaatgcctttggaatattggcacataaatggcgtctattttttagaccactagaagttaaagttcaaacagctacaaaacttgtgaaggcagcatgcgtattgcacaatttgctgcgcacaaaaaacactgacgagcaatctttgcatttacaagaaaactgcaatattcctttaccagtagttgataatctggcggttgacggaagaagagcagtaaacgaagcttttgaaatacgtgaaaaattcgttacttattttagtaatttataa

SEQ ID NO: 451 - DNA, 1248 bp, Diabrotica barberi
aatccatgtaatccaatacctttaccacctgaatatcctagatttagatattttaaactgggtttgcgaggtggtacaccaatgtggggatttggaagaggagcaaaacggatacctactcccccaaatgctccaactaaaccggaagaaaaaatggcaaaccaagacagtatgatgttacaaaagatgaaaaaggagcctcacttaagcaaagtttctatccttaaaagaaaagttggagctggaagtggcaaaatcggctctcttgttagtacagattacaatgatatggacgatagctcatccacgcctcctataactcctccattagctactacaagtcgaggaggcataccaaaaacattgcccaaaaagattttggagaatcaaagcagcaaggattccgttattgtcatgcacagcccagaggacaaacaacttgatatgatggattttgacgatgacaccaatactgttttatcagcggaagtctctctaagttctgcagctcaaaatgacgaagatatgttggaaatggagacactatcacaacaagatttagctgaaggattatctagtcccttggaacccgatcaaatagcagatgaatatttactatttcctgggaatatggtagttgacatgtctgcaggggaacatttttccgaaaaagaggaggaagaagaaaccgtagatgaagaatttaacgatgaaaacatgcatatcatgattcgtagtcctacaaccagtgactatgaatacattatgcaaagtaagggtaagaaatataacgtaggtgtccacgatgaaaacgatgaaatgccagaatctccagatcaggaagacttggctgtaccgtcacctgaagtttcagacttgttgacaaattacgatgaaaatgatgtcttaatgggcgatcaaagtaacagcacacccgaggaatcaatttctaccaaagaagacttcgaagagttaattgatgaaggctcacgtaagaacagcataacgaagtcagaagtaacaactaaacagatcaatgaattccacaaatacgcaggaatatttaattattccaaaggagttgttcaagcgactcagaatcagacagctttaaataaaattacgagcgtagctaacaaaaaagcacctgcaaaaatatcactcgtagcgggtcctattgtacataatctatcaaccgggaaggtcaatcctgaaaaattgataatcactcaaaatccaaatatttta

SEQ ID NO: 452 - DNA, 2061 bp, Phyllotreta armoraciae
atgcctagagaagattcacttgaaaggcacaaacacaaaagtcacaaaggaaagaaaagccggtccagtagccgttccgaacgtagtcaagaaaaacgcaaacattcatctagctcaaagaaaaagagtagttttcacgaagatgtcgaccgaaagaaaaagaaaaagcgatctaagagctcttctagtgaatcagaatccactagtagcgaaagttcaggtaaatcggtggaactattaaaaaaactcgaaaaggaaagattgcgaacagctgaacagaagaagaaggaaaaggagcttctcaaagctacggaaacagccgaggagaagagattgagaagattgatgaagaaagaggcgaaggaaagaaggcgaaaagaaaaaatgggctgggacaacgaatacttacattacacgaacagcgacaatccattcggagacggaaatttactgaccacattcgtttggaacaaaaaactgtccaaagaaggcatcaaagacgtcggccatgaagaaattgaagcgataaacagattaaaacaagaagagaataaaagggaactggaaaaagtcaagaagcgaagattagagagagaattagagaggcaaagaagagaggaagaaacgcaaatgatgcaaagaactaaagaagcagcccaattcgaggaatgggaaaggcaagaagataaattccacctggaacaagctcgattgagatctcacataagaatacaagacggacgagctaagccgattgatctactagcaaagtacataagcgctgaagaagaagtcgatgctgttgaaatgcacgaaccgtatacttacctcaatggtttgcaaatcaaagacctagaagacttagtcgaagacatcaaagtctacaaagaactagaaagggggaaaaacctagattactggaacgatataacagtcatagtcgaagacgagctacaaaagttgagaaaaatagaaaaacaaaacgatttcgactttggattgaacagaagggaagggatacatcaatctgtagccaccgatgtaacttcggtatttaaaggcaaaacagccgcacaattagcagcgttagaaaaacaaatcggaagtaaaattagcagcaaagccgatggaatagacataggctattgggaatctttgctgtcgcaactcaaagcccacatggcaagggcgagattacgggaccgacatcaagatagcctaagaagaaaactgcaagtattaaaagcagaacaagctatcacaggagtaggtcaaagtcacagcgaaactcattctactgataacgaagaaaccacttcggaacctaaaccaggcacttctcaggattcgttggaaacgatggcgatggaagaaagcaacgaaaaaagcgaagacgctgctcatgcatggctgagcgaatgcttttcggcataccaagcaggcggatacagccccaagtttttaactccagacgataccgagcctggcacgattgtggtctcggaagtagacgacgtaaatagattggaattcgctaggatgcaggtgatgggtcaaggatccaaaattgaaaacgccattacaaaggaagaattgctgctacaaaaggaggcgagaaaaggaatggatggggatgaggctcagttttcggttgagcaagccttggataatccggtgtacctttggtcggataagtaccgtccacgaaaacccaggtacttcaatagagtgcacaccggattcgaatggaacaaatacaatcaaactcattacgacatggacaatccaccgccgaaaattgtacaagggtataaattcaacatattttaccctgatttgatcgacaaaagcagcacgcccgagtattatttaacgcctagccccgagaatagggaatttgctatacttcgattccatgctggaccgccttatgaggacatcgctttcaaaattgtcaaccgagagtgggaatattcatacaaaagaggatttagatgtcagtttcataataacatatttcaattgtggttccatttcaagagatataggtatcgaagatga

SEQ ID NO: 453 - DNA, 1323 bp, Phyllotreta armoraciae
atggacaatttagaagctaacataatggacaagtcgatgagatcggtcttcgtgggaaacatcccctacgaagccaccgaagaaaagctaaaggacattttcggcgaagttggccaagtgttgtccttcaagctggtctttgaccgtgaaacggggaagcccaaaggctacgggttctgcgaataccgagaccaggaaaccgccctgagcgccatgaggaatttaaacggatacgaaataggcgggaggaatttacgcgtagacaacgcttgtacggaaaagtcccgcatggaaatgcaaaatttgctcaaccagccgcccatcgagaacccttacggggagcccattcaggccgagaaggcacccgaagcgatcagtaaagcggttgcttcgctgccacccgagcaaatgttcgaactcatgaagcaaatgaagactaccatacaaaataatcccacagaggcgagacaaatgctattgcagaatccccaattggcttatgctctgttacaagcgcaagtcgttatgaagattatcgatcctcacacggcttccactctactgcaccctgttaatcaagtacctgcgactttgctgccgggcgataaaaatgtggccgtgcaagtaccgattagcaatcagtatcgggaacctccggttccagtgcaagcccctcgacaggagtaccagccggtaccggcgcctgcagtacatcccaatcatgtgcaacagcccgtttttacaggtcaagatgttgatttgcgatcgatgggtaacgtgactgatccgagaatcaggccgatgatcgtcgatcaggatatgagacaaatgccaaatgtcatccagaatcctctaccgcctactataagcgaaagtctcgccaaagcgggagattcgaaacttgataatttttcgagggatcctcgaagtgtcaccggtggtttcccatcagatccaaggcaagctaggatggacccgcgacaaaaaaatataataccgccgacgagccagcaagtaccttcatcggtgaatcccaaaataatggcgaatcaagccggccctgccgccatcagaccggcccaaaacgtcaccgtgcaagctcaatctgcgggtgttgtgcccgctgcatcggctgcagctgcaccggccaatgtgatgagtccaggaataggaggagctggggctacagatcaagaaaaagccgccctgattatgcaagtcctccaattatccgatgagcaaattgcaatgttgccgcccgaacagagaaatagcattttggtgttaaaagagcaaattgcgaagagcgcgcatgttcgttaa

SEQ ID NO: 454 - DNA, 1179 bp, Phyllotreta armoraciae
atggcacatatgtatgcagaacgggaaaaaagcctcctagagtacaggaagaaatggttggagcacaaagaggttgaatccagactaaaagaaatgcgagaacagctcaaagatttaactaaacagtacgataaatcagaaaacgatttgaaagccctccagagtatggggcaaattgtaggtgaagttttgaagcaactgacagaagagaaattcattgtaaaagcaacaaacggtcctcgttatgtagtcggttgccgtcgtcagttggataaagccaagttaaaggccggcacgagagtagctctcgacatgaccactttaaccataatgcggtatttaccgagagaagttgatccgttagtttacaacatgagccacgaagatcccggagatgtcacttattccgccataggtgggctttccgagcagataagggagttacgagaagtcattgaattgcctcttatgaatcccgaattgttcatgcgagtgggaattacaccaccaaaaggttgtctgttgtatgggcctcctggaactggtaaaaccctgttagctagagccgtagcttctcaactggacgcaaactttttaaaagtcgtatcgagtgctatcgtagacaaatacatcggtgaatctgctaggcttattagggaaatgtttaactatgccaaagaccatcagccgtgcatcatcttcatggatgaaatcgacgctatcggtggtcgtaggttttcagaaggtacatcggcagatagagaaatccaaaggactcttatggagttgctgaatcaaatggacggattcgattcgttaggacaagtaaaaatgattatggcgacaaataggcctgatactttggatcctgctctgctccgtcctggtcgtttggacaggaaaatcgagattcctctgccgaacgaacaagctcgtcttgaaattttgaagattcacgcacttcctattgctaaacacggggaaattgattatgaagctattgttaaattgtcagacaccttcaatggggccgatttaagaaatgtgtgtactgaagcaggacttttcgccattagagcagaaagagagtacgtgattcaggaagattttatgaaagctgtaagaaaagttgccgataacaagaaactggagagtaaattagattataaacctgtataa

SEQ ID NO: 455 - DNA, 780 bp, Phyllotreta armoraciae
atggctcgccggtatgacacaagaacgacgatattttctcccgagggaagattgtatcaagtggagtatgccatggaggccatatcccatgctggaacatgtctaggcatcctggcaaacgacggaatccttcttgccgcagaaagacgtaacaccaacaagctgctggacgaagtttttatttctgagaaaatatacaaacttaacgatgatatggtttgcagtgtggcaggaattacctcggatgctaatgttctaactaatgaattgcgtttgattgggcaacggtacttgtatcagtatggtgaatcaattccctgcgaacaattagtttcgtggttgtgcgatgttaaacaagcttatactcaatacggaggaaaaaggccttttggtgtatcgatcttgtacatgggctgggataagcattatggttatcaattgtaccagtccgatccgagtggaaattattccggttggaaagcaacttgcataggaaataacagttctgctgccatttcgagtttgaaacaggaatacaaagaaggcaatatgactttgaaagatgcaaaaagtttggctgtaaaagttctggcaaaaacgttagatatggctaaattgacgtcggaaaaagtggaaatggctacgctgacacgaagaaatgataaaaccatcataaatatattaaataacaaagaagtggaagaacttatttccgagtacgaaaaatccgaagcggccgcagaagccattaagaaacaagaacaaaaatccgctgcttaa

SEQ ID NO: 456 - DNA, 2661 bp, Phyllotreta armoraciae
atgagtgaatcaaaagccgaacctataaaggtggaatcaaaagcaaatgatgacaaaaacaaaaacgatctttctgatgaagataaacaacttcaagaggaattgaacttgtgcgtggaaaaattacaagaaaatgacagtaaactgtatatgcccgcattgcaagctttgggaaaccacattcgggcctcgactacttcaatgacttccgtgcccaaaccactgaagttcatgaagcctcactacgatacaatgaaacagattttcgagaaaataactgaggccccagttaaatctctctgtgcagacattatctccgtactagctatgactatgggagaaggaagagactgcttaaaatacaggctagtgtccgatttggacaagatcggtgaatggggtcacgaatatgtcagacatttggctggagaaattgccggtgaatgggctgaaaccgatttcttagtaaacacagaaattagggataagctcatactcttaacaaagcagatcgttccttacaatatggcccataatgctgaagcagaagcttgcgatttattaatggaaatcgaaagactagacttgctcgagcaatacgtggatgataatatttaccaaagggtttgcttgtatcttacaagctgtgtgccttacgtagcggatccggaaaatactactcttcttcaaaccgctttaatgctattcaggaaattcaagcagtaccctcaagcactccgactggctatgcaattgaatgatcacagcctcatcgaagaaatattcctaaattgtcccgatactgatgtacagaaacaattggcattcatgctgggcaggcaacagatttacatagaagttcccgacagcactccggaatacgaagacctcattgaaataatggcgaattgtcatctgaacaaccactttttgaatcttgcccgtgaattggacattatggacccgaagaccccggaagatgtttacaaatcccacttggaaaacagccgacctccgttcggtggaagccaagtcgattctgccagacagaacttggctgcaagcttcgttaatggtttcgtaaacgctgctttcgggcaagataagctcttgatggaagatgggaataaatggctctataagaacaaagaacacggtatgctaagcgctaccgcttcattgggtttagtattgttatgggacgtcgatggaggtcttacgcctattgataaatacttgtattcctctgaagatcacatcaaatctggagctctattggcgtgtggtattgtcaattgtggagtcagaaatgagtgtgatcccgctctggctctattgagtgactatgttcttcataacacgaatataatgaggataggtgctattgtgggccttggtttagcttacgttggatccaacagagaagcagttttaagtttactcactcctgtcttctccgatccaaaatctaacatggaagtgatcggtatgtgtgcgctggcttgcggaatgatcgcagtgggatccggaaatctccaagttactaccacgattatgcagacgttaatggaaaaatcagaaactgaactgaaagatacatacgctagatttttgcccttaggtcttggcttgtgtatgttgggcaaacaggagggtgtcgattccataattgccgcgctggaagttataccggagccttttaaatcaatggcaactacgatggtcgacatttgcgcttacgctggcaccggcaacgtacttaaagttcaacatttacttcacatttgctctgagcattacgatggtgacagctcagacaagagttctaaagataaggacaaaaaagatgcttcagagaaggagaaagatctttcatcgagacaagcagtggccgtactcggcatagctttgatcagtatgggtgaagacatcggtagtgaaatggccttccgaacctttgggcatttgttgcgctactgcgagccagtaatcagaagagcagtaccattagctctaggactcatttcagtatcaaatcctaaattgagcatactcgatactttgagtaaattctcgcacgacagtgatgctgaagtagcccataatgccatatttgctatgggcttagttggagcgggtacgaataatgcaagattggccgcgatgctcaggcaattggcgcagtatcacgctaaagatccaaacaacctatttatggttcgtatcgctcagggtctaacacatttaggtaaaggaacattgacattaagtccttatcacagcgaccggcagctcatgagccctgtagcagtagcaggattaatggctacgcttgttggatttttggatgttaaaaacattattttgggaagatcgcattatctcctatacactttagcagcggctatgcagcctaggatgctcgtgacatttgatgaagatttgaacccattaccggtacctgtgagagtgggattggctgtagatgtagttggtcaagctggtaaaccaaaaactataaccggtttccaaacgcataccactcctgttcttctcgcatatggtgaaagagctgaactggctactgaagaatacttggcactcactccgattatggaaggttttgttatattaagaaaaaatcccgacttcaatgcataa

SEQ ID NO: 457 - DNA, 1356 bp, Phyllotreta armoraciae
atgaccgacagtaatatggattcaaaagaagagaaacaagcatcaccggaaaacgtgaagctgaaactagaagcatccgcgcccgagactcctccaactcaaaccaccgcaaccggcgtgatccgaagaaattttatcactccggccggcacaatagttgaaaccaacgaagagcaaccgccggaaccaacgatagaagaagtcgtcaaaacgacatcgtcgaatccaagtcccgccgaacagaaaacggaacccgcagaaatagtcacctacgctgcggaggtcctgccgcaggagcagagagagcaattcgctgacgccaaatcttacgccgtggaaatgcctgccgaaaattttcaaaatcagagctatacgcaggacattagttacgtgaatatagaaggaactgttgtgccagttacaatatcggaaatagaacatcctggggactacgccaatctacaaaccgctcaatacaataacggctatacggacggtacacaatatttaaccaatcatcaataccaaaatttgtatatagatagaagtacagttgataattctccttctgctacagttttataccgtggcgatgatccaaatttgggagcttccagattccaaggaaactacgacatatccagttctcaatcgcaagtgaaccttcttcccgcttccggagaagcctactatccatcaacgtctaactggacgccaaccagcagcgggtcttaccaacaacaatacccgtcgggaaacgtccttcaagctgattcgactcaagctttcgcaggtccttacataaacgctacctggtcgtcgaattcgatggaggacggacggcaatctagtcaagagaccggaaatagaagaaacggcgtaacgtgtgcaaattgcaaaactaacaacaccacactttggagaagaaacaaccaaggcgagccagtttgtaacgcttgcgggctttactttaaattacacaatgttaacaggccgatcagtatgaaaaaggaaggtatccaaacgcgcaaaagaaggcccaaaaactcttcggtcggaaaccctgcgagtgctgctggtcaagtaagaatggggcttccctcttatcaataccaagatattgaagtacagcaagatcaataccaattaccagttaacgtttattctcaaagaccacaagtttcttatcggcattacggaacagaaaatattggaactttaaatgcccaaccactgcagccaataattactcacgaagatgaacaggcaagcgtcattacatcgacttcacaacaggctaggtttaggacgaaggtggaagaagacgaaggaagcaatccatccatgcaatcctaa

SEQ ID NO: 458 - DNA, 4827 bp, Phyllotreta armoraciae
atggcactaccgggcaacgggatattcgtcgtcaaaggcgaaatatcgaacttgatggccgccatgaagaggggccccaaatggtcgtcgcactcctatcaagacgacgacgtcgacgcgctgctgaggaatttccaagagctcagggacattttacacaacgtaaacgatctaggatacgtcgagcccaacaccttcttggcccctttcttaaacgtcatccggtcagaagagactacgggtcctgtcaccagtttagccctatctgctgttaacaagttcctctcttacggtcttttagatcctgtacaaacttctattccgcaaactattcacacaatcgcagatgcagttacgcacgctcgattcgtgggcactgatcaatcctccgatggagtagtactaatgcgtatcctgcaagtcctacgaactctcaccctctcccccgagggctccacactgaccaacgaaagtctctgcgagataatgctgtcttgctttcggatatgcttcgaaacgagactatccgaactgctccgtaaaaccgctgaacattacctgaaggacatggtgcaattgatattcatgaggctgcctcagttctccgaagacccgaagctctcctatgtgaaacgtttgcggatgcagccgggggacctcgagcagacgagaacgaagaggaaaaagtacttgaagaaggagaataaagaggttgttaaagtgcagcagcaagaaattaatgtagaaactgatatagtagatatgcaaggtgctattcttcgtaataacgaaactactggtgttagtacgccttctagtccgaatccgaacgatacagatgttgctgtagacattcctgtagatgatagtacgaagaatttagaaacgtctttagacgatagtgcggagaaggaagtcgatgaaccgtttcaagactatgtcaatcaaaggggtattcggtttacgcctcaattccaacaggagaccaacctatctccttatggtttagcctgcgtacgcgaactgtttagattccttataagcctctgcaatcctttggataagcagaatacggacgtaatgataaatttagggctcggtttgctcacagtagcgtttgaaataagcgcagacaacataggcaaatacagcacattattagccctagtggaagatgatttatgcaggaatttattcgctttgatgaacaccgatcgattaacaatattcgcagcgaatttgcaagtatcttttttgctgttcgagtcgttacgagctcatttaaagtaccaattagagtgttatttgaagaagcttatggaaatcatgcgtagcgaatcgaataaagtgagttatgagcacaaagaaatcgccttggataatttgctgcagttgtggagggtgcccgggttccacgccgagctctatgtaaactatgattgcgacatgtactgtgctaatttgtacgaggagctcaccgagctgctggccgaacggtccatttctaccgttgtgggagtttatcatgcgcatttgctgtcgctcgacgggcttttgattataatcgatgggatagggaagagattcgatgaagcgaaagatcgatcagataccgatgagattagcagttatacaggagagaatacgaggattaaaggttgtgttaaagttcccgataagaaggttttggctgcgaagaaggcgatcaaaaaatggttgccgcaaggtacggagtatttcaatcagaagccgaagaaaggtatacagttcctgcaagagcacggcgttttaaagcaggaactcgacgtggaggagattgctagattcttgcgggagaatcctgcgttgaacaaagctatgatcggagagtatattagcaatcgggggaatttgaagatactagaggctttcgtgagcacattcgatttcaccggaatacgaatcgacgaagcgcttagagcgtttctggagacatttcgattaccaggtgaagctcccacaatttcgctgatcctggaacatttcgccgagcactggcacaaaagcaacggagaacccttcgctgacgtagattctgcttttaccttagcgtatgctgttattatgctaaatgttgaccaacacaacgaaaacgccaaaaaacaaaccattccaatgtcaccaaacgctttcaagaagaacctgaaaggcgtaaatggaggtgacgatttcgaggaagagatgctcgacgaaatctacacgtctatcaaaagcgaggagatcgtgatgccctccgaacgaacgggtctcgtgcgcgacaactacctgtggaaagtcctgctgcgcaaaggcagatcgcccgaaggcggcgtttacatgcgcgacgacggcggcgcctacgactcagaattgttcagcatcgcctacggtcctctagcagccgcattgaattcagtctacgagcgagcagaccacgaaggcgtccaaaagaaagtcatgcgaggtttcgaacgatgcgcttccatagcgtctaatctaaatatgacttccaatctcgacatgttgctggtcagtttggcgaaattcaccgtattccacaaccatcagaagcaaactgctgttgtggtgcaattcggttcgaacggtaaagctcaattagctctgaagacgctttttatgctgatccaccagcacggtaactccacgagggagggctggaagcatctcttcgatctcctactcgctttgtacagcaacgatttgctcagcaagggcttcgtggaggtcgaagacttcgtagaaccttcgggtaaattatgtttagtgtataaagatgcaccgagcgcagccaaacaggatacaggattgttaagctctttgtactcctacatgatatctgtcgagaatttatctaaaataccttctccagaagaacagagtttgatagacaaagccagggaatgtatcaaagagtgtaacttggagcaaatgattactgattcgaaattcctccatcaacaagctcttttccaactggtcgatactctaatagaattatccagaggtcctgaaatacaagaaggttcatcgtacgactacaacgaaaacataacagtcttcttcctcgaattactcgtgaaaatcgtcatacaaaacagggacagagtcatgaccatatgggatcgcgtcagagaccacgtctacaccctagtcatgaattcatcgctgatgagctaccagtttctcctggagagatcggtggtgggtttgttgaggattgccgtgcggttgatgcgcaacgaggagatgagccacgtggtgttgcagtcgctgcgcatgctgctgttgctgctgaagggcggcgtgctggcgaggatatccagacagatggcgttcgggttgtacgagatgctgaaaacttcggcgcagaatattcacacgacggccgattggacggtggtgttcgcgctgttggagtgcgtgggagccggggcgaagcctcccagacccgtcttgactgccgaagaaaccgatgctaaacccaaacctgacgaagaaacttgctctaaacaagacgaagaaagcgcagaaaaaaccaacgacactaccaaaactgcgtcccaaaggccccaaagtccggtaacctcgatcacctcaccggtcggcacccccaacaccggcggatggatcatcgtcagcgacgaagaagatctccaaccccaccaaactcgccagcaaaccttaccgattcactaccacctgcgcctcgacgccgatttatccccccacgatccgctcagcatgctcaaatgctgcgagagcttggcctttttagtgcgcgacgtcgcccacatcacaccgtacaacttcgacgtgtgcgtgcgctgcgtgcgcaccttcgtcgaggccgcgctcaaacctcctcccggcaaccaatcgaacgagcgaagatccaacgcgaggaaaagcaggaagagaagtcctgcgggaagccaagaggaagacagcagcggcggcgacgaggacgaagacctgcccagcggctaccaccaggtccccatacaactactagacctgatgcacacgttgcacacgcgcacagcgcagatattcaaatggtgggcagaagaaggcggggagatatccggggaaacttccttgtggacgcaaggttggtgtcctttgctgcaagggatcgcgcgatcctgctgcgacgtccgcaaaacggtcagaaccagcgccatcgcttacctccaaagagctctcctggtgcacgatctccaaactctaacgccccgcgaatgggagcagtgcttccgaagggtgctcttccctcttatgaactacctactgcaatccggaagtcccagagacgccgtatccaccgaagaaacgaggataagagctgccggagtgctgtcgaaggtgttccttcaccatctggcaccgctgtcttcattagcgggcttcgctgatctttggtcgacggtgctggagctgatggacgggtacatgcacgccgacggtagcgagctgctgctggaggccgtgcccgagagcctgaagaatatgttgttggtgatggaggcggcgggcgtgttcgacgcgcccgacggcaagaagaacgttttgtggacggcgacgtgggagagaatagggaagtttctgccggggttgaaggacgagctgtttagggagatggggtcgaggaagaaggtcgtggaggaacgggagagggaggtgaatgactctgatgtgaggaaggaggcggagtgttgggagaagaacgttgggggaagggagcaagatgtggatgggagggagaaggaggaagtggttgcttgttga

SEQ ID NO: 459 - DNA, 618 bp, Phyllotreta armoraciae
atgtcgattttggcgtacaacgggggcgcgatggtagcgatgaagggagagaattgcgtagcaatagccgccgaccgtagattcggcatacaagcccaaacagtagccacgaatttcgagaaagtcttcgaaatgggcccgcacctgttcgtaggcctccccggcctcgccaccgacacgcaaacggtcatggagaagctcaggttccgcaagaacctgtacgaattgaaagagaaccggcggatctcgcccaaggtgttcgcagccatgatatcgaacatgctgtacgagaagaggttcgggccgtttttcgttgaaccggtcgtggccggtctagcgcccgatacctttgagccttacatatgcaatatggatttgatcggttgccttaacgagcccagcgatttcgtcgtgggcggtacggcctctgcgcaattgtacggaatgtgcgagtccttgtgggagcccaatctcgcgcccgatgatctattcgaaactatatcgcaggctttgataaacgctttcgatagggacgccatatccggttggggagctaccgtttatattgtagaaaaggataaagtaaccataagaaacctgaagactcgcatggattaa

SEQ ID NO: 460 - DNA, 2886 bp, Phyllotreta armoraciae
atggacggaaaaccagatttggaagtggtgaaatcagccgtatcaacattatacaacaacccggatggtggagaaaaagaaagagcctcccgatggctattggaattacagaaatcggttcacgcatggaccgttgccgacgagttgctgcgtcgttgcacaaacgccgacgatctccaaacccgctatttcgcggctcaaacgatgcgcaccaaaatacaccaatctttccacgaactacccagagaagtccacgagtctcttagggactcgcttctggagcacatgggagcttgcgctggcgtcgatgagggcgcaggtgccgccatagtgacgcaattatcgcttgcacttgcggatttggccctactgatgcccgattggcgaacgcctgcactggatttgatcagcagattcagtgcggggaataacgtgtggccgttgttggaggtattgactgtgctccctgaagaattggagagcagatcagtaagactaggggaaaaccgacgatacgaggtattagaagatatgaaattctgcgcacccactgtgaatgaatttttgaagcattgctccaatttatatggaagagggggatcggaaaggttagcagcaggtcatagaccaatcgacgtaaaaatcctcagatgttttgcttcttggatatcagttggagcaattggacctagtcaattaagcgaggatcgggtcgtagtcgacatggcttttgacgtgttgaaagcagatgaaaaagaaaacataacaggtcaacttcacgaagccgccacagactgtatttgcaccttgctattacgtctcgaggataacaacaatcacgtcgcattagaaacccatttatttgaaaatatagtgaatttagaagtggcctatcacgcatccgtcgccctcgaagatcaagcaaagtcgacggattattgtcgactatttaccgagttggcggaatcgtttttggggaagattgtagacgacggtggaggcgggagcggcgacggcggaggagcgaagaggcgtaccgtgtacgccgttaaatgcctggatttggtactgatgtgcgtcggccatcatgattacgaggtggccgagataacttttaacctttggcatatgctaagtgaggaattatatcagaaaaataataaggaattaacggaattattcaaaccatatgtggaacgattgatcacagctttatgtaggcattgtcagatggagccagacatggagggtttactcgaaaaaggagatgaatttaaagattttaggatgaaagtctctgatttaataaaggacgtcgtctttatagtaggaagcagcagttgcttcagacaaatgtttatcaatttgcaaacctctggtgtaacgtgggatgccagtgaagccgctctctttgtaatgcaggctgtagccaaaaacgtcttaccaacggaaaacgaagttgttcctaaagtcgttgaagcaatactgaacatacccaacagcgcacacgtcgctgtgaagtacacctctgttctcttactaggcgaactggccgaatggatagaaaagcacccggacgctttggatcccgtccttaatttcctaatttgctgccttcgaagcggtgccgaaggtggaggcgtcgcaacggcggcggcggcggcgctgcagaacgtatgcacgtgctgtggagctcacatgggcaggcacgttcccattctgttacagttgcttcaacagtcggattcgttcggcatcggcaacacggcgatcataggattattgaagggcgtcgcgtcggtggtgagttgcggcatcggaagcagcgccgaaacggcctccgccgtacgggaattgtgttctttgcaattgtcgccgttgtgcagtttgatcgaaaacaacgttcgacccgttaaagcaactttaacggatccggtgctgtggttggatagattgagttcagttttgagatacgttaatgtcaatgttgttgaaggagaaatccatccttgcaaaccggtaataatggagatatggccgatattatctcgcgcattcgacacataccacagcgacgtccggataatggaaaggtgttgtcgctcggtgcgtttcatgttgcgttgcgtagctcgacaactccaagatttgctgccttctttggtcggccaaatcgtgcacatttaccgtctctacggacattcttgttgtttgtacgtcggcagcattttagtggacgaatacgccggagatgcgacttgcgttcaaggtcttctcgacatgttaaatgcctttttggaaccgacgtttcgtttgttgcaagaagaaaatggcttgaagaaccatccggatactgtggatgacttctttaggttgtgcgcccggttcgtccagagggcgccgaaggcgtttctaagcggaggggcccatctggcgcccattatgcaatgctcccttctcgctgccaccttagatcacaaggaggctaacgtgtctgtcatgaaatttttctacgatttaataaatcagggactgagcggcagaggggaacccgacttcgacgagagaaaagccttggttaggagcctgctaaacgaatacggccaacaactcgtgtctaatttaattcactcttgcgtattttacctgcattcatacatgttaagcgaagtgggtgacgtttttgtgcaattgttagatttcgatagacagataacgagtgaatggttagcgaacggtttggaattattacccaaacagcagaatggtggaataatggcggctaagcctaaacaattaaatgatgttcatgcttctataacgagatcaaacagttctaaatcggtgacgcacgccctgaaagacctaaccaggctatatcgttaa

SEQ ID NO: 461 - DNA, 1506 bp, Phyllotreta armoraciae
atggctcaaagatttcccggaccggtgtcgaatcaagtcccagggggcccgccgccgcctcaaaggtaccaacaacagccgcctaatcaaggaatgaggcaatacggccaacaggcctttcctcccagaccgggctacaatgctccacctccaatgcagtcgagcggaggcactatgattcaaagaccgcccggggccccctattcgccgatgcgaggaggccccatgccgccccagccggtgggaaagaggccttcggataacaggaatcctttgcaacagaaaactggtgattacagccacggtacgagtaagaaaaaaaagaagcttgctgataaaattttaccccaaaaagtaagagatttagtgccggagagtcaagcttacatggacttgttagctttcgaaagaaaattagattccacgattatgcgaaagagattggatattcaagaagctttaaagcgtccgatgaaacagaaacgaaaattaagaatcttcatttcaaacactttctatccggcgaaggagccccaacccgaaggccccgatggcccttgccaagaaggcacggtagcctcttgggaacttagagtggaaggaaggctcttggaagactcgaagaacgatccgaacaaagtaaaacgcaaattctcctcgtttttcaagtcgctggtcatcgagctcgacaaagaactctacggccccgacaaccacttagtcgaatggcacagaaccttgaccacccaagaaaccgacggtttccaagtgaaaagacccggcgacaagaacgtgaggtgtacaattctactgctcctcgactaccaaccgctgcagttcaagctcgatccgagactagcccggttactcggggtacacacgcaaaccagaccggtgattatatcagccttgtggcagtacattaaaacgcaccggctgcaagacggtcacgagcgcgagtacatcatttgcgacaagtatctagagcagattttcaactgtactcgtatgaagtttgcagaaattccccaacgattgaaccccctgctgcatccgcccgatccgatcgtaataaatcacgttatatcagtcgaaggcggtgctgaaagcaaacagacagcttgctatgatatagatgtggaagtggacgatacccttaagactcagatgaataatttcctgttgagtaccgctagccagcaggaaattcagggattggacgcgaaaattcacgagacagtcgatacgataaatcagctgaaaaccaacagggagtttttcctgagtttcgccaaggatccgcagcaatttatacataagtggatcgtgtctcaaacgagagatctcaagactatgaccgatgtggttgggaatccggaggaggagagacggtcagatttcttctatcagccttgggctcaggaggctgtgtgtcggtacttttacactaaggtgcagcagaaaagggccgaattggagcaggcacttggtattcgtaataattag

SEQ ID NO: 462 - DNA, 885 bp, Phyllotreta armoraciae
atgccagcagctactttgggtagcattccacatcctaacaatgaagactgcggcattcgggacgtttgggctcacaatttagaagacgaatttcgaactataaggcaaatagtgcagaaataccaatatgtcgcaatggacaccgaatttcccggggttgtggctagacccataggagaatttcgaagttcagccgattaccaataccaaatgttaaggtgcaacgtagacttactgaggattattcaactaggtttaacgttcttagacgataatggcaaaacgccgggaggagtttatactacctggcaattcaattttaaatttaaccttcaagaagacatgtacgcacaagatagcatcgatttactgcaaaactcagggatccaatttaagaagcacgaagatgaaggtatcgagccattagaatttgccgaactactaatgtcctctggaatcgtgctcatggaaaatattaaatggttatcgtttcattccggctacgattttggctatttaataaagttactaaccgacaacaatctcccacaagacgaaaccgaatttttcgatctattaaaattgtattttcctacgatatacgacgttaagtatttaatgaaatcgtgtaaaaatttaaaaggtggtcttcaagaagttgcagaacaactagaattggaaaggattgggcctcaacatcaagccggatctgactcacttctgaccggaatggcctttttcaaaatgaaagagatgttttttgaggatactattgacgattcgaaattttcgggccatctttacggactcggaacgtctttcacagttaatggtacaactaacaattacggaaacgataacggcgacacgacaaactcctcatga

SEQ ID NO: 463 - DNA, 1212 bp, Phyllotreta armoraciae
atggcggaagctcagaaaaggggagcttcggttttcgaggacctctcgaacgtcgaattcgagaccagcgagaatttggatgtgatcgaaaagttcaaagatatgaagctgaaggaggaactgcttcgcggcatcttcgcatatggtttcgagaagccttcggctattcagcaaagagccattattcctgtgatgaaaggccgggatgttatagcccaagcacagtcgggtactggtaaaaccgctacattttccatagctattctacaagccctagatttgacaatgagagaaacccaggtgttgtgtttatccccgactagagaattggctgtacaaattcaaaaagttatactagctctaggcgatttcatgaatgtacaatgtcacgcttgtatcgggggtacgaatcttggagaagacatcaggaagttagattacggacagcatgttgttagcggtacacccggaagagtttatgatatgattcgtagaagagctttgaggactagatcggtgaaaatgctggtcctagatgaagccgacgaaatgttgaacaaaggcttcaaagaacaaatctatgatgtgtacagatttcttcctccgtccactcaagtcgttttaatttctgctacgttaccccacgaaatccttgaaataacatccaaattcatgaccgatcccatcaggattctagtaaaacgtgatgaactgacgctggagggaatcaaacagtttttcgtcgccgtggagagggaagaatggaaattcgacactctatgcgatctgtacgacaccctaaccatcacgcaagccgtaattttctgcaacaccaaaagaaaggtcgattggttgactgaaaagatgcgagaaaacaacttcaccgtgagctccatgcacggagacatgccccagaaggagcgcgacaacattatgaaagaattcagatcgggccaaagcagagttttgatcactactgacgtatgggccagaggtatcgacgtacaacaagtttcgttggttatcaactacgatttgcccaacaatcgtgagttgtatattcatcgaatcggtcggtccggtcggttcggcaggaagggtgttgctatcaattttgttaaatcggacgacattaggattctgagagatatcgaacaatattattccacgcagatcgatgaaatgcccatgaatgtagccgatttaatttaa

SEQ ID NO: 464 - DNA, 1632 bp, Phyllotreta armoraciae
atgaccgctcctgctgccggtggcgatgcaagaggaagaactcttgcctacaaagacaaaagcaaacccgccgatgtccggactagcaacattaacgccgctaaggctgtctgcgatgcaattcgtactagtttggggcccagaggaatggacaaaatgatacaagctggtaacggtgaagtaactattaccaatgatggagcaacgattttaaaacaaatcaacgttattcatcccgcagcaaaaatgttggtggaactgtcgagagctcaagatatcgaagccggtgatggtacgacatccgttgtggttattgccggagctcttctagatgctgcagaaaaattactacaaaagggaattcaccccacggctatttcggagtctttccagagagctgctcaactagctgtcgaaattctacaaggaatttcaacaccagtagaaatcaccaacagggagttattaattaaaagtgcttctacttctttgaattccaaagttgtatctcaacagtcgagtctcttaggccctctggcggtcgatgctgttcttaaagttgtcgaaccagggcacgaacaagcgtgtaacttgatagatgtcaaagttattaagcaattgggcggtactgtggaagataccgagttgatcgagggtatcgttttctcgcagaaatctgccaacgtatctggcccgaagaaaatcgaaaaagccaagattggtttcatccaattctgcatttcccctcctaaaaccgatatggaccacaacgtgatcgtatctgattacgctgcgatggatcgagttttgaaggaagaacgagcttatatcttgaatattgttaaacagattaagaaagccggttgtaacgtacttctggttcagaaatcgattctccgagatgctgtatccgatctggcccttcactttttggataaaataaagtgcatggtcatcaaggatgtcgaacgagaagacgttgaatttgtgtgcaaatcgttgggttgtagaccgatcgcatctctcgatcatttcaccgcagagaatttagtaacagccgatttggtcgaagaagttggactaggcggtaaccgaatggtgaaaatcacgggtattcaaaatgcggggcgtactgtcaccctgctcgtaagaggctcgaataaactagtattagaagaggccgaaaggtctctgcatgacgctctttgtgtcattcggtgtcttgttcgcaagaaggcgttgatcgcaggtggcggagcacccgaaattgaagttgctctcaagctggctgctatggctaataagttggagggcattgatgctatttgtaccagagcttacgctactgctttggaaattataccgtttactttggcggagaatgctggattgaatcctatacagacggttaccgaattgaggaatagacatgcaaaaggtgaaacttctgcgggtattaatgttcgtaagggcactattacggatattttggaagaaaatgttgtacaaccgctgttagttagcacatctgctttgagctttgccactgaaaccgtcaggtccatattgaaaattgatgatattgtaagtaaaaattttgattacttttggataaatggtaaaatttcttga

SEQ ID NO: 465 - DNA, 1230 bp, Phyllotreta armoraciae
atggaggctatggatattgtaataccagaaaaagaggaaggcagcccttccgaagtgaaacaggtcctgcaagatttagacatggaagatctgtacacgaaatacaagaaattacagcagacgttggagtttttggaagttcaggaagaatacatcaaagacgagcagaggaatttgaaaaaggagtacttgcacgcccaagaagaagtcaaacgtattcagtcagtacccttggttatcgggcaattcttagaagcagttgatcagaataccggcattgttggatcaactacaggttctaattattacgttcgcattctctctacaatcgatagggaattattgaagccctcagctagtgtagccctacacaagcacagcaatgctctggtggatgtgttaccccccgaagcagattcctcgattagcatgcttcaggccgatgagaaaccagatgtacaatacagcgatatcggaggtatggatatgcaaaagcaggagatacgagaggctgtagaacttccgttgacccacttcgagctgtacaaacaaatcggtatagaccctccgagaggtgtgttgatgtacggtccgcccggttgcggcaagaccatgttagccaaagctgtagctcatcacaccacagccgcttttattcgagtggtcggttcggaattcgtgcagaagtacctgggcgaagggcccaggatggtgagagacgtgttccgtttggccaaggagaattcccctgccatcatattcatcgacgaaatcgatgctatagccactaaacggttcgatgcccagacgggagccgatcgagaggtgcagagaattctgctggaattgttgaatcaaatggacgggtttgatcaaaccaccaacgtgaaggtgataatggcgacgaatcgagccgatacgttagatcctgcgcttcttcgaccgggtcgtttggataggaaaatcgagtttccgttgcccgatagaagacagaaacggttgatattcagtactatcacgtcgaaaatgaatctatctgaagaggttgatttggaggattacgttgctaggccggatagaatatcgggggctgatattaacgctatttgccaggaagccggaatgcacgctgtaagagagaatcgctacatcgttttgccgaaagatttcgaaaagggttacaagaataacatcaaaaaagatgaaagcgaacacgaattttataaataa

SEQ ID NO: 466 - DNA, 489 bp, Phyllotreta armoraciae
atgccaaacataaagctgcaatcttcggacggcgagacgttcgaaatcgacgtcgaaatcgccaagtgctcggtgaccataaaaaccatgttggaggacctcggcatggacgaggaagaggaagaggtagtaccgttgcccaacgtaaactcagcaattctacggaaggtcatccaatgggccacctaccacaaggacgacccgccgccgcctgaagacgacgacaacaaggagaagagaacggacgacatatcctcgtgggacgcggatttcctgaaagtcgaccaagggaccctgtttgagctgatcctggccgcaaactatctcgatatcaaagggctgctcgatgtaacttgcaagactgtagccaacatgataaaaggcaaagcaccggaggagatacggaaaacgtttaatattaaaaacgattttaccccgtccgaggaagagcaagtgcgcaaggagaacgagtggtgcgaggagaaatag

SEQ ID NO: 467 - DNA, 1038 bp, Phyllotreta armoraciae
atgaaggcagcaaataacactaaatccgttaaaatgacatcgccaaaattgaataacgtcgaaagcgtcgataaatcggagaaaggaaagataaaaaacgtagtaataatggacgataaggcttcatgtaaggaactagatcaatggatagaacagttaaatgactgtaagcaattaaccgaaaaccaagtgaaaactctgtgtgataaggcgaaagaaatactgtccaaagaatcaaatgtgcaggaggtaaaatgccctgtcaccgtttgcggagatgtacatggacaatttcacgatctgatggaattatttaggataggcggccgaagtccagatacgaattacctttttatgggtgactatgtcgatcgtggatattattccgtcgagactgttactcttttggtggctttgaaagtcaggtataaagaaagaattacaattctgagaggaaaccacgaatcgagacaaatcactcaagtatatggattctacgacgagtgcctacggaaatacggaaacgcgaacgtttggaaattcttcaccgatttgttcgattatctgccgcttacagcgctcgtcgatagtcaaatattctgtttgcacggaggtctcagtcccagcatcgacaccttggaccatattagagcgctagatcgtttacaagaggtacctcatgaaggtccgatgtgcgatcttctctggtcggatcccgacgatcgcggaggttggggcatttctcctcgcggtgccggttatactttcggacaggatatatcggaaacgttcaaccacagcaacggtttgacattggtctctcgagcccatcagctcgtcatggaggggtacaattggtgccacgacagaaacgtcgtgactatcttcagtgctccgaactactgctatagatgtggtaatcaagctgccattatggaattagatgatgcgcttaaatattcattcttacaatttgatccagcaccgagacgtggcgagcctcacgttacccgcagaactccggattatttcctttaa

SEQ ID NO: 468 - DNA, 1602 bp, Phyllotreta armoraciae
atgcagatcttcgtaaaaaccctcactggcaagaccattactcttgaagtcgaaccatctgacaccatcgagaatgtcaaagctaaaattcaggacaaggaaggtatcccaccagaccagcaaagattgatctttgccggtaagcaattggaagatggccgtactctttccgactacaacatccagaaggaatctactcttcacttggttttgagacttcgtggtggtatgcagatcttcgtaaaaactcttaccggcaagaccattactcttgaagtcgaaccatcagacaccattgagaacgtcaaagccaagattcaggacaaggaaggtatcccaccagaccagcagagattgatcttcgctggaaaacaacttgaggatggccgtactctttctgactacaacattcagaaagaatctactcttcacttggttttgagacttcgtggtggaatgcagatcttcgtgaaaactctcaccggtaagaccatcactcttgaagtcgagccatcagacacaattgagaatgttaaggctaaaattcaggacaaagaaggtatcccaccagaccagcagagattgatcttcgctggaaaacaactagaagatggccgtactctttctgactataacatccaaaaggaatctactcttcacttggttttgagacttcgtggtggaatgcaaatcttcgtaaaaactcttaccggcaagaccattactcttgaagtcgaaccatcagacaccattgagaatgtcaaagctaaaattcaggacaaggaaggtatcccaccagaccagcagagattgatcttcgccggaaaacaactagaagatggccgtactctttctgattacaacatccagaaggaatccactcttcacttggtacttagacttcgtggtggaatgcagatcttcgtgaaaactttaaccggaaagactatcaccttagaagtcgagccatccgacacaatcgagaatgttaaggctaaaattcaggacaaagaaggtatcccaccagaccaacagagattgatcttcgccggaaaacaactagaagatggccgtactctttctgattacaacatccagaaggaatccactctccacttggtactcagacttcgaggtggaatgcagatcttcgtgaaaactttaaccggaaagactatcaccttggaagtcgagccatccgacaccattgagaatgtcaaagccaaaattcaggacaaggaaggtatcccaccagaccaacagagattgatcttcgccggaaaacaactagaagatggccgtactctctctgattacaacatccagaaggaatccactcttcacttggtactcagacttcgtggtggtatgcagatcttcgtaaaaactcttaccggcaagaccattactcttgaagtcgaaccatccgacacaatcgagaatgttaaggctaaaattcaggacaaggaaggtatcccaccagaccagcagagattgatctttgctggtaaacaacttgaagatggccgtactctttccgattacaacatccaaaaagaatctacattgcatttggtactccgtcttagaggaggacagtaa

SEQ ID NO: 469 - DNA, 1623 bp, Phyllotreta armoraciae
atgatgcaacctcaaatactactcctcaaagaaggcaccgattcatcgcaaggcaagccgcaattgatatccaacataaatgcgtgccagaatatagtggacgctatacgcaccaccctggggccccgaggtatggacaaattgatcgtttccaacagaggctcggcgaccatttcaaacgacggagcgacaatattaaatttactagacgtcgtgcatccagcggcgaaaactctagtcgacattgcgaagtcacaagatgccgaagtaggcgatggcacgacctcagtggtgttgctagccggcgagtttttgaagcaactgaagtcctacatcgaagaaggcgtgcacccgaggatcatcatcaaagccgtacgaaaggcaacgcagatttgcttggagaaaatcaactccctggccgttaaaatcgacaaaacgaacgccgatgactacagatcgctgttggagaagtgcgccgcgacggcgatgagctcgaaattgatcaacaaacagaaatcgttcttctccaaaatggtggtcgatgctgtcttactgctcgatgaacttctaccgttgaacatgatcggcatcaagaaggtgcaaggcggtggtttggaggagtccatgttagtcgccggagtggcctttaagaaaaccttctcgtatgccgggttcgaaatgcagcccaagatttacaaagactgcaagatcgctctgttgaatatagaattagagctgaaagctgagagagacaacgccgagatccgtctgagcagcgtcaaggagtaccagaaagttgtcgatgccgagtggaacattttgtacaacaaactccagaaaatttacgaatccggagccaacgttgttctgtcgaaattacctatcggcgacgttgctacgcaatacttcgccgacagagacatgttctgcgctggaagggtccaagaagaagatatgaagaggaccttgaaagcatgcggtggctccgtaatgaccacagtcaacgatttaaaagacgatgtgctaggtaactgccagctcttcgaagagaaacaaattggaggggaccgatacaacttcttcaaaggctgccccaacgccaaaacctgcaccataatcctacgaggaggagccgagcaatttttggaagaaaccgagagatccttacacgatgccatcatgattgtccgcagaacaatcaaaaacgactccgtcgtggcaggaggaggagcaatagaaatggagctatcgaaactacttagggactattcccgtactattgctggtaaagagcaactgctgattggagccatagcaaaagcactagaaataatccctaggcaactgtgtgacaatgccggtttcgacgctaccaatatactgaacaaattgcgacagaagcatgctcagggcaattcttggtacggggtggatgtcaacatggaagatattgccgataactatgagacttgcgtgtgggagccagcgattataaaaataaacgctttgactgcagctgcggaggccacttgcttgatcctgtctgtcgatgagaccatcaaaaaccagaaatctgaagcgcccccgcaagtaggaggtcgcggaatgggcagacctatgtaa

SEQ ID NO: 470 - DNA, 13968 bp, Phyllotreta armoraciae
atgggggactccttggaagcctcggaagcggctcatgaaactcaaaatgtggcattagtggattttactgcgtttacaaattttattctaaaagcggctactgtacttttgcccgaagatgatagccaagcggagccggctaacctcgtagcagctatagatgacaaaaccaatcaagaatgtattaaaaaattcataagcgatccccaaattgtgatactgtacgtccaaaggaactcttcaaaagatgatgacaacgtccagcctcccgaaggggaagaagaaaaagaacccgttacatactatattagcaatgaagtgcactattcaaattcaaaaatgtccagtttggtgtgcatcaagagaggtccggtgatagaagcagataaaagtattcgagctcaggttcgtttgatgaacttcagcgaggggtcgccatatgaaattctgcatgattatgtcagcagaacggttgccccttacttcaaatcttacgtaaaagagtctggtagagctgatcgtgatggtgataaaatggcgcctgcagttgaaaaaacaatcgctgaattggaaatgggactgctgcatttacaacaaaatatagatattccggaaattacgcttcaagtgcacccgtacgttgccagtcttataaagcaatgcgccgatgaaggaaggaagccgaaagtcgccgattttagtgacaaagtggacgactcgaactttcttaaccaacttcaacatggagttaatcgttggatcaaagaaattcaaaaagtaacaaaattagacagagacccctcttctggcacagctcttcaagaaattagcttttggctcaatctggaaagggcccttcaccgcatccaagaaaaacgcgaaagcatggaagtcgctctaacattagacattctgaagcacggtaaacgttttcacgccacagtgtctttcgataccgatacaggcttaaaacaagccatagctacagttaacgattacaatccgctcatgaaggattttcccatcaacgatttgttagctgcaaccgagctggagagaattcgcgccgcagttcagttgattttttcccatctaagaaaggtcagatcgactaaatatcccattacgaggtgcttgagactggtcgaagccatttcgagagatctaggcatgcagttattgaaagtattgggcacccgccggttaatgcacattccattcgacgaattcgagaaagtcatgacccaatgttttgaagtgttctcgatttgggatgacgaatacgagaaattacaaggtctcctcagagatatcatgaaaaagaaacgagatgaacatatgaaaatggtctggcgcatttcgccgcaacataaaaaacttcaaagccgtatggatcaaatgcgcaaatttcgcagacagcacgaacaactgcgtacagttatagtgcgtgtattgagaccaagtattaaagagagtgcagtgcctgctgaaggaagtgatatcgaacctccgaaaccaacattttcccttgatgctgcagacgcaaatgctatagaggaagtaaatttggcttatgagaacgtgaaagaagtcgactgtctggacattaccaaggaaggacaagatgcttgggatgctgcagtacagagatacgaagagcgaatcgatagagtcgaaaccaggatcacagcacatctacgcgatcaattgggaacggccaaaaacgccaatgagatgtttagaattttctcgcgttttaacgctctattcgtcagacctcacataagaggagctataagagaatatcaaactcatctaattcaaagggtgaaagacgatattgaagccctacatgaaaaattcaaggttcaatatccgcaaagtaacagtgctaaaatcagtaaagtgagagatttgccgcctgtagctggttctatagtgtgggccaagcagattgatcatcaactaacgacatatttaaggcgcgttgaagatgtgttaggaaaaggatgggagaaccacatcgaaggacaaaaactcaaagccgatggagacagcttccgtttaaagctaaacacgcaggaaatattcgatgattgggcgcgaaacgtgcaacaacgtaatctcggcgtatctggaagaatatttaccattgaagccgtgagatcaaggagcggtcgtggtaacgttcttaaattgaaagtcaactttctaccggagatcattacgctggctaaggaagtacggaatttgaagtgcctgggttttagagtgccgttggcaatcgtcaataaggcacatcaagcgaatcaactttatccgttcgccatatcgcttatcgaaagcatccgaacatatgaaatgactttggagaagatcgaggacaaggccagcatcatcccactcgtcgctggcatgagaaaagaagtccagctagtcctagccgaaggaatacaattagtatgggaaagttacaaactcgacctctacgtgcaaagactttccgacctagtagtgggtttccaagagcgagtcgaagagctcgttttcgtcggcgagcaattagaagtagacgtcagatcgttggaaacttgtccttactctgccaacacttttgccgacatattatcgaagatccaacacgccgtagacgatctatccctcaaacaatactcaaatttacacatttgggtgttgcgattagacgaggaagtcgagaaaaacctcgccaggcggctccaagcggggattgaggcctggacggaaactctgagtggccagaagaaagaaatcgatcacagcatggacaccgacgctcctgcccaacccacccataaacccggaggcgatccccaaattcaaaccatgatacacgaagtgcgaataaccaatcaaactatgtacttgtttccgagtatcgaagaggccaggttcctgatcatgcagcagttattcgcttggcaggcgatcgtgacgtgccaacaacgtcttcaaagcagtcgctaccaagttggtgtggacaagccggtggttgaaacttacaggaatattttgactagattaccggctggagctcaaccgttgatcaacgcttacagcgctatttcttctaaaattaaggaggttcaaaactatgtaaacgaatggttaacttaccaatccctgtgggatctgcaagcagataatctttacgggaaactgggagaagatattagtaaatggatggaatgtctgaatgatataaagaaaactcgaactacattcgatacatctgacactcgtcgcgaattcggccccatagtcatagactttgccaaagtccagagcaaagtttctcttaaatatgactcctggcacaaagaaaccttaagcaaattcggcagcctcttgagcaacgaaatgacctcgttccacgctaacgtatccaaatccagatccgatctggaattacaaagcatcgaggcagcaagcacttccgatgccgtcagcttcataacgtacgttcaacaattaaaacgaaacatgaaagcttgggagaagcaggtagacatctacaaagaaggtcaaagaatcctggaacgccagagattccagttcccgacaaactggttgcacgtggagaacttggagggcgaatggggagcattcaatgaaatcatcaaaaggaaagattcgagcattcaaactcaagtcgctagtcttcagcaaaagattgtttcggaagacaaggcagtcgaaagccgcacgaacgatttcttggtagactgggaaaggagcaagccggtcgaaggccatctcagaccagacgacgccctctctcagctacaattattcgaaagtaaattttcgcgcctcaaagaagaacgcgataacgtcgctaaagctaaagaggctttagacttgcaagacccgggtggcataagcaccagcgaagatagaatgcaagtcgtttacgaagaattacaagatttgagaggcgtttggtccgaattgtccagaatttggcagcaaatcgacgaaaccagagaaaaaccatggctttccattcaaccgaggaagctgcgacaacaactggaccaactctcgacgcaactcagagaattaccggcccgtctgagacaatacgcttcctacgaatacgtcaagaagactctccaaacctacaccaaagtcaacatgctgatagtcgaattgaaatccgacgccctcaaggaacgtcactggaagcaactcatgaagcagctgagagtaaactgggtcctctccgatttaacgctcggccaagtctgggacgtgaatctccagaaaaacgaagctatcgttaaagacgtcatattagtagcacaaggagaaatggcgctcgaagagttcctgaagcaagtgcgcgagtcctggcaaaactacgaactggacttgatcaattaccaaaacaaatgcaaactgatcagaggatgggacgatctcttcaacaaagtcaaggaacacatcaattccgtcgccgccatgaagctgtctccgtactacaaggtcttcgaagaagaagcttcgacttgggaagaaaagttgaatcgcataaacgcgctgttcgatgtatggatcgacgtgcaaaggcgctgggtttatttagaaggaatattctccggaagcgctgatatcaaaacgctcctcccggtggaaacgtcgcgtttccaaagcatcagctccgacttcttggggttaatgaagaaggtcagcaagagtccaatggtgatggatattgtaaatattctaggcgtgcaacgtgtactggaaagactcgctgatttattgggaaaaatccagaaagcgctaggcgaatatctggaaagagaacgtacatcttttcctcgattctacttcgtgggagacgaagatctcctggaaataatcggtaacagcaagaatgtcgcgaggttgcagaagcatttcaagaaaatgttcgccggtgtagcttccatattactaaacgacaacaacactgtcataaccggtatagcttcaagagaaggtgaagaagttgtattcaaaacaccagtttccaccgtggagcatccgaaaatcaacgaatggctgactttggtcgaaaaagaaatgcgagttacattagcctcgaatctaacgcaggccgtgcaagatatcaaacaattcaaagatgaaatcgactcgaaatcctacatggaatgggtcgacaagtaccaagcgcagattgtggtattggcagcccagattctctggagcgaagatgtcgaagccgcgctcgtcaaaatgaacagcgaaccccaaaaaggcgtgttggaaaaagtcctacaacaagtcgagaatactcttaacgtactagcggattccgttttgcaagaacaacctcaattgagaaggaagaaactggagcatttaatcaacgagtttgtgcacaaaagaactgtgactagaaggctcatcgctaacggggtttgtagcaacaaggcgttcgaatggctgtgcgaaatgaggttctatttcgatccgagacaaacagaagtacttaagcaattgacgattcatatggcgaatgcgaggttctattacggattcgaatacctcggtgttcaggatagattagtgcaaactcctctaactgacagatgttacttgactatgacccaagctttggaagcccggctcggaggatcaccgttcggacccgccggaactggtaagaccgaatccgtcaaagcgctcggaaaccagctaggtcgtttcgtgctcgtgtttaactgcgacgaaacgttcgacttccaagccatgggcaggatattcgtcggtttgtgtcaagtgggcgcttggggttgtttcgacgaattcaacagattagaagaaagaatgttgtccgccgtttcgcagcaaattcaaaccatacaagaagcgttgaaatcacagaaggaagccgccgctgaaggagtagctatcggcagtataagcgtcgaactcgtaggaaaacaagtcaaagtatcccccgatatggctatctttattacgatgaatcctggctatgcgggtcgttcgaatctgccggataatttgaaaaaattgttcagatcgttagccatgactacgcctgacagacaacttatcgccgaagtgatgctgttctctcaaggattcagacaggccgaaaaactggcttcgaaaattgtacctttcttcagattatgcgatgaacaactgtccaatcaatctcattacgatttcggtttgagagccttgaaatctgtactaatatcggcaggaaatgtgaaaagggatagaattcaaagaataaaagaaggtatgacccaacgaggcgaaaccaacatagatgaggcaaacatagccgagaatttaccggagcaagaaatattaattcaatcggtttgtgaaactatggttcccaaattagtcgcagaagatattccattgctattcagcttgttaaacgacgtgtttcccaacgtacaatacaccagagccgaaatggaaggtcttaaagatgaaattagaaaagtgtgtactgaagaatacctcgtttgcggagaaggcgacgaaaggggttcagcttggatggaaaaaagagacacatggctatcaaaggtattacaattataccaaatttcaaatcttaaccacggtcttatgatggtcggcccgagtggttcgggtaaaagctcagcatggcgagttctgctcaaagctctcgaacgattcgaaggaatagaaggcgtggcccatgtaattgatcctaaagcgatcagcaaagaaactctatatggtgttttggatcccaatactagagagtggaccgatggtctgttcacccatattctaagaaaaatcatagacaacgtgagaggtgaaattaacaaacgccaatggattatcttcgacggtgacgtcgatcccgaatgggtagaaaacttgaactccgttcttgacgacaacaaattattgactcttcccaacggagaacgtctttctctaccacccaacattagagttatgtttgaggtacaagatttaaagtatgccactttagctacagtctcgcgttgtggtatggtgtggttctcagaagacgtactatccaccgaaatgatattcgaaaactacattcttcgattgaagaacattccgctcgaagaaagcgaagagggcttcggcaagaaatctgacatcaaagacgacatgttgtctcccacccttcaactgcaagtagatgtcgtgaatctacttcaaccgtttttgggacccgatggtcttgtagtacgttgtttagagtacgctatggaacaagagcatataatggacttcactcggctcagagcgctgagctcattgttctccatgctaaatcaagcagtgagaaatgtcttgcagtacaatcacatgcatcccgattttcctctctccagcgaagccctggataaatacatacccaaatgtttgatatattcgatcttatggagcttcgcaggcgatgctaaacttaaagttagatcggaattgggcgattttattagatctgttaccaccgtgcccttaccatccgatcgcaatttgcccattatagattacgaagttactattgaaggcgaatggtcgctttggtctaataaagtgccgcaaatcgaggtcgaaactcacaaagtcgctacacctgatattgtggtgcctacgttggacacggttagacacgaatctttgttgtacacttggttggctgaacataaaccgatagtattgtgtggtccacctggttccggtaaaacgatgacgttattctccgcattaagagctttaccagatatggaagtcgttgggttgaatttctcctcagctacaactccagaattgctgttaaaaacctttgatcattactgtgaatacaggaaaacaccaaatggcgtaatcctatcgccaatacagttaggcaaatggctggtcctcttctgcgatgaaatcaacttaccagacatggacaattacggaacccaacgcgtcatcatgttccttcgacaaatagtggaacaaaaaggattctaccgcgcttcagaccaaacctgggtaacattggaacgcatacaattcgtaggcgcatgtaatcccccaacggaccccggaagaaagcccctctctcaccgttttctcagacacgtacccgtcgtttacgtcgactacccgggagaaacgtcgctcaaacaaatttatggcaccttcacgagagcaatgctcagattagctccaggactaaagggctacgcggaacccttaactaactccatggtggaattctacttatcctcgcaagataggttcacccaagatatgcaacctcactacgtgtattcccctcgtgaaatgacgagatgggtgagaggcatatgcgaagccatcagacctttggacaatctttctgtcgaaggtttggtgaggttgtgggcgcacgaagcgcttcgactgttccaagataggttagtggaagacaccgaaagacgatggacgaacgaaaacatcgatgccgtcgctttgaagcatttcccgtcggcgaattgcgagaaagccttagaacggcctattctatacagtaactggctgtccaaggattacgtgccggttggaagggagcaattgagagaatacgtcaaggctaggttaaaggtgttctacgaagaagaactcgacgttcctttggtgctcttcgatgaggtgctggatcacgtgctcaggatcgacaggattttcagacaaccgcaaggtcatttgctcttgataggtgtgtctggagccgggaaaacgaccctatccagattcgtggcttggatgaacggattgtctattttccaaatcaaagttcacaacaaatataccgctgatgatttcgacgaagacttaagatcggtcttgagaagaagcggatgtaaacacgaaaagatcgctttcattttagacgagtcgaatatgttggattcgagtttcttggaaagaatgaatactcttctagctaacggagaagttcccggattattcgaaggagacgaatacacaactctaatgacacagtgcaaagaaggagcccaaagagaaggattaatgttggattcgaacgatgaactgtacaaatggttcacacaacaagttatgcgaaatttgcacgtagtttttacgatgaatccttcaaccgatggattaaaggacagggctgctacctcacctgctttattcaacagatgtgttttgaattggttcggagattggtcggatggagctcttttccaggtgggaaaagaatttacgaaccgtttggatctcgacaaacaaagttggaaatgtccagacttcttccctgcttcttgcaaccacatttctgctacgcccaatcacagggaagccgtcatcaacgcctgcgtttacgtccatcagacgcttcataaagccaacggcagattagtaaagagaggaagtcgcacgatggcgatcacccctaggcactacttagatttcatacatcatctcgtcaaattgtacaatgaaaaacggtccgatttggaggaacaacaactccatcttaacgtcggtttgaacaagatcgctgaaaccgtagaacaggtggaagagatgcaaaagagtttggctgtaaaatcgcaagaattacaagcgaaaaacgacgccgccaacgccaagctcagacaaatggtgaaagatcagcaagaagccgaaaagaagaaagttcaaagtcaagaaattcaacagcagctcgctcagcaaactgtgcacatcaagcagaaaaagtctgaagtaatggccgatttggagcaagtagaaccagccgtcatcgaagcacagcaagctgtaaaatccatcaagaaacaacaattagtagaaatccgtaccatggcgaatcctccagccctagtaaaactggcgctcgaatcaatttgcctactattaggagaaaacgccagcgagtggaaatccattcgagctgttattatgagagacaatttcatcaacagcgtggttaatttcaacaccgaagacattggtgacgatgtcagagaaaaaatgaagagccgttatttgagcaatcccgattacaacatcgacaaaatctatcacgccagtaacgcctgcggcccgctggtgaagtgggcttgcgcccaagtcgaatacgccgacatgctgaagaaagtcgagccgctacgtgaagagctcaactctctggaaacccaagccgaaaccaaccagaaacgcggcgaagacgtcaaagtcctcatcggccaactggagcaaagcatcgcctcttacaaagaggaatacgcgcagttaatcgcccaagctcaggccatcaaaaccgatttggagaacgtccaagccaaagtcgacagatcgatagcccttctcaaatcgcttgttatcgaaagggaacgatgggaggccagcagcgagacgttcaggtcgcaaatgtctactatcatcggagacgttctattatcagccgcattcatcgcgtacggaggatacttcgaccaacattaccgtcagaatctcttcagcacttggtctcaacatttaaccctagctaacatccaatacagagctgatatcgctagaaccgaatacttatcgaaccccgacgagagactcagatggcaagccaacgcgctgccttcggacgatttatgcacagaaaacgccatcatgttaaagagattcaacagatacccgctcattatcgacccttcgggtcaagcaactgaatttataatgaacgaattcaaggacaagaagatcaccaagactagcttcttggacgattccttcaggaagaacctagaatcagccctacgtttcggcaacccccttcttgtccaagacgtcgaaaactacgacgccatattgaaccccgtgctcaacagggaactgagaagaaccggaggacgtgtgttaataacactcggtgatcaagacatcgatttatcgccttcgttcgtgatattcttatctaccagagaccccacggtcgaatttcctccggacatttgctcgagagtcactttcgtcaacttcacggtgaccaggagctcgttgcagagccaatgcttgaatcaagtgctcaaagccgagcgtcccgacatcgacgccaagcgatcggatctgctgaagctgcaaggcgagtttcacctcagattgcggcagctcgagaagtcgcttttgcaagctctcaacgacgctaaaggaaaaattctcgacgacgatagcgtcattacgacgttggaaacgctgaaacaggaagccgccgagatcgggcagaaagtcgaggagactgataaggttatttcggagatcgagacggtttctcagcaatacttgcccttatcgcaggcgtgcagtaatacttactttactatggatagtttgaatcaagtacatttcctctatcagtactccttgaagatgtttttggatgtatttgctactgtgttgcataataacgtgaagttagatggaatcaccgattatcaatctaggttgaacgtcatcaccagtaatttgttttcggttgtttatgagcgagtagctagaggaatgcttcacaacgatcgcatgacgttcgccattctactatgcagaatccacctgaaagggcgaccaacggaacccaatctagaccaagagttcaacttcttcctcagaggcaaagagggtgtctttagcaaccccaattcggccatcgtcgacggtttgaacagcgatcagcaggaagccatcacgagactctcgaccaaactacccgccttcaaaaaactaccggaacaaatcaaagacatgccggagttcggagcgtggctgcaacaaagcagtcccgagcaggccgtgccgcagctgtggatcgaagagaagcagctcagcgccgtcggcaggggcatgtaccagatgctagtgatccaggccttcaggccggatcgcgtgatagccgcggcgcagaacttcgttgccgccgtgctaggcgcggactttatgtacctggccgagaaggaaatggactttgcgacttgcgtcgaaaaggagatcaggtcgaacgtgccggcgctgttgtgctccgtgcccggtttcgacgcttccagtcgcgtcgacgatctggctgccgagctcaacaagcagatatccagcattgccatcggttccgccgaaggtttcaaccaggctgatagggctattaacatggcttgcaaaactggaagatgggtcatgcttaaaaacgttcatctggcgcctcaatggctcgtacaactcgaaaagaaacttcactcccttcaaccacacgcccagttcagactgttcctcaccatggagattaatcctaagctaccggtcaatttactgagagccggaaggatattcgtattcgaacccccgccgggtatcagagctaatttattgagaacattcagcactgttcctgcaagcagaatgatgaaagcgccaaacgaaagagccagattgtacttcctattagcttggttccacgccatcgtgcaagaaagactgcggtactgtccattaggttgggccaaatattacgaatttagcgaatcggatttgcgcgttgcttgcgatactttagatacgtggattgacgcaacagcgatgggaagaaccaatttgccaccagagaaagtaccgtgggacgcgctcgtcacgctcctctctcaatccatctatggcggtaaaatagacaacgatttcgatcagagactcttgcattccttcctaaacaaattatttacgcctaaaagcttcgacagcgatttcgctttggtagcgaacatagacaacggacccggaggcaatcgtcacataaccatgccggacggtactcgaagggatcatttcttgaaatggatcgaaagtctcgccgacaggcaaacaccggcttggttgggattacctaataacgcagaaaaggtacttttaaccacaaggggtaccgacctcatagcgaaactgctcaaaatgcagcaattggaagacgacgatgaattggcctactctctcgacgatagctcgccgtccgatccggccgctcaaatcgacgggcgtccgtcgtggatgaaaaccctacacaacagcgccgctacctgggtcaatttgttgcccacgtcgttgcagactctcagaaggacggtcgataacatcaaagatcctttgtacagatatttcgaaagggaggtcaattctgcttctaaattgcttatggatgttttgcacgatcttcacgatgtacttttaatctgtcaaggagaaaagaaacaaactaactaccatcgtacgatgttgtctgaattagtcagaggaattattccgaagaactggcatcggtacacaatacccaaaggttgtacggttatgcaatggatcaccgactttagtcagcgtgttaagcaattgcaaaaagtgtcgcaagtggtctcatccgcaggtgctaaagaattacagagttttccggtttggttgggaggacttctgaatccggaagcttacataacagcaacgagacagtgtgtcgcacaagctaatagctggcctctcgaagaactccacttagatgttactattacggattccaatgataaaaattccattcctcatgattgtttcgccgttgttggaatcaaattgcaaggagcccaatgcagaaacaaccaactcctgctcacctcgagcatcatgatcgaacttcccatcacgctcttccgttgggtgagggtaacgggggatgaaaaactaaaggaagggaaattatctttaccgctttatttgaattcaactagaaccgagcttttatacacaatcgaacttaatattgcagcagggcaagaccctcacagcttctatgaacgtggtgtagctgttttaacttctacttctttaaactaa

SEQ ID NO: 471 - DNA, 2673 bp, Phyllotreta armoraciae
atgagtcgtcagggccccagcaaacgttacgaatcggactcggattccgatagcgtggacagcgctgaggaggcccgaaggcgcgacttgcaggaacgggacgagttcgccaatcggctcaaaaagcgcgatgaagaccgtacgagaaacgtcgtgcagaatttcgacaagaagacctacgaggaggcggcgaagcgcctgaagttagacaacgccggcagggacaaggtgatatcggagcttcgcaaaacctcgagatttaagtacttggagaagaggaaggacgacaaattgcaggagttggaggctgatatcgtcgacgatgagtacttgttcgaggaggaaatattaacggagagggaaaagaaggaacgccagcataaaaaggaattattgcaactagcccaggaacatgaaaaggcacgggaactcgaacgaatacaacgctatcacatgccgagggacttgggtaaggactcgacggcagattacatcgaagtggacgagctcgagaaagtaccgcaatccgaacagaagaaatgggaaaaagaccaaatggcctcagctgtcttcaaatttggtgctaaagatgtcaagaaaaccgacgattacgaactgttactggaagatcaaatcgatttcatacaagctctgcaaatgccgggatccaccgagaagaaagtctcgcaactatccgatgtacaaaagaagaaactaaccatcgaggaaacaaagaaaagcctgccgatttatccattcaaagatgatttaatacaagccgttaaagagtaccaagtgttgattataaaaggtgaaaccggttcgggaaaaaccacgcaaataccccagtatctccacgaagctggtttcacagctgacggtaagaaaatcggttgtacacagcctcggagagtcgctgccatgtcggtagcagccagagtagcccaagaaatggacgtaaagctaggcaacgaagtcggttacgctatcagattcgaagattgcacttccgaaagaaccattataaaatacatgactgacggtacgttacacagagaatttctatcagaaccagacctgcaatcgtacagcgtgatgattatagacgaagctcacgaaagaacccttcacactgatatattgttcggactagtgaaagacatagccaggttcagaccggatttaaaactgttaatatccagtgctactttggatgttaccaagttttctgagttcttcgacgacgcgccggtgtaccaaatcccaggccggagattccccgtggatatttactatacgaaagccccggaggcagattacgtagacgcctgcgttgtttccatactgcaaattcacgtgactcaaccgttgggcgacattttggtgttccttactggtcaagacgaaatcgaaacctgtcacgaactcctgcaggatcgagtgagacgcttggggtccaaagtcaaagaactgattatacttcctttatacgccaaccttcccagtgatctgcaagctaagatattcgaaccgactccaccgggagcgaggaaggtcattctggcgacaaacattgcggagacttcgctaacaatcgacaacattatctacgttatcgatccgggttttgccaagcagaatcacttcaattccaggaccggcatggagagtttgatggtcgtgcccatatctaaggcttcagctaaccagcgagcagggagagctgggagagtagcggccggtaaatgctttaggctgtacactgcctggtcctataagcacgaactggaagaatctactgttcccgagatacagaggatcaatttggggaatgccgtgttgatgttgaaggcgttgggaattaacgatttggtgcatttcgattttctggatccacctccacacgaaaccttagtgttggctttggaacagttgtatgctttaggagctttgaatcatcacggagaattaactaaattgggaagaagaatggctgaattaccggtagatccgatgatggctaaaatgatattggcatctgagaaatacaagtgttcagaagaaattgttacgataggtgcaatgttgtcggtaaacggggccatattttacaggccgaaagataagattatccacgcggatacggctaggaagaatttcaatcacttggctggcgatcacttgagccttctgaacgtttataatcaatggagagactccgattactcgttgcagtggtgttacgaaaatttcattcaacacagatcgatgaaacgagccagagacgtcagagagcaactagtcaacttaatgaccagagtagaaatcgaaatagtatcgggaatcgacgaaaccgataacgttcgcaaagctattacagccggttatttctatcacatagccaggttttcgaaaggtggaagttacaagacagtgaagcataatcaaagcgtgactatacacccgaacagcgctttgttcgaaacgctaccgcggtggctgttataccacgaattagtgtttacgactaaagagttcatgaggcaagtcatcgaaatcgagagcaagtggctgttggaagtggctcctcattactacaaggccaaggaattggaagattcaactaataaaaaaatgcccaaaaccatcggaagaagtaaaatgactgattaa

SEQ ID NO: 472 - DNA, 1371 bp, Phyllotreta armoraciae
atgaaggtagaagaggtgaaaagcaccgtgaaaactcaaagaataagcgcccatactcacataaagggcttgggtttagatgaagcgggttttgcaatcccttcggcagccggcctggtcggtcaggagcaggcaagagaggctgcgggagtcgtcgtggacatgataaggagtaagaaaatggctggaagggctgtccttctagctggccctccaggtaccggtaaaacagccattgctctagcaattgcccaagaactgggcaacaaagttccattttgccccatggtcggctcggaagtctacagctcagagataaagaaaaccgaagtgctcatggaaaattttagacgagccattggccttagaattagagaaacgaaggaagtctacgaaggagaagttagcgaactaacacccgtcgaaacagaaaacccagcaggaggttacggtaaaactgttagtcacgttgtaatcggtttgcgaacagccaagggcagcaagcaattgaaacttgaccccagtatttacgaagccctgcaaaaagaaaaagtggaagtgggagatgtcatttacatcgaagccaccagtggggctgttaaaagacaaggaagatctgatgcttacgctacagaattcgatttggaagccgaagaatatgtgccgcttcctaagggagatgtgcacaagaagaaggaagttgtacaggatgttactttacacgatttggacgctgctaatgcaaaaccacagggtggtcaagacgtgttgtccatgatggggcaactgttaaaaccaaagaaaactgaaattacagacaaactcagaaaagaaataaacaaaatcgttgacaaatacattgatcaaggcattgcggaattggtaccaggagtattattcattgacgaagttcatatgttggatatagaaacgttcacttatctccatagagctttggaaagcgctatagcccctattgttatttttgctactaatagaggtcgttgtctcattagaggaaccgatgatgtattttctccacatggaattccattagatcttctagatagactgctgattatacgcaaaattccttacaacaaatccgaaatggagcaaattattaaattgcgagctgttacagaaggtttggaaattgagcaggaagcaatctcgagtttgggagaagtcgggacaaaagccaccctgagatatgcagttcagcttttaacgccgtcgtttttaactgctaaaattaacggaaggggtaacattctcaaaagcgacgtggaggagattggtactctattcctcgatgccaaatcttcggctaaaatacttaccgagcacaaagataaatttatgacgtaa

SEQ ID NO: 473 - DNA, 2256 bp, Phyllotreta armoraciae
atgacttcaataataaaagtacaagccttatccggcgccaaagacgaatctcccccttgttacctattacaagttgacgacgttagaattcttttagattgcggttgggatgaaaaatttgatatggaattcattaaagagctcaagaggcacgtacataccatagatgcggtgttaatttcttacccagataactatcatttgggagctctaccttacgctgtaggtaaattaggcttaaattgtccaatatacgccactatacctgtatacaaaatgggccagatgttcatgtacgatctttaccagtcccagtacaatatgaaagaattttgtatattttctcttgatgatgttgatgccacttttgaaaaggttgttcaattgaaatataaccaaacagttcctttaaaaggtaaaggatatggcataactgtaacacctttgccagccggtcatatgatcggaggaaccatatggaagataatgaaagtaggcgaagaagatattgtgtattgcaacgattttaaccataaaaaagaaaggcatttgaacggttgtgaactgaagaaacttcaaaggccatcgttactcataacagacgcatttaatgccacatatcaacaggctagacgaagggcgagagatgaaaaattaatgacaaatattctgcagactctacgaaaccacgggaacgtccttatagccgtagacacagctggtagagtactggaattagctcacatgttggatcaactgtggagaaacaaggaatccggacttttggcttattctctggcttttttgaacaacgtcagttataatgttgtcgaatttgctaaatctcaaatagaatggatgagcgataatctaatgagaagtttcgaaggagcaagaaacaatcccttccagttcaaatatttgcagctatgccacagtttaggggagttgagcaaagtgcccagtccgaaggtggtactggctagttcgcctgatttggagagcggattttccagggaactgtttttacagtggtgttctaatccaaataacagtattatattaactacaaggacctcgcctgggactttagccagggatttaattgacaacggaggaggaagaaacatagacttgatagtagagcgaagggttaaattagaaggacaagagcttgatgattatgaaagtcgtcaacggtctaaatatgacaaattagaagatgaggaagccgattccgattcagattccgatattgaaatgttagtcacaactaaaggcaaacatgacattgttatcaaacaagaaggcaaaatatccacaggattttttaaagtgacaaaaaaaatgtacccgatgtatcctttcaaggaagataaaataaaatccgatgaatatggcgaaataataaaagcagaagattacaaactagctgaaatttcagccgaagccgaagataataaagaaaacatagtgattaaaaaagaggaagaggaaataagtaaatattattcatttataaacgatctaatagttacgcatgaatcatttttagctgaaattaccgagcaaccgaccaaatgtataattcttcaaagaaccgttcaagtgagttgtcaagttcagtacatcgatttcgaaggtagatcagacggagaatcgttgatgaagattttaacgcaattgaaaccgagaagagtgatcgtagtgcatgggactgaagaaaacacatctgttatagaaaaacactgcttggataatttagaagctagggttttcactccatccagaggcgaaataatcgatgctaccagtgaaaatcacatttatcaggtgaggctgacggacgctttggtttcacaattgagttttcagaaagccaaagaagctgaagttgcttggcttggggctcagattgtactcagggaaagccaagctgacgctaaaaggatgaatttggataatgaggaaatggaagtggaagaagaggatacgagaatcctgacgcttgaaccattgccggaaggtattccacacgatcctgttttcataaatgaagttaaacttgccgaattcaagcaagttttagggagaaataatataaattctgaattttccggcggcactttgtggtgttccaacggctctttagcagtgagaaaggttgataacggcaaaatcatgttggaaggttgcatatccgaagattattataaggttaaagaattgttgtacgaacagtacgctattttatag

SEQ ID NO: 474 - DNA, 2283 bp, Phyllotreta armoraciae
atgcctcctttggaggtaacagcaaataccaacaacgaagaatcggctccaattaatccagtcgtgggcataatttaccctccaccagaggttagaaatatcgtcgacaaaaccgccagtttcgtcgcgagaaatggccccgaattcgaagcccgtatcagacaaaacgagctcggcaatcccaaattcaatttcctcaacggcggcgatccctatcacgcctattaccagcacaaagttaaggatttcagggaaggaaaaggacaagaacctaatccgggtttgagccaagccgtagccaaattatccgtgagcgcttcggcgcagcaaaagcaacaagagatattgaagcaagtcgagcagcctttcgttccgaaagatcctccggctgagttcgaatttattgcggatcctccttcgatttctgctttagatttggatatcgtgaagcttactgctcagtttgtggcgagaaacggtcgggcttttctaacgcaattgatgaatagggagcagaggaattttcaattcgattttttgaggcctcagcattcgcttttccagtattttaccaagcttttggaacagtacacgaaggtgcttatacctccgaagagcatggagcagaggctcagagacgaggcgaaaagcgccaaagccgtgcttgagcaagtcaagtacagggccgaatggttgcggtatcaagaacagcaaaaggccaaagaggaggaaatactcgaaagagaaagggtggcttacgcgcaaatagattggcacgatttcgtggtagtcgaaacagtagattatcaaccgttcgaaataggtaatttccctcctccgactacgcccgaagaagtgggagcaagaatattgatacaggagaggatcgaagaaggcgaagatatcgaaatgcaattggaaagcgacgaagacgaagatccttcaaacgcggatgacggtttgagctccatgcaggataaaactaaacgcaaaggaggcgacgataatcgcctacaagacatggaagaagatacttctgatgaagataacgatgatgaaactggtaaaacttcgagttcgtcttcgctcattcaaccgcctttgccgcccatacccgataaagtgctcgttaaaaaatacgatcctaaacaagctgtcaaagtgtccagaccgacagtaggcgacgattatctagtatcaccaatcacaggcgagaagataccggccagcaaagtacaagagcacatgcgcataggcctcttggacccaagatgggtcgaacaacgtgacaaacaaatgtccgataagatgaatcaagacacggtatatgctgcaggaagcgccatcgacgcttcgttgaaattactagccgaaagacgtacggacatttttggtgtgggagacgaagaaacggcaattggtaagaaaataggcgaagaggacgtgagaaaagacgaaaaagtgacgtgggacggtcacaccagcagcgtggaggcggcgacgagggcggctcgcgccaatatcaccttagaagagcaaatacatcagatacataaggtaaaaggtcttctacctgacgaggagaaggagaagatcggtccgaagaatattggttcgaagaaaattaacatacaaagtgttattactaccaaaccgcctaatccgtcttcacagcaacccaaacaacaggtttctatgattcaaacgggcgcacagccaatcatgccggttccaacgcaacctacgatgctcgcgccccaaccgtctattatgatgatgcccgcccctcctatgcctaacattcgtccgcctcctttgatgatgcccggcggtgtggctatgggcggttattcggtgggtccgatgcccggcccgccgggtcccggcatgaatatggcccccatgaaacatcccagcgacggtcccagcgaagaagaaccgaccaataagaaattgagaaacgaggattctttggtgccagaaaacgtgtttctatccagaaatccaagccaagtgtctataaagatttccattccggttatgccggagaaatccgaatggaggttaaagggccaaatggtatcctggacattggcgctcacagaatcagtttcgaatttgaaagccaaaatacaggaggaaaccaacatgccgccggccaaacagaaattattttttgacggaatgttcttcaaagattcaaacactttagcctactacaatgtaacccaaggagctgtcattcaactacaaatcaaagaaagaggtggaaggaagaaataa

SEQ ID NO: 475 - DNA, 975 bp, Phyllotreta armoraciae
atgccgagtacagaggttacaacgactaaggtaatagtgcacccgctggtgcttctcagcgtagtggaccatttcaatcgaatggggaaaatcggcaatcaaaagcgcgttgtcggtgttctactcggttgctggagggctaaaggagtcttagatgtgtccaacagttttgcagtccctttcgatgaggacgacaaagataaatctgtatggtttttggaccacgactacttggaaaacatgtacggcatgtttaagaaagtcaatgctagagaacgcgtcgttggttggtaccacacgggccctaaattacaccagaatgatatcgctattaacgaattaattcgaagatactgtcccaattccgtgctggtgattatagatgcgaaacctaaagatttggggcttcctaccgaagcttaccaagcggtagaagaagtccacgatgatggctctcccacgtcaaaaacatttgaacatgtcccgagcgaaataggcgcagaagaagctgaagaagtcggagtggaacatttactgagagatatcaaagacactacagtgggaactttgtctcagaggatcactaatcagttattaggccttaaagggttgcatttgcaattgagagatattagagactatttgatgcaagtgtgcgataacaaactgcccatcaatcatcagatcatctatcaattgcaagatattttcaatttgttgcccgatataaaccaagatgcattcaacaattcgttttatgttaaaaataacgatcaaatgctagtagtttatttagctgctctcgttcgatctatcgttgcactgcacaacctaatcaacaacaagctcaccaacagagacgcagaagaaggtaaaaaggaagagaaaaaggacaaggataaagagaacaaagacaaagataaggaaaaaacggataaagacaaggagacgaagaaggacgagaagaaaaaataa

SEQ ID NO: 476 - DNA, 1653 bp, Phyllotreta armoraciae
atgtttggaggaggacgcgcccccatcttagtgttgagccagaatacaaagcgcgagtcgggccgaaaagttcagttggagaacatcaatgccggcaagcaaatcgcagatgtcattagaacatgtctcggtccacaagccatgttgaaaatgttgatggaccccatggggggcatcgtcatgaccaacgacggtaacgccattctgcgagagatcactgtgcagcatcctgctgctaaaagtatgatagaaatagccagaacccaagacgaagaggtgggagatggaaccacttctgtaatagtattagctggagaaatgttggccgctgctgagcagttcctcgaacagcaaatccaccctacgatcatcattcgacaatacaggcaggccctcgaagatatggtgcagttcctggaaggacctttaagcgtgcccttagatcgaaacgacaaaaacgccgtagccgaagtggttaaaggttgcataggaacgaaattcttgagcaaatggtcggatttggccgtaaatatcgctttagatgcggtgaataccgtcctattagaagagaatggtcgaacggaggtggatatcaagagatatgccaaagtcgaaaagattcctggtggttctgtggaggaatccaaaattttgagaggcgtaatgttgaacaaagacgttacccatcctaaaatgaagcgacacattaagaatccgagaatcatccttttggattgcgctttggaatacaagaaaggagaatctcaaaccaacgttgaaattagtaccgaaactgattttaccaaacttcttgaattggaagaagatcatgtgaaacgccaatgcgacgagattatcgccctcaagccggacgtagtgttcacagaaaagggagtatccgatatagcccagcatttcctgctcaaggccggcatcactgccatcaggcgtgtcagaaagtctgacaacaaccgaatcgctagagcttgtggagccgtcattgtaaacagaaccgaggaactccaggagtccgacgtgggcaccggagctggtgtatttgaaatcaaaaaaatcggcgacgagtacttctgttttgtcgacgaatgcaaagatccaaaggcctgtacaatcctcctccgaggagccagcaaggatattctgaacgaaatcgagaggaatctgcaagacgccttacaagtcgctaggaacattatattgtctccgcgtttagtgcccggcggtggggctatcgaaatggccgttgcccaacgattgatgcagaaggcaacacacggcccctacagggcgcttgctcacgctttggaaatcattccgaggactttagcgcaaaattgcggtgctaataccatcagaacgttgacggccctgagggctaagcacgccaaccacactgaaaccgacaaaccctgcacttggggtatcgacggtgagactggggaattggttgatatgaaagtcaaaggcttgtgggagcccttatctgttaaactccagacttacaagacagccgttgagaccgccattctccttttacgtatcgacgatattgtatcgggatccaaaaagaagggcgacaaggaggtcccaacgcccagccagatgcaacagcaggaagccaaagagacggattaa

SEQ ID NO: 477 - DNA, 702 bp, Phyllotreta armoraciae
atgatgcaaacaggaatacgtccctattatccagactattctacagttcccgttgaacgccagattaatccgtacgctgacaatggaggaagtgtcgtagcaattgcaggaaaagatttcgtggttattggtgcagatactcgtcttagttccggcttttccatttacactagaaaccaaaacaagctgtttcctctttccgaaacgactgttttaggatgttcaggttgttggtgcgatactttaacgttgactcgtattttaaagtctcgtatgcaaatgtaccatcaagagcataacaagaacatgtctacaacagcggctgctcaaatgttgtcgaccatgttgtactacaagcgatttttcccttattacatatcgaacattctcgttggattagataatgagggaaaaggttgcgtctacagctacgatcccgttgggcattgtgaaaaagccacatacagagcaggtggttctgcgggggctttgcttcagcctttgttggacaatcaaattgggcaaaaaaatctgcagaagccttcgcaagaagatcttactcaggaaaaggccatttctacactgaaagatgttttcatatccgctgcagaaagggatatttacactggtgatagtgtacttattaaaatcataactaaagatgggactaaagaggaaacatttgatttgaggaaagattga

SEQ ID NO: 478 - DNA, 900 bp, Phyllotreta armoraciae
atgttccaatttggtttcaacatgttcccggacatcccgagacccttcaacatgacctacaaatgctactcagtggccatgttcccggggaacgaaagacaggacgtcgaacgtggaggaaaaataatcatgccaccttcagcactggaacagctcactcgattaaacatcaactaccccatgttatttaaactagttaataagaagacgagccgcacgactcattgcggcgtgttggagttcgtagcggacgaaggaaaagtctaccttccattatggatgatgcacaatttagtactatccgaaggcgatttggttcaaatggaaagcgtctcgctgccggtgggcactttctcgaaattccaaccgttgaatccggatttcctcgacataaccaatccgaaagccgtgctggagaattgcctgcggtctttcgcttgtctgaccaccggcgatgtcatagcggtgaggtataatcaaaaggcgtacgaattgtgcgtgttggaaaccaaaccgggaaacgccatcagcataatcgaatgcgacatgaacgttgaattcgccgctccggttggctacaaggagcccgaacatgcgaaaaaagaagaagaaatgtcggtggatcccgctgatttgatgcccgaaccgtcgggattcgtcgcatttcggggggccggtaaccgattggacgggaaaaaacgcaaggattcttcctccagcgatgctccttcgtccaaaccggcctacgtccggggaattcccgattacgattatcaaataggcacgctggacttcatcaggcgtacggtggtgaagccgaaggaaaaggagagcagcgatgacgcggatgatttcaaggcttttagcggcactgggttcagtttgaggagtaggaattag

SEQ ID NO: 479 - DNA, 1623 bp, Phyllotreta armoraciae
atgtcggccttaccaggagctatcgctttcgatgaatatggaagaccttttataattttaagggaccaagacaggcaaaaacgattgaccggaatcgatgccctgaagtcgcacattttagccgcgagccaaattgcccacactgttcgcacctctttggggcccaaaggcctagacaagatgatggtatcctctgatggagaagttactgtaacgaatgatggggctactattttgaagatgatggatgttgaacatgaagtagctaaattgttagttcaactatctcaatcccaggatgatgaaataggggacggaactaccggtgtagtagtattagcaggggctcttctggaacaagctggcgctcttctggaccgcggaatccatccgataagaatagccgatggtttcgaattggcatgccaaacagctgtggatcatctagagaaaatcgccgaactgtttccagtgtccgctgaaaacaccgagccccttattaaagtcgcgatgactacattaggttcgaagataattaacaaatgtcacaggcaaatggccgaaatcgccgtaaatggcgtgttagcagtagctgatctcgaacaaaaggatgtcaactttgaactcattaaagtagaaggaaaggttggagggaaattggaagacaccacattagtgaaaggtgtcgttatagataaaacaatgtctcatcctcaaatgccgaaggagctaaagaatgttaaattggccatcctcacctgcccgtttgaaccccccaaacccaagaccaagcataagttggatgtcaccagcgtagaagactacaaagaactaagattgtacgagcaagagaaattcaaggaaattgttggcttggtaaaaaaagcaggagctaccttggctatttgccaatggggattcgacgatgaagccaaccatttgctgttgcagcaggagttacctgctattagatgggttggaggtcctgagatagagctaatagccattgcgaccggaggaagaatagttccaagattcgaggaacttagccctgaaaaactaggttctgctggtttggttcgcgagatatcattcggaactaccaaagataagatgatggtgattgaagaatgctcaaattctcgggcgattaccattcttgttagaggcggtaatcaaatgttgattgatgaagctaagaggagtttacacgatgctttgtgtgttgtgaggagtctcattcaggaaccaagagtcgtgtatggaggaggtgcagctgaaatagcttgcagtttagctgtggcagctcaagccgatcagctagcttctttagaacagtatgcttatcgggcatttgccgaagcgttggaaagcattccgctggctctggctgagaattcaggtttttctgccattcatactttgggagaaatcaaggcaaaacaagctgcttcgggagatccggcacttggcgtcgattgcatgaatatcggcaacataaacatgagagaacagcatgttacagaatctctgcgatctaaaaggcaacaattgttattggctactcagttagtgaaaatgattctcaaaattgacgatgtacgtcagcccggctccggctaa

SEQ ID NO: 480 - DNA, 342 bp, Phyllotreta armoraciae
atggccactgctatggacgtcgattccgaagaaattgaattaccaacttcaagcagttcgaaaggcgagaaaaaacgatttgaagtgaaaaagtggaatgctgtagcactttgggcttgggatattgttgttgataactgtgctatatgccgaaaccacataatggacttgtgcatcgagtgccaggcaaatcaggcctctgcaactagtgaagaatgcactgtagcttggggagtatgcaaccacgcttttcactttcactgtatttcaagatggttaaaaactaggcaggtatgccctttggacaatagagaatgggaattccaaaaatatggtcactag

SEQ ID NO: 481 - DNA, 1605 bp, Phyllotreta armoraciae
atggtgtcattaaacccggtgaggattctcaaacaagaggccgaggatgaacggggcgaaatagcgcgtttgagcagcttcgtcggcgcaattgccattggagatttggtcagaagtaccttggggcccaaaggtatggacaaaattttagtatcgagcggtagaaacaccggaatggtagaagtcacaaacgatggagctactatactaaaatccgtgggtgtcgataacccggctgcgaaaatactcgttaacatgtcgaaagtacaagatgacgaagtaggcgatggcaccacatcagtaacagtatttgcgtcagaattattgaaagaagccgaacgtttgatcgagcaaaagatacatccgcagaccatcatagctggttggagaaaatccgtagatatcgccagaaaagcgcttttggacgcttccaacgacaacagcgccgatttagcagcgttccgagaagatctgatgaacatcgctcgaaccaccttgagctcgaaaattctatcgcaacacaaagagcatttcgcgaagctcgccgtcgacgcggtgctgagattaaaggggtccggcgacttacaagccatccaattgatcaaaaaaaccggcgggaccctgcaggaatccttcctcgacgaaggttttctgctcgacaagagacccggcgtgcaccagcccaagcgagtcgagaacgccaaaatcctgatcgccaacactccgatggacaccgataaaatcaaagtgtttggctcgcacatcaaagtcgattcgatggccaaaatcgccgagctggaatcggccgaaaaggataaaatgaaagacaaggtcaacaaaatcctcaagcacaacgccaacgtcttcatcaaccggcaactcatttacaactatcccgaacagttgttcgccgacgccggagtgatggccattgagcacgccgatttcgatggtatcgaaagactggcgctggtcaccggaggagaaatagtctcaactttcgatcaccccgagctggtgaaacttggtacttgcgacctcatcgagcaagtgatgataggagaagacactctcctgcgtttcagcggtgtggccttaggagaagcttgcacgatagtcatccgaggagccacccagcagatcatagatgaagctgatcgatccctgcacgatgccctttgcgtgttagccgcaactgtaaaagagagcaggatcgtgttcggaggcggttgcagcgagactttaatggctactgctgtggctagagcgtctgttaacacagctggtaaggaggcgctcgccatggatgccttcgccagagctctgctccagctaccgaccatcatcgctgataatgccggttacgattcggctcagttaattagcgaactgaaagcagcccacaacagcgggcttaatacaatgggtttgaacatggagaagggcgaagtgggcgatatgcgtgcgttgggcatcaccgaatcgttcgttgttaaacgacaggtgttgatatcggccggtgaggctgccgaaatgattcttcgtgttgataatatcatcaaagcggcgcccagaaagcggaccgaagacagaggaatgtgttaa

SEQ ID NO: 482 - DNA, 846 bp, Phyllotreta armoraciae
atgaaaatgttcagaaatcaatacgacagcgacgtaacagtatggagtccacaaggacgtcttcatcaagtcgaatatgcaatggaagcggttaatcttggttcggcaacagtaggactaaaaagcaacagtcatgctgttagaatagcattgaaaagagcttcatctgaattatctgcttaccaaaagaagataattcaaatcgatgatcacattggcattactatatctggtcttacagctgatgcaagaattttaagcagatatatgagaaacgaatgtttgaattacaagtactccttagacgcttacatgcctttgaatagattaattaatattttaggtatcaaaatgcagcattgtacgcaaagatacgatcgtagaccgtttggtgtaggtctcttgctagccggttacgatgacaacggcgcccatatttaccaaacatgtacgtctgctaatttctacaattgcaaggccatgtcgatcggagctcgatctcaaagcgctagaacttatttggaaaagaaactcgacgagttaccttcgagttctttagaagatttgatcaaacacggtttgagagctctcagagatactcttccaccggaagtcgatttgaatacgaagaacgtctccataggatacgtcggtaaagggattacctttaaaattttggaagaagaagaaactgctccttatcttgctttaatcgagggtgaagaacgtcgtggaggtggtggaggaggaggtagttcggaaggacaagctgatcctttgagagaatcgggggacgatggtcccaaagatcccacaccaactgtagcaacggataccacagaataa

SEQ ID NO: 483 - DNA, 2553 bp, Phyllotreta armoraciae
atggttttaaagccaggaagtaaacaggaacctatggaaattactttcaacgacgatgatttgccttatgaagaagaaattttacgaaatcccttctcggtcaaacactggcttcgatatatagatcacaagaaaacggctccttataacgaaatgaacataatctttgaaagggccctcaaggaattaccgggttcatataaattgtggtacaattatttacggaccagaagaaatcaaattaaaagcaaatgcatcactgatccgagttttgaagaggtaaataacgcctttgagcgttcgttggtattcatgcacaagatgcctcgaatttggatggattattgcacgttcctcactgaccaatataaaataacgagaacccgaaaggtgttcgacagggctcttcgagccttacctgtaactcagcataacaggatatggcctttgtatttgaaattcgtgcagaaacatgatatatcagaaacggctgttcgagttttcagaaggtatatgaaattatgtcccgaaaacgctgaagaatacatcgattacttaacgaaagtggaaagattggatgaagctgctataattacagctaaaatagtaaacgatgataattttgtgtctcaacaaggcaaatcaaagcatcaactttggaacgaattgtgcgagttgatttcgaaaaatcccgaaaaagttcgctctttaaacgttgacgccatcatcagaggcggcttgcgaagatacactgaccaattaggccacttgtggaactccttagccaattattacgttcgcagcggcttatttgaacgggctagagatatatacgaagaggccattcaaaccgttacgaccgtcagagatttcacgcaagtattcgacgcttatgcgcaattcgaggaattaagtctgagcaaaagaatggaagaagtggcagccaagcagaatcccagcgaagatgatgatacggaattagaattgcgattagcgcgatttgaatacctcatggaaagacggttgttgctcttaaattcagtattattgcgacaaaatccgcataatgtgcaagagtggcacaaaagagtgcaactctatgaaggtaaacctcatgaaattatcaacacgtacactgaagccgtgcaaactgtggatccgaaattggccgtgggcaagttgcacacgctctgggtggaatttgccaagttctacgaaagtaatgatcaaatcgaagaggcccggctgatattcgagaaagcctcgcaggtcccctacgtaaaagttgacgatctggctacagtatggtgcgaatggacagaaatggaaatccgcaacgaaaattacgatgaagctttgaaactcatgcaaaaggcgaccgtaatgcctagccgtaaagtggcctatcatgatgacactgaaactgttcaaagtagactgtacaagtcccttaaagtgtggtcgatgtacgcggatttagaagaaagtttcggcagcttcaaatcctgcaaggccatttacgacagaatcattgaactaaaaatcgctacgccgcaaataatcattaattacggcgtgtttctggaagaaaacaattatttcgaagaagctttcagggcttacgagaagggcatttccctattcaaatggcccaacgtatacgacatatggaacacctatttaaccaagtttttgaaacgttacggtggcagtaaattggaacgagcgcgtgatctattcgagcagtgcttggacggttgtccctcgcaattcgccaaacatctctatttattatacgctaagttggaagaggagcacggaatggccaggcatgcaatggccgtgtacgaaagggccactaaagccgtaccggaaaacgagatgttcgacatttttaacatatacataaaaagagccgctgaaatatatggcataccgaaaacgaggcaaatctacgagaaggccattgaagtccttccggaggataaaaccagggaaatgtgcttgagattcgccgacatggaaacgaaattaggtgaaatcgatcgagccagggccatttacgcgcattgcagccaaatctgcgatccccgagtcacggccgagttctggcaaatttggaaggagttcgaagttcgacacggtaacgaggacacgatgagggaaatgttgaggattaaacgcagcgttcaggcggtgtacaacactcaggtgaatatgatgtcagctcagatgttgagctcggcgggcagctcgagcggcaccatagcagacttagcgcctggggttaaagacggaatgaggcttttggaggcaaaagcggccgagatggcgggctcggcggcggcgcagaaatccaacataatgttcgttagaggggaaactcaaggggacaataaagacaaagtggtcaatcccgatgaaattgacataggaagcgaagatgacgaagaagaggaagaggaggagattccgttggagaagcaaaacgtgccgtccgaagtgttcggaagcctcaagaaaaaagggcacgatgaagatgaggatgattaa

SEQ ID NO: 484 - DNA, 1110 bp, Phyllotreta armoraciae
atggcaaacggaccgatagctgaaagaaatagagatgctactatatacgtcggtggtttagacgataaagtatcagaatccctgctatgggaactcttcgtacaagcagggccgttggtgaatgtacacatgcccaaagatcgcgtcaccatgatgcaccagggctacggttttgtcgaattcatgggcgaagaggacgccgattacgctataaagataatgaatatgataaaattgtatgggaaacctataagagtcaacaaagcttctgctcatcaaaagaatttggacgtaggagcgaacattttcatagggaacttggacccggaggtcgacgagaaactcttgtacgataccttttcggccttcggtgtaatattacaaacgcccaagataatgagagatcctgagactggaaattccaaaggctttgcgtttataaactttgccagcttcgaagcttccgacgcttccatcgaggccatgaacggccagtatctttgcaatcgaccgatatctgtgtcctatgcattcaaaaaggattccaagggcgagagacacggttcggcggccgagcgattgttagccgcccagaatccgctatcgcaggccgacaggcctcatcagttgttcgcagatgctccaccaataggaatgatgccgatgagtatggcgccgccccctccgcctctaatcaccggcatgatgccccctccaccaccaacgccgggcggcatgccacctccccctccgccagtccctccaccgagctccttccccgcgggtataccgccgccgcccttaccgccttctcagccacctttaccgccaggcgctccgcccacgcttgctcctgtgcccggtggtgcggccagaccgccgccgccgcctccttggtccggtgcggctgccaacgtgccgatgcctccgggtccccctggaccgaacgcaaacttcgggggaatgctaccacctcctcctccgccgggcggcaggccgctaccgcctaattggagaccgccgcctccgccgccgccgaattttggcggggccagaccgcctttcccgccgcggggacctcctcctccgccgccgacgttcgacgggtaa

SEQ ID NO: 485 - DNA, 774 bp, Phyllotreta armoraciae
atgggtcgtgttattcgagcacaacgtaaaggagcgggatccgtattcaaatcccacactaaaaggaggaaaggagcacccaagctccgttatttagatttctccgaaaggcatggctacatcaagggtgtagtgaaagacatcatccacgaccccggtcgcggcgcccccttggctttagttcacttcagggacccttacaagttccaaactaggaaggaaatattcattgctcccgagggaatgtacacaggacaatttttgtactgtggaaagaaagctaacctccaaattggaaatgtgttgcctgtaggaactatgcccgagggtacaattgtctgtaatttggaagaaaaaactggtgaccgtggccgattggctcgagcatctggtaactacgcaaccgtgattgcccacaatcacgatacaaagaaaactagagttaaattgccatcgggagctaaaaaagttatcccaagcaacaacagagctatggttggtattgttgccggaggtggtcgtatcgacaagcccatcctgaaagccggtcgtgcctaccacaagtacaaggtgaagcgtaactgctggccgaaggtgcgtggtgttgccatgaaccccgtcgagcatcctcacggaggtggtaaccaccagcacattggtaaagcttccaccgtcaagaggggaacttccgctggtcgcaaggtcggtcttattgctgcgcgtaggaccggtcgtatcagaggaggtaaggtcgaaactaagaaggacgattaa

SEQ ID NO: 486 - DNA, 411 bp, Phyllotreta armoraciae
atggctcgaaccaagcaaactgctcgtaaatcaaccggtggtaaagctccacgaaaacagttagctgccaaagccgctcgaaagtctgcaccttcaactggtggtgttaagaagcctcaccgataccgccctggtactgttgcccttagagaaatcagacggtatcagaaatctaccgaactacttatccgaaaacttccatttcaacgattggttcgagagatcgcccaagactttaagactgatctaagatttcaatcatcagctgttatggcactccaggaatctgctgaagcttacctagtcgggttgtttgaagatactaatcttgctgcaattcatgccaagcgtgtcactattcaacctaaagacattcaattggctcgaaggttgagaggagagcgatcttaa

SEQ ID NO: 487 - DNA, 1593 bp, Phyllotreta armoraciae
atggccataagtttattgaatccaaaagccgaagtggcgagagccgctcaagcgttggccgttaatataactgcagccaaaggaatttcagaagtgatgaaaacgaacttgggaccgaagggtaccatgaaaatgttggtgtccggtgccggcgacatcaaaataaccaaagacggcaacgttcttctccacgaaatgcaaatccagcatcccacggcttcgttaatagccagagcttctacggcacaagatgatatgaccggagacggaaccacatctacagttttagtgatcggtgaactcctgaaacaagccgacatatacatcgcagaaggcttgcaccccaggacactcacagaaggtttcgacaaagcgagagcaaaggccctagaaattttggacaagctgaaaataccgattgaaatcaacaaagaatcgttaagcgacgtttgtcgaacaagcttaagaacaaaactgcatcaaaatttggctgatatccttactgatgtgtgcgtcgaggccattctcgctatcaagcagtccgataaaccggtcgatttgcacatggttgagctcatggaaatgcagcacaaaacggagaccgacacccaactggtcaaaggtttagtgcttgatcacggcggtcgtcaccccgatatgccgaagagcttgaagaattgttacatcctcacctgtaacgtcagcatggagtacgaaaagagtgaagtcaattcaggtttcttctacaaaaccgctgaagagagggagaaattggtgttggccgaaagagattttatcgaacagcgagttaagaaagtggtcgagttgaagaaggctctttgcaaagacacaaacaagacgtttgttgtcataaaccaaaaaggtattgaccccatgagcttggacatgctcgccaaagaggggatcattgctctccgaagggctaagaggcgtaacatggaacgtttggcgttagcttgtggtggaacggctgtgaacagtttcgacgatttacaagaatctcaccttggttatgccgggcatgtttacgaacacgtcctgggcgaaaacaaatatacctttgtagaagaatgcaaagtgcctcaatctgtaacgattttaatgaaaggacccaacaagcacactttgttacagatcaaagacgctgttagagatggcttgagagctattaataacgccatcgaagacaaagcccttattccgggtggtggtgctttggaagtggcagtaaacaaggaattactggcgtacaaggacgaaataaagggaaaagctcgcttgggcgtagccgcttacgctgaagctctgttggttattccgaaaactctggctgtaaactccgggttcgacgcgcaggataccatcgtgaagctgcaagaggaagctcgactaagttccgaaccgatcggcctcgacttaacgtcaggcgaacccatcaatcccaaagatgcgggcatctacgacaactacgtggtgaagaagcagatcattaattcgtgctcgataatcgccagcaacttgttgctcgtcgacgaaatcatgagagccggtatgagcagcttgaaaggctaa

SEQ ID NO: 488 - DNA, 3126 bp, Phyllotreta armoraciae
atgtctagtgctggaatcgcagacagccccatcgatcctccagcaaagaagcgaaagctcgactcgaaaaattgcggcaccgacatggcgaataatgaagcttcaggatcctccaacgccggcgaaatcgacgagggactctactcgaggcagctgtacgtgttgggacacgatgccatgcgccgcatggccaccagtgatgtgctcgtatcgggtttaggcggtttgggtgtcgaagtagctaaaaatgtgatcctaggcggtgtcaaatcagtgactcttcatgacgatgctctttgcaccgtccgggatttgtcgtcgcaattttacctcaccgaggccgacgtggggaagaaccgcgccgaagcctgctgcaagcacctatccgaactcaacacctacgtccccaccaagccctacacgggcccgctcgacgagaagatcctccagaaatacagggtggtagttctaacgaatagcactcgagccgaacagctccgtattagcgagataacgcataacaacgatatcgctttgataatcgcagatacgaaaggcctgttcgcacaggtcttctgcgacttcggcaaggccttctccgttgtagacgtcaacggggaaccccccgtatccaccatgatagcagatatatcgaacgatacagagagcgtagttacttgcatagacgatacgaggcacggcatggaggaaggagattacgttaccttctccgagatcttgggcatgacggagttgaacaactgcaagcccattaaaatcaaagtattaggtccgtacacgttcagcatcggcgacaccaccaaattctccaagtacgtacgaggcggtatagtcacgcaggtaaaaatgcccaaagaagtgcactttaagccgttgaaggagtctctgcagaatcccgaattcgtggtgaccgatttcggcaagttcgatcatccgattcaattgcacctcgctttttccactctccacaagttcgtggagaagaccggccgattgccgaagccctggaacaaagacgacgcttcggagtttatcgctctggcgaaatcgttggccgtaaatggttccacggataccgaggtcaacaccgatattctcaacattttctccaaatgttgttcgggcgatcttaatcctattaatgctacgatcggtggtatcgtggcgcaagaagtcatgaaagcctgttcggggaaattctttcccatttaccagtggttgtatttcgatgccattgaatgcctgcctcaagacaaggaggaaatcactgaagagctcgcagctccagttgatggaagatacgatggacagatcgctgtattcggaaaagatttccagaagcgattaggtgaactgaaatatttcattgtcggtgccggagccatcggttgcgagttattgaagaacttcgccatgatgggattgggcacgcaaggcggtcaaatcactgtaaccgacatggatttgatcgaaaaatcgaacttaaacaggcaatttttattcaggccccataacgttcagcaacccaagtctgctaccgctgccaaggtaataaagaagatgaatcccgacgttaacatagtcgcccacgagaaccgagtgggccccgaaacggaaagcgtctacaacgatgagttcttcgaggttttagacggcgtagccaacgccttggataacgtagacgcgagaatatacatggacagacgatgcgtttactatcgcaagcctctcctggagtccggcacgttgggaaccaaaggaaatactcaagtagtcgttccatttctatcggaatcgtacagttcatcgcaagatcctcccgagaagagcataccgatttgcactctgaagaatttccccaatgccatcgaacacactttacaatgggccagggacaatttcgagggattgttcaggcagaacgccgagaacgcttcgcagtacctcagagacccggagttcatcgaaagaaccgtcaagctacctggtgtccagcctttggaagttctagaatccgtaaaggccgctttgatcgacgaaagaccgaaggattacgacgattgtctggcctgggcgcgtctacattgggaggaccaatacgccaatcagataaagcaactgttgtttaatttcccgccggatcaactcaccagcaccggccagctgttctggtctggaccgaagaggtgtcccgaaccgctcgtattcgatatcaatgaagatttgcacgtggattacgtaatagctgcggctaatttgaaagctcaagtttacggcatccctacgaatagaaacagatgttatgccaaacaagtagtcaccagcattgaggtacctccgtttgtgcccaaatcgggcgtgaaaatcgccgtgacggattcccaaatggccatgaacggtaacaacgtcgacttggatcgtatcaatcaaatcaaacaggagctaccctcgatggaagagctcaacggcctgacgctcacaccactggaattcgaaaaggatgacgacagtaatttccatatggacttcatcgtcgcggcctcgaacttgagagccgccaactacaagattccactggccgatcgacacaaatctaaactcatagctggtaaaattataccggctatagcgactactacgtcagtggtagctggtctggtttgtttggaattgtacaaactggccaggagtatcaagagtttaacgccgtttaaaaacggtttcgtaaatctggccttgccgttcttcgggttctccgagccgatcgcagcccccaaaatggagtattgcggtaaccagtggacgttgtgggacaggttcgaggtgcaaggcgaaatgacgctcgccgaatttctggagtatttcaaggagaagcatggcttggagattacgatgttgtcccaaggggtgtgcatgttgtactcgttcttcatgccgaaagccaaagctcaagaaaggttgggactaacgatgtctgaggtggtgaggagagtgtcgaagaagaagatagagcctcacgttagagcattggtgtttgagttgtgctgcaatgacgccgacggtgaagacgtggaggttccgtatgttaaatacaacctgtattaa

SEQ ID NO: 489 - DNA, 1287 bp, Phyllotreta armoraciae
atggccgacgctgatgccgccgacgatctattagattacgaagatgaggaaaacccagaacagaccgcaaatgaaaataatgcgactgaaggtcagaaaaaaggggttaaaggaacatacgtttcgatacacagctccggctttcgggatttccttctaaaaccagaaatcctccgagctattgcagactgcggtttcgaacacccttcggaagtgcaacacgaatgcattcctcaagcagtaattggcatggacatcctttgccaagcgaaaagtggtatgggtaaaacagcggtatttgtactagccaccctacaacagctagaacccaccgaaaatgtcgtttacgtactcgtaatgtgccatacgcgcgaattggccttccaaatcagcaaggaatacgaacgtttcagcaagtacatgtccaacatcaaagtcggcgtgttcttcggaggcttgcccatccaaaaagacgaagaagtattaaaaaacagctgtccgcacatcgtcgtcggaacgcccggtcgaatcttggctctcgtcagatcgaagaaactcaatctcaagcacataaaacactttattctcgacgaatgcgataaaatgttggagctactagacatgagacgcgacgttcaagaaatatacagaaatacaccgcacgaaaaacaagtaatgatgttcagtgcgacgctcagcaaagaaattcggccagtttgcaagaaattcatgcaagatcccatggaagtgtatgttgacgatgaagcgaaattgacgttacacggtctacaacaacattatgttaagcttaaagagaacgaaaagaataaaaaattatttgagttacttgatgtattggagtttaatcaggtggtgatatttgtaaaatcggtgcaaagatgcgtagcattagcacaacttttgacggaacaaaattttcccgcgattggaatacaccgaggaatggagcaaaaggaacgattatccagatacgaacaattcaaagatttccaaaagagaatattagtggccactaatctctttggtcgtggtatggatatcgagagagtcaacattgttttcaactacgacatgccggaagattcggacacttaccttcacagggtagcccgagcaggtcgtttcggtacgaagggtttggccattactttcgtttccgaagaaggagatgccaagattttgaatgaagtacaagacagattcgatgttaacattaccgaattacctgatgaaattgatttgagttcatacattgagggacgatag

SEQ ID NO: 490 - DNA, 1473 bp, Phyllotreta armoraciae
atgggagctctcgagacagacgtcgagatgaaaaacgccgatagccccacggggctggaagccggagacaacaagagagacaaagatttgaacagtttcacggaaatccgagagcaggccaagcaaatagaaaaaggcataatcaacaaggagggccgctttattctgagagtgctccgctgcttgccgaataccagacgaaagctgaacggaattgtcctcagaactcttataaatcatatttacccggcggttgatcgtgatgtactcctgagcttcatcgaagaatccgccggtgagcttgacactacccaaactaaagctagaccggccaccaagtcgcccgtagcagaaatcgatacctacatcaacttgctctgcttagtgcatttaatcgacaccaacaaattagtagaagccgaacgctgttcgcaaatcctcatgaacaagatcaccagtcaaaacagacgaacattggacctaatcgcagcgaaatgttacttttattactccagagtagcagagctcaccgacaagctggactcgatcaggagattcctgcactcccgtcttcgcacggccacgctcaggaacgatttcgaaggacaagccgtactaatcaactgtttattaaggaactacttacactattccctgtatgatcaagcagataagttggttaataaatgcgtgtttcctgagactgccagcaacaacgaatgggcgagatttttgtactacttggggaggatcaaagcggctcggttggagtacagcgtggcgcataagcatctaatacaagcgatgcgtaaagcgcctcagaatactgcgatcggttttcggcaaactgttcagaagctgacggtcgtagtcgaattgctgttgggggatataccggagagacaaatattccggcaggcgagcatgcggcattctcttgcgccctatttccagctcacgcaggccgtgagaatgggaaacttgcataggtttggagaggtactggagaatttcggtccacaatttagacaagatcatacttttactttgatcctacgccttcggcataatgtcatcaaaacagctattagatcaatcggtctgtcgtactccagaatatctccccaggatatagccaaaaaactgggactggattcagcagaggatgcagaattcatcgtagcgaaggctattcgtgatggtgttatcgaagctattttagacccccaagggggatacatgaggagtaaagagagcactgatatctactgcactaaagagcctcagctagcctttcaccagagaatatccttctgtttggacttgcacaatcagagcgtgaaagccatgagatacccgcccaatgcgtacggaaaggaactggagtcggccgaagagaggcgggaaagggaacagcaggatttagaattggccaaggaaatggccgaagatgatgatgatagttttccttaa

SEQ ID NO: 491 - DNA, 1683 bp, Phyllotreta armoraciae
atggcctccagccatcaagcccttccagtgtcggctatcctgaaatccaaaagcgaagtcgaggatgagcctaagaagaagtccagggaggattggcgtaaggctaaagagctagaggaggctcgaaaagccggtacagctccggcggcagtcgacgaagaaggtaaagatatcaatccccatattccgcagtacatatctacggctccttggtattacggaacgaccggacccacgttgaagcatcaaaggccacaggatgagaaaaataaagagtattcggatttgaacgattggtataagagaggcgtagatacttcgaagattataacaaagtatcggaaaggcgcttgtgaaaactgcggggctttgactcacaaaaagagggactgcatggacagaccccgtaaagtcttagctaagtattccggtgcgaatatagcacctgatgagtttatccaaaagaatttatcactaagttttgacggtaaacgagataggtggagtggttacgatccttctgaacataagacggttatcgaggaattccagaaagtagaggaagccaaacggcaattaaaatccgacaaattgaacgcaaacgaagagtccgaagacgaagaaaaagacgaggataaatacgtcgatgaagtggacatgcccggcacgaaagtcgacagtaaacaaagaataacggtcaggaatttgcgtatacgagaagatacggctaaatacttgagaaatttggatccgaactcggcgtactatgaccccaaaaccagatcgatgagggaagatccgaaccccgggaacgacgctacataccatggggaaaatttcgttcgcttttccggcgacactacaaatcacgccagagcgcagctgttcgcttgggaagcacacggtaaaggagtggacgttcatttactagcagaacccacgaaattggaattactgaagaaagaatacgagaaaaagaaggatgaggtgaagtcgaatattcagggtacagttttagagaaatacggaggtgaggaatatcttgaagcgccaccaaagagtttgttgttggctcaaactgaaaactacgttgaatattcgagatcgggtaagattattaaaggagcagaaaaagaagttattaaatcaaagtacgaggaagatgtttatattaataatcatacgtcagtatggggctcttactggcgcggaggacaatggggttatcgatgttgtcattcctttattaagaattcttattgtttgggcgaagcaggaaaatcagtaaacgctcaacctacatcagaaataaaaaataatgatgaacccaaagaggagcaactacaagaagatgaagaaaaagaaaagagcgaggtactagataaagaaagtgaagaatctgattctagtagttcgtcggaagatgaaaaatccaaagcaaaatcgaagaagaaattaaaaaagaaactgaagaagcagaagaagaagcaaaagaaaaaggacaaggataaggaggttaaagcgtcggcgtcgataaaggaagtagacgaagaagtgattttagacgatagaaagcggccttacaacagcatgttcgaggcgaagaaacccacagacgagcaaatggaggaatacttcaagaaaagacgaagagacgaagatccgatgaaccaattcatgtaa

SEQ ID NO: 492 - DNA, 627 bp, Phyllotreta armoraciae
atgggtataagccgagatcattggcataaacgaagggccaccggaggcaagaggaagcctcttcgcaagaagaggaagttcgaattaggccgtccggcggctaacacgaaactaggaaccagaaggatccattatgttcgtacaaggggaggcaacttgaagtaccgtgccctaagattagacaccggaaacttttcttggggtagcgaaggaactgcccgtcaaacacgtattatcgatgtcgtttacaacgctagtaataacgaattggttcgtaccaagacgttggtaaagaatgctattgttgttattgacgccaccccattcagacaatggtacgaaagtcactacatcttaccattgggacgcaagaagggtgccaaaatgacgcctgaggaggaggagattttcaataaaaaacgtagcaaaaaagtacagaagaagtacgaaactaggcaaaaaaccgctaaagtagaacctgcgatcgaagaacagttccacactggaagattgttggcatgcctagcatcaagacccggacaatgcggcagggccgatggttatgtcctcgaaggaaaggaacttgaattctacatgcgtaaaattaagtctaagaaagctaaataa

SEQ ID NO: 493 - DNA, 936 bp, Phyllotreta armoraciae
atggatagattgcttcgtctcggaggcggcatgccgggtttgacccaagccccgccgccttccgacgcccccgtcgtcgacaccgccgagcaggtctacatctcctcactagccctactgaaaatgctcaaacacggcagggccggcgtgcccatggaagtcatgggactcatgttaggtgaattcgtcgacgattacacggtgagagtgatagacgtgtttgctatgccccaaacgggcacaggagtgagcgtagaagccgtagatccggtttttcaagcgaaaatgttggatatgttaaggcagaccggcaggcccgaaatggttgtcggttggtaccattcccatccgggtttcggctgttggttgtccggcgtcgatatcaacactcaacagagctttgaggccctttctgagcgagccgtggccgtagtcgtggatcccattcaatcggtcaaaggaaaagttgtcatcgatgcctttaggttaatcaatcccaacatgatggtgttgggtcaggaaccccgtcagacgacttcgaatttgggtcatttgcagaagccttccgtacaagcgctgatacacggtttaaatcgccattactactctataagcattaattataggaagaacgagttggagcaaaagatgctgctgaatttgcacaagaaatcctggatggacgggctcactttggccgattactcggagaattgcagtgtgaacgagaaaaccgtagccgatatgctggaattggctaaaaattacaacaaagctttggaggaagaggagaaaatgacgcctgaacaactggctatcaagaatgttggtaaacaggatcccaagaggcatttggaggagaaagtcgatatattgatgaccaataatatcgtacaatgtttgggggccatgttggataccgttgtgtttaaatga

SEQ ID NO: 494 - DNA, 1461 bp, Phyllotreta armoraciae
atgaggtacgtaaagaattactttcatattcatctttttcgaatctatacgttcagtcacttaattgtcttttgttatttccaaaatgtcatcaaattaatattgttcgaaaatttcggtaaaatgggacaaggctccctgacaaaattaaaaagaaataaaaggaaaaaaagtttattagccagtacatcaaagggtctcgaaattaaaccttcctcagaattaattgtcaacatggttacttgtgtcgaaagaaatccaaagatggaggtcgatgggcctctcaagggtgaagggttcaggtcctattatatcaccaaaattgaggaattgcaactaatcgttgctgaaaaaagccagaacctcagaagattacaagcccaaaggaacgaacttaatgctaaagttcgtatgcttagagaagaactgatgcttcttcaagaacaaggaagctatgtgggggaagtggtcaaacccatggataagaagaaagtacttgtgaaagtccatccagagggaaaatttgttgttgatattgacaaaaatatcgacattaatgacgttacaccaaattgtagagtcgctcttcgaaatgaatcgtacactttgcataagattttaccgaataaggtggatcctttagtatccctcatgatggttgaaaaagttccagattccacttacgaaatggtcggtggtttggacaagcaaatcaaagagatcaaagaggtgattgaattgcccgtaaaacatcccgagctctttgatgcattgggtattgctcagcccaagggtgtgttgttgtatggaccgccaggaactggtaaaactcttttggctagagccgtagctcaccacactgaatgtacgtttattagagtatctggatcagagttggtacaaaaattcatcggggaaggttccaggatggtaagggagctgttcgtaatggctagggagcacgccccttcaatcattttcatggatgaaatcgattcaattggatcctctcgtatcgaatcaggttctggtggtgattccgaagttcaaagaactatgttggagttgctgaatcaactcgatggatttgaagctacgaagaacattaaagtgataatggctacaaacagaatcgacattttggatcccgctttgctgaggccaggtagaattgacaggaaaatcgagttccctccaccgaacgaggaagcccgattggatattctgaaaattcactcgagaaaaatgaatctgaccagaggaatcaatttgaggaagatcgccgaattgatgccaggtgccagcggtgccgaagtgaagggagtgtgtactgaggctggtatgtacgcgctaagggaaagaagggtgcatgtaacccaagaagatttcgaaatggctgtggccaaggtcatgcagaaggattcagagaagaatatgtctattaagaaattatggaaataa

SEQ ID NO: 495 - DNA, 600 bp, Phyllotreta armoraciae
atggtaaaattatattgcatcagtattctctacaaagatactacctacgctacgtggttgaagtctgctttcgatttgcaaagcttcagtttcttccaaagagggtctatacaggaattcatgtcattcttttgtaagactattgtggaaaggactataccatcatcgagacaatccgtcaaagaaggagaatatatgtgccatgtttatgtaagacatgataacttagctggtgttgtgatatcagatcacgaatatccgtctagggtgtcgcatacgctgattacgaaaattttggacgaatttgccgctaaaatacctgctgttaattggcctaccttgcaagagaaggatgtaacgtttccgctgctaaatacataccttgccaaataccaaaaccccaaggaagccgatgcaatgactaaaatacaagaggaccttgacgaaaccaagattattctgcataatacgattcaagctgtcctggaaagaggcgaaaaattggatgacttggtaaataaatcagagggcttaagtatacagtccaaagctttctacaagactgcaagaaaaacgaacagttgctgcaatttcacttaa

SEQ ID NO: 496 - DNA, 729 bp, Phyllotreta armoraciae
atgtttctaacaagaagcgaatacgatagaggtgttaacacattttcccccgaaggaaggttatttcaagtggaatatgccattgaagctattaaattgggatccacagctatcggaatatgcaccagcgaaggggtcgtgctagcagtcgaaaagcgtattacttctccattaatggagcctacaacgattgaaaagatcgtagaagtagataaacacatcggctgtgctgtttcggggctcatggcagattcacgcacaatgatcgatagggcaagagtagaatgccaaaatcattggtttgtttacaatgaaaacatcactatcgaatcatgtgctcagggagtatcgaacttagctattcaattcggagattcggacgatgatggtgctgctatgtcgaggccatttggtgtggccattttgtttgctggcatagacgaaaaagggcctcaactttaccacatggatccttcaggtacatttgttcagttcgatgcgaaagctataggatctggttcagagggcgcacagcaaagcttacaagaagtatatcaccgtagcatgactttagaggaagctaccacagcagcattgactattctcaagcaggttatggaggagaaattgaactcgtccaatgtagaagtcatgacaatgacgccaaaggatatgtttcacatgtttactaaggaacaagtggaggaggtaattactaaattatcttaa

SEQ ID NO: 497 - DNA, 1158 bp, Phyllotreta armoraciae
atgacagaatactggttgatttccgccccaggtgacaagacttgtcaacaaacatgggatacaatgaataatctgactagtaaacagaacaatttgtctgcaaattacaagttccaaatacccgatttaaaggttggaactcttgaccaattagttgggctatccgacgatttgggaaagctggatggtttcgtggagcaggttactcggaaggtggctcagtacctcggcgaggttcttgaagaccagagggacaagttgcaggagaatttgcaggcgaacaacaccgatttgccaagttatttaaccagattccaatgggacatcgccaaataccccatcaagcaatcgctccgcaacatcgctgatataatcagcaagcaagttggacaaatcgatgccgatcttaagaccaagtcctcagcgtacaataatttaaaagggagtcttcaaaatttggagaaaaagcaaacagggagtttgctaacccgtaacttggcagatctggtcaagaaggagcactttattttagattctgagtacttgcaaacgttgctcgtcatcgttcccaaatctcagtttaatgagtggaacgccacttacgaaaaaatcacggacatgatcgtccctcgatcgtcggagcttatcattcaggaccacgactacggcttgttcaccgtgtcgctctttaagaaagtcgtcgaggagtttaagctgcacgccagagagaagaagtttatcgtgcgagatttcacgtacaacgaggaggaattggcggccggcaaaaacgaaatcaccaagctcgttaccgataagaagaagcaatacggtccgttagtgagatggttgaaagtgaacttcagcgaatgcttttgtgcttggatacacgttaaagcgctgagagtgttcgtcgagtccgtgttgagatacgggttaccagtcaattttcaggccattctgatccatccaaataagaagcaagccaaacgtttaagagatgttttgaatcaactatacggtcatctagacagtagtgcagctctttccggacctaatgttgatagcgtagacattccaggattaggtttcggccaatcagaatattatccctacgtgtactacaaaataaatgttgatatgatagaatcgaaggtctaa

SEQ ID NO: 498 - DNA, 1674 bp, Phyllotreta armoraciae
atgtcgattttagcgagtcccctatccgtagccggttcgagaacgacgggcgcttcggttcgcacccaaaacgtcatggcagcttcgaccatagccaacgtggtgaagagctcgttgggcccggtgggcctggacaagatgctcgtcgacgacatcggcgacgtgaccgtgaccaacgacggcgccaccattttgcggctgctggaagtcgaacatcccgccgccagggtgctcgtcgaattggcccagctgcaggacgaggaggtcggcgacggcaccacctccgtcgtcatcatagccgccgaactgcttaaaaacgccgatgaacttgtaaaacaaaaaatccaccctacgtcgatcataagcggatacagattggcttgcaaggaagcttgccgatacatacaagaccatttgactataccagtagaggaattgggcaaggaatccatcgtaaacgtcgccaagacttcgatgagctccaaaattatcggagctgatgctgatttcttttcgcaaatggtagtcgacgccgcgacagccgtgaaagtaacggactccaaaggcaactcgatgtatcccataaaggcggtgaacgtgttgaaagcgcacggcaaaagcgcccgggagagtttcctggtggccggctacgccttgaactgcacggtcgccagccaggccatgcccaagaagattttaaacgccaaaatcgcctgtctggatttctcattgcaaaaggccaaaatgaagatgggcgtgcaagttctgattacggaccccaatcaattggaaggcgtgcgcgccagagagctggacatcaccaaggagcgcatccagaagatcctggctaccggcgtgaacgtggtgcttctgtccggcggcatcgacgacgtctgtttgaagtacttcgtggagcgcggcgccatggccgtgcggcgcgtcaaaaaggccgatttgaaacgcatcgccaaggctacgggcgccgctttcgtcacgtcgttgagcaacatggagggcgaggagaccttcgacgccgccatggtgggcgaggccgcagaggtcgtacaggagaggatatccgatgacgaattgatcgttatcaaaggaccgaaagctcgtactgctgcatcgataatcctgcgcggtccgaacgatttctactgcgacgagatggagcgttcggtgcacgacgccctgtctgtggtgaagcgcgtgctggaatcgaagagcgtggtggccggaggcggtagcgtcgaggcggcgctctcgatctacctggagaatttcgccacgacgttgagctcgcgcgaacaactcgccatcgccgagttcgccaggagtttgctggtcataccgaagactttggcggtgaacgcggcgcaggacgccactgatttggtggccaaattgagggcctatcagaattctagccagactaagaaggatcatgcgcatttgaagtacgtcgggttagatctgattgaaggtactgtgagagataataggaaagctggggtgttggagccgactatgtctaaggtgaaatcgttgaaattcgctactgaagcggcgataactatactcagaatcgacgatatgatcaaattggacgctgagcagaagggcgggaagagctaccacgatgctatggagagcggtgaactgtacgattag

SEQ ID NO: 499 - DNA, 768 bp, Phyllotreta armoraciae
atgtttaattctacctattcggcgcctccgccgttttggagcaacggcccagccccaggggctttctacaacttcccgggaaccgaatggaaacctataacaaacccaataactcatactcaatctcctgtaactacttcaacttctattgtgtctataacgtacgataaaggagtactaatagccggagacttgctggcctcttacgggtctttagctagatacaaaaattgccctagggtaatcgaaatcaatccgaatatcatcctaggagcaggaggagattacgctgattttcaatatgttaaaagctttatcgagcagaaaataatcgatgaagattgcctagatgatggtttgaaaatgaaaccgaaatctctttattgctggctgactaggattatgtaccaacggagaagtaaactcgacccgttctggaacaacttagttgtcggagggatacaggatggtgtaccattcctaggaacagtcgataaacttggtacagcttacacagataaagtaatttgtaccggttacggggctcatatagcccttcctgtcctgcgagatgccctcgataagaaaccaaatttaaatttaaacgaagccaagcagcttattaaaaagtgtatggaagttttgttctacagggatgcgaggagttacccgaaatatcagttggggatgatcgatgcggatgaaggtgtgaagattgaggggccgattgcggtcgaggaaaattggaatatcgcttatatgacttaa

SEQ ID NO: 500 - DNA, 2103 bp, Phyllotreta armoraciae
atggaattttcgaaagaacccaactttgaattaacagctaaggatttttcaccagaaaaatatgtaaaaaaattgtcccagaattatgtgggtggatccgaattacagaatcttcgaagaaaaattcaagggctctccgaagaaacaagctctaatttaaagaaaaatgtttacgaaaactacattcaatttatcgaaactgccaaagagatttcacatcttgaaagtgagatgtaccagctttcccacttactctccgagcaaaaagcattgcttaattgtttatcggccacatcaatattggaagacgtacagccagttaacattgatagggataataaagtaaacgaaaaggatcttgaagaagaaaacaaacaaaaaatagctgctattttagaaaaagtagaaggttgtcaggaaatgttaaaagtaccaggaagaattttcttgtacgaaggagatttattggaaatcgaacccaccgaaaacaccgccttaaaaatagttcacgtttatttatttaccgatagttttatgataactacaagaaattcaaacagtcgaggtctcatgaaatacatctacgaaagcatatacgacttgagcagcctagcggttgtgaacgtaagagatttgggaaacgttaagcacgcctttaagcttctcattttccccgatacaagagttttccaatgctcctcgaactccaataaaaaagagtggctagacaagttcgatcaagccaagaaaaccaagctggcccaagaacagcaaaaaagggaatccgtatcggaaaaatctcccactcgcgtatccttcgaatcgcccagctacaatccttttgacgatgtggaagaagaaacgagcgcgttgcatccagaatggttcgtggacattccggaagagctggacgtttgcgtggcccaaaggcacttcgaagacgccctttctttactgcaaaaagccaaagaatatttgactcaagcatcctctgcgacaggagacaagcgagacaccgttttcacggatatccagaggaaagtagagcaaaggcagaacaatttaacggaggtgttgatgaaggaattagaagtaaacccggataaatcgctgcagggcggtttgagagcggctcgcagggctgtgagattgctgaatcaattaggaagggaaacacaatcttgtacgctgttcctaaagttgtgcagcagcatgctaaggactcagtgcaaacgagttaaaagagaaggctctactaccacttacataaagcatctttcgagcgtggttttcaccaatatgtgtcacatgtctgatgaatttctgagagctttccccgactctccagcctgcgcctcagcgtatgtggtttgggcgagcaatgaactgctgcaatttactacccattttattaagcaggttttcatgcctcagacttccttatcaacggtgaccgaatgcatagttttagtgagacaacagtgtgaaaggctgtacgtttacggattagacctttgttatcaattagacggtgctttgagatcttccctgatgaaagcattgaaagacgctcgagataaactaatcgactcgataaagttgcgagttctagatgataaatggatacctattaatttgcacagcaaatcggctttaagtcgttgcgtgcaagagtattcccaaatgggactcactaacgttggaagttacgtttctggcgatacttggttacaattaacggctagtactttatcgttcacgaaaatgtttttgaacttgctaaacgattgtatgaaattgaaaactacagagttaatgtacacgatcgatgagactttgtataacgtgttcgaagctcaagtcaggcacaacgaaaacgctctcaggagcgaattgaatcaagaccaaaggaactttctcacgaaaaacgccgagtttttattggttagtttgatgcaggtggtgcaaaagaagtacgaggagaatgttggttacgaatgtcccacgctcgcgaaattgcaaaaggaatatgtagcattacagaaaggcgttacgccagcgtcgagaagtacaaaagccaagtattcatcagagtttatttaa

SEQ ID NO: 501 - DNA, 3705 bp, Phyllotreta armoraciae
atgaacgaattggagaaactagaatacctctctttggtctcaaaaatttgcacagaattggacaaccatcttggaatgaacgataaagatttagctgaatttataatacatctttccgaaaaaaacaacactttggaatcatttaagaaggtgctttcagaaaatggtgccgaattctcagactcttttgtttctaacctgttgcgaattatccagcacatgaaaccgaagaaatcgacaaataaggaagaagccgataaagtggaaaaagagggattggcttttaaatttcccggtttagcgatacctaatgagaaacaaatacctttacaattagaagaatttgacgaggaaaataaaaatgatgaaatagacgttgtagccgacatgatgaaacagcttgaagctgacgcaccttcccaaaagcaaacaaaagaaaagtccagaagcccaagcattgaaaagaaatcaagagtaagatctagaagtaggtcaaaggaaagaagaagatcgagaagcagatcaaataataggcgaagaactagaagcagatctagagatagaagaagatctagatctaaagatagacattctagaagagaaaaaagacacagaagtaggtcaaatgaagactacaagaggagaagaagagacaacagttactcgagagatagaagagaaagaggtaggtccaaagaatcggaacgaagagacagaaatagatcaagagatgatagaaaaagagaaagaagtagatcgagaacgaggaggcgagaaaggagttacgaaaaaaaattcaaaagcgaaaaggataatcctgaatttgaggatgatcctactccaggaaagatttataatggaaaagtatcaaatgtcgttccgtttggatgtttcgtacaactggaaggtctaaaaagaagatgggagggtctagtgcatatttctcagctgagagcagaaggtagagttaccaatgtttctgatgttgtctctagaggaagcaaagttaaagtaaaggtattaacaataactggtcagaaagtatccctttcaatgaaagatgtctgccaaacgacaggaaaagatttgaatcccctatcccatgccactacggaaagagaagataaagaccgtaaccctgacaggcccacaaacaatagcacatctgtgttgaggctgccagttagcatcgatgaaggagaagaagattccaggaaaagggtaactcgaatgtccagccccgagagatgggaaatcaagcaaatgatttcttctggctgcatagacaaaagtgaattgccagaattcgatgaagatactggtttgctgcctaaagatgaagacggtgaagctgatattgaaattgaattggttgaagatgagccaccatttttacaaggtcacggtagagctgttcacgatctaagccccgtaagaatagtaaaaaatccagatggttcgctagcccaagccgctatgatgcaatcggctttggcaaaggaaagacgcgaacagaaaatgctgcaaagagaacaagaagtggattcgcagccttctggaaagaacaaaaactggatcgatccccttccagaagaggaatctaaatcgatggcaagaggaataggtcttcaaagtcaagatttgcccgaatggaaaaaacacgttatcggcggtaaaaagtcatcttttggtaaaaaaactaacttaacgatcgtcgagcaaaggcagtctcttcctatttacaagctcaaagaagagttacgaaaagccgtaacagaaaatcaaatattgatcgttattggtgaaaccggctccggaaaaacaacacaaatcacccagtatttagctgaggccgggttcacagccagagggaaaattggatgcacgcagcccagaagagttgctgcaatgtcggtggctaaaagagtggccgaggagtttggatgcagattgggccaagaagttggttacaccattagattcgaagattgcaccagtcccgaaacgatgatcaaatacatgacagacgggatgttgctacgtgaatgccttatggatttggatcttaaaaattactctgtaataatgttggacgaagctcacgaacgtacgattcacactgacgtactctttggacttttgaagcaagctgttatgaaacgagacgaactgaaattgattgtaacttctgctaccttagacgcggttaagttttcgcagtatttctttaaagccccgatattcacgattcccggtaggacattcccggtagaagttctgtacaccaaggagccggagactgattatttagatgctagtttaataacggtgatgcaaatacatctcagagaacctccgggcgatattttactgtttttaacgggtcaagaagaaatcgatactgcttgtgaaatattatacgaaagaatgaaaagtttgggtcccgatgtacccgaactgatcattctacctgtatactctgctttaccgtccgaaatgcaaactagaatattcgaaccagcacctcctggcagtagaaaagtcgtaattgctacgaacatcgcagaaacttcattaacaatcgatggaatatattacgtagtagatccaggattcgtcaagcaaaaagtttataattctaagactggaatggattcattagtagttacaccaatttcgcaggcacaagcgaaacaacgagcaggccgagctggcagaaccggtcctggcaaatgttacagactttacacggagagagcttatagagacgaaatgcttccgacaccggtgcccgaaatccagcgaactaatttggcaacaaccgtacttcaactgaaaactatgggcataaatgatttgttgcattttgattttatggatgcccctccggtcgaatcccttataatggctctcgagcagttgcattctctatctgccttagacgatgaaggtttattaactagactaggaagaagaatggctgaatttccactggagccgaatttgtgcaagatgttgatcatgtcggtagctcttcaatgctccgatgaaatattgactatagtgagcatgttatctgttcaaaacgtgttttaccgtccgaaagataagcaagcattggctgaccagaagaaggcgaagttcaatcaacctgaaggcgatcatttgacgcttttggcggtctacaacagttggaagaacaataagttttcgaatgcgtggtgttatgaaaatttcgtgcagatcaggaccttaaaaagagcgcaagacgtgagaaaacagttgttgggtatcatggacaggcacaaattggacgtcgtgtcggcggaaaggaacacggtgagagtgcaaaaggccatttgttccgggtttttcaggaatgcggggaaaaaggatccgcaagaaggctacaggactttggtcgatagtcaggttgtgtatattcacccttccagcgctttgtttaatcggcaacccgaatgggtaatctatcacgaattggttcaaactacgaaggaatacatgagagaagtcacaacgatagatccgaaatggctggtggagtttgcgcctgcatttttcaagttttctgatcctacgaagttgagcaaattcaagaaaaatcaaagattggaacctttgtataacaaatatgaagaacccaatgcgtggagaatttctagagttaggagaagacgaaattaa

SEQ ID NO: 502 - DNA, 1248 bp, Phyllotreta armoraciae
atggccacaaaaaggaaaaacaaaaaaaacatactggcaaaagtgaattttcctttatacaccgtccagatgttaacgtcaaggcatgttatcgtaggaggcggcggtggaacttcgaagactggggttgaaaacggtttcgaaatatacgaaatctttcatgacggtcacaaattctcagccaaagaagttacaagacacgaaactggaggaaacgtagtcatgaattgttgtgtgtttagtgataggaaaaattcatttttagtagctggtcaagaaaactactctcaactttataaagtcaatacgaaattaatcgagcatgaacaagtagaaacagttggagacactgcaagcgttcggcacagaaataccaagtccaaagaacacgtagataataataaaaacattaaaaaggagctggtttttgacctgaatcctttagatagcatacaaaccgattttaagggttctgaacccctatgtagagtagttagaattaatcactcgggaaagatattagctactggaggaactgacggcgatgtaagactttggaaattccctatgatgcagcccttgtccattctaaaaggacatacaaaggaaatagacgatatagatttcagtaaatttgataacctcatcataactttggcaaaagacggtttggctattttgtgggacgcccaaacgggaaaattgaaatcaaaattgacatggaaaactccagagggatcgaaatatttgtacaagaggtgcagatttggcgttatcgaagaccaaaaaaataagtgcatgctgtacatgatagcgaatgcgactaattcgaagcaaacatcgtttcttcaacaatggatacctgaggagaatactttaaaaaagttctcggaattcaatgaaaccctatcggcacttgcggtgagagacgatggacgatttgtagctgtcgggacaatgttcagcggctctgtttccattcacattgcatttagtttacagaaaatattagtagttgtgggcgctcactcgatgtttgtaactggcctagaattcctatctcatgaaaataccaatcattccataagtagtgttgcggagactgctgtattgtctatttcggtggataatcagctttgtatacattcagtgccatacagacgaagtatacctttatggattggaataatggtgttagttttagtattatttattacatttatgttatgtgcattcatgggtttgtga

SEQ ID NO: 503 - DNA, 1242 bp, Phyllotreta armoraciae
atggctggtgcaatgttattcgaaagagctcagtccgtaccttcccaacacgacaagttgttaaaattaaatccaacagacgaagatgacgaagagaatatcgttaacaaagagcaagacatcctcaacttgggcgagaagtacaagaaggagggcaaggctaaagaactagcggagctgataaaggctaccagaccatttctgagtcttattagcaaagcaaaagcagcaaaattagttagatcactggttgattactttttggacttggaagcaggcatcggtatcgaggtacaactgtgtaaagaatgtatagaatgggcgaaagaggagagaagaacgtttttgcgccaatcgctggaagcgcgcctcatcgctctgtatttcgacaccggcatgtacaccgatgccctacaactggaatccaccttgttaaaagagctaaagaaactggacgacaaaaatctgctggtcgaagtgcagctacttgaaagcaaaacatatcacgctctaagcaatttacccaaagcacgagccgctctaacatccgctagaacgaccgcgaacgctatctattgccctccgaagatgcaggccgccctagacctgcagtcaggcgtgctacacgcagccgacgaaaaggatttcaagactgcttactcctacttttacgaagccttcgaaggtttcgacagcgtcgagtctcccaaagctctaactgctctcaagtacatgcttctgtccaaaattatgattaatagtcctgaagatgtacagcaaattgttagtggaaaattagccataaagtatgccggtaaagatattgatgccatgaaagcagtcgcacaagcagcccacaaaagatctcttgcagattttcaacttgccgtaaaacaattcaaacatgagctggaagatgacgttatcgtaagagcacatttaggaaccctctacgacaatatgttagaacaaaacttatgcaggatcattgaaccttactcacgtgtccaagtagaatatatagccaagacgattaagcttcctgtgttacaagtagagaagaaactatcgcagatgattttagatgccaagtttcatggaattttagaccagggtgatggtgtcctgatagtgtttgaagaaacgccggtagacaaaacctacgaaatggctctagaaaccatccagagtatgagtaaagtagtagacactctctatcaaaaagcgaaaaagttgtcatag

SEQ ID NO: 504 - DNA, 1737 bp, Phyllotreta armoraciae
atggcttcgcggtcgaaaaaaagctcaacgccgtcggcccaacagcggccggctagcccgctaagcccgacgaggcattccaggttgcaggagaaagcggaactccaaggtctgaacgaccgcttggccggttacatagataaagtgagatttttggaagccgaaaacaacaaactatccagagaaatccagacgacccaggaaactgttacgcgcgaagtctccaacatcaagtctatgtacgatcatgaattaggggatgctaggaaactgctggacgacacgcaccgcgagaaagcccgcctggaaatcgacgtgaaacgtctcatagaagagaacgaggagctcaaagccgagctggccaaaaagagcaaggatctggtagtagccgagaaccatgccaggatatacgaatccaggtgtaacgagtaccagctcaagtccaaccaagcgactgcagatgctaaaaaggccatcgctgacgccaaggagttggaaaaggaaagggacaagctgaagaagcttctcgatgctgctcgtaaacaactggaagaggaatccctggccagagtcgaggtcgagaatcacaatcagagcttaagggaagagctaaccttcaaagatcagatccatcaacaagaactcacagagactcgcactcgccggcaagtcgagatcagcgaaatcgacggccgtctggcgcaaaaatacgaggccaagcttcaagaggccctccaagagctgcgcgaccagtacgaatcgcaaatggccaacaatcgaggggagatcgaattgctctacgagcagaaaatcaaaaacctccaagccgccgccgacaggcatcaatcgaccgcctccggcgctctcgacgaactgagacaggttcgaacgaggatcgacagcttctcgtcgaagatcgacgacctggagaaccagaaccgcggtctagcagccagagctagagatttggagaaattgctcgagaacgagcgcattcgtcacgccgaagatctggcgttggtcgagagggaattgcacaggctgcgagaggaaatggcccaacaacttcaggaataccaggacctcatggatatcaaagtatcgctcgatttggaaatcgcagcttaccgtaaacttctcgaagcagaagaagctcgattgaacatcacaccgacaggcatggaacacgaggtgcaccataggagttcttctcaacgtcggacgccggtgagaatgggggccaaaaggaaacgagccctgctcgaggagactcaggagtcgagcttgtcggattacagcgtgaacagttcatctaaaggggacatcgaagtggccacagtcgatccggacggtcagtttgtgagattgcacaacaaaagtaaccaagaggtgccgctcagcggatggcaagtcataaggcgggcgggtgatgaggagactttctacaaattccacaggactgttaaagtagaaggaaatggtacagtaaccatttggagttcggatttaaataaagatcacgaaccccctagtaacctggttatgaaaggccaaaaatgggttactggagacaacatgattacgatagtattgaacaacaatggagaagaagtagcgtcatctgaaagggtaagaaggcagatttcaacgtcgcatttaagacacagggaattgggggatgaagaactttatcaccagcagggggacctgcaaggtgaaaagtgcggactgatgtga

SEQ ID NO: 505 - DNA, 2079 bp, Phyllotreta armoraciae
atggacgaactgcagctcttcagaggagacactgttctacttaagggcaagcgtcgaaaagaaaccgtctgcatagttctgtccgacgatagttgtagtgacgaaaagatccgcatgaaccgaaacgttcggaataacttaagagtcaggttgtctgacgtcgtttctattcagccctgccctgatgttaagtatggtaaaagaatccacgttcttcccattgatgacacagtagaaggacttacaggaaatctgtttgaagtgtatctgaaaccgtatttcctggaagcttatcggcccatacacaaggacgacgtgtttatcgtaagaggcggcatgagagccgtagaatttaaggtagtggaaactgatccggctccttactgcatagtcgcgcccgatacggtcatccattgcgacggggatccgatcaaacgcgaagaagaagaggaggctcttaacgctgtcggctacgatgacatcggaggttgcagaaaacagctggcccagatcaaagaaatggtcgagttgccgttaagacatccgagtctcttcaaggctatcggtgttaagccgcctcgaggtattcttttgtacggtccaccgggtactggaaaaactctgatagccagagccgttgccaacgaaaccggagcgttcttctttttgattaacgggccggaaatcatgagcaaacttgccggtgaatcggagagcaacctgcgcaaagctttcgaagaagccgacaagaactccccggctatcatcttcatcgatgagttggatgctatcgctccgaaaagagagaaaacgcacggagaggtggagcgtcgtatcgtttcgcaattgcttactctgatggacggcatgaagaagagctcgcacgtcatcgttatggcagctacgaacaggccgaactccatcgatcccgctctacgtcgattcggaagattcgacagggaaatcgacatcggcattccggacgctaccggcagattggaagtgctgagaatccacactaagaacatgaagttggccgacgacgtcgatttggagcaaattgcggccgagactcacggtcacgtgggcgccgatttggcctcgctttgttcagaagcggcgctgcaacagatcagagaaaagatggacctaatcgatctcgaagacgatcaaatagatgcggaggttctcaattcgttggccgtgaccatggagaacttccgttacgctatgacgaagagcagtccgagcgctctgcgcgaaacggtggtagaagtaccgaacgtcacgtgggaggatatcggcggtttggctaacgtcaagaaggagttgcaggagttggtgcaatatccggtcgagcatcctgataagttcctcaagtttggaatgcagccgtccaggggagtgctgttttacgggccgcccggttgcggtaagaccctattggcaaaggccatcgctaacgaatgtcaggccaacttcatatcggtcaaaggaccggaattgttaacgatgtggttcggtgaatctgaagctaatgttagggacattttcgataaggccagatcagcagctccttgtgtacttttcttcgatgagttagattcaatcgctaagtcgagaggcggaaatgtaggagatgccggcggtgccgccgatagggtgattaatcaaattttaactgaaatggatggtatgggagcgaaaaagaacgttttcatcattggtgctacaaatagaccagatatcattgatcccgctatattacgtcccggtcgtttggatcagttgatctacatcccattgccagacgaaaagtctagagaagcaatctttaaagccaacttaaggaaatcacctgtagctaaagacgtagatcttacttatattgccaaagttacacacggcttttcgggtgccgatttaacagaaatatgtcagagagcttgcaaactcgctataaggcaaagcatcgaaacggagattagacgagaacgggagagagcattgaatcccaacgtagcaatggacgtaagtatttgtttgcatttattaaaatcctgtcttaaaaaaatataa

SEQ ID NO: 506 - DNA, 825 bp, Phyllotreta armoraciae
atgagtgaccaatttgactgtgcactcgatttaatgaggcgcttgcctccgcagcaaatcgaaaaaaatttgagcgatttaattgatttagtgccaagtctttgcgaggatcttctttcgtctgtagatcaaccattaaaaatcgctaaggacaaggattcgggcaaggattttctattatgtgattacaatagggacggggattcttacaggtcaccatggtcgaatacctattaccctccattagaagacggctcgatgccctccgagaggctaagaaaattagaattagacgccaatttagcgttcgatcaatatagagaaatgtatttcgaaggtggcgtatcttctgtttatttttgggacttagatcacggtttcgcaggagtaattttaattaaaaaaactggagatggtagtagaaaaattaaaggttgttgggattccctgcacgtagtggaggtgcaagagaagagttctggaaggaattcccactacaaaatgacctccaccgctatgctgtggctgcaaaccaataaacaaggctcgggaaccatgaatttgggcggtagcttaacccggcagatcgagcacgatgcagcagtaaatgacatcaaccctcacatcgcgaacatcggtcgaatggtggaagacatggaaaacaaaattcggaacactttaaacgaaatctactttagcaaaaccaaggacatagtcaatagcttgagatcggtgcaacccttaacggagagccgtcaacagcaagcgcttaaacaagacttggccgccgcccttcagcgtagacaaaataaatccgagaactga

SEQ ID NO: 507 - DNA, 3813 bp, Phyllotreta armoraciae
atggaacgtccaccccgcaatgaaccgcccgtggagcctgtcaacggagtggtgcaaccgccggtgcatccgccgcctgacagtccgggacgcgtaacgaaccaactgcaattcctgcagaaaaccgtactaaaggctgtatggaaggacaaattcgcctggccctttcaacaacccgtcgacgctaagaaactcaacctgcccgactatcatagaataatcaaacagccgatggacctgggaacgataaagaagcgtttagagaacaactactattggtcgggtaaagagtgcattcaagatttcaacacgatgttcaccaattgctacgtgtacaaccagcccggcgaggacgtagtcgtcatggcccaaacattagaaaaagtatttttaaccaaagtggccgacatgcctaaacaagaatttgtcgttgaaattccaatgaaaggcaagaaagggcgagttagcgtcggcggtgggagcaccccatcttccagcggaccggtgccggcagctgtacccggaggtgtcagaggcaggccgcccgcgaccgtttcttccaccagtaccacaccaattgccaccactactggttcgtccggtctaccgttgggcacacaagcgcctgcgacgttgccgggaagcactgccacgacgacgatagcgccggccaacaacaacaacagctctctgacgccgcagcagctcggcacgcccgtcagctcgatgcacggaacccccggagcgcctctatccaattccctcgatcccacaggagtgttgcccggaaacgtcatgccgccggcgcaaccagccaaggtaaaaaaaggcgtgaagagaaaggccgacacaacgacgccggcgacggcctacgattatccgacggtattagaatcgaaatcggcgaagatttcgactcgcagagaatcgggcaggcagataaagaaaccggcgcggcgggaaatcgaccttcatgtacctcaaccggcgatccacaaacccaacgataagttgacggaatcgcttaaagcttgcaatgaaattcttatggaattgttctccaagaaacattcgaattacgcatggcctttctatcaaccggtcgatgcagaactattgggtctgcacgactaccacgacatcataaagcgaccgatggactttggcacggtcaaagagaaaatggacaacagagagtaccgcaccccgcaggactttgccgccgacgttagactgatttttagtaattgttacaagtacaatccctctgaccacgatgtggtcgccatggcgcggaagctgcaggacgtgttcgaagtcaaatttgcgaagatccccgatgaaccagtaaaccggataggaggaggtgtaaataatttgcccattaagtcggaatcgagtagttccggttcgagttcagattcgtccagcgagtccgaggattcggaggaggaaaggcgtaataaacaattaaaagtactggaaaaagagctgacggcgttgcaagagaagatgcgcaagctggtcgaagaaagttcgcgccggaaaaaggagaaaaagaaaaacaaaatgaaaaagaaaccgagcggggcgctgccggcgggcgctctgccgaacagcagcagcggtctcggtttgcgcggcaacaaacccgccgccgcttcgaacgccgcccccaaacgggtgaaggctaacaacaagaccggagccggcaggaagaagaacgccgcccaaccgcccccgatgcccttcgattcagaggacgaggacaacgccaaaccgatgtcctacgacgagaaacgacaactttcattagatattaacaaattacccggcgacaaattgggtcgagttgtacatataatccaatcgagggagccgtcgttgagggattcgaatcccgatgagatcgagatcgatttcgagacgttgaaaccgtcgacgttgcgggaattggagagttacgtcgcgtcgtgtctgcgtaaaaagccacataaaaaagtagccggcaaatctaaagacgaacaaatggcggagaaaaagcaggagctagaaaaaagactaatcgatgtaaacgataaaatcggcaattccaaaaaagcacctaaaaaagatgaagggaacaaggtggacccgacgggcgcgggcggtccctccggtcgcctctcctccagctcgagcagctcggattcggacagcagcagtagcagcctgtcgtcgagttcgagcgattccagcgacagcgaagcaggtggtacgaccaacagatctactaaaaagaaagtgaacaaaaagagcccaaacccttcagtcgataatactacaataacgaaaccacagcaaccaacaacagcaccaccaatgtcacaaacacccgccaacgcatcggtcaatgctaatctaaacgtatcggtatcggctaattcaaacgcaccgccacaatcagtacctgcgacgacgacggccacgccgaccgtcaacaataacttcccccagtcgcagcaacagcagcccgtgcagcaggcgcagcagatggctcccaacaagcaacagcacaatttaaacgttaacgtgtcgtctgcgcagcaacagctcgtgccgccgttgaacataaaacccacggggatagataaattgtcggccgtgaacccggtgacgccggccagcgtaccgcaagcgccgaaatccgtcgcgctgccgacgccctcgcccgacaaacctaaacccaacgtgatcgcgcacatggaaacctacaccgatcccatcgaacagagcctcgccaatttggaacaggacaccatcaccgtacaacaattgaccaatcccatcccatcccatccgcacatgaacctcaatcctaacttgaaccatcccgttttgcagccaggttctttaaacatggacctgaaggcgccggtgacgatgtccgcggcgatgctccaccacggcgtgccgatgtcgatggacgtcggcgacataccggccctgatgcagacgcaggcgagcctgatgcacgcccagaacaacggtttcggcatcaaacacgaattcgatttgacggcgaacaacaacggcatcacgtcgatgggcctgcccatggagatgtcgatatcgtcgatgttcgatcagctgccgcagcacctgcacggccagctgatcaagcccgatcccggccaggaccggctcgacgggctgatcaacgacagaaaaccgccgcagggcgttgttatcggcgccggccccccggccgcctccaagccgcagccgcagggccagtcgttcgggtacaagcaggagaagtcggagcacaacgtgaagaacgccagctcgtggtcgagcctcgccaaggggaagagtccgcagaacaacacgcccggcggcagtagcaagcaacaggtgatggacagctttaaagcgttccagaacaaggcgaaggagaaggcggatagggagaagcagcgattggagaacctcgaaatgaagcggcagcagcgcgagcaggccgaacgcgagcggttgcgcgccgagcacgagaggaggcgagaaaaagaagaggaagatgccttggagaaggccaggaaagcagtagcggaacaacagcccataacgaatcagagggtggaagagctgcgatcgtcgcccggtgagggcagcacgtcgccgggatctttgagttcgggctccgaaaggatatcggaaagggaaaggcaacgattgcaggagcaggaaagacgaagacgagaagtgatggagaacaagatagatatgaatatgcaaagtgatttaatggccgctttcgaaggttcgttatga

SEQ ID NO: 508 - DNA, 1224 bp, Phyllotreta armoraciae
atgtctttatccacagctcgtcctttagtgagcgtatacaatcagaaatcggaagaagtaaaaggcagcggcgtagctctgcacgctgtcttcaaggccccaatcagaccagatgtcgtcaatttcgttcatcagcaggtctcaatgaaccatcgccagccctacagcgtcagcgacaaagctggtcaccaaacctccgcggagtcctggggaacaggtcgtgccgtagcccgtatacctcgtgtacgcggtggcggtacccaccgatcgggtcagggagccttcggtaacatgtgtcgcgggggtcgcatgttcgcgcccaccaagccgtggcgccgttggcacagacgcgtcaacatcaaccagcgtcgctacgccctggcgtcggccgtcgccgccagcggcgtgcccgctttggtcatgagcaaggggcacgtggtcgatcagatacccgagttgccgttggtcgtcagcgataaggtgcaggagatgcacaagaccaaggaggccgtgcagtttttgagaaggatcaaagcatgggctgacatccagaaggtttacaagagccaacggttgcgtgccggtaaaggaaaaatgcgtaacaggagacgtatccaacgtaaaggaccactcatcgtttactacaaagatcaaggtcttcgtcaagctttccgtaacatccctggcattgacctcattagtgtccaaaagttgaacttgctaaaactggctcctggtggtcacgtaggtcgatttgtcatctggaccgaatcggcattccaacgtttagacaaattattcggtacatggaagaacccatcgaccgaaaagaagggttacaatttaccccaacccaagatgtccaacaccgatttgtctaggttgttgaaagctgacgagattaaagctgttcttagggctcctcaaaagaaggtggtacgtcgtgttcgtcgtctcaatcctttgaccaacactaaggctatgcttaagttgaacccgtatgctgctgtactcaagagagaagctatcttgaagaaccaaaaaaggcaattgcaaagggacgaagctttggctaagaaacgaggaatcaccctgactcctgacaacgctgtaatcaggaccaggaaattgcaggaaagacgaagagctcaaattttgaaagataagaagtcgaaacccaagaaggccgttaaagcgccggccaagcctgctggaaagaaataa

SEQ ID NO: 509 - DNA, 5394 bp, Phyllotreta armoraciae
atggcagattatcttaattcagaagctgaggaatctagcgaggaggaagaattagaccatagggatcgaaagaaggcacaaaaagcaaaactagtagatagttctgacgaggaagaggaagaagatgatgaagagaaaattagagaagaattaaaagatcttatcgacgataatccgattgaagaaagtgatgctgaatccgatacttcaggtcgtgaaaaaagaaaaaaatcagacgatgaagacctcgatgatcgattggaagacgaagattacgatctgttggaagaaaatttgggtcataaagtagaaagaaggaaattcaaacgtttgcgtcggttcgatgatgaagaaagcgaaggagaagaagaacatgatcccgagcaagatcgtgaacaaatcgccatggacatattttccgacgatgaaaaagacgatcgtcagaaaaaggatgaagaacgaaggtcagaacgaagtcaaagaccggtcgttgagcaagaatctttcggagtgggcgaagaggaagaagaaggcgattattcagatgctgatgattttattgtagacgatgatggtagacctttaatcgagaaaaagaggaagaagaaaccgattttcactgacgccgcgctgcaagaggcccaagaaacattcggcgttgatttcgactacgacgagttcaccaaatatgaccaagacgagtatgaagacgaggaggatgaagaagaagacgaatacgaagaagatgacaacgaacgaagaaaacatccgaagaaagcggcgcggaagaagttgaccaaaaagtccatttttgaagtgtatgagccgagcgaattgaaaaggggtttcttcaccgatctcgataatgaggttcgtaacaccgatatacccgaacggatgcaacttcgcgacgttcccattactcccgtaacggacgattcgaccgagctggaagacgaagcagagtggatttacagacaagctttttgcaacaaggcaatatccaatgttgatgcccacctttcagccgaggcaagagagaaaatgaagaagggctctcaaactgtagggaaaataaagaaagcattagatttcatgaggaatcaacaactcgaggtgccctttattgctttttacagaaaggagtacgttcaacctgaactaaatattaacgatttatggaaagtttataaatacgatgctaagtggtgtcaactaaagtctcgaaaggaaaatctccttaaactcttcgacaaaatgaggtattatcaactagatcaactcgtaaaaaatccggacgctcctattccggacaacgtgcgagtaatgaaagattcggatatcgaaagactaaaaaacgtccaaactgcagaagaactcaatgacgttcacaatcatttcatattgtattattccggagacttacctgccatgcatgccgcttggagaatcaaagaaagagagcagaggaaatacgagaaacgtcaaaaaagactcagacaaattgccgaagcggaagaaggtgctgagattcccgatgaaccagaagacgacgatgatgatgaaccagaaacggaaactttgaagtacgctaatcggtcgggcagttacgcattatgttcgaaagctggattagatcctttggcaaagaagtttggtttatcacccgagcagtttgctgaaaatttaagagataattatcaaagacatgaagtcgatcaagagcctgtcgaaccctccgacgttgccagagagtttatttctcctaaattttcaactgtcgatgaagtattacaagcgtctaaatatatggtcgccttgcaaatagctagagaaccattagtaagaaaatgcgttagggaagtatattttgaaagagccaggattaatgtatatccgacaaagaaaggacaaaaagtcatcgatgagtctcacaattgttacagtatgaagtatttaaaaaacaagccggtgagagatttaaacggagatcagtttttaaagttgtgcttagccgaagaagaaaaccttcttactattacaattaacgataacatcgaagggaatacatcaaactcttacatagaggaagttaaacagctctacatcaaggacgaatttagtaaaaatgtacaagattggaacgcgctgaggatggagtgcgtagaaagggcgctaaccaaaagcgttttgcccgatttgagaacagaattgaagaggaccttgttatccgaagccaaagaattcgtccttaaggcgtgttgcaggaaactctacaacagcattaaaattgctccatactcgattacatttcccgatgaagacgaacatgaatgggatacatctaaaggtgtcagagttatgggtttagcttacgtgccggaatattcagtttcagcatttgcttgtatagcagctcctgatggagatatcactgattatttgcgtttacctcacatattaaaacgaaaaaacagtttcagaacagaagaaaaattaatgaaggaaggagatttgcaagccttgaagaactttatctttttgaaaaaaccacacgtgattgcaatcggcggagaatccagagaagctctcatgatagcggacgatttaaaagctctaattaacgaattggttgaatccgatcaatttcccgaaatcaaagtcgaaattatcgacaacgaattagccaaaatttacgcaaactccaacaaaggccagtcggacttcagagactatcccgagctgttgagacaggccatttccttggccaggaaaatgcaagatcctctcatcgagtattcgcagttgtgtaacggagacgaagaaatattgagtttaagattccatccactacaagaacaaatagcgaaagaagaactcatcgaagctctgtgcctcgaattcgtcaacagaactaacgaagtcggtgtcgatattaatttggccgtacagcaggcgcacaaaagcagtctcgttcaattcgtttgcgggctcggccctcgcaaagggcaagccctgctgaaagtccttaagcagaccaatcaaaggctagaaaatagaacgcagttggttactgcttgtcacatgggcccaaaagtgttcattaattgttccggtttcatcaaaatcgatactaatagtttgggagatagtactgaagcgtatgtggaaatattggatggttctcgtgttcatccggagacgtacgaatgggctaggaagatggctgtagacgctttggaatacgacgatgacgagagcgctaatccggcaggtgctttggaagaaatcttggaaactcccgaaagattaaaagatctggatttggatgctttcgccgaagaattggagagacaaggattcggcaacaagagcatcactttgtatgacataagagccgaattgaactgtagatacaaagatttgaggcaaccttttcattcggcaaatcctgaagaattgtttgatatgctaacgaaagaaacgccggaaacattctatataggaaaattggttactgcttcggttataggtattgcaagaaaaaaacctaaacctgaccaactcgatcaggccaatcccgtcagaaatgatgaaacgggtctttggcaatgtccgttttgtttgaaaaacgattttccggaattatctgatgtctggaatcatttcgatgctggtgcatgtcctggccaagcaaccggagtcaaacttagattagataatggaataatgggttacatttatataaagaatattagtgataaaccggtatcgaatccggaagaaagagtaggagttggtcaattaattagttgtcgtataataaaaatcgacgttgaaagattcagcgttgattgtacgtcgaaatctagcgatttgttggataaaaatcacgaatggagaccaccaagagatccccattacgatacagaacgcgaagaaaaagacaacagaactgaggcggaaaagaaaaaagaaaaacaacgcttgacatacataaagagagtaatagttcacccggcttttcacaatatttcttacgccgaagctgaaaaatgcatggtcaacatggatcaaggcgaagtcatcatcagaccgtccagcaaaggagccgatcatttgacgataacatggaaagtcgccgataacatttatcaacacattgatattagagaagaaggaaaaactaacgctttttctttgggtaaatcgttgttgataggcaacgaagagtttgaagatttagatgaaataatagcgagacatgtcactccgatggcggcgcacgctcgcgatttgctctacttcagatattacaaagacttcgagggcggtcacaaagacaaggccgaagagtatctaaaagacgagaaaaagaagaacgcctcgaaaatacattacgtcgttagcgcagcaaagcacatacctggcaaattcttactttcgtatttaccgagaaacaaagttagacacgaatacgtaacggtgactcctgaaggatttagattcagacagcaaatgttcgattcgataacgtcgctgttcaagtggttcaaggagcactttagagagccaccgccgggcggaatgacacccggaactccaagaatgtccactggaagaacaccttatgatatgagtactgaagctattcaaagagttgcacaaaatcttccaagcgatatggtccaagctttatctgctgcaacgaaccagactcctcactatccacacactcctggcggttacggtggtaattacatcaatacaccgtacacccctagcggtcaaacgccctacatgactccattccaaacgcctcacgctcaacaaactccgcgatacggccaacagacgccgtctcagccgtctctgagcaacccgttcctccatcccggcgccgtgactccgtcgcaacgaacccccagctacaggaacctatcgactcaaagtccgatgataccgcaaagtccggtgccgagtcctggatcgcagagttcgtacagcagccacatgagccaccacacgagggcgagttacggggattcgatgagattccaaccgccggaatcgccgaggggttacccgagcagcaggggctcatatcctgatggaaggtacgggggtagcgaatcgatggattggcagaaggccgctgaagcttgggcttcgaggtccaaatcaacaccacggagcgaaggtcgcgggactcccagatcgtctggtcacagaactcctcgtaactacgataatctatctgaaagcgatcgatctaggatgaagcatatgagcagtaagagcccaaaatcggtacggtcgactccccgtaccaattcttcgcctagatctatgtcattgggcgacgcaactcctttgtacgacgaaaatatttaa

SEQ ID NO: 510 - DNA, 2583 bp, Phyllotreta armoraciae
atgccagaagtggacaacagcgaagcgcgctctcctcggcgtaaacgccgcaggtccaaatccggcgatcgcaaggaagagaaatcgtccaaaaggaagtcatcgaggaaacgttcgtcggacgacgattacaatgagcgagattatccacgctattacggcgaagatcggccgaacagcgacagctactggaacaaatatcccaggagagacaacatgaaagtcggtcgaaggtattacgatcaccctgagcacgagaagaatagggatagggatgtctcgaacgagaggagcagagatagagatagagaaagtaccagagggaagaaagaggagaacgaggataaatccgttattaaacccagagaacgtaaagtcgtcgatatgctaacttccagaacaggaggagcctacataccaccagcaaagctccgtctgatgcaagagagtataacagacaaatcttcagctgcttaccaacgtatcgcctgggaggcccttaaaaaatccgtgcatggttacatcaacaaaatcaacacatctaacatcggcataatcgccagggaaatcctgcacgaaaacatagtaagaggcaggggtctgctttgcaaatcaataatccaagcgcaagctgcctctccaactttcacaaacgtttacgctgccctagtggccgttatcaattccaaatttcccaatatcggagagttgttgttgaaaagactggtgctccagttcaaaaggggctacaagcagaacaacaagtctatttgcatttcggctactacattcgtggctcacttggtcaatcaaagggtggctcatgagattctggcgcttgaaattctgactctgctcgtcgaaactcctactgatgattccgtagaagtggctatttcttttctgaaagagtgtgggcagaagcttacggaagtctcgagtaaaggaataactgctatattcgagatgctgaggaatatcttgcatgaaggccagctcgagaaaagaatacagtacatgatcgaggtgatgttccaaattagaaaggacggttttaaagaccacgccgctgtaaccgaggaattagatttagtggaagaagaggatcaatttacccacctaatcatgctcgatgatgtaaaggaggcaaatgctgaagatattctaaatgtattcaagtttgacgaacattatgaagaaaacgaaggcaaatacaaaactctgagtaaagaaatcttgggaagcgatagcgaatcagatacgggatcggagggatctgaagaggattctgaaggcgaagacgaggatgaagaagttaaagatgccgggaaaatcatcgataatactgaaacaaatctaatagcccttagaaggacaatatatttgactatacaatctagtttggatttcgaggaatgtgctcataagcttttgaaaatggagttaaaacccggccaagaaatcgaattatgccatatgtttttagattgttgtgccgaacaaagaacatacgaaaaattctacggacttctagctcaaaggttttgccaaataaacaaaatatacatcgagccctttcagcaaatattcaaagacacctacgctactacccatcggttggacaccaatagattgaggaacgtcagcaaatttttcgctcacttgctcttcacggacgccataggctgggaggtgttcgagattatgaagctgaatgaagaagacactaacagctcgagcaggatttttattaaaatcttgtttcaagaattagcagagtacatgggcctaggaaagttgaataccagattgaaggatgaaacacttcagcagcattttgcagggctgtttcctagagacaatccgaaaaataccaggttttccattaatttcttcacgtccattggtttaggaggtctaacagacgaacttcgggagcatttaaaaaacgtccctaaaattatggaaactaaaacggcctctgtgaaggaagaaagtggcagtagcagtagtagcagcagcagctctagtagcagcagttcgagcgaagaagaaagcagtgatgatagttctggggattcgagttcagaggatgaaaaacaaaaggaaaaatcgaaaaagaagaaaaagaaacgcgattcggaaagcaaatcgtcaaaatcagattcaaaaagtaatcgtaaagctgaaaagcgtgatagcagtaagcacaagaaaaaggacaaggaagatcacaaagaaacccacaaaaataaagagaatagaagcgatacggacaagcacgtttcaagggagaagcaaaactcgaggcaagataaaagaaaagacgacggcgatagtaaagaaaaacacagaaaagatgatagagaggacagggagaggcaacggaggaacgaagaaaagggtgggaagaaaaaggactacgaatggatcaaaagtagacacgaggataacatacatcaattaaaaacttctaaaaaagtgtttgaaaaaccatcaaagcacagatcgagatcgagagacaaaattagtagtaaagaaaaggaccgaaggcatagaagtaaagaaaggcgaaaaagttaa

SEQ ID NO: 511 - DNA, 1788 bp, Phyllotreta armoraciae
atggcgttgaaaaaccaagtcggtcaaaaaataatgaacgaggtgataaaacacaaaccctccaagaagaacgggcctgcagttgcacaaccccataacgctgccggtgttgactggagaatcctggtggtcgatcaactggcaatgagaatggtatcggcttgctgtaaaatgcatgacatatctgccgagggtatcacattggtcgaagatataatgaagaagagagaaccgcttgctacaatggaagctgtgtatttgatcacgccttccgagaagtctgttcatgctctcatgaacgatttcgaatctccgagacccatgtatagaggagcacatgtatttttcactgaagcatgtccagacgaattatttaacaaattaagtaagagtcatgcagcaaaatatataaaaacgttaaaagaaatcaacatagcatttgttccaacagagtcacaggtattttctttagattccccagacactttccaatgtagttacgatccttcatttgctgccgcacgaaatgcgaatatggaaagaatggccgaacagattgcaacgttgtgtgccactttgggggaatacccgcacgtccgatataggagcgattgggaacgtaacgtggagttggcgcaattgattcagcagaaattggacgcttacaaagctgacgagccgactatgggagaagggccggagaaggccaggtcgcaactgctgatcttagaccgaggcttcgattgcgtttcaccgttgctgcatgaactgacgtttcaagctatggcctacgacttgcttccaatcgaaaatgacgtgtacaaatacgaagcttccgctggggtgcagaaggaggtcctcttggatgaaaacgacgagctgtgggtggaattgcgccatcaacacatcgccgtggtttctcaaagcgttaccaagaatttgaaaaagttcaccgattcaaagcgcatgacccagagtgataaacaatccatgaaggatttgtccactatgattaaaaagatgccgcagtatcagaaagaattgtcgaaatacgctactcacttacatctcgccgaagactgcatgaaggcctaccaagggtatatcgacaagttatgcaaagttgagcaggatttggcaatgggaactgacgccgaaggggagaaaattaaagatcacatgcgcaacatcgttccgattcttttagacaccaaaataacaaacgagtacgataagatgcgcatcatagccttgtacgctatgactaaaaatggaataaccgaggaaaatctttcaaaactaggacaacatgcatcaattaaagacaaacaaactatcgctaatctacagctcctgggagttaatgtcattaatgatggtggtcccagaaaaaagcagtacaccgtaccgcgcaaagagcgaattacggaacaaacttaccagatgtcgagatggactcctgttattaaagacatcatggaggattgcatcgaggacaaattggatcagaaacattttccctatctaagtggaagggcgcaaaccaccggataccacgcagcgccttccagtgctcgatatggacaatggcacaaagatagaggccagcaggcagtcaagaacgtcccgcgtttgctggtcttcgtcgttggaggcataagtttctcggaaattcgctgcgcgtacgaggtaacaaacgcccagaagaattgggaagtcataatcggatcgtcgcatattcttacaccagaaggtttcctcagtgatttagcgacgttagccggctag

SEQ ID NO: 512 - DNA, 2139 bp, Phyllotreta armoraciae
atgatgcaacaatatatgaaagaattagaacaagagcctttcgatgctgaagaatttgtagaacgtttagcctggagaactttagctgaatcaaaaagcgatggagaggagaatgaaattaatccggctcttcttcacgaatccttcgttcaagccataaaggaccttaatttattgcacgaaaggcaacagaaaaaatgcgaaaaattagaagttgccgttagagaagacgaagcgacgtttttccaagaagtttataatttattggaacagaataagcaagctatggagacatttcaagaactggatggaaaaattaatcatgtggcaactaaagttcttcacttaggagatcagttagacagtgttaatggtcctagatctagagttgtcgatgcgttaagcttaatgactcacttgagggaatttctatcaaacgaaccagtttcatccacaatatttaccaatgaaaaatacattgatgaagcagcagatgtaattcaaaagttgtatttaatatcgcaagatttgccacccaagtttgaatcgataaaaagaaaaatagaaagaaaatattcagatatcgagaaaacactgatagaagagtttgttggggctatggataatgagaatttaacaagaatgaaggagatagcattggtactgtctcaatttaaaggctactctcagtgcattgatgcatatatagatcacagccaagtgggttgtttatctagtaaagatgtcttctataactttttgaatttgtgtaaatacaaggatgaaataattagaaaagttttcaagaatccggagcaagtgatggcgaaattcgttttaaatatatatcaattgaaacttgtggaatatatagatcaaaaactaaattctaaattgggtacatacagttatttacaaacgttatatgagttgtattcaaagactaatcatctttcgaacgaattagccgtttttcatatgggcaatgacaaaaactttctcactaaactaacaacaaatatttttaataagtacattaatgattacatttctatggagctgaagtgtctcaaagacagatgttcaactaacttacaaaaatattacgactcaaaaaatcatcaaaagaaacagattcaatctgggggctttcaagatcttagaagagatttacaagcagtgataggtacaagggcaaatattaacatagcacaaatagaaaattatggcggtgaaactttcttatcagaggaattggctatcatgattcttcaggatactaaacaagcttttcaacgttgcttattgttatcaaaaggcagtgaaaaagcttctaatgccactcaaattttggatagacttattaatagtttgctaatagaacatgtagactatgcagttgaattgggtctacaagctgtacccgttgtcgaaggcgttaaaaatccccctgttttgtatttttttaatgtcgtccatcaaagcaataatataacccatctcgtcgagaaacagttcatggatttggtggtcccattagtagaaaatactccaaaatacagcgattgcgtccagaagaaaaaatttgttttggaggatatagaaagaaaaattaatacaggattggataggtgcttgagtgccatattaaattgggtgaagttgtatttacaatctgaacaaaagaaatcagattttaagccagagtctgatgattttgatacagtggcctcatcagcttgcaagaacgtacttaattatgttaatggcattattaaagaaattaaaacgaatttggatggcaataatgtaacagctattcttcaagaattagggattagattgcatagagttgtttacgagcacatgttgcagtatcaatacaacactgcaggtgcaatggtggcaatttgcgatctaaacgaatatagatcttgtactaaacaattaggtcctttagttgcggaactttttgatactttacatgctttatgcaaccttttactggttaaaccagaaaaccttcaacaagtgtgctctgaagattctttgggtaaattagacagagcaatccttcatagttttatacaattacgaagtgattttaaagttcaaaagcagactatgttgaaagtttag

SEQ ID NO: 513 - DNA, 813 bp, Phyllotreta armoraciae
atggatttccaaaaccgacccggtgggaaaacgggcggaggcggcgtcgcctcctggtcggaaaccaaccgagaccgcagagaacgactgcggcaactggccttagaaaccatcgatctgcagaaggacccctattttatgaaaaaccacctgggctcctacgaatgtaagctttgcctaacattacacaacaacgaaggaagttacttggcgcacacgcagggcaaaaagcaccaggccaatttggctcggagggcagccaaggaggccaaagatgccccctcgttgctccagcccgagaagcccagagtggagcccaagaaattcgtgaaaatcggtagacccggttatcgggtaactaaacagagggatcccgaaaccggccaacagagtttactcttccaaatcgattatccagaaataagcgacttggttttgcctcgacaccgtttcatgtctgcgtacgagcaaaaaatcgaaccgcccgaccgtaaatggcaatacttactcttcgcagccgaaccctacgaaaccatagcctttaaagtacccagcagagaagtcgaaaaaaccgatactaaattttggactcattggaacagagacaccaagcaattttttctgcaattcgctttcaagaacgagaacaaacgatccgttaactccgttgttcaaaggcattcgatcgtcggtggagttccaccgcctcccatgctgccggtaccgccgccgcccaggcctcctatgtttaatcccattccaccgccgccgccgatgatgagggccgttttacccgtacctccaccgaactaa

SEQ ID NO: 514 - DNA, 402 bp, Phyllotreta armoraciae
atgtctatcggcgtacctattaaagttctccacgaagccgaagggcatattataacctgcgaaaccataaccggcgaagtttacaggggtaaactcatagaagccgaggataatatgaattgccaaatgacccagataactgtaacgtacagagacggacgagtggcacaattagaaaacgtttacattagaggttccaaaataaggttcttgatattaccggatatgttgaagaatgctccgatgtttaaaaagcaaaccaaagctggcactgcaggtagagggaagtctgcaattctacgagctcaagctcggggaagaggccggggccaaccgcctgtgcgaggaggcagaggagcatggcagaatcagcaaaatgcccctgcgggtcgagcaaaataa

SEQ ID NO: 515 - DNA, 1329 bp, Phyllotreta armoraciae
atggctacaaatttgtcccgaacatcgctcctgagaatccttaacgcaaggggctattctgcctgtccgcatccactttccggcattccaaatgcagaagtaaaaagcaccgttctccccaacaaaaccgttatcgctgctgttgataacagcgcctctctcaccagagtttcaatcgtattcagggccggaagtcgtaacgaagacccagaaaatttaggtgtagctcacgttttgaggacggccgccggtctgagtacgagaaactgttcgcaattcgctattatccgcaacattcagcaagtcggagccaatttaacggccacatccgacagagaaactatctgttacacgttggaaggtacccccgaagctgtggaatgcgctataccattcttaaccgaagtagccacccaacaagaatttagaccttgggaagtttccgaattgtccagtagattgcagttggatatcgccactagaccattgcagttgagagctatcgatttgctgcacaacgctgcttttagaggacgcggcttgggtaattctttgtttattccgaaaactcaaattggcaaaatatcgtccgaaactctacaacattacgttagctcgaacttcttgagcggacgtatggcagtcgttggttcggggatcagccaaaaggaattgacgtcttttgctaattccttaaaagtagaaaacggcgaaggcaataacgccccttctccttacgtaggcggtgaattaagatcgaacaaaggtggtcaactggcctttattgctgtagcaggagagggcgctgctctcaaaaaccacaaggaagctttagcttttgctgtacttcaaggagcccttggaggaggcccccaagttaaatacggagtttctgataatggaatcttccgaaaggctcttggaaataaccctagcgttagttcagtagccataaatgccagttactccgataccggtctctttggacttcttctggctgttccgacgaattctgcgagaagtgctctagaaagcgctgttaaagtactcaagagtggatcggtatccgatgaagatgtcagcagaggtaaaaatcaattgaaagcatcgatcctcttcaacgctgaaagcggggcagatattgtaagaactattggacaagaagctgttttgacgcaaaaagttacaagtgctgatgcacttttggctgaagtagatgctgtttccaccagtgacgtcgcaaatgctcttaagaaagcaggcaagaaattatcgctcgcatctgttggaaacttagctggagtaccatttttagatgaactaaagtaa

SEQ ID NO: 516 - DNA, 330 bp, Phyllotreta armoraciae
tacaaccaacaactccatggctcaacctcatcaaactacctgttaccagtctctaacaggtcttcatcctctctctctaatcatcggacggctgaagagctggaatctcagaacgatgaagccatcgatgggctaagtgcaaaagttaaaatgctaaaggagattacagttgggattggaaatgaagtgaaagaatcgtctaagcttatcactggaatcaatgattctttttcagaagctagtgggatcttaagtgggacgtttagaaagatgaacaggatgtctaagaaacatactggtagatggtactactggctgctatttctggtt

SEQ ID NO: 517 - DNA, 1491 bp, Phyllotreta armoraciae
atgtctttcccatcgacgataaacgcaaaacaggccgcacacgaacacgttttggccgtgtccagagacttcgtatcccagccgaggctcacctacaaaacagtgtctggtgtcaacggaccgttggtaatcctcgaagatgtcaaatttccgaaattcaacgaaatcgtccagctcaaactggccgatggcagcttgcgatccggtcaagtattggaagtgagcggctcaaaagccgtagtacaagtgtttgaaggtacttcgggaatcgacgccaaaaacaccatgtgcgaatttaccggcgatattctcagaacgcccgtgtcagaagacatgttgggtagagtgtttaacggctcaggaaaacccatcgacaaagggcctccgattttggctgaggactacttggacatccaaggtcaaccgatcaatccttggtcgcgtatctacccggaggaaatgatccaaaccggtatctccgctatcgatgtgatgaactcgatcgctcgtggtcagaagattcccatcttctcggcggccggtctgcctcacaacgaaatcgccgcgcaaatttgtagacaagccggtcttgtcaaagtgcccggcaagtccgctttggacgatcacgaagacaacttcgccatcgtgttcgccgctatgggagtcaacatggaaactgctcgtttcttcaaacaagatttcgaagagaacggttcgatggagaacgtatgtctgttcttgaatttggccaacgatcctaccattgagagaatcatcacgcctcgtttggctctgaccgcagccgaatttttggcctatcaatgcgagaaacacgtgttggtcatattgactgacatgtcttcgtacgctgaagctttgcgtgaggtatcagccgccagggaagaagtgcccggtagacgtggtttcccaggttacatgtacaccgatttggctaccatttacgaaagagccggacgtgtggagggccgaaacggttccatcactcaaatccccatcttgactatgcccaacgacgatattactcacccgattcccgatttgaccggttacattaccgaaggacaaatctacgtcgatcgtcagctacacaacaggcaaatttacccgcccattaacgtcttaccgtcgttgtcgcgtctcatgaagtccgccattggcgagggaatgaccaggaaagatcactctgacgtttctaaccaattgtatgcttgctacgccattggtaaggacgttcaggcgatgaaggccgtggtgggagaggaggccctgacgcccgacgatttgctctatttggagttcctgaccaagttcgagaagaatttcatcacgcagggcagctacgagaaccgtacggtgttcgaatcgctggacattggctggcagttgttgcgtatcttccccaaggaaatgttgaaacgtatcccggccgccacgttggccgaattctacccgagggactcgcgtcattag

SEQ ID NO: 518 - DNA, 1515 bp, Phyllotreta armoraciae
atgaacgaaatacgcgaacgggaaagggcaggaatccgagtccccgacgaattacgagccatgttgctcgaattcacctgcagctatttgctcgaacagcccgaagacgtagtctcatacgcgcaggaatacttcactaaatttaaagaaagcaggggcactgcgttgatctatgaccaggacatgtacgatcaggaaacaatgggtatcaaaatgggtatcaaaaccgttttggctcgccagatattcgactccagaggcaacccgaccgtcgaagtcgacatcaccaccgatttggggctattccgagcagccgtaccatccggagccagtaccggtatctacgaagccctcgagctccgcgacaacatcaaaaccgaataccacggcaaaggcgtgagccaggccatcaaaaacatcaacaccatcatcgccccggagctgatcaaggccggcttcgaggagacacaacagaagaaaatcgacgagttcatgatcaagctggacggcaccgagaacaagtccaaattgggcgccaacgccatcctcggcgtttccttggccatttgcaaagccggagcggccaggaaaaacgtgccgttgtacaaacatatcgcagatttggccggtaacaaggatatcatcctaccagtacccgcttttaacgttatcaacggtggttcccacgctggaaacaaactggccatgcaagagttcatgattctccctactggcgccacaaccttcaccgaagccatgcgaatgggttccgaaatataccatcacctgaagaaggtaatccacgccaagttcggcttggacgcgacggccgtcggcgacgagggcggttttgccccgaacatcctcaacaacaaagaaggtctcgagctcatcaaagtggccatccaaaacgccggctacaccggcaaaatcgacatcggcatggacgtggccgcttcggaattcttcaaagaaggtaaatacgatttggacttcaagaaccccaacagcgacaaatcgaaatggatatcctccgacgaactagaagctttataccaggagttcatcaaagagtacccgatcgtttccatcgaagaccccttcgatcaggacgattgggccgcctggagcaagctcaccggcaacaccaaaatccaaatcgtaggcgacgatttgaccgtcaccaatcccaagcgcattcagacggccgtggagaagaaggcctgcaactgcctgttgctgaaggtcaaccagatcggtacggtcacggaatcgatcgaggcccatctgctggccaaggcgaacggttggggcaccatggtgtctcacaggtccggggagaccgaggacacgttcatcgccgatttggtcgtcggactgtccaccggacaaatcaagactggggccccgtgcaggtccgaacggttggccaagtacaatcagattcttcgtattgaggaggaattgggggccggtgccaagtacgccggaaaggcattccgtaaaccgcagtaa

SEQ ID NO: 519 - DNA, 2421 bp, Phyllotreta armoraciae
atgagttacatgcagactaaccaaaatagaccaatgtctcaaggttatcatcagggcggcaacgatctcccgatgcagtcgtccaaagaacagaccctgctatggcagcagaactcctatatgggagactcaggcatccagtcgggggctgccactcaagtgccatcgctctccggcaaagaagaggaagagatggacctcttcgatctggaccagccctaccaaggattcacgcaagagcaagtagacgaaatgaacaaccagttgaaccacaccagatctcaaagggtgagggcagctatgttccccgaaaccttggatgaagggatcgagattccttcgactcagttcgatccaaaccatcaaacggctgttcaacgtttggctgaacccagccagatgctcaaacacgctgtggttaatttgatcaattaccaagacgacgctgatttggcgacgagggccataccagaattgataaagctgctcaacgatgaagatcaagtagtggtatcgcaagccgctatgatggtgcaccagctctcgaagaaagaagcttctcgccacgccatcatgaacagcccgcaaatggtggccgctttggttcgagccatttcgaactccaacgatttggagacgaccaaaggtgctgtcggtacgttgcacaaattatcgcaccacaggcagggtttgctggccattttcaagagcggcgggatcccggcactcgtgaaattgctgagttctccggtcgaaagcgtactgttctacgctataaccacccttcacaacttgttgctccatcaggacgggtcgaaaatggcggttagattggccgggggattgcagaaaatggtggcgttgctccagagaaaccacgtcaaattcttggctattctcaccgactgtttgcaaatcttggcttacggcaatcaagagagcaagctcatcatactcgcctctcaaggccctatcgaattggtcagaataatgagatcgtacgattacgagaagcttttgtggactacatcgagagtattgaaagtgttgtcggtgtgttccagcaataaaccggctattgtagaagctggcggtatgcaagccctcgccatgcatttgggcaaccccagcactcggttggttcaaaactgcctttggaccctcagaaatctatcggacgcggctactaaagtcgacggattggagagtttgttgcaatcattagttcaagtgctgcaatcgtctgacgtgaacgtggtgacttgcgccgccggtatcctgtcgaatttaacgtgcaacaatcaacgcaacaaagtgacggtgtgccaagtgggcggcgtggacgccctggtgcgtaccatcgtcagcgcgggcgatcgcgaggagatcaccgagccggcggtgtgcgccctacgccaccttacatcgaggcacgtcgagtccgagatggcgcagaacgccgttcggctgaactacggcatacaagtgatcgtcaagctgttgaatccgccgtcgcgttggccgctggtgaaggcggtcatcggtttgattagaaacctggcgctgtgtccggccaatcacgctccgttgagagagcacggcgcaatccatcatttggtgcagctgctgatgagggccttccaagacactcaaagacaacggagtagcgtcgccagcggaggcagccagccgccgggaacgtacgcggacggggtgcgcatggaggagattgtagaaggaacggtgggagcgttgcatatattagcgagagaatcgcacaatcgggccatcattagacagcaaatggtgattccgatattcgtgcaattgctgttcaacgatatcgagaacatacagcgcgtcgccgccggtgttctttgcgaattggccgccgacaaagagggggccgaaatgatcgaaaacgagggcgccaccgctcctttgactgagttgttgcattcgagaaacgaaggtgttgctacgtacgcagccgcggttttgtttagaatgagcgaagacaaaccgcaggattataaaaagcgactatcgatggagttgactaattctttgtttagagaagaaaatctttggaatcccgacctaggcatgggtccggatttgcaggatattttaagtcccgaccaggcatacgacaacatgtatgctcagggtcccccgagtgttcacagtagtcacggcggccgaccttatcaacagcaagggtatgaccagatacccatagacatgcagggtttagagatcggttctcacggagggggcaacgggtccacttacagtgcaatagacgcgatggacgttaccagcggggaacccgatctcaatttcgataccattgatcaactccctacccctcctcaagataacaaccatgccgctgcttggtatgataccgatttataa

SEQ ID NO: 520 - DNA, 801 bp, Phyllotreta armoraciae
atggcccgaaacgcagagaaggcaatgacaacattggccagatggagggcggcccaattgggcgaaatcgacaagcacaaaaaacgccggccctatttggcgtccgaatgcaagagcctgtacgcctgcgagaaatggcgcatgcagataatcagggaaatagcgaaaaaagtggcccaaatccagaacgccgggctgggcgagttccggatacgcgatctgaacgacgaaatcaacaaactcctgcgcgagaaacgccactgggaggaccaaatcaaggagttaggaggcccagattaccagcgagtcggcccgaggatgctggatcacgaaggcaaagaagtacccggcaacaggggctacaagtacttcggagccgccaaggaactaccaggcgttcgagagctgttcgaacaggaaccgccgcctccgcctaggaagagccgggccgagctgatgaaggacatcgatgccgattactacggctacatggacgacgacgacgggatattaataccgctcgaagtcaaagctgaaaaaatcgccgttcaaaacgccgtatcggaatgggtgagcaacaaggaaaagaacctggactcgagcaaggtaatcgaagagagcatttacgcggtggaggactccgacgaagaggatgccgttcaacagttcgatggctcgcaacagcgattcgttgctcacgtacccgtaccgtcacaacaggacatcgaacaggctttgttgaggagaagaaagcaggagttgatggaaaagtatggcgtacaagacgaacaagatgtatga

SEQ ID NO: 521 - DNA, 645 bp, Phyllotreta armoraciae
atggctgcgaaagacatgcccacattcaaatgcgtcttagtcggagacggtggtaccggcaaaaccactttcgtcaaacgccacatgaccggcgagttcgagaaaaagtacgtagccaccctgggtgtcgaagtccatcccttagtgttcacgacaaaccgaggcaaaatctgctttaacgtgtgggacacggcgggccaggagaagttcgggggcctcagagacggttattacattcagggacagtgtgccattatcatgttcgatgtcacgtccagggttacatacaaaaacgttcccaactggcacagggatatcgtcagggtgtgcgaaaacataccgatcgtactatgtggaaacaaggtcgacatcaaggataggaaggttaaggctaaaagtatcgtgttccataggaagaagaaccttcagtattatgacatatctgccaagtcgaactacaacttcgagaagcccttcttgtggttggcgcgaaaacttattggcgatcccaacttagatttcgtcgctgaatcggcccttctccctccggaagttcaaatggatccccagtggcagaaacagctcgaaaacgatttgaaagaagcttcggagaccgctctgccagatgacgatgaagatttgtaa

SEQ ID NO: 522 - DNA, 2505 bp, Phyllotreta armoraciae
atgccgagaataatgataaagggtggtgtttggaggaacacagaggatgaaattcttaaggccgccgtgatgaaatacggcaaaaatcaatggtccagaatagcatctctgcttcacaggaagtctgcgaaacaatgtaaagcccggtggttcgaatggctagaccctagcattaaaaaaaccgaatggtccagggaagaagatgaaaagttgctgcatttagctaaactaatgcccactcaatggagaactattgcgcctataataggcaggaccgcagcccaatgtctagaaagatacgaatatttactggatcaagcgcaaaaaaaggaagaaggcgaggacgccgtggatgatccgaggaagttaaaacccggagaaattgatcccaatccagaaactaaaccggcaagacccgatcctaaagatatggacgaagacgaattagaaatgctttccgaagctagagccagactggccaatacccaaggcaaaaaagccaaacgtaaagctcgcgaaaagcaattggaggaagctcgccgtttggcagccttgcagaagcgacgagaactgagagcagccggtattgaagtcacttcgaggcgcaagaagaaacgcggtgtagattacaacgcggaaattccattcgaaaaacaaccagccatcggtttctacgacacttccaacgaagccctagacttgatggccccagatttttccaaaatgagacaacaacatctagacggtgaactcagaagcgaaagagaggagagagaacggaaaaaggacaagcaaaagttaaagcaacgcaaggaaaacgacattccgcaagccatgttgcaaaacgaagagcccgctaagaaacgatcgaaattggtattgccagaacctcagatatccgatcaagagatgcatcaagtggttaagttgggcaaagcgagcgaaactgcccgagaaatcgcaacagaaagcggagtcgaaaccaccgatactctcctcaatgattacatgttcacaccgcaagctgctgccacaccaagaactcccgcaccccaaaccgacaggatacttcaagaagctcagaatatgatggcccttacccacgtcgatacacctctcaaaggcggtttgaatacgcccctgcacaactcggacttcagcggggttctgccgcaatcgcaagccattaccactccaaatacagtactcgcaacgccgttcagatcttctagaagcgatgggggagccactcctggaagtacggccggattcatgactcccaaaagcggagccttgactccggttggtaaaaacgcgacgccttctgtcagagataaactgaatataaatgctgaagaaagtttagatgtggcaagtactccggccgaacatagaatgtatcaaatgtcgatgaaagaccagttgaagctgggactgagcagcttgccgcaacccaggaacgattatgagattgtcgtgcctgaaaacgaagcgcaggatgaacccgaagaagcccaatctcaattggttgaagatcaagcggatatcgatgctagaaaacaagaggaactgagagccaaagcggctcaagaattagcttcccgttcgcaagtcatccaaagagaattaccgaggcctcaggaggtgaatttgaccgtgctccgaccgcccaacgaaagctactccttgactgaccttcagcgtgccgaagagttgatcaaatgcgaaatggttaccatgttgcaatacgacaacctgaaaaaccctctgccggcgcaaagtaagagatcgaacatgtcgcaagctcagcaattagcctttctcgagcaacatccttacgattcgttcaaacaagaagatttagaagtggctaaaacgttgttgagaagcgaaatggacgtagtaaaaagcggtatgaaccacggagaattgccattggacgtgtacaatcaggtgtgggaagagtgcctgagccaagtgctgtatcttcctaatcagacgaggtacactcgcgcgcatttggcgagcaaaaaagatagattagaatccgcggagaagcgtctggaacagaatcgatcgcacatggctaaagaggcgaagcgcgccgccaagatggagaagaaattaaagatattaacgggcggttatcaatctagagcgcaggtgctgattaaacagttacaggatcaatatgagagcatcgatcaatcgactttggagttgaacacgttcaaattcctggctgagcaggaaaagaatgctctgccgatgagaatacagtctcttaccgaggatgttaatagacaaatggaaagagagaaggtacttcaaaagaaatacgccgattatcagggtcagattaaacagttacaagaggagtatttagttcagatgcaaaatgttccaaatgaagaatctattaagtatgacgaagtcacttcgaccacaaacgaagaaaatggtatggatacaacggaaaatgataaaattaccgctgaaaactaa

SEQ ID NO: 523 - DNA, 474 bp, Phyllotreta armoraciae
atgatgcaatttatgttattgttcagtaggcaaggaaagttgcgattgcaaaagtggtatgtggctcatccagataagctgaagaaaaaaattactagggaattaattactaccattcttgccagaaaaccaaaaatgtgcagtttcttagaatggagggatttgaaaatcgtttacaaaaggtatgctagcttgtatttttgctgcgcgatagaacagtgcgacaatgaactgttaactttggaaatcattcatcgttacgttgaacttttggataagtacttcggaagcgtatgcgaattggacataatttttaacttcgaaaaggcctatttcattctggacgagctgatgcttggtggcgaggtgcaggaaaccagtaagaagaatgttctaaaggcaatcgctgcacaggatctcctacaagaggaggaaacgccgcaaggattcttcgacgatcacggattgggctaa

SEQ ID NO: 524 - DNA, 1251 bp, Phyllotreta armoraciae
atgtatggattacaacgatattcgtttggttacactctcaaaaatgcggtgcgttattactcgagagaacccgctaagagatcgtcgtttctcagccgattgtacgacaatttcaaagacgaaatggccaaaaacaaagaaatgaaagagtcgctgaaaaaattccgcgaagaagcgcaaaaactagagcaaagcgatgccttgaaagctgcccggcaaaagttcgaaaccgtagagaaagaggccagcaaaagcggcgaagtcttcaaagagagtttaggttcaatcaaagaaagagtcaaaggcgtcatagacgaggccagtaaatcggatttagccaagaaagctggtaaattcaccgaagaagtgggaaaaactactcacaaaatcagcgaaaccgcacaagaaatcagcaagaccggagcgtttcaaagcatatcggaggccaccaaagcggttaaacaagaaatcgacaacaccagcatggaaggtcgagtgtacgtgagccctaaaaagctgcgaaaacgaaccgaaaccagcgcggtagtccaacaaaagtactacgaaccgaacacagacgcaaccggcgtagagctacacaaagactccaaattctacgagtcctggcaaaacttcaaaaacaacaacccgtacgtgcacaaagtcatggactggaaactcaaattcgacgaaagcgaaaaccccatcattcgagcctcccgagcgctcaccgagaaagtcggcgacataatgggaggcctctttcaaaaaaccgaactctccgaaaccctcacggaaatctgtaaaatcgaccccgctttcgatacgaaacgattcctgaaacagtgcgaaaccgacatcatcccgaacgtgctcgaagccatgacgagaggagacctcgaagtcctgaaggactggtgtcacgaaggacccttcaatttgttcgccgtgcccatcaaggaagcctacaagaaaggctacagaatcgagtcgaaaatcctggacgtagaccacgtggatttggtgatgggtaaagtgatggatcaagggcccgtgttgatcatttcttttacttcgcagcaagtcatggctgtgcgggacggttcgggggcggtggtcgaaggcgacccggacaaggttatgcgggttaattacgtgtgggtgttgtgcagggatgtggtcgagcccgatccgagggcggcttggagattgctcgatctatcggcgagcagtaacgaacagttagtgtaa

SEQ ID NO: 525 - DNA, 909 bp, Phyllotreta armoraciae
atgagtagcagtgattcggaattaagcgatagtgatgctgagttgcaacaagcgttgttagatggtaagctgaaacctggattaaataaaatcgaagaagcccctaaacaattcgtgaacaacataagcggcttaaatcagaaaatcgaagaattcaaattgaaactgccatggatcgaacggctggattgtacgaatgcccaagcccccttggcgcccgagttagcggcagaaatgttggttcacgaggaaaagaggagtaatcaactgagaaacaacaaaaaacttccccaatttcaacccgcccaagatcccgttctgaacgatttcaaacgagaactcatattccaccggcaagcacaagctacaattctagaggcaattccgaaaatcaaagaattagggatacttactaaaaggccagatgattattttgctgaaatggccaaatcggatgagcacatgcacaagatcagagagaacctgaagcaaaagcaggagcaacagaagcggattgaacgggtgaagcaattgaggcagcaaaggaaagagggaaaatcgctgcaggtgcagatgaaattgcaacgctccaaagagaagaaagaaatgatggatcaagtgaagaaggcaagaaaaaacttcgactttttggatgataaaaataagcccatgggaaggaaggctgcagaaaaacggaagatgaaggacaagaaattcggtttcggtggtaagaaaaaggggatgaaaaagaatacaaaggacagtgcgggcgatattagtgagtataaaaatcctgggaagccggccaagaaacagatggggaaaaaattcgtcaataaaaacaaaccaaaaaatcaaagaatgggcaaaaataggaggattaaaactaaggctaaaggaagaaaataa

SEQ ID NO: 526 - DNA, 1533 bp, Phyllotreta armoraciae
atgaatccaggcgccccaaattaccccatggcgtctctgtacgtcggagacttgcattccgatatcaccgaggccatgctctttgaaaagttttcatcggctggccccgttttatccatccgcgtctgcagggatttgataacccgcagatctttgggttatgcctacgttaatttccagcaacctgctgacgctgaacgtgccctagacactatgaatttcgacttgatcaaaggcaggcccattcgtatcatgtggtctcaacgtgacccttctttacgaaaatccggagttggcaatgttttcatcaagaacttggaccgatccatcgataacaaggctatgtacgatactttctctgccttcggtaacattctcagctgcaaagtggctcaagacgagagcggagtcagcaagggatacggttttgtccacttcgaaaccgaagaagctgccaataaatccattgaaaaggtaaatggtatgctgttgaacggcaaaaaggtctacgttggtcgattcatcccacgcaaagaaagggaaaaggaattgggcgaaaaagccaagctcttcacaaacgtttacgttaaaaatttcggagaggacttgtccgaggaacagctgcgaacgatgttcgagaaatacggcaagataactagctacaaaataatgagcaaggacgatggaaaatcgaaaggattcggattcgtcgctttcgagagccccgaggcagccgaaacagctgtcgaggccctcaacggcaaagaaatattggaaggcaaacctttgtacgtcggcagagcccagaagaaggccgagcgtcaacaggaattgaagcggcgcttcgaagctctgaaaatggaaaggctgaaccgttaccaaggcgtaaatctctacgtgaaaaacttggatgataccatagacgacgagcgccttcgcaaggaattttcaccgttcggcaccatcacttcggccaaagtaatgatggaagaaggcagaagcaaaggcttcggtttcgtgtgcttctcctccccggaagaagccaccaaggccgtgaccgaaatgaacggtagaatcgtcggtacaaaaccgctgtacgtcgccttggcccaacgcaaagaggaccgcaaggcccatttgacgtcgcaatacatgcagcgcatggcgaacatgcgcatgcaccagatgggccagttcatccagccgggcggctcgagcggctacttcgtgcccaccatccaagccacggcgccccgtttctacgggccggcccagatgccgattcgtacgagcccgagatggccggcgcagacgcccgtgcgtcccggcgcccagggaagcaccgctacctacaccggaatgccgaacagctacagagctgcagcgagaccgccgggtcaatctacgatgcgcagcaacatcagcgtaccgcgacccatcaccggacaacaaccaccaagtatgcacggtcgtccacttgttggacaaggtgtggctgctgctggaaatcgtgcagccaacttcaagtacacc

SEQ ID NO: 527 - DNA, 2766 bp, Phyllotreta armoraciae
atgaccgactcaaagtattttacgaccaccaaaaagggagaaatattcgaattaaagtcagaactcaacaatgataagaaggagaaaaagaaggaagccgttaaaaaggtcattgcttctatgactgtaggcaaagatgtctcagcattatttcctgatgtcgtgaattgcatgcaaactgacaatttggaactcaaaaaattggtttacttatatttgatgaactacgctaaatcgcagcctgatatggctattatggcagtaaacaccttcgttaaagattgcgaagatcccaatccactgattagagcactcgctgttagaacgatgggttgcattcgagtcgataaaatcaccgaatatttatgcgaacctctaaggaaatgtctgaaagatgaagatccgtatgttagaaaaactgctgctgtttgtgttgctaaattgtatgatatttcgtcagggttagttgaagatcagggatttctcgaacagttaaaggaattattaagcgattccaatccgatggtagtcgcaaatgctgttgctgctttgtccgaaatcaatgaaagcagtccgaccggacagcctcttgttgaattgagcaccaacacgataaacaagcttctaacagctctaaacgaatgcaccgaatggggccaagttttcatactcgattccctgtcgaactacaccccacgagacgaaagagaagcccaaagtatatgcgaaaggatcactccacgtttagcccacgctaacgctgccgtagtactatcagccgttaaagtattgatcaaaatgatggagattttggcaggagataccgaattctgcaacacgctcagcaaaaaattagcgcctcctttggtaactctgctgagttcagaacccgaggtgcagtatgttgcattgagaaacatcaatttgatcgtacaaaagaagcccgacatattgaaacacgaaatgaaggtgttcttcgtgaaatacaatgacccgatttacgtgaaactggagaagctcgacataatgattcgattggcttctcaagtcaacatcgctcaagttctcagcgaactcaaagaatacgcgaccgaagtcgatgttgactttgtgaggaaagccgtgagagccatcggtcggtgtgccatcaaagtggagccttccgcagaaagatgcgtagccacgctgttggatttgattcaaactaaagttaattacgtcgtacaagaggccatcgtagtcatcaaagacatatttagaaaatatccgaataaatacgaaagtattatcagcaccttgtgcgaaaatttggatactctggatgagccagaagccagagctagtatggtgtggattataggagaatacgccgagagaatcgacaacgcagatgagctactggacagtttcttggaaggttttggtgacgagaacgctcaagtacaactccagttgctaacggccgttgtgaagctattcctaaagcgtccccaacacacgcaaggcttagtccagcacgtactcagtttagccacccaggactccgataatcccgatttgagagacagaggtttcatatattggagattattgagtaccgatccggccgcagccaaggaggtggtgctggcagacaaacctctgatatctgaagaaacggacctcttagagcccactcttctcgacgagctcatctgccacatatcgtcgctagccagcgtttatcacaagccacccacggcgttcgtggaaggccgaagtgcaggtatcagaaagacgttgccggctagacaaggctccgatgaaggtgctgccgctgccgaaacgacggttattccgaaccaagaaagcctcatcggcgatttgctttctatggatatcaacgcaccggctccgtcagctgctgctgctcctgccgcccctcagaccagcaacgtcgatttactcggaggcggactggatgttttgttgggaggaggcaacgatatcggaggtgctcctgctagcgctgctgctcccaccaccacaggcctgctcggcgacatattcggcatacctactgcacctacgatgtacacaccgccgaaggtcgtctggctgccggccgaaaagggcaagggcatggaaatctacggtactttctccagacgatcaggccaaatggccatggagatgaccattaccaacaaagctatgcaggcaatgtccggtttcgctattcaattcaacaagaacagtttcgggatcacgccgagctcgcctttgaacatcccgactttgcaaccgggccagaatctggagtacagcttgccgttgaacactaccggtccggtacaacgtatggatcctttgatgacgctccagattgccataaaaaacaacgtcgacgtgttttactacgcttgtcagatacccatccagatattgttcggggaggacggtactctggataagagggtgtttctcaccacttggagggacattcccggagctaatgaggtgcagtacacgctgaacgatatcaaaggcaacaccgacacggtttcgaacaaaatgacgttgaacaacatcttcactatagccaaaaggaacgtggaagggcaggacatgctgtatcagtcgctgaaattgacgaacaacatttgggtgttgttggagctgaagttgcagccgggcgtcccgacggcgacgctgagcttgaaatcgaggtcggtggaggtggccccgtacgtttttcaagcctacgagtcgattttgaagagttaa

SEQ ID NO: 528 - DNA, 498 bp, Phyllotreta armoraciae
atgccgcctaaattcgatcccacggaagtaaaatacgtttacttaagatgtgtaggaggagaagtaggagctacatcatccttggctccgaaaatcggtccccttggtttgtctcccaaaaaaattggtgacgatattgccaaaggtacagctgactggaaaggtttaaaaattacggtccaattgaaaattcaaaaccgtcaagccaccatctccgtcgtaccatcggctgcttccttaattattaaggctttgaaagaacctcctcgtgacagaaagaagcagaaaaacattaaacacagtggaaatattacatttgatgaagtgatttccattgccaagcaaatgaggcatagatcaatggccaagagccttgctggaactgttaaggaagtgctgggtacagctcaatctgtaggttgtacaattgacggcaaagcccctcatgatgtcatagatgaagtcaacgagggtactgtagaagttccggatgagtaa

SEQ ID NO: 529 - DNA, 1095 bp, Phyllotreta armoraciae
atgagcgaggaagggaagagagcgttaattttagtcggaggttacggcacaagactgaggcctctaactttgagccgtccgaaacctctcgtagaattcgcaaacaaaccaatattattacaccaaatagaagcattagtagatgcgggagtaacagaagtcatactggccgtatcatatcgtgccaagcaaatggaggaagaacttacagttgaagcggctaaactgggcatttctatagtattttcgcatgagactgagcctttaggcaccgcaggaccaatagcattagctaaagaacacttatcgaaaagtacaaaaccgttttttgtattgaattccgatataatatgcgacttcccgtttagggagctagagaagttccacgaaggccacggaaaggaaggaactatagtcgttacaaaggtcgaagaaccatccaagtacggcgttgtagtttacgatcaaaacaactgcatcgagagtttcgttgagaaaccgcaggaattcatttcgaataaaatcaacgccggcctgtacattctaaatcccagcgtgatcaacaggattgaactccgaccgacttccattgaaaaggaagtgtttccttacatggcatctgacaagcagctttatgctttcgagctgaaagggttttggatggacgttgggcaacccaaagacttcctgactggaatgtgcttgtatttaaaccatttgcgggaaactaatagccagaagctgtacaaaggacccggtgtagtcgggaacgtgctggtcgatccgacagcaaaaattggcagcaattgccaaattggacccaacgttacaatcggaccaggtgttgtaatagaagatggggtttgtataaaacgctcgacgatcctaaggggtgcggtcgtgtgctctaactcttggttggagagttgcattgtgggatggaagtgtcacgtaggtaaatgggtgaggatggaaggaagtaccgtactcggagaagatgttattgtgaaagatgagacgtacataaatggagggcaggttcttcctcataaaagtattgctacatctgttccggagccccagattattatgtag

SEQ ID NO: 530 - DNA, 858 bp, Phyllotreta armoraciae
gacggtgaagaagtgataagtgaccaagaaaaagtaaaaatagtttcggacttcatcctccattccccgcccggcgaatttaacgaagtcttcaatgatgtaaggaagcttttgaataacgacgaccttctgaaagaaggcgtaaccggggcgttcgcccaatacaataaagaccaactcacccccgttaggatagaaaacgccgatcaaatggtgctgattacagaatacaacgatttaggtaacaatagattcttcgacccccgtagtaagcaaagtttcaaatatgaacatttaagaaaggaagcttctgattaccagccttatagtgtcgatacgacggcggagccctggcgggccgctctagataacgagtttatacaatatacgagaaaccattataaagacggcgtttgtagcgtgttcggtcgcagtcaaaacggtgcgatcacccttactgcttgcatcgaagaccaccaatttcagcccaagaacttttggaacggtcgatggagatcccaatggtccgttagcctaaccgatgaatctactgcagaagtacggggcgtcctgaaagtgcaagtccattattacgaagaaggaaacgttcaactggtgagtactaaggaaatcaaggagtcgattccggtttctaacgaagcgcaaacggctaaggaaatcatccacgtaatagagaacgctgagaatctgtatcaaactgcgatttctgagaattaccagacgatgtcggacacgacgtttaaggctctgcgaagactcctgcccgtcaccaggacaaaaatggattggaataagattgtatcttatagtattgggaaagaactaaaaacgcaatga

SEQ ID NO: 531 - DNA, 4116 bp, Phyllotreta armoraciae
atgctcgtgaaaatgaactttctactagttttaacaatcagtgcggtggccgtgggggctcaagagggcgcggcgccggccgtggcgagtcaggataatacgggagacgtggagagcatcgacgtgggtgcagcaggaagcgatgtcggcgaagattccaggcccgttcctgtaggagaaaacgacgggccggttacgaatagtcccagttacgacgctcctgtagaagtattaacaaatatcgatagcgaaacaattgatactaacagttccagacccaactggactttccagaaaaaaactaaatctgggaaatacgttacttattatgcggctaattatgaccccatgacgtcagacactgcccctccagacacggaccaaaggggtggaggcatcccttactccattaccgaaaacaggttagctgaaatcaggaaaaactttatgtacccgtacttcgataaagggggcaacgtggacaacgagggggattaccagaaggaaatccaatcctccacgccccaagtccacaagaatctgaacttccaagtgccttttttcggattcaggtataattacacgagagtttccatcaatggttatttggaattcagcgatccaccttccaacttaaattatccactggtctttcccataaaggactggcctaagcaaaacgatccttcgtttattggtattttctacagtaaatgtaaaatcggtaatcttcgtgacgaagacgtggacaaaaggaaacccggcgtgtacttcagaatggaacgagacctcagggacaggcaagacaggatgggagttgaaataagggagagattgaaatgggatataagagaaggagtgatcggttcggataccttcgatccaaaacacgctataatcgtgacgtggaaaaacgtgtcatttaatggaggatatgcaaacgcagtttatcaaaccaacacattccaaatggtactcgctaccgacgaggtattcacttacgcaatattcaactatctaaatttggcgtggaccagtcacacggaagccggtggagacaccagaacaggcgaaggcggtgtaccggcgtttgtcggattcaacgccggtaatggtacgagaagcttccagtacgcgccctacagtcaagcgtctgtcattcgagatttggtatcgaccggttggggcaacaacaaacccggaaggcatattttccgaatcgacgagaatattctgctgggttcttgtaacaaagatatagatggtgctaatttaccccttcaattcgcgccggagagcggcaatatgctgggcggaaccgtcgttaacatcacaggtccttgctttaaccccaacgatagaattagatgtaaattcgacgtgtacgatgaggtcgtgggatacgttgtagacagaaaccgcgcgatttgcattcaacctcgcctttactcagaaggttgggtgagactccaaatcgccatcaattcggacgcttttaaatggaagggaaagtattacgtcgaatcgcccgccagcgcctcccagaagatcttcttcaaagacatgaagtaccacgagaaatcgcccagcgagattcgcatcacgtggcaaaagcagaacttgaccaccaacgaaaacgccaacatcaggatctccttgtggggctacagggaaaccaccatgaggcccacgttcgtttacataacggacatagccgataatgttcaaaataccggggagtacacgatcgtaccgtcgcagtacaggggcaaaatcaaccagtacctgtccgacatcaagttcggtttcttgcagataaatttgaccgaatcgatagaggtcaacacttactctacgaacaatcaaaacatcaaaattacaccgataatatggagcaggccgataccgctgggttggtacttccaatttcaatgggagaatcaatacggcaaaaattggccaaaatacctgtgcgacgattggctcagaacggacagatatttgaagaacttcgcccacgaattaccccaatgtccttgcacggtccagcaggcattggcggataagggaaaattcatgcccgactttgattgcgacaaagattcgaatcctgtttgttattacaacaatcaagctctacattgcgtcaaaactggtgctcccacgatggaaggttctgagcaacaatgttgctacgacaaaaacggctacctgatgctgtcctatgatcaacaatggggttcgagtccccgtcgatgccacaatctcggtaaaatgccttacaacgaggccaccaaagtccccacgctatcgcagtggttcaacgacgtcgtgcccaagtacctttgttgtctctggcaggaagagcaagccgtgggctgcgaaaccctgcgattcgagagaaggccatcgcaggattgcgtcgcctatcaagcgcctgccgtagcaggagtgtacggtgaccctcacatagtcaccttcgacgatgtggagtacactttcaacggcaaaggagagtactccttggtgaaatcggttaaagtagacgataatttggaaatacaggccagattcgagcaaatgggtaccaatgcctatggtgaagttagagcgacacaacttacggcgatcgtggctaaaggaaacaagacaattcctattgaagtcagaagaagaccgccggaagccagatggaggtatagattggacgttatcgccgaaaacagaaggttgttcttcgatagaccttccttgaaattccaacattttcaaggtgttactgtttacacaccaacatacattctgaatcaatctgaagtactaataatgtttgacaacggagccggtgttgaggtactggacaatcaaggatacatgagcgccagagtatacctaccttggtcatttataaacaaaacggtgggcctgttcggcaactggagcttcaacaaagaagatgacttcacgctgccggacggatccaaagcggccgtggcgagcaacattaacgacatggagagagtcttcaacgaattcggttcgaaatggatgctcgacgacgtcgccgacgcgaacaaaggccaatcgttgttctacagggaattcggacgcacctcggccacctacaacaacaagaccttcagaccgcagttcctcatgctgcccgaggacatcctgccggcgaacagatcggagcaaatacagcgcacgtacgacgtgtgctcgacgaagatgtacgaatgctactacgactacgccatgacgttgaacagggacctcgcgcacttcacgcaaaactacaaggcgaccatctacgaactgaaacaaaccacgagggagaagatcacgtcgtgcggcgtgctggaaacgccgaggttcggcaggaagagtacgttcctgttcgtacctggcaccaaggtgacctacgaatgtatacaagattttgtgctggtcggcgatcctcgacgagagtgcggggccgatggaaaatggaacatacctgattttgggtacacttattgtttacgtcaagaagaatattcctcccgccaagcggcaatagcgtccggtatcgtactcgcgattctcataccactcatactgctattcctatacttaggctataagatatacaaacggttgttcgcgaacgacgacggctcgtggaagtaccaatcggccgcgcaaaaatccagcgccccgccgacgttcaggcgcagcttttctccctaccgtgacgaggacgacgacgacatcctgcgcagcccctccgacggcgatacgctgccgaagaagcgcaggagctacgagaaatcgtacaggacgcacgagccgttgaccgatcggccgagcatcgatttcgaagacaagccgttggatcccaacgatcccagttacgatgatatcgataggacttcggcggctttgtcgagccccgcgagtcccacgagccccacgtctagcgtgcagtatacgactccgtacaacgcgaggcccgatatattgggaaatggcaataggaatttggaatacgcggagaacgattacgcgatgcccgttaaaaagcctaagaataggttcagtcagagtcaaagcagtattgttacggatgtttga

SEQ ID NO: 532 - DNA, 342 bp, Phyllotreta armoraciae
atgcgttacgtggctgcttacttattggccgctttgggcggaaacgcttctccaagcgctgctgatgtcgaaaaaatccttggctccgtaggagttgaagccgaagctgaaaaggtcaagaaagtcttaggcgaactcaacggcaaatccatcgaagagctcattactaaaggtcgcgagaaattgagttccatgccagtaggtggtgcagcccctgtagctgctgctgcagttgccgctgctcctgctgccgcagaagaaaagaaagaagccaagaaggaagaaaagaaagttgaatcagaatcagaagacgatgacatgggctttggtcttttcgactaa

SEQ ID NO: 533 - DNA, 2724 bp, Phyllotreta armoraciae
atgatgactgaccgttttggattaaaatgggaccccaaaaatctagaaattagaaccatgtcagtggagaaaactctggagccccttgtgttgcaagtaacaacccttgttaacacgaaggggcccagtaaaaagaaaaagggcaagtcaaaacgtgccaatgctctcgttagtacagtagagaaggccactgagaatttcatcgagaaaggtgagcaaattgcttatgagaatcccgatataacggatgagatgattgctgctgttgaagaagtcaggaagactggcaatgcaatgagcatagctgccagggaattttcagaagatccctgttcttctttgaagaggggcaatatggtacgcgcagctagaaatctactatctgctgtcacgagacttctgattctcgctgatatggttgatgttcatcttctactacaatcactgcacgtagtcgaagatgatttggaaaaactaaaaaatgcttcaagccacggggaacttcttgacaatattaaggcctttggtcataacgcaaacgagcttatgaatcaggctgctaaaagacaacaggaactaaaagatccacagctacgcgatgatttggctgccgctagagcagtacttaagaaacattccacaatgcttctaacggcttctaaagtttacgttcgtcatccggagctagctgcagctaaagctaacagagactacgtgctaaagcaagtttgcgaagctgttaatacaataaatgatgtcgcccaggggagaacaccgcagcccgcttctggcccttatgatggaccgggagaactcgcagctgctttagatgatttcgatgatcacatggttatggagcctctggcttataatgaggttcacacgagaccatcgttggaggaacgtctggaaagcatcatcagcggggctgctttaatggctgattcgagttgcactagagacgaaagaagagaacgtatcgttgctgaatgtaatgctgtcagacaggcattgcaggatttgctgtccgaatacatgactaacatgggtaagaaggataagagcgacaatcttaacagagccatcgataatatgggcagaaagacccgcgacctcagaaggcagctcagaaaggccgttgtcgaccacgtttcagatagcttcttggagaccaacgtgccccttttggtcctgataaaagcagctcaaaacggcaacgaaaaggaggtggaagaatacgccgttgtatttaccgaacattccaataaactggtggaagtagccaacctcgtctgcagcatgtcgaacaacgaagacggcgttaagatggttcgatacgctgccgctcaaatcgacaatctgtgtcctgaagtaataaacgccgctaggatcttagcggcgagatctcgcagtaaagttgctcaagaaaacatggaagctttcaaacaatcatgggagaaccaagtgcgcatcttgaccgaagccgtcgatgatatcacgactatcgacgactttttggctgtgtccgaaaaccacattctggaagacgtcaacaaatgcgtactagcccttcaagaaggcgatgctgatacattggatcgtacagccagcggcataaagggcagatcgaacagagtgtgcaatgttgtaacagctgaaatggataactacgaaccgtgcatttacactaaacgcgttttggaggcggtgaaggttttgaacgatcaagtgatgcccaaattcacccaaagagtgcaggtagctgtacaggctttgggcaacagcccgcctaaagaggtcgacgagaatgatttcatcgatgcatcgagattggtttacgacggtgtcagggaaataagaagagctgtgctcatgaacagagctgacgaagatttggatcccgaagacgtcgaactcgatgaaaactatctgattgagaccaggagtaaatcgagtgctcatactggagaacatggcgttgatgaatatcctgatatcagtggaatcacaaccgctagggaagccatgggtaagatgcccgaagaggataagcaaaaaatattgcagcaagtggagtttttcaagaacgagaagctcaagttcgataacgaagtcgctaaatgggacgatactggcaacgacatcatcgttttggctaaacacatgtgcatgatcatgatggaaatgacagattttaccaggggaaaaggccctctgaaaactaccatggacgtcataaatgcggccaagaaaatttcagaagcaggtactaaattggacaagctaaccagacagattgccgaacagtgtccggaaagttcaacgaagaaagacttactcgcctatttacagcgtatcgctctctactgccatcagatgaatattacttctaaggtcaaagcagacgtccagaatatcagtggagaattgattgtgtctggtcttgacagtgctacatcattgatacaagcagccaaaaatttgatgaacgctgtcgttctgacggtgaaagcttcatacgttgcatctactaagtatcctagaccaggaactgtagcttctccgattgttgtgtggaagatgaaggctccagaaaagaaacctctggtaagacccgagaaacctgaagaagttcgtgccaaagtgcgcaaaggctcacaaaagaaagtgcaaaatcccatacacgctttatccgaatttcaaagccccacagagtctgtgtaa

SEQ ID NO: 534 - DNA, 789 bp, Phyllotreta armoraciae
atgcaaatttacatgtttgattttttatcagggacccccctttttggagttgctcctacctcaagcagcactactacaatagccagtgtccccgctttaggtttatcgactactgtttcttccgctgcttcaacaactccatcgacttcattaggtacaacaacagcagctcctccagcttattcaacatcgacacttccttcttctggttcgttaactttcagccaactagaagattctatcaacaaatggactattgatttggaagagcaaggcaaatttttcattaatcaagcgaaacagcttaatgcttgggattcgctacttatttcgaatggcgaaaagattctcaatctgaatggtagtatcgagagagttaagcagcagcaacagcaattggaccaagaactcgatttcgtcttggcgcaacagaaggaattagaagagttgataacaccactagaaaaagaattgttggaaattcctgtaacggacatagatcgaaatcaaatgtatcaattttcggaaataatcgattctcaattgaagcaaatgtccgatgatttgaaggaaattatcgagcatattaatgaatctaataaaagcgaagaaatttcaaatccgttgacgcaaattagccgcataatgaatgctcacatgaattcactccagtggttagacagaaatacggcacaaattgtttctcatctcgaacaaatcagtaaaatgcaggactctaatagaagaaattttcctctcaatcattcttttaataattcactcctttaa

SEQ ID NO: 535 - DNA, 582 bp, Phyllotreta armoraciae
atgttcatatgggattggttcacgggagtgctgggttacttaggattatggaagaagtccgggaaattgctctttttaggactggataacgctggtaaaacgaccttattacacatgcttaaagacgacagactggcccagcacttgcccacattgcatccgacctccgaggaactgtccatcggaaacatgagattcactacgttcgatttaggagggcattcgcaagctagaagagtgtggaaggattacttccccgccgtagacgctatcgtatttcttattgatgctaacgacagatcgagattcgtcgagagcaagcaagaattagatgccttgttaacggacgaaaccctagccaattgccccgtgctgattttaggcaataaaatcgatttaccggacgccgcctctgaggatgagttacgaaacgtttactcgctgtacgggcagacgaccggtaaaggtaaagtggctcgatcggatttgcccggacgaccgctcgagcttttcatgtgctccattctgaagaggcagggatacggggagggttttcgttggttggcgcagtacattgattaa

SEQ ID NO: 536 - DNA, 702 bp, Phyllotreta armoraciae
gtcaatgtcacctgtcactactgtcaacaccaaccaaaaacatacatatttttaatcaaaatttcccttattcaactaatattaacgagcaatttcgataaaaaatcgaaacgaaccgatacagccagcctttcagtcatggacccgatcgccgtgctggaaaaacgcatcgaggcgctcgagctgcaggtgttccctttgggtgactacaatcaaatatcgaacaagacgctgaccataacgaatctgctggtggagacgcaaacgatgataaattcggctttaacttgtcgcgaatccatcacgtcgatgctgcaacacctggtggtgatcaacgactacctgaaccccgtcagcgaggcggacgagctggaggtcgaagcgaaaaggcagtatttactcgaattgtatcccgaattgaaggatacgatacagacggtgagcacgttggaatcgctgttgccttttatcgattcaattaatatatccaaagtggtggagttctcggggaagctggaggaggtggccgtgagcaatctcaagttgtacggggaatgcagggatatcacgaagaaggtgctggtcgcgttacagcaatataacgacatatccaattccattaaattgttattttcgcaattggatacggccgttacgaatttagaatacgctttgcagcttcgagatgctaacgaagaatga

SEQ ID NO: 537 - DNA, 1752 bp, Phyllotreta armoraciae
atgaacaacgctaaacttcaagaagtgtacagtgacctaacgctctataccactccagataaattcttcatcgagccgaaggctggcgaggaattgatggtaatagagcgaaattccgaaaatataatatgtttcaaaagcgaccacagacacctgatacctgcagcgaatagccggaaggatttctgcgggttaataggtataatccaactgttagcttgtccctacttagtagtagcagttcaaagagaattagtcggttatatagcaggttgcgctatctggcgcctcgccaaagctgaattaataccatacaggagctccgcacacttgactcctgaaaagcaagcagacaacgatgtctatttgtccatggtgtattccgtactatccactccatttctatacttttcctacgactacgatcttacgcattccttgcaacgcttgcacggcataagccccgatttttggaagcaatcgttgtttgagcgagccgatcaaaggtttgtttggaatggaaacctattgtattcgttcaaaggattttcgatacacagattttgcctgcctctcatgcacggattcatttccataaatttctgcgtagtgaacgggcacagtttaaactggtcaattgttagtagaagaagcattcaacgagccggcaccagattacacagaagaggtttagataaagaaggaaacgtggctaatttcgttgaaaccgagcagatagtcgaatatcaaggcgatcgggcgagtttcgtgcaaatacgaggcagcattcccctgttttggcaacaagatcccgacctgagatacaaaccaccgcctactatactcgatgtcgatccacaagatcagcactcgatgtgtctaaagcacatgaacgatttaatgactttctacggaaaggtcgtttgcgtgaatctagtcgatcaaaaaggagcagaaggaaatatggaaacagcatttaaaaacgccattgccaacgtttcgtctccttcggttaaatacgaatcgttcgatttccacgccgagtgcagcaaaatgagatgggacagactgttgattctcatcgatcgattagcgcacgatcaagacgaaatgagtttctttttattgctaagagacggctcgttgagttcgttacaagacggcgtattcagaacgaactgcatcgattgcttggaccgcacgaacgtcgtgcaaagcatgctggcccatcgaaacctcgaaagcgtgctgaggaaattgcaaatccttcatcagaatcaaacgttggaattccagtattcgtttgaggtgttgtttaagaacgtttgggcggacaatgcggatataataagcacccagtattcgggtaccggcgctttgaaaacggatttcacgaggaccggcaaacgtacgcgttacggattgcttcaggacggtatgaattcccttacgaggtactacaagaataatttcgctgacgggctccggcaagacgccatcgatctgtttttaggtaacggtaaacccatttcacccttgcatattgataaaggttggaaatacgtgacttatccgtcgattctactgatcgctgtggcgatgttcgtagcttgtgctgtcactccttccgagtattcgacggattcgttgctgtttctcttgttctggggttccatggtctatgcaactttgcacactattttgaagtatggttcggagtttgttgataaacctaggctcacccattcttag

SEQ ID NO: 538 - DNA, 1488 bp, Phyllotreta armoraciae
atgcctcctactattcaacagaataatcagaacgccgcaaatggcgtggaaaaaagacaagtaaagactgtcgaaaaaaggtccgatttattatgtaaagtgaaatattgtaatacactacccgatataccgttcgatctgaagtttataacctatcctttcgaatctattcgattcattcagtataatcccacatccttggaacgtaattacaagtacgaagtattaacagaacacgatttaggtgtaagcatagaccttataaataaagatatatacgcaatcggagctggcgctgccttggatccggccgatgagaaactcctagaagaagacatccttactccccaagactccaagaggtcccgtcaccatgccaaatccgtgtcgtggcttcgacgaactgaatacatctccacagaacagaccagattccagccccaaaccatggacaaagtcgaagccaaagtgggctacagcatcaagaaatcccttaacaacgaaaccctttacatggacagagactcgcaaataaaggctatcgaaaaaacgttcgaagataccaaaacgaccattgataagcattacagcaagccgaacgtagtccccgtggatgtcctgccagtttatccagatttcagtttgtggaaatatccttgtgcgcaggttattttcgattctgatccagctcccgtgggaaaacaagtacccgctcaaatcgaagagatgtctcaagccatgatcagaggtgtaatggatgaaagtggtgagcagttcgtagcctacttccttcccaccgaagagactctccaaaagcgcagggaagacgtcgcgaaccaagtccaataccaagatgaagaggaatacgaatacaaaatggccagagagtacaactggaacgttaagagcaaggcaagcaaaggctacgaggagaattacttcttcgtcgtacgatcgagcggtatttactacaacgaattagaaaccagagttaggttaagcaagcgaaggcagaaagtaggccagcccccgagcaacactcggctcatcgttaaacacaggcctatggatgctaatgaatttagaatgcaacggtacagggaaaagcagctggaacctacaggcgaggatgacgaagagatggaaatcgacgagccccaagacgaggaaaacgtgctcgagccggacaacgaaagccgcgacaaagaaaccgagagcgacaacgaaaagaaacgatccagagcttcctcagtatcttcccaaaggcgatccagatccagatcgaattcttcggctaaatcgaattcgagatctagttctagatccttgtcaaagtccaggtctcgttcgagatcgaagtcgtcgtcgaggtctcggtctaggacgccgtcgaagtccccctctagatcaaggtccgtttcgaagtccccttctaagtcaagatcaccgtcaccatgccaaatccgtgtcgtggcttcgacgaactga

SEQ ID NO: 539 - DNA, 1170 bp, Phyllotreta armoraciae
atgccgattgaaaatttggaagatcaaggtttagaaaagaacccagacctagagctagctcactacaagtttctcctgacgctcccggaatatcgcagcgaccggaatgtccactcgaagatcaccgaagccatcaagaaggatgatatggccccatggtacgaactcctttgcaaagaggtaggctggaagttggactcggccttgctgaaggccctcaaggccaagaatgccgaaaaggtcaagctcctggacgaagccatcgaggacgcggagaaaaacttgggagagatggaggtgcgggaggcttatttgcgtaaagcggagttttacagcaggatcggcgacaaagaaaacgccgtgagtaccttcaggcaaacttacgataaaacagtgtctttgggccaccgtttggacatcatatttcacttaattagaataggcttgttctttatggaccatgacctcatcaccaggaatatcgacaaagcgaagagcctaatcgaagaaggaggcgattgggacaggagaaaccgattgaaagtctaccaaggtgcttattgtatgtcggtgagagacttcaaaaccgccgctaacctatttttggacactgtgagcacattcacgtcttacgagctcatggactacaaggcgttcgtgagatacaccgtctacacttccataatcagcctgccgagaaaccaactaagagataaagtaataaaaggctcggagatactagaggtcctccactctgagccgttcgttaaagactacctgttttcgttgtacaactgccagtacgcggagtttttctcgaatttggccgaggtcgagacgattctgaggaaagactacttcctgaatcctcattaccggtattacgttagggaaatgaagatttcggcttacacgcagctgctggagtcctatcgatctctcacgttgcagtatatggccgaagctttcggcgttaccatcgagtacatcgatgaggagttgtcgactttcattgctgctggaagactgcattgtaaaattgatcgagttggaggcatcgtggagacgaataggccggatttaaagaatgctcagttcaattccgtcgtgaaacaaggggatttgttgcttaatcgagttcagaaactctccagagttattaatatttag

SEQ ID NO: 540 - DNA, 15381 bp, Phyllotreta armoraciae
atggaggaattaacctcgggtttggatcccgacgatttgatggatctagacgagccagaagggtccgatttggaagaggacgacgaggatctcatcgatgatcacgtctcgtcgcctttcatctcgtcctcggcgccggaatccacggccaactccgtcgcctcctctccgatccacgaagacttccctccgcccttcaatttcaccgggaaacctctacacgttaaacgcggaagaggaagacccagaagagaaggaggtaagccttcggcgccgagaacgacaaggggcggtggaactggagtgtcgagagtacgtaggccgagacctccgggtttttcgagaagaggatcgttaggaggaagtagaagtgttaggcaagtagacagatcggattacgaaatgtctcttttcgccggctcgccggtggatgacggtttgttggatcccgagacgggttcgatgatctttcccgagaagtttgttcctgcgatcgaggagcctccgtattttccggagcattggccagggaaagtttgtgccttgtgtaatttaggtgaacggagccagctaggacaaggtgaaatgctaaggttaaattgtcccgaaggattctcgccggagaaagttattagtgagcaaatattagaaagagccttgcaagctccagataaagaatgcggggataaaagcccgaaaggtcctgtgacatgtagaaggcaaaaaagtttcaataaatgcagacatccttcgataaccagtgaatacgttgatgaattaactataattggatataatgaagtacctgatgtatctagtttgtttgaacccaatggacagttttacgttcaccgtaattgtgcgttgtggtctaatggagtaacgaaagcagaaaattcggcgttgttgaatgtagggcctgtagtttcgcaatgttcttccaaaaaatgttccttctgtaatcattacggagccagcctgacctgccacgttgacaaatgtaccaaaatttaccactttccttgtgctactgctgctggtgcctttcaggacgtttcttcattgacaactttgtgcaacgaccatttaggacaagtggccgtgctcactaacgcatctccatgtttaacttgcgcatctatgggagatatagcaaatttgatgttttgttcgggttgcggcgcgcattatcatggaatttgcgtgggattagctcagttgccaggcgttagatctggctggcaatgtagaaaatgccgttgttgccaagtttgtcgagtcgttggagacgagtctaaactgatgacttgtgaacaatgcgataaaatttaccatgctagttgtcaaagaccgatagttacttcaataccgaaatacggttggaagtgtagatgttgtagagtgtgcggcgattgcggcgcgcgaactcccggagctggtttatcttcaagatggcacgctcactatacagtatgcgattcttgctaccaacaaaggaataaagggttttcttgccctgtatgccataaagcttaccgagctcacgcacatagggaaatggtccagtgttcgagttgcaagaagtttgttcatggaacctgtgatcctgaagcagacgttgtcacctacagtcaaaagaaagaaataagcgtggactacgaatacgtatgcttgcattgcaaaaacagcacagccagacaaataactgcgaaaagagctagtatcgatgatccttctgatgtatctgcttctcatgattccctgtacgacgatacgtccgaattggatcttccctcgcccgatgagttcgccagaaacatgggtttgggaaaaggaaagccgtatagcgcgaataaaatagccaaaaagcgccttagcttcaccgtgaatccggttggcaggccgaaaggcaccggaaaagtgcctcccgggaaaatgggctttatgaaacggtaccgattaacagagttcaacagaaaacgcggccccaaagccaaaatgaggggtattttcggcgtgcccggcgtcggtctgcaaagaccgatttcagacgggaaaaccgatgaagaaccaggagtcgaaaatcgattggtactctgttcagctaaagataaatttacgctcacgcaagatatttgcgtaatgtgcggggcatttggaaccgatcaagagggttgtttgatcagttgcgtacaatgtgggcaatgttaccacccctattgcatcaacgttaaagtaacaaaagtgatcctacagaaaggttggagatgcttggactgcacggtttgcgagggctgcggtcaacgaaacgacgaaggccgtctgatcctctgcgacgactgcgacgtgtcctttcacatctactgcatggacccgccactcgactacgtgccgcacggcaactggaagtgcaaatggtgcgccatctgccaatcctgcggagccaccgatccgggtttcaattgcacgtggatgaacagctcgacccaatgcggcccgtgcgcttcgcacgtgaattgccccagctgcaacgagccctacggcgagggcgatttgatcatacagtgcgtgcagtgcgaaagatggctgcatggagcttgcgattttattaaatgcgaagaagacgcagagaaatgcgccgaagaagggtacaattgcattttatgtagaccgagagacgtgccaccgccgcatatggttcctgctgcagttaccccgaagcctccgactccgacgaagagtcccgagctgggcaagagtaccagctactacatggacggcgtgtgtctcagcgaattcggcagtaatttgatcaaatcattggcgctcgaatatcacggatcgaggaagaaacggaaaaagataccaactgtacaagataaggaagccggtatcatggctacgattgaatctgttgttgccggaggaaatattattcctactaatatggaagacagcgctaaactagagctcgtcgacatcaaagacgagcctcaagagctgtacaaggagggcatgatgtggactaaagaggacggtcctcctcccgaaggttttacgataataacgatggagaacgggttgaacgtgctgcgaaggaagagacaacgcaatctgcagaagctcggcataggcgggttcgtcgtcaggatgagaggtatcagaacgggtcaggataacgatgatgtggattcgaccatcggtcaaagtgggctcaacgccaacgacattgttccatcgcctgcagacgtcgataaacccagaaggaaagctattcgacgaaagccgaagagtaaattagctgaaacgtttcccgcctatctccaagaggctttcttcggaaaggacctcatggacacagtggattgtaaaaaagaagaagtcgattgttatagcagcgatgaggagaaaacggacaagcattataaatccattaatttgtctcaggatgaaataatagcaatcgtggcatcgggtaaaaccgaaaaattggaaaacaataacaaagattcgaccaaagaagtcaaaccaactgtattgaaagaggaagaagaagataatccggaggatttgaaagatgttcttgccttaccgggcgatttgctcgataccgatttggttaatagtattatggaagatgaggaggaactgagcaaaacgactgcatctcttgttgctttagattcaaatttaccgcatgatacggagctaacggacactctgagtagttcaggaaattcaaaagaaaccaaagatgaattgagcgacattttaggccctcatttcaacctcgattccatatcgaacataaacagcaaggacgtcgaagatatatttaagggcgtgttaacggatgagtcgcaagaatcccaagaaagcagcaacttttccttacaaggaaacagtatgttctcgaacaataatgctcaacagaccgttgcccaacaccccattattaatcaaccagtgagaccgaaaactttgcctactgttaaccataatttgaattccccggtcagttttccaccaccgtcaccctatcactcggagtacagcaacagtcctcaatttagtcctgccttcaccgaatcgtcgtgttcgtgggtaagcgggaacgaaacgccggaaattgatagtacgaatgtaacggtgacgtcgacgtacaatcagaggtcctccgataaaatgaaagccgatgaaagtttgggcaaaagcgctacgatttcggctgttttatacgcgaatatcaaccatcctgaatggaaaaaggagtacccgaattggcccgataggtacaagcaaataataaaaaaatggagaacgttgagtcaagaacagaaagcgccgtttttgcaacacgcaagagataataggagtcaattgaggatgaagaaagcgcaacagtcacagaccgtcaaggaaaccgcctctgccgccacgtccccgaacgcgagcaagcctcttcaccaagccggccaagccttagtgacaactctccaggcggtaacgcaacagccggcgggggttcccgcggcccccgcggcgcccgtttcagaggaccaggaaaaaatcgccctccaacaaaaatcagccagggaagcagaacaggaaagacaatggaagcaattgcaggccctcaggcaacagcaaacccaacaaacccagaacatcctgcacgaacagcgcgtacaagccattgctcgcgtacaacgtcagatatcaaccgatcccgcgcaacagttcataaacgagcagcagagcccgttgcaggtgaacacgcctcaggaattgagcccttcgactacaccggcccccagtccccgtcaatttctcggcattaaatccccgacgttccccgtcccctcgcctatccaacaaactagcgtcagggccaacacgccctcacaatcgccccacgacgtctcccaaccgagcacgcccgacggtaacgatcactttatccattcccccaccaatcctaaacctaatttccaacctagattgcccaacgatccgttcgccgcgcaacccgccacgccgcgaccccaattcggaatggcccggccacctctacagaacttcggcggtaccgttcgcaacgagcaacaggacatcaacatcaatcgccaattgagggagctgttgcagcgacagcaggttaagaagctggatgaattgttgcccggcaaagcgccacctcagaggctgtggcacgctaatgatcagcaggagggtagcgatgcttcgatgacgtcgcctgtagctcaaggcgcccagagtgctcaaggcgctgacgccaccttccggcaacctttaccgcccggcgttgtcaaacctaggctggcgatttcttcagttaacaggccgatattgaacgctgttagagtcaatcaattggatcccagaattcaaaatttggatccgaggatgaggttgattttacaacatcagcaacaaaggctcgccacgggtattcagcagcaattcatccgtttcacgtcgaacgtgcgaccgacgaccgtggaacagtacgagcaactgttgcagcgtcagggtaataatcagaatcaaattcacgcggaggaacagcagcagggtgtcgcgcgaatacccataacgcaggccagcgttatacaaaggcctcacgtcgctcaggctgtggtgactggcgctgctgctgctacaaatagttccacagaaagtaatcccagcgaagagggaatcccggataatgtcacagctgaattggagaaactggaacaggaaacaggtactatggtagagcttcaaggcgtgagcgatattttgggcggtttggacgacgacgacgagcttctagccgaaatgggcgcggatttcaacatactcgaatacgctgatcccgaattagaagccttgacgggcggaaaaacgaacattttagacctggagctcgaagaggaaccggtcaaaaaagaaaaactagcctcaaacgcgaacactagcgctccttctcaaaaaccgacgcctaacgtcgccactacggccactagcaacagtacagctgttactacaccgaccgaagccaatacggaacccaaaattgacaatacgattcaacagaacattccgaaaacggtgcaagcggcgcctcaacagctacaacatcccgcttctctgccacagcagcagaacatgccccagcacggcgctcaggttcaagtgcaatcccaacagtctcagccgcatccgccgcagcaaatgcccattcaatcgacgctgcatatccagcagattcaccagcaaatggtgcatcaagtgcaacaagcggctgctcaaggaaggccgatgcctccgggttcgaagatgcaaactactgatgggttcgttggcgtcgtgatggcgaacaacgccgtgcaattgcagattcccccgaattatcaacaacggttgcttcttttgcaacaactgcaaaatcagaagttaatgcgagttggaagcactcagccaagggcagctttgcaagtggcccctaatcaaatacccgtaggtatgaatccgggacctaggatgccggtttcggcaccgccgccgcctccgccaccttatcccggcccgcccccgccttatccgggaaacgcgaatcaacatcagcaggaacaaccgctgttattggaagatctgcttgagcaagagaaacgcgagcaggagaagctgcaaaaccaaccgcctaaccacgaagtcacctcttccaccggcaacgaaaccgaatctgcgctcatgagcgaccaagacttcgaacgtctcaaagcagacgtgttcaacagcgctcccgtaaataatatatcctctacaaatcaagggaacgccgggcaaacgtcgcaagcgtggcctcagttgcaaaaccgtcaagcggtggttcccgcggccgcttctcagcacaccatggaagtgacgactagagtacaaatgtttaacccgaatttggtaccggcgccgcctcttccgccggagaatatcgccaccgagcaggataagcaggcgcagcttttgtacgagcagtggctgaaccatcagaacaacacgctggtgcagcaattgcgctattatgagaccgaagtgcagaaacttcgtaagagtaaaaagtcgttaaatagtaagcaacgccagttgaggaaagctggtaatcagttgactgaggtagatgctactgagcttcaaagaatcacagctgaacaggctatattacaaaagcatctggaatcgagtagaaaacaaaatcgccaacacggaatgttgatacaggaatatagaaacaagcatcccgctatcaagcagcgaaccggaactgatcagatccaatcaccgttgggccatccggcttcttcgcccatacaacaatcgagcgcttcgttatcgcccatgttatcaccatctgtctcgccgatgacccagaacagttcgcctttgaacagccccgggccgatggtgccttcttctcccggccacggtcccgttcagaacattttacagagccctaacggcgccaacgcggctcaaatgtctccgatgcaatcttcgcccagaataggaacgccccattcccaaagtgatgagagtccagggtcggcgcaatcgccttcgcaagtatgcctgccgccgcccatgcctagaatgacgtcgcctcaacacagacgagtcgtgaccagtccggtgggaatgtcgcaaatgcgttttatcaacaacaacatgttgcagcaacgcgttcgcatgcaatcgcccatacaaaattttcaacagaaacccggcacgccttcgccgttgaacagcccgacgtcccaacagatgagcgtcaaccagcaacatcaaatccagaagcagctccagcaacagcagcaacaacagacgttgttgcagcaaaatttggagggcgatcctaacgccattcactcgcagagaaccacgcagttgttgcagcaccggaattttatcaggcaacaggtgtcccagcagcaaatatcgcctcagacgttgaccccgcaacagcatcagttgatgttgcaacagcaaaaacagctggcgcagcagcaacaacagcagattgctcaaatgaacgccgcgagattgcaacaacaacagcaacagcagcagcaacaacagaacaatcctccgcattcgccgatgcctcctaaaagtcctatgatcaaccagcagataatgtcgccgcattctatgccgcaatcgcccatgcagatgccgccgaagagtcccatggtgcctttcaatcccaaccagaatcctaattctccagcggccagaagcccggctttccatcagggcatcaaccagccgacgagtcccatcactcacggccatcaacctcccagttctccgatgcccaggagtccgatgatcaaccaaacgcactctccgcataacgttcggaggcctcccagcgccaacagcagcccggccatgcccgacaggccgcacagcgtagaaaactcttcccctagaatgtactctatagatcaattggtgcaggagagtttggccaatcaaaatgtaaacgcgcagtataattacgcttcggatatgattaatgaaagcggcggagggaattcgaacaacccgataccctgtcccccggagatacccagatttcgttactttaagctcggtttgagaggtggagcacccatgtggagcttcggcagaggtgctaaaagaattccggctcctccgaatgccaaaccggacgaaccgaaggcgaagaaggagtcgcatttgagcaaagtttcgatcctcaaaagaaaaacctcgatcggttctatcggtaaagtgggctcgttagttagttctgattacaacgatttggatgacagttcaacgacgcctccggtaaccccaccgttggcctcgaccagcaggggtatggtgtcgaagaagaagaatctcgagcttcaagcgcaaaaagaatccgtgatcgtcatgcacagtccggacgataacaaacagctcgaaataatggattacgacgacgacaacaatactgttctgtcttcagaagtttctttgagttcagcagctcgaaacgacgacgacttggtggaaatcgaaacgatatcgcaagacctcgccgaagggctatccagcccgttggaatccgatcaaatcggagacgaattcctgttgtttccaggcaatatggtggtggatatgtcaggcgaggggcattactcggagaaagaggaagaagaaaccgaggaattcaccgatcagaacatgcacatcgtgatacgcagcccgacgaccagcgacgacgagttcatcatgccgtgcaaagtcaagcagtacaacgaggacgagcaggaggacaatcccgaatcgccggatcaagaggaattcggcgaatcctccgacatgttgaccggttacgataacgaagaaaccgatattatcctctccgatcaaactaccagcgttcccgaagactcgatatccactaaagaggacttcgaggagctcatcgacgaggggtcacggaaaaacaacatcagcaaacaggaggtgaccgcgaaacacattcaggatttccacaggtacaccgaattgttcgattacggcaaacctgacactcaaacagctaagaaacctgtaaccaaaaaatttcaaccgaaagtgtctgtagttcgaggagtagctttgcctagtaaacccaacaccgagaagattattatcacgcaaaattcgaacgtgttaaacacttctcaggcttcgaaagtgactagcatcattttgactcacaacgccaacgtgaggaggaacattataagcgtgccgaaaatagtgagtaccgtttcaccggctataactatagtgagcgccagtacatcgcaaatggcctcgatattgccttctaaattcacggtgccagtcataagcgccagtgcagtacgccagctttccaacgtcaaagtcatcgataaaccttcctcttcgtccctatcgatttctacgagagataacgtcctgccgaagaagatattcgaggacgattcggtgtctccggatagctctaattgcgaagatgaaaagtcgaaagattcgttcgacgataaagttaaatcggagtctcctccgcaggaaatcaaacagcccgcgttcgtaaaatccgacgctaatccgcaggttatatcgttgaaatcgaaaaactactccgatcaatcgaagaagatcgaacatctccaaatagtaaacatatcttcgaaggacgtggttcaaaggcaaagaataccgagtcccatgatatcgaaggcttctccggtcatcatacacaacacgcccgagttgaaaatgaccgctcaagttattcaagagagccaaactcgcatgaaaattactactactactgatactgaacattacgatgagtctacggacgatacgaagtcggtcgtaatttcaattccctcacctacaccttcgcaagaacaaatgttagatagcatagccttccaagcgctggaaaacaggagaagagaatacgattcaatcgaagacgtattagacatgattgaaaatatagaaaacatcaccgccgaaccgccagagatactagaagaaaacacactgcaaagttccgattccaacagcaatatcgaaaacaaaaacaccgaaacgaaggaattgcaactacctaccagcgaaagcgaaccttctgtcacgaaatcctccatcgtgcctcaattatcgcccctttcccagcccacggaattgaccacgaacatggccaacgcctcgcagcaactcagaactctgctgtcgtcgctacaaaccacctccacgtcgtccccaacgagcgtggagtccatagcgaagagtatcggccagaagatcatcacgtcctcgtcggctaaccagcccatagtcgcttcgagggtgatcagccaacaggccggcaggcaatcgcccgtcgtcaccagcgtctccaccgtcatagtgccgaatttcaagcagaaaatcaccgtcacggcgaccagcacgtccaggagcagccccgtgaaggtggtcaccacctcgcaacaactggcgggatccataataacctcgactctgaattatctaccgaacaggacgatcggtatacaaatggtgccggagcagtcgaaattaccaccggctagcatcgtgactaccatgcaacagatcaactcgattacttccagtcaggagtcgaagaagccttcgttgactcttacggcaatgctgcaaaaccaacccgcggcgaatatgatgaccaaatcatcagctgataccattacagctgctagtttgctaggttcacctatcagtttgccgaaaaccgggttcaccacgtctttggtgcaagcgcaaccgagcgtggtgctttctaacataccgccagcgcctagtcaaccttctgctgtgactaaaaccaccgcggattcgatcacagccgctagtttattgggtaacatcgccaaaagcagtttctcgatgcaaccgagcagcaccgtcggcgtggcgacaagttgccccaacaaaacccctacttccactacgaatttgctacacacgcaactaacgaaagtggtaagaagtaaatcagtcgacgatgttaaagaattggccaaaatcgacgagaacaaaccgaatgttagtaacgaaaacgttgatgatagcagtaatagcgggtgtaagttatcgcaattaactactgctgtttgcaacaaaaccgaggattcgcagaacgtgttgctgaagaaattgctgcaaaatacggcttgtgccagcacgcaatcctccccgcccgcttctaccagcattgtcaccacgagcgctgctaatgctatatctaaagtagctaattccagttctaacgctagcgtagagcaaccgcccgttagcgctccttctatcgttccaatccaaaggagcgcgagcagagacgaattactatccccgccacaagacgtacaaaccatgatagtgattaagaaagagcccccgctcgtgccgctgtcccaacccagtcccgtgatgaattcgaatttaaacgctcacacgcccgaggtaaagaaagaattcatcgacgaatcgtcccagcactctgaagtatccgaccacagcagatctgacgctccaatcaaagaagaactggaaaccatggaaaacgcagcagagaaaatgttgctcgacaaggaggagctgaagaagcagaagcgcaggatgtaccagcagaagcgccgccagaaccagatactcaacaaggagctggcgcaacagcagcctaagaaaaggccgcggaagaattcgaagatcgacgaggactacgacacgtacatcgacggcgtgctggcccagctgaggcaattaccgccgatccaggtctccgagccggtgttgaaccgcaacttcggcgttgtgccgctcttcgggtgcggcgatctgtccaaaatcggcgccaaggactattcgacgcacctgggcgagttgacggggagctacggctacggcgagctgcccggtttcacggatttctactcgacgaaaccgtacggggatatggatcctctgcctgagaaaccgccgtcgtccacgcagcgcggcttctacgaccaggagttcccgctcattagattcgacgcggacgagcacaagaagttcgacgtgttctgcagggaggattcgcccgattcgatattgagcagctcgtctccggagtgcacgcgcgaacccgaaaccaaattcgtcgggttgaagctcatcagcgacagcgaagaggacgaggaagatgatgccaaagaagcggttgcgaaaggaaggatgtcaccggttgttcccgttatcaaacctgtacctattagactgaagcccgcgggagaattgtacttcaaagagagccttaacgagaacaaggagaacatcaacagcgactcgttgcacgtaatgacgaaatccaaattcgacaacaagcagtctccaccggcgaacgtttccggacacgttacagtgactttaactctgacatcgtcggcggccgaagacataatgggcgtgctgagggatttggcgaatattttgcacatacccgcgccgacgagctaccaaatcgtcgagcgaacggcgtcgccgcccagccagaaattgggtttatatcgcaccaaaggcaaggacggtaaagaaggggctccgatcgacatacagagcatcctcaacggcgctacgaagttctgcaagcactgcgacgtgatcattttgagcaatatcatcaggaggaaggtgtccgatttgccgtttctcgccaaagattcggatttactcagcgacggggaggaattgttcttttgcagttcagcttgttacatgcagttcgctttgatgcaccggtcgccttcgatatccgaagataaggctgctgaaattattaatcacctatcgcagaaagacaatttggattcgaagcaaaaattatcctctgcagattcgttggacagcaacaaatcgatagcccagaaattatcttttaacatcaaagattcgaaacgggaattcgagccgatggagacgaacgatgcgttcgcttacttcgcccgtacggctaccaataaacagggtaataacttttacgatggcgctccattcaaaccggtccctgctagggtgcacaggaacgacaggtacaaactctggacgcccgggtgtcttcaacccacccagaaacacaaaacgcccacagataaggagattatggaactactttacaggatgcagatcaccgttacgccttctgtcatgccggaagatactagaaagtgtctgttttgtcacggtattggagatggcgtggctgacggcccggcgaggctgctgaacttcgacgtggataaatgggttcacctgaactgcggcctctggtcggatggagtatacgaaacagtaaacggggcattgatgaacgtcgaaaacgccctacagtccggattactagctacttgcgtacattgccaaagcaacggagccaccatcaagtgcttcaaaacgaggtgctcgagcatataccacttgaattgcgccgtcaaagacaactgcgtgttttacaaaaacaagacggtgttttgtaaagtgcacgcgccgaagaacgaaaaagataacgaactcaccacgctatcggtgtcccgtagagtgtacatcgaacgagacgaaaacaagcaagtagccgccgtcatgcaccattccgattccacggatttactgagagtgggtagtttgatattcctgagcgtggggcagctgctgccgcaccagctgcaaagcttccacacgccgaaccacatctatcccatcggctacaagatcatcaggttctattggagcatgaggaacttgaacaagcgctgcaagtacatttgtaccattagggaggtgtcgggcaagccggagtttcgggtgatgatccaagagcctcccgaagccgacgtggagttctccgattccacgccgaagggcgcctggcagaagatcctggataacgtcgctagcattcgtaaagagaacaactgtttgcacatgttcccgaaattcgccacgggcgaggatttgttcggtctaacggaacccgctatagtcagagtgttagaaagcatgccgggcatcgaaaccctgtcagattacaaattcaaatacggcaggaatcccttgttggagctgccgctcgccataaacccttcgggctcggccaggaccgagccgagactgaggagccagttgcattggaagaaagcgcacactcagagaaccaccggcggtacttcgtcaattcgaccgatgttcggaccgtctctaacagggtctattagtactcccgctcagggcgagctcgcttgtccctacagcaagcaattcgttcattcgaagagttcgcagtacaagaaaatgaagcaggaatggaggaataacgtttatttagcgaggtcaaaaattcaagggcttggtttgtacgctgccagagatttggagaaacacacgatggttatcgaatatataggggaaattattagatccgaattggctgagtgcagggaaaagcaatacgaagcgaggaatcgaggaatatacatgttcagactagacgaagaacgtgttgttgatgctactttatgcggcggtttggccagatatatcaatcactcgtgtaatccgaattgcgtggctgaaaccgtagaagtcgatagggatgttcgaataattatattttctaaacggagaattctaagaggagaagagttggcatacgattacaaattcgatatcgaagacgatcaaaacaaaatatcctgtatgtgcggagctccgaattgtcgcaagtggatgaattaa

SEQ ID NO: 541 - DNA, 4494 bp, Phyllotreta armoraciae
atgggggattctcatcaggattctcaggaaggaaggagtagcaggagaagtaggacgttcaaagccaaggcttcagaaaagtttaagcagttcaagaaaggcgtgaaaaataagtatgagatcggcgaagtggaaaatgtttacgaagttgtcgatgaaaaacagtacattaaagaagttatgtcgagatatgatgatgattggatcgttggtgactccagtgggtatatcgaggatggtagagatatatttgatgatgacttggacgtagaatctgtagctcaagcttcgagtaaaggcaaaggtataaaacgaaagcacaagaatgtatcggaaaatgctggcaagggaaagttgcaacaaatgttttcaaccatgccgactaaacagaaaacggtagcaaaagtcgatgatgacgaaatgctctcggaaatcttgggtgaaatcgattctgatacaccaaatacatctgctgtcgagaaaccaaaaatttcccagtactctacactagcaattaacttatcggctaaggattacatgaaaaatttgtcgcaaccctttaaaaaacgcgccatcgaaaaaaaagtacaaaaagtaccaaaaatacaacccagtgcatccaaaccaatcgaaaatacaaacaaaaaagtaccagttaaaccagtaacagaaaaaatagtacctgttaaaattcaaaatactgaaaaggaggagattgattctgaaaaaaatgcagaaaaagaaaagatagatcctgataaaaatgccgaaaaagaaaagcttgatctagatacatctcactttgatgacgatttggatgaaactctacttgaagaatttaacgaagatctcaatgaaactgtatcccaagtaacagaatctgaaatgaacgtagacgatttcacaggggatatagatacaacagcaatagacgaaattgaggaacgaattaatgttgctggtgaacaactgataaacgatattcaagcagaagtcgaaacggaatggcaatattttaacaatgctaacgaaagctttaaaatagcaacagaaggttcagaagatcccgattcttctgttgaaattacggctgatgttccattcgtaaaagtcgaagggaaaaatgtgtttaggttcttttggtgggatgcttacgtggatccactatatcaacaaggaactgttttcctgtttggtaaaacatactgcgaaacttccaagaaatatgaaagttgctgtgtgcctgtaaagaacatagaacgaacaatatttgttttacctagaccttttgaactagatgagaacggaaagcccacagaaaaaccggtcacgtttaaaacagttcacgatgaatttaacaatcaggttttaaagcgaatgggcattacatctttcaaatcgagattgatcacgaaaaaattcgcattcgatccaagcgtaccagtcgaatccgaatacttagaagtcagatatcctgcttcatttccacggattttttgcaatgatgacgaggaccaaaaagacgatttaagtgacttcgatgatcccagctataaaactttttcaaagatattcggcataaaaacgagtttcttggaatcgctttttctcgaacgtaaaatcaaaggcccctgttggatcgacatatctgaccccgaacccgcaactaatccgatgagcttttgcaaattcgaagtaaactgtcttaaacctaccaacttgaaaatcacccaattcgagaaacctgttcctcctcctccgcttgtagttgccactataaacatgagaaatttcatcaatcgaggatcgtcctatcacgaaatcgtcatgatttcttgtttggtgcaaaatcgatacgctgtgaacaaaccgcctcctgaacccgcttttcaacaccatttttgcgtttttagctgcccgcgaggacaagtcttaccactaaatttgtacgaagccctgcaaaattacaaaataacgaaagtgctgaaaaccgacaacgaaaaggccatgctgaattgcttcatcaacaacatcgtgcaaatcgatccagatctaatagtcgggcacaatttacaaggatatcaaaccgctatcttggcagatagattgctgaaattgaactgccgatcttacaatagactgggcaggctcaagaaaagaacaacgaacacgagacaattggagagaactttgtttttgggacgattagtttgcgacataaaagtatccgcgaaagagctgataaaatccagatcgtacgatttggatacgctctgccaggtcgttctgaagttaaaggagaaccaacgggtggatttggagcctgaggatgtgatcaaaatgttcaaaacgtcacaggatttgattaaactaatttccttcactatgcaagattccgggtatattatgaaaatgatgtacaatctgaacattatacctctggctttgcaaattaccaatatagcaggtaacgtcatgtccaagactttgatgggaggaagatctgaaagaaatgagttcctgctgttgcacgctttccatgagaaagggtatattttaccagacaaggttcttagaaaaaatgaaaacgaatccaaagggagttccaagaagaaacccacatactcgggaggtttggtattggagccgaaagtaggcttctacgacaagctaatactcctgatggatttcaattccttgtaccccagcataatccaagaatacaacatttgcttcaccacgctccccataatggattccgacgaaaatttagtactgccagacagtaatttaccgcccggaatactcccaacagaaattagaaaattagtcgaaagccgtcggcaagtcaaatctctgatgaaaaagccggacatctccaaagatttgaaattgcaatacgacattcgacagatggcgctgaaattaaccgccaactcgatgtacggttgtttgggcttcggacattccagattctacgctaggaatctagcagctctgatcacccaaaagggccgggagattctcgtgaataccaaagatttgatcgaaaagatgtgcttggacgtcgtctacggggatacggacagtcttatgatcaacacaaacattttggaatacgatcaagtatttaaagtcggcgttaaaatcaagcaagaagtcaacaaattgtacaagcaagtcgaactcgatatcgatggagtgttcaagtatttgttgctgttaaaaaagaagaaatacgccgcagtaacgctcgctaaaagcccgtccggcgaattgatagccactaaagagtacaaaggattagatatagtgcgtagggattggtcacaattatcctcagaaaccggcaaattggtcctcgaacatctgctcagcgatcagtcttcggacgaaaaaatacaaaacatctacgatcacttggctaaaatcaaatcggatttgatcgagggtaaaataccgatacctctgttggtgatcacgaagcagctgaacaagtccccgcacatgtacaccgacaagaattccatgccgcacgttcaggtcgccctgcgctacaaccagaagagccgggatcacttcagaatgggcgacacggtgccctacgtgatctgcctcgacggcaccagcaacggccccatgcagcgcgcctatcacctagacgaactgaaggctaacccggacctgaaaatcgactacgactattatttggagcagcagattcatccggtgatagcgagaatttgcgaacccattgagggcttggacgcttaccagttagctgagtgtttgggcgtgaacatgaaacgggtgaagattcccaaacttcaagggggtaaagagaacattcagggcgagaacgtcgttaaagccgaagtaaaattcaagaacgccgagaaatttacgtttgtttgttacatttgtaaacgctacaatatcgtcagcgagccattgatcaacaacattcccttcctggagaagtgtcaaaacgccgactgccaatcgaagcccatcgattacttaccgagcattcaaaatcaactctaccgatctatccgttcgcacataactaaatattacagaaaacttttaacgtgcgaagaccctagttgcccgaactctcccagacgattgcccctgaagttcctgaagaaacgtcccttatgcagcatgtgttgcaacgccgtaatgtataaggtttacaccgaattccacttgtacaaccagctggcttactatcggtacatgttcgatttgagcaaacttaaaaataagcctctgatggatggtgaaaccgaactgggttatcgggcgcttcaagatattgtggataaattcatgaatcaatcggaatactcgctcataaatctgagtgaggtgttcggtcaactcggttgggccgctccgagtcaaaaagttgattcggaagagtcgaaaaccagcatcctttttaacgaagaaggtaatgaagatgcctatgatgatgatgaatga

SEQ ID NO: 542 - DNA, 1398 bp, Phyllotreta armoraciae
atggcggctgctgcagcggcaaaaattgccgaagtacgcgagacaacccgcgtagaaagaatcggcgcccattctcacattagaggcctaggattagacgacagtcttgaagctagacatgtatctcaaggtatggtcggacaagtctcagctagaagagcagttggtattgttttgcaaatggtacgcgatggtagaatagcaggaagagctgttttattagctggacagcctggtactgggaagactgcgatcgcaactgctttagctcatgctttagggcaagacacgccattcactagtatggctggatcagagatatattcattagagatgagtaaaaccgaggcattgacgcaagctattagaaagagtattggagtaagaataaaggaagagagcgaaatcatcgaaggcgaagttgttgatctgagtattgaacgtccagctacaggagttggtactaaagtcggtaaactgattctcaaaactacagatatggaaaccgtgtatgatttgggcggtaaaatgattgatagtattctaaaagaaaaagttcaatctggtgatgttataaccattgataaagctacaggaaaaattacgagattgggcagatcttttgctagagctagagattatgatgctactggccaacaaacgagattcgttcaatgtccggaaggtgaattgcaaaaacgcaaagaagttgtccacacagtgactttgcacgaaattgatgtaattaacagtcgcactcacgggttcttggcactcttttcgggtgatacgggagaaattaaatcagaagtaagagagcagattaatggcaaagtagccgaatggcgtgaagaaggcaaggctgaaatcataccaggcgtactctttattgatgaggttcacatgttggatatagaatgcttctcctttttaaacagagctttagaaaatgaaatgtctccaatcgtcataatggccaccaatagaggaatcacgaaaattcgaggtacaacttacaaatctcctcacggcataccattggacttgctggatcgaacaattattgttcctactcagccatatgacgaaaaggaattgaaagaaatattaaacattcgatgcgaagaagaggactgtcaaatgtctgataatgctttagtggttttaacgaggatctgtaaggagacatctttgcgttacggcatgcagctcatcatgacatcgagtttaatagctagaaagcgtaaagcccacgaagtcgatgtggaggacattaaacgagcctatcaattattctttgatgaaggtcgctctgtgcaatttctcaaagaatatcaacaagaatttatgtttaacgagattgatgagaaagatgatatggaaatggaaacgatttaa

SEQ ID NO: 543 - DNA, 1170 bp, Phyllotreta armoraciae
atggcgttaagaacttacggagataaacccatcagtttccagttggaggaaaatggagagtactactgcgttggatccgaagtaatttttattggtatcttctggatatacttgatgatacgttcgaatttacaggtgggaaattatcttcgactcttcagaggatccctatacaaaaagtaccctggaatgttcaggaggtctataaccaatgaagaaagaaggaggttgattgaactcggtttgagccagcacgttctagcgagtagcgtatcactgcttagagcagaagaagttgaagatataattgaaggaaatgatgaaaagtataaagctgtatctgtacacacttctgaacctcctatgccaagagaaggaaaatccaagaaaaacatgcagtgggtaccttcattacccaattccagtcatttagatgccgttccgcaagctacacccattaacaggaacagagtagctgctaaaaaggtgagaacatttccactatgttttgatgataccgatccccaattaaacatagaaaacgcttgtcaacaagaattgctagttcctattagactggatatggaaatcgaagggcagaagctcagagatacatttacttggaataaaaatgagagtttaataacgcctgaacaatttgctgaagtcctctgcgacgatcttgatttaaatcccttaacttttgtaccagcgattgctcaagcaattagacaacaactcgaagcattcccgacagaacctcccagtattatagaggaaacctgcgatcaaagagtcattattaagttaaacattcacgtgggaaatacttctttagtcgatcaagttgaatgggacatgagtgaaaaacagaataatcccgaagaatttgcgttgaaactttgcgcagaattgggtcttggtggtgagtttgtcactgcaattgcttattcgattagaggtcagctctcttggcaccagaggacttatgcttttagtgaagcaccccttcctactgtagaggtaccattcagaaatcccagtgaatcagatcaatgggctccattcttggagaccctgactgatgcagaaatggaaaagaaaattcgcgaccaggacagaaatactcgtagaattagaagattggctaacactacgccgggttggtag

SEQ ID NO: 544 - DNA, 561 bp, Phyllotreta armoraciae
atgaccaataacaacgtaaaagtaacagtagtcggggatggaatcgtgggaaaaacttgcatgttaagtacttacactacgggcgaatttccagaggaatacataccgacagtatttgaacattatggacaagaaattacggtcgatggtacacattacaatatgactttatgggacactgcaggtcaagaagattatgaaagactaaggcctctatcttatcccaatacaaactgttttctagtttgtttttctgtggacaaaaatctagcctcctacgacaacgtatggttgaaatgggtaccagaagttcggcattttaacccaaacgtgccgattatattagtagcgaccaaaactgatctaagagacgatccgagcctggcttgttactcgaccgaggaaggcaagaagttgaaaagaaaagtcagggcgcaatgctacatggaatgctcggcattgaggtaccaaggactcgaggaaattttcgccgaagccatcagagtgttcttgaagagcaaatctaagaagccaaaggcgaggcactgtcggatattgtag

SEQ ID NO: 545 - DNA, 4017 bp, Phyllotreta armoraciae
atgaatacaaccacttttaatccaagaatggacgccgctcaaaacccggtgcaaaaaatggaattggcgtccaggaacgtggaaaattctttgttaatcgacaacaatgctccgagattgatcgattttatgaatattaatccgcaaagcggttccacagcaagcggttttgctgaccatgattatccaactttaagtggattatcgcatattatcaacagtatgacccaaatcaagtgcgttagcaatgttcctataccttcggaaattgtcgaccattttgcccgtgtacaatgccactgcatgatgggtttattttcagaaataaacagagcttggttaactgttgatagtgatatttatgtatggacttacgaggaaaacaccgacttggcttatttcgacgggataagtgaaacgattgtttgtgtgggactagtaaaacccaaagcaggagttttccacgcctttataaagtatctcctgattttagcgacttctgttgatattgttgtattgggggttactttcactgagcgacctggtgacaacgctgatgaaattcaacttatacctgaccccgtcttcatattacccaccgatggttccactgtcacgataattaacagtaccgatgatgggaggattttttatggtacgaaagaaggaaatttgttcgagattgcttatcaagctgaaagtggttggttcggcaagagatgcaaaaagattaatttatcgaccagcactttgtcgttcctggttccctcatttattaatgcggcattaagtgaagaggatggaataacgcaaatttcaatcgacgacagcagacatattctctatattctgacggaaaaaggatccatagaaatttgcgatctaggagagaaagggaattcattctccagaattagtaaaatctctcaaaacacgttggttaaccaagcgatgaatactgttaaaactctcgacagtcaaaattttcgaccgatcgtgagcatatccgccatcgaagcgtcagaatcggttaatttaaatttagtggctgtgtctcaaacgggagtaagattttacatgaccgttacgagtttgtcgaaccaaaatcccaatcaaagaccatacaccctaaccctagctcacgtaaggcttccgcctggttattcagccaacattactgtacgaccgagggctgtacatgtgtcccagtatagagacagaaacttgatattaatatcaactgttaacgagaaagatgtgttgtggtgtatgagctcggacttatttccattcggccaagggctgactgaagcttacacagctattaatttagacggaccagctctagctatctctgaagtgagaaatgatagtccccttcaaataaaagatatacatgaagcgcctcctttagtcgtccggcaacatgccgaacctccgaaaaagtacattgtcctcacttcgcacagcattcagattttcattaagttaagaccagtagatgtattgaaacaaattttgaaagacagccatgggcaagacaccgaagcgttaaaagctttctttaccattcaaaaagaggatcaagcgtgcgctaccgctttgatactagcttcactggaaaacgaagataacatggacatagccgagtttgcgaccagagctttcttcttattcggaggcgaaccaaaattggcagctccaattaatactttttctggaccgtccgtattctgtccacccgtcatgtctactcctaatatgcatcaatatcatcaacagcaacagcaatttcaaacatcaccgcaataccaacacaactttccgcatggcatttcgcccgcagcaaatgcatacgaattgaccagtccgttcgttttttctcccaagcacaacggcctctatttatatttaggtagaatattaagacctatatggaatcgaagaacagtggataagctttgcttagatggaaaaattgttacaaatcacagtacagtgactagcgaagactgcatatttattttgaactatgtaacgtccctgcataatttcctaacgcgtaatactcagctttcaacgttaagcgccgctcccagtcacaatcctcaaacctttaataatactacgatgaatatgaccagattaaaccataccattcaagacgtccagttagaggaaagggcttctctggatgctttgaaaacattcgtgtgtcactgttgtcaaatattaggtctgtggagaattctttgtgaacatcaattccacacattgatagcttccttgcctgaaactgagcagcagatattgcagaatacaacctttaaggatctgcttttatacagacacgatatctgtacattgttaattgcgacattagtggatagttatttaggtgataacgcctcagtcgattcgattagcagcaaattgagagaagtctgtccgctgttttataaaacggaagatgcagcattttcaaaagctgtcgaaatattaaaaatgacacggacaattcaaaacaacgatgaaaaggaggagatgatccaatcggctctgcagatttgcaaatcaatcggccccactattaatataactgatatatgcaaggaattcgctaatctcaaagcgtataaagctgttacggaattgtgtgcgcatttcggcaagaaaatcgatccggataaaatagcagaaagttactataacgcggaagacaacagtggtgaccaagaagggtacaattattatcaaagaaggttggaaatttatcgtcatattttaaatatgttggatcaattatacaacgaacaaaatcaaacgcaagtcgttagtagagatccagcatactcagttaatcagaccatattactggatggtgtggaacagtctcaagtaggatatgtgatgaagcaagtaataaaagacgttatggaaacgcccgatgaaattatgcacttcgccctttacgattggctagtattcaagaacatgactggagatttgataaacatccaaaatccgtctttggaaacgtatttgaaacgaacatccacccagaaccccaacaacatcgaggccatgaatttgttatggaaatactatgaaagttgtaacaaccacgcggccgctgccaaaattttgaacaacctcgcctcaaggactggcataaacgttcctttgaaagagagactgtcttacctggcgagagctatcatgtgcatgcgaagcgataaaataggttatgcgccgtatcttggtgtatttctgagagatcttgaagataaaatggaggtggcgaaggtgcaagaacaaattttggatgccattgtaaatttgcaaggacaagtacctaacgctcaggaaattataagtgcacttaattctggcttgtacgaaatttcgcagttgtatgaaaatttcgctgaacccttcaaactattagaatgtcaattggcgatcattgaatgcgccggatacaccgatcaagttttgattgagtccatttggcagcaaattttgactgaagaactaaggaaaacctacggaacgggtacagataaagtctgtcaacttttgaacaaagtaaagcagttgtcgaagcaatacgctcagtctgccaactgttttcccttaagttacattgtttatgaattggaaatagtgaacgcaaaacttagaggagacaaacagctcgttccctgtgccttggaaagtatgaatattccattcgaaaatttaatcaacgtttacaatagtttgaatacgatttctataaatgatcatttctggcaattagaggagaacgaatttcatctttctgaagccactgctgcgttaataaattgtttcctgagccatcttgaacagtacagcagtgtggaaaaacgaaaaataacttcactctgtcaagatgcagtggttgctttgctatccaacttgtacagcaagcccaacaccgaagtgttagttaataagttaagaaatatacaagccaaattgtcaagaatttag

SEQ ID NO: 546 - DNA, 4140 bp, Phyllotreta armoraciae
atgagcgaattcactttaagctacagagaagtcactccggaacaaatagatttcgaaaattggaaagaaataacccttactacaggaggaacgcaaagcaccttacaagatataaaagtagccgagaaagccaatggatactgttacaaagactccgctaaacactgcacaaggaatagattcatctattggagaattaatcacaatgtattggaattggtggagcacagtttagatataaatctcacaggaaatcgaatcagatacaagtttgatactccaattttagatggtgtttcgatacacgaggtactcgataacattgttattttggttcctacagtttgcagtgttcacaggctgatatttccccatccaaatgtttttcacgcacaggatgatttactgggcatatatccggatttaacagctttatctatattttcgaaagcatcgatcgtcgataccagaaatccgaacagcttttacgttttcaacaatcccagcactgccaatgatcaattgccgaacctagccaattcgtacttcgtaccggaaaccggggaagcttatttcgttttggcatttccttcgaccgaacttctactaatcaggcaaagtcctgatcaagttacttgtgcagaactcaaaggggaatctttagttcccagatttttcgccggtatcgcagacaaattcaggcacaagaattcggacagcgaaaatattgtgagcttgctattctacgatttggacgaagaaacttacgtactatcgttaacgcaagatgctcatttgaaattttggtcctgcagtaaaggccaatgtgtagcagtaatagatgttcgtgaaaaaataacgaacttgaaatatagagttcagtcggcgattctaaagaaagctgaagatgggaacaattcggaaaatattctggttttattcctaagtttcggaaataaatgccagttccacattttgaaaccttcggttagagaccaagaaatctctctacatagattagccactctcgaatcgcctttgaacgatttgatagatttcgccgcacaaatagattgcttatggtcagtatggcgatcggacgtgggcgaaacagtggtttacatggcatcgttcaaatccaaccgatggacccaagtaatcctggaaaccgaaccgtgcgataaatattttcccgtaaaatacaacgacgtcaagacgctttacttacagcatatttttcatccaggcagattccctctgcacgttattaacaaaactctttcgatatacaaaatgcctacgattggctcggacagccatctgtccatttcagcgctaaagcaaagagtgtgcatggccgtcgaaaatgatatacaaaatctgttcaacaaagacggtactgatgttaacagtgttgaagttgatgaatacgtagagtgtgccgaatggtgttggcaaaagttcgactcctgctgcgtccaataccagatcgccagcaggaaaccgctgggtttgatgcttctaccatcggtatcgggagccatgctgctgaagaaatctgctttttcattcctgcggcccgtcgattcgctggaacacatgactttgtctacggatttgtacagagagcagttcttcaatttctccatgttggccgatgatttggatacggtagaggacgtgataaacgtgttcaaagtgatcgtttacatcgaacaacagttaaaggataatttcatgcaatcgttcgaaacggaacttctcaatctccaatcgcctgatgtcgttatagaagatctgctaaagaagatttatgttgaaatggattcggattttttttcgcacattttgcatctaatcaaagacgtcaacgatttgtacaaagccatacacaaaatcctggagctgctgagatacgaaaacaccttagctaatcccgataatgacattaatccagccgctatgtactatttcaattcgctcttaggcacctcgttagtagcccaaagttttcgacaacaagctgaaatcagatttcaaatttgccgcaatttgttgctcctatgcaacttcttggtgatggacaggacgttgaacgggggcgttttggaaggggttcgatcggtctgtatgccggatattgtcgttttaacccaagccagtttcgtcgtgctctggctaagcggcttgacgatgttcgaaagtgactcgattcgggattcttcaatgagcacgctgaatccgttaaaattaacgcccgtttacaatctgttgccgttcactcgttgcacgtctttattggaagtgtttatatcttcatcgggcgttcaagatgccaggaaatcgttcgctagagtctcttgcaaagacgaagccttggctcgttggcattggtctctgttgccctacgtgaatcacatcaggcatcttatttggcccataagcgggtgtacggtgttcgaggaatggctcttatcgagtggccagcacgtgtggctgcagcagtatgttcggttactcagcaattggtgcgaatggaacgtttgtacacgaaacttcttattggcctcgtcgtttctgacttccggcgaattttacaaggccgaagagctcttcgaaaccgcgtcgaaaggcgtttttaccgacacgtttttgaaaaacagaatcaaaagtgtcgatgaaaataatattagaaccactattcattattatttaaaggtgatccaattattcgagttgtgtaacgctagaagtcatgtgattaatgtggccaatacggctctgtgcgtagtcaaaagggacgatccattagcagctacgttgttttcgatcaaattcaagcatcatttggctttgaagcactaccaattggccttcgactcgctgaattcgaacccggacggcgaacgaaggaaagataatctcagggatttggtgaagacgttgctggacgagaaaaaactgaatgtattgttgaatttcacgtacggaagcatggatgaattcttcgcgaacattgttttgactagagctagagcggcagacgtcatgaataacgtgttttatgatttcttgtattcgtaccaaatcaagaaaggcccaccatctttcagattagccgcttcggctatgtatgagcaagcgtttcgattgagccagaaaaccaccatcgaggccttggagaagcaagtgaaatgctatttagcagccaaaaatgttctacacttgtgcccgacacaacacgcttgggtcgtcaggcctgctgatcccgatgaagaagacgaacaagtcatctttcaacctttagccggctcaaacggggaaatccgtacgttcaaaatcaagaaacaaatcgaagtagtagacatcgaaaccataggaaaagaactaaccttcgccagcgccaaattgaaattgctgcaattcaacccttcggtttccattaacatttgcgaccccttggagctggtgatttcgctaaacaactccggcatgttcaaagtggcctttgagatttgctctacgttcgatttaccctattcgctggtattcgaggcccttacaaaacgttgcgttttactcaccgaagccgaggatcccaacgcttggaattggctggtggagaacgatttgcaagatttgccggttaatagagagtcagctgctgatgtggtttggaaattcctgcaggattgtttggagaagtacgaagagcctaacatgtcttgtttgcataacgtcgtttgcaggaaaattatcaacatgcaaatttacttgcctcattggttgaaagcttcttacaaggctcgaaatccatccgaattgctgaggttgctgcacgcctccgggcgtttggaagaagccgtggaattggccaaagactacattctatcagcgatgggatacggcaacgaggacttcggtttcgcgcagcctttggcaccgacttcgccggctttctgtcttcccgtctacgccatacagcgactcgtcgacgaattggacatgcaaaactccatgaacatcgaaaaacccttcgttcacgagcacgatgatttgaaggtgttgttttcgaagtatctcgaaacggctattagagtttccaatcagatgtgccaggttaagagtaaagctatttaa

SEQ ID NO: 547 - DNA, 2907 bp, Phyllotreta armoraciae
atggaggtctccgacaagaatttagaaactttgagcagatatttgcaagaaactctcaatccggacccgaacgtgcgtagaccagcggaaaaatttctggaaggagtcgaagtcaaccaaaactacccgctgttgctgctcaatctggtgcacaagcccgaggtggacatgacgatcagggtggccggctcggtggcgttcaagaattacataaaaagaaactgggtggtggaggaagatcagacggatcgtattcacgaatccgatcgattggccatcaagaatctcattgtgactttgatgttgagctcgccggagtccattcaaaagcagctcagcgacgctatcagcataatagggaaaaccgactttccgttgaaatggccggaactcatcacggaaatggtcgagaaattttctacaggggactttaacgttattaacggcgtgttgagaacagcccattcgctatttaagaagtacagatacgaatttaagtcgaacgaattgtggacggaaattaaatacgtgctcgagaagttagcgaaacctcttacagatcttttggtcgcgaccataaatttatctcaaacccacgcaaacgacgtggctgcattgaaaataatctacagttcgctagtgctcatctgcaaagtattctactcgttgaatttccaagatttacccgaattcttcgaagataacattcaagtttggatgaccaatttccatacgctgctctccgttgatgttaaagcgctacaaagccaagaagacagcgaagctggtgtattagaacagctgaaatcacaagtgtgcgataacgtagctttatatgcccaaaagtacgatgaagaattccagccgtacttgcctcagttcgttacggacgtttggagcttactagtcgctacaaatttacagcccaaatacgatttgttggtttcgaacgccctgcaattcctttcgtctgtggccgaacgttcgcagtacaggaacctcttcgaggacgataacgtactgagcagcatatgcgagaaagttattataccaaacatggaattcagaacttccgatgaggaattgttcgaagacaacccggaagagtacacgagaagggacatcgaaggctccgatatcgacacgcgcagacgagccgcctgcgatttggtcaacacattgagtcagaacttcgagcagagaatcatagaaatattcgggcgttatttacaagtgatgctggcgaagtacgcggagaatccgaagcagtattggcgcagcaaagacgccgccttgtacttagtaacgtctctagttagcaggggctctactcagaagcacggggtcacgcaaaccagccagttggtggacattacgcagttctgtcggcagcacattttgcccgaattagaacgacctgatgttaacgatttaccggtgttgaaagccgatgctataaagtacgtcatgacgttcagatcggtgcttcccagcgatatagtcgtatcgactttgccacaattaataaggcacatgccgagcgaaagttgtgtggttcacacgtacgctgcgtgcacgttagagaagattctcatgttgaaattcaacaatcagcccattgtgaccggagctcagttggagccgttggcctccgaattgttgaccaatttattcgccgtactccagaaaccggtgtccgaggaaaacgagtacataatgaaggcccttatgagaacgttcgctacgctacaggacaggatcataccctatttgaacgtggctttgcctaaaatgacggaaaagctgcaaatggtcgccaagaatccgtcgaaaccgctcttcaatcattacctgtttgaagccttttcgttggctattaaaatcgtttgcaaggtaaatcccacagcggtaacctctttcgaagatatattgtttccgatatttcaaggaattttgcaacaagatatacaagaatttattccgtacgtgtttcaaattttgtcgttgttaatggagaacacaccacaaggctccttatctgatccctacatgcaattgctaccttgtctattggctccgatactgtgggaacgtccggccaacatcagcccgttggtgagattattagcagctttcgctactcaagctgctccgcagatcgtactgcaggataaagtgggcggttttttgggtgtattccagaaattgttggcttcaaaatcgaacgaccacgaaggttttcgactgatgcaaagccttattcagaatctacctattgaagctcttacgccgtatcacaagcagatatttttccttctgttccaacgattgtcgtctagcaaaaccaccaaatacgttattaatttgatcgtgttcttttgcttgtatgtggtgaagtattcggccaacgatttggtgactttgatcgatgaaattcaagctcagatgtttggtatggttctggagaaactcctaatcgcagaactacagaaaatcgccggcgatgttgaaagaaaaattgtcgcttgtggtgttactaaattactgtgcgattgcccccaaatgtatacgggatcttaccagaaatattggccgcaattgctgcaggcgctcttagcgttcttcgagatgcccagagacgagacaacattccccgatgatcatttcatcgaagtggacgacacgccggcctatcaagcgaccagcgccaaattgaatttcgccgatggtaccaaaaacgatccccttcaaggtgtcagcgagccgcgtcagtttctagttcaaagtttggccactctgggggcttcgcagcccggtcgtttgcccacttacataaacaacatgaatgcccaatcgcagacgatactgcagggctatttggccaagttcggagtccaattggtgtga

SEQ ID NO: 548 - DNA, 600 bp, Phyllotreta armoraciae
atggcaaaagtacaattatgcaatatcacagttatggacaatcctagtcctttcttaaacccatttcaatttgaaattacgttcgagtgcatagaggaattgaaagaagatttagaatggaagatgatttacgtaggttccgctgaaaccgaagaacacgatcaaatcttagactctgtgtttgtaggacctattccagaaggtaaacacatgttcgtctttcaggccgatcctccgaacgtctcccgtatacctgaaaatgatgccattggtgtaacagttgttctgctcacttgctcctacaagagtcaagaatttattcgtgtaggttactttataaataacgaatacagcgatccggaaatgagggaaaatttgcccagcccacctcagttcgataaggtaattagaaatatattggcgtcagagccaagggtgacgaggtttaaaatcaattgggaagaatcaagtggcactcaggaaaacggaaccacaattgccgaagcacccgctaaccaaacaaccgaaacttccgcttcggtagaagtacctgctttcaacgagaattcgaattcgtgggccaccatggagtgttcataa

SEQ ID NO: 549 - DNA, 939 bp, Phyllotreta armoraciae
atggatcaaatgctaccgagccccggttttagtatacctagcataggtacacctcttcatcaacccgaggaagaccagctaattttaccgaacgccatacagcaacaacaaagtctacctactactaactcacaagtgcctcctctagctccaatgggaggttctactccaacacttggtctaggtttaggccatgctatgtccatgccacatacgaagtatgtaactggattttcactgcctatcagttctatgactcctcaaacaccacaacatacaatgatgagtcctatggtaaatgtaggtggaactggtaccactagttccggtgtaacgcctacgttaggtccctctacaccttcaccaatgactcctatgacaccacactcggcagatcctggaatcgttccacaattacaaaacatcgtctcaacagtaaacttgagctgtaaattagatttaaagaaaattgccttgcatgcgagaaatgccgaatataatcctaaacgttttgctgctgtgattatgagaatacgagagccgagaacgacagctttgatattttcgtcgggtaaaatggtgtgtacgggtgcgaaaagtgaggaagactcgaggctagctgcgagaaagtatgctcgaattatacaaaaattgggattccctgcgaaatttttggatttcaaaatacagaatatggtgggaagttgtgatgttaaatttccaatacgattggaaggattggttctgactcacagttcgttcagtagttacgagcccgaattgttccctggtctcatatatcgtatggtgaaaccaagaattgttctgttaatatttgtctctggtaaggttgttctgactggtgctaaagttagacaggaaatttacgaagcatttgataatatttatccaattttaaaaagttttaagaaacaatga

SEQ ID NO: 550 - DNA, 567 bp, Phyllotreta armoraciae
ctggtcctgctgtcagttttggggttattaaagatttttaaagaatcttttatattttatctaccaaagtcccttttcaaagctcataaaatggctgcaattcgttccatgtctcgcctgttattctccagatcattacaaactactgtaaaaaggggttacgctgatcaaatgagcttcacttttgctgctggaaatcaggtcttctatgacgcaaaatctataaaacaagtggatgttccttctttctccggtagcttcggtatcctcccagctcatgttcccactcttgctgttctgaaacctggagtagttactgtttacgaagacggcggtgcagtcaagaaaatttttgtatccagtggtacggtcactgttaatgacgattcatcagttcaaatcttagctgaagaggcccacccagtagaaaatttagatgttagtgcggccagagatcttcttaacaaagcacaaagtcaattgtcatcggccactactgatcaggccagagctgaagctgccattgccattgaagtgggagaagcacttgtaaaagctgctgaatag

SEQ ID NO: 551 - DNA, 966 bp, Phyllotreta armoraciae
atgagcggagatggcagtcaaaacgagcatttcgatacgttatttctatcaatcgcccagcatcatccccaggggcccacgcaactcctggacacttttgtgaacttcctgagcagaaaaacggactttttcacgggcggaaaggaaggagaatgggaaaagctagtattgaatacgttcaagaaatacgagaagtcgagcagggaacaacacgctgccgaattgaaagagaaactcgagcaggaagcgcgtaggaaggcgaaaaaagaggccgaatcggccaaacaggctcaaataaccgaattaacggacgaacaagcggagaaactacaagccgaactcaacgctaaaaagtccccctcatcggcagccccttcgaatagctcaaatactccttcgacttcgaagatcgaagaagacgaagacgagtccgagaagggtaaattattaccgaacaaaggaaacggctgcgatttagaaaaatacaattggacacagacgcttagtgatatagagctgcgcgtgccgctcgaatgcgatttcagagtaaagcaaaaggatctcacggtgaacataactaaaaagcacctcacctgcggcctgaaaggccgtccgcccatcatcgacgacgatttccagcacgagatcaagctggaagagtccaattgggtcatcgaggacgggaaatcgctgctcttcgccatagagaaggtgaacaaaatgaattggtggagcaaaatcgtcaagtccgatccggagattagcaccaagaaaatcaatccggagccttcgaagctgagtgacctggacggtgagactcgcggtatggtcgagaagatgatgtacgatcagagacagaaggaaatgggattgcccacgagtgacgagcgcaagaaacaggacgtgctcaagaagtttatggaacagcatccggagatggatttttccaaatgcaagttcaactga

SEQ ID NO: 552 - DNA, 477 bp, Phyllotreta armoraciae
atgcagtctcccagcggaatggtgcacggttatccccaggcctcaatactacaatggagccctgataaaaaatacagcgatagagaaaggtggatttgcgtttatccagcgtacattaattgcaaaaaaaccatagcccaaggcaggaaattaaacaaagaaaaatgcgtggagaaccccactcatcaagagatcagagacgttttggtcgcagcaggtttgaaggttggcgtagaaaataaattgtacagcagggaacgaagcaaagaattgttgtatcgaggacgaattagagttcaattgaaaaacgacgatggtacactgtgcaatccaaattttgctaccagagatagcataatgctccatttgggagacatgattcctaaattaaaaagtagacaaaacaagggcagtggagatccccaaccgcagaccaccagctcgaaaggaaagggaaaaggcaaaggaaggcgttaa

SEQ ID NO: 553 - DNA, 2196 bp, Phyllotreta armoraciae
atggaagaaccggagcctactaaacgccaaaaaatgcccaaagtggcaaaagtgaaaaacaaagccccagctgaaatccagatcacagctgaacagctattgagagaggcgaaagaaagagacttggaaatccttccgccgccgcccaaacaaaaaatttccgatccggcggagttggcggactatcaattaaggcgcagaaagcaattcgaagataacatcaggaaaaatcgggcggtcatttcaaactggatcaaatatgcccaatgggaggaatcgcaaaaagaaatacaaaggtccaggtcaatatgggagagagccctcgatgtggaccacagaaacattacgatttggttgaaatataccgaaatggaaatgcggaacagacaagtaaatcatgcccgaaacttatgggatagagctacagtacttttacccagggtaaatcagttttggtacaagtacacctatatggaagaaatgttggaaaatgtagccggtgcaagagcagtgttcgaaagatggatggattggcaacctgatgaacaagcttggcaaacttacattaatttcgaactgagatacaaagaaattgatagagccaggcaaatatacgaaagatttgttataacgcatccggaagtaaaacattggattaaatatgcccgtttcgaagaaaatcatggttttattcattctgctagacagatttatgaaagagctgtacagttttatggagacgatcatttggacgaaaagctttacatagctttcgccaaattcgaagaaaaccaaaaagagcacgatagagcgagagttatctacaagtatgctctagaacacattccaaaggatgaaacgaaggaactgtataaggcttataccatccatgaaaagaaatatggagacagaagcggtatcgaggaagttataatgtctaaaagaaaactgcaatacgaacaagaaatactccaaaatcccaccaattatgatgcttggttcgattatctcagattggtagaaggtgaagcagatttggaaacaacccgagaaacctacgagagagccatcgcaaacatacctccatcaaaaaacaaacaatactggagaagatacatttatttatggatcaattatgctttattcgaagaacttgatgcaaaagattatgaacgaactagacaggtttataaagcttgcctggaaatcctgccgcacaaaacattcacattttccaaaatttggctgctctatgcgcagttcgaagtgcgacagaaaaatttaaaagcagcccgtaaaattctaggcatgtccataggaatgtgtcctagggataaattgttccggggttacatagagctggagatacaactccgggagttcgatagatgtcgaaaattgtacgagaaattcctggaattcggtccggaaaattgcgttacttggatgaaattcgctgaactggagactcttttgggcgataccgacagagcaagaggcatttacgaattagccataaatcagacgagattagacatgccggagttgctttggaaagcttacatagatttcgaaatatctcaagaggagcctaacaatgccaggcaaatttatgaaagattgctggagagaacgtctcacgtcaaagtgtggctatcgtacgccaaattcgaattgaacaatccgagtgaggaagatttcaacgtacgtttagccagaaggatttttgagagagccaacgaaaacttgaaaaacttcccagaaaaggaagcaagggtattattgctagaaaattggaaggagttcgaaaacaatcacggcgatgacgagcacaaagaaaaagttaacgctaagatgcccagaaggattaaaaagaggcaaaaggttatcgatgaggacggcgtcgagcaaggctgggaagaagtatttgattatatattccctgaagatgaagccagcaggccgaacttgaaactactagccgctgctaaaaactggaagaagaatactgacgagccggatgaggattccgaaagtagaacaaccctttccagcagtagccaaaggatgaaggaaaagttattagcttccgtgaaaaattggaagaataatgacaaagaaaatagtgattctaataaagatgactgctcaaatgaagaggaagttcagattgacaacaatgaagtagaagattaa

SEQ ID NO: 554 - DNA, 1431 bp, Phyllotreta armoraciae
atgggaattaaatttttggaagttatcaagcctttttgcagtatcctgccagaaattgcaaaaccagagcgaaagatacaatttagagagaaagtgctatggacggcgataacactatttatctttctagtatgttgtcagattcctctattcgggatcatgagttcggattctgcggatcccttttactggattcgagttatcctcgcgtccaacagaggtaccctcatggaactgggtatttctccaatcgtaacatctggcttgatcatgcaactcttggccggagcgaagatcatcgaagttggcgacactcctaaagacagggctctttttaacggtgcacagaaactgtttggtatggttataacggtcggtcaagctatcgtgtatgtaatgacaggaatgtacggagatccagctgaaataggagctggagtctgccttcttatcatcatccaactattcgtggcaggtcttattgtgctccttcttgacgagttgttgcagaaaggatatggtctcggttccggtatttctcttttcatcgctacgaacatctgtgagacgatcatatggaaggctttctcgccggctactgtcaatactggaagaggaaccgaattcgaaggagctgttatcgccttgttccacttgctcaccaccagacaggataagattagaggattacgagaggctttctaccgtcagaatcttcctaatttgatgaacctcctagcaacagttttagtgtttgctatagtaatatacttccaaggttttagagtcgatttgcccattaagagtgccagataccgtggccagcattcgagctatcccatcaaacttttctacacttctaacattccgatcattttgcaatctgctttggtatccaacttgtatgttatatcccagatgttggccgttaaatttcaaggcaacttcttcatcaatctcttaggggtgtgggctgacgttggaggcggcggcccggctaggtcttacccaatcggcggtttgtgctattacttgtctccgcccgaaagcgtaagccacattttggaagatcccgtccacgctgttatgtacattattttcatgttgggttcttgcgctttcttctcgaaaacgtggatcgaagtatccggcagttcggctaaggacgttgccaaacaacttaaagagcaacagatggtgatgaggggtcacagagaccattctatgatacacgaactcaaccgatacattcccactgccgctgcttttggcggtttgtgtatcggagctctgtctgttctcgccgatttcatgggagcaattggttctggaaccggtattttactcgcagttacaatcatttatcaatatttcgaaatatttgtcaaagaacaaagcgaaatgggcggcatgggcgctttacttttttaa

SEQ ID NO: 555 - DNA, 489 bp, Phyllotreta armoraciae
atgtcgatggtttcatcttcagctgttgaattaagttcatatagggatcagcatttcaagggtagtcgagctgagcaggacaagttattaaggctttctacgacgttgtatgtaggaaacctatcattttacaccacagaagaacaaatttatgaattattttctaaatgcggcgacattagacgaatcgtgatgggtctggacaagtataagaaaacaccttgtgggttttgtttcatcgagtattacactcgcaatgatgcggagaattgtttaaggtatattaacggtaccagattggacgatagaatagtacgtacagactgggatgcgggttttatagaaggcagacaatacggaaggggaaaaaccggtgggcaggtaagggatgaatacagaactgattttgactccggcagaggagggtatggtaaaataacccaacaaagaattggacctatggatacgcctagttatttcagaaaataa

SEQ ID NO: 556 - DNA, 921 bp, Phyllotreta armoraciae
atggctgccaccgtaggacgaatttgtggtgtagggctgttaaagccgaataatttaaccaccatcggtcagatcggctcttattcgacggccaaagaatggactagaggtaaaaaagcactgttaggaacattagggatgttagcaggcggcacgggtgccgtattaattgctctcgaccaatccgttaaagcatcggaactagaactgcacccgccgaagaacatctggagccacagcggaatattcagctcgttggaccacgctagcgtccgaaggggtttcgaagtgtacaaacaagtctgcgccgcctgccactcgttgcgtttcgtagcctaccgtaacctagtaggagtatcccacacggagctcgaagcgaaggccgaagccgaggaacagatgatccaagacgggccgaacgatgtaggagaaatgtttatgcgtcccggcaagttatcggactacatccccagcccgtaccccaacgaggaggctgcccgtgcggccaacaatggcgcttacccgcccgatttgagctacattacagctgcgagacacggagccgaagattatatattcgcgcttttgacgggttactgcgaggctccggcaggtgtggtgctcagagaagggcaatattacaatccgtatttccccggaggtgccatttcgatggctcaggctttgtataacgagacgattgaatacggagatggtactccggcgacggcaagtcagctggccaaagacgtgtcgactttcttgaaatggaccgctgagcccgagcacgatgatagaaaaagaatgctgattaaagttataggaatattctcgttcttgttaggggtgacttggtatatcaaaaaggtgaaattcgcctcgctgaagtcgcgcaagatcgaatttaggccaaaaaattga

SEQ ID NO: 557 - DNA, 1695 bp, Phyllotreta armoraciae
atgttggccttacaacaatactcagggagtagcgacgaagaagaagacaaacaaaaatcccccggtaataacgagccctcaactccttcggaatactcgttaaaaggtcagctcgcgatttgcgcagcaccagaagtccttcccaccgggctagaggaagatcaaatgcacatcgacgtagatacgaaagagctagcatttaatcccaagttcgatgtattattcgcaccggctcttggccctgccaatccttttaaaacgcaacaacagttggtagaacgaaacatgctctcgggccacatcgaaagggcccacgtcagtgaatttcagtttgaaaaccaaaggcgaactttcgccagttatggttacgctttggacccgtctgtaactaacgacgggcaaataaaagtggtgggatcttcggaagccgaagaaagtagcattaagactgtattcgaagcttccaaaacgagacctttggataaacgaaaaagaaagaaaaacgacgatccgagtgatgtggacgggtttctaggcccctggggtggattcgtggacgaacaaaaaatatcaaaacccaccgaggaagaacaaatcgaactggacgagatatcgtccaaaaagaataaaaagggtaaacccaacgaagataaacccctcgaagaaaaatcagtcttgcacatcaaagacgccgtggattaccaaggacgttcgttcctccacgcgcctcaagacgtcggcgtcaacctcagatcggacacaccaccggacaaatgtttcctaccaaaggctcacattcacacctggacgggccattcgaagggcatcgctgccatcagattgttccccaggacggctcatcttctgttatcagccggaatggactgtcgtattaaaatttgggaggtctacaatgaaagacggtgcataaggacctactatgggcatcgacaagctgttagggacatcaatttcaataattccggaaagcattttctttctgccggttacgacaggtatatcaaactgtgggatacggaaacaggtcaggttttgtctcgcttcaccagcagaaaaataccctattgcgttaaatttaaccctgataagaacaaacaacatttgtttgtggccggtacatcggataagaagataatttgttgggatacgaggtcaggggatatcgtgcaggagtacgataggcatttgggtgctgtcaatagtattacatttgtggatgaaaatcgacgattcgtgaccacatcagacgataaatcgttgagagtatgggaatgggacattcccgttgatatgaaatacattgctgatcctacaatgcacagtatgccttcagtaactccagcaccaaacggtaaatggttagcttgtcaaagtatggacaacaaagtggtcatattctcttccatgaatagatttaagattaatcgtaaaaagacgttcagcggtcatatggtggccggttatgcatgctccttggacttttcgcccgacatgagttacctaacatctggagatgccgatggtaaagtttacatatgggactggaaatccactaagcttttcaagaagtggaaggctcacgataacgtttgcatcagcgtcctgtggcatccacacgaaccgagcaaactgatatctgctggatgggacggccttattaagtactgggattga

SEQ ID NO: 558 - DNA, 807 bp, Phyllotreta armoraciae
atggtgcagaaaaagcccaagaagaaggtgggaaagaaggtagccgcggctcctttggcagtgaaaaaagtcgagccaaaaaaagaagtcaaccccttattcgaaaagcgacccaggaatttcggaataggccaagacatccaacccccgagggacttgtcgaggttcgtgaaatggcccaaatacatccgtatccaaaggcagaaagccgtcttgcagaaacgcttgaaagttccgccgccgatcaaccagttctcccaaaccatcgacaaacaaacggccactcaattattcaaagtattggagaaataccgaccggaaaccgccttgcagaaaaagaaccgactgaaggccaaagccgaagctaaagtggccaagaaggaagaggccccgactaaaagacccaacactttgagagccggtactaacacagttaccaaattggtcgaacagaaaaaagcccaattagtcgtcatcgcacacgacgtagaccctattgaattggtactcttccttcccgcgctttgcagaaaaatgggagtcccctactgcatagtcaaaggtaaagccaggctagggttgctcgttaggcgtaaaacttgcgcgactgtcgctcttacgcaagtcgattccggagacaggtccaacttcaacaaactcttggaggttatcaagaccaacttcaacgaccgtgccgatgaaatcaggagacactggggaggcggtatcctcggttcgaaatcagctgcccgtattgctaaattggaaagggccaaggccaaggaactcgcccagaaacagggttaa

SEQ ID NO: 559 - DNA, 1065 bp, Phyllotreta armoraciae
atggcaacaataattaaggatataacattacaggaaaacattccacaaaatatacttttcgaaaagcacatcgacttcataaaggaatacggtcaaaaggaaaacaactttgaatatgcaatgaccgactatttgaggatatccggcatgtattggggcctcacggctctcgagttgatgaatgcctcgcctccgcacactatagaagagatttcagattacatcaaacattgtcaagaccccgaaagcggtggaataagctcttgcctgaaccacgaccctcacatactccacaccttgagcgccgtccagatactgtgcatgtacgacaatttaaaagccatcgacgtggagggcgtcgtgaaatacgtgaaaaacctacaattacctgatggtagcttcacgggagacaaatggggcgaagtagacacgagattctcattctgcgccgtcgccaccctgtcgctcttgaacagaatggacgctattgacgttaataaagcagtcgatttcgtagcttcgtgtaaaaacttcgacggaggcttcggctcgaggcctctttccgaaagccacgccggtttaatatactgctgcttaggatttttgtctgttaccaatagattggatattgtggatcgagacatgctggcttggtggctgtgcgaacgacaactaccttcgggcggtttgaacgggcgtccggagaagctgcccgacgtctgctactcctggtgggtgctttcttctctaaccatactgggaaagctgcattgcatcgacgccaacgctttgaagaaattcatattggcctgccaagacactgaaagcggaggcttcgctgatagacccggagacattccggatcctttccacacagtcttcggaatatccgcgctttcattactaggaaacgatacagttcagaaagttaatcccacttattgcatgccccagcacgtcatcgataggcttcagctgaaacctggtgcacgaaacgagcggggtccccactatgaattccacgacgaccggcgagctacaaaagaggtaacgctcgccgggtag

SEQ ID NO: 560 - DNA, 2670 bp, Phyllotreta armoraciae
atgcaccaagaaaccttgcaactaatccaaatattagaaaaaacagtttcacccgacaagaatgaattggagcaagcttcgagctttttggaacaagcatcccaaacaaatttattaggattcataaagaccctgtcagatatactgcggcatggcgggaacagtccggtggccagaatggccgccggtttgcaactgaaaaatcaactcacttcgaaagattcaaccatcaaagccacctaccaacaacgctggctgctattttccgaagaagtcagagactacatcaagaagaatgtggtcggtgcccttgggacggagaccaacaggccatcctcggccgcccaatgtgtcgcttacatagccgtaactgaattaccacaaggacaatggccggatctcatatcgacgcttgttagcaacatttgccatgggaattcgacggaaatgcaaaaggaagctacactcgaagctatcggttacatctgccaagaaatagagtcggacgttttagtttctcaatcaaatgatatacttacggccattgttcacggtatgagatcgtcggaaccgagcaatcacgtacgattagctgcaacgcaggctttactaaactcattggaattcaccaaggctaacttcgatttgaccaccgaaagaaattacattatggaggttgtttgcgaagctacacaatcgccggtgtcgcaaattaaggtggccgctttgcaatgtttagtgaaaataatgtcgctgtattatcaacacatggagccctacatggctcccgctttgtttcccataacgttagaggccatgaaatccgagaacgatgccgtcgccctgcaaggtatagaattttggtcaaacgtaagcgacgaagaagtcgatttggccatcgaagatacggaagctgccgaagctggaagaccccctacgagagtatcgaggcattatgcgaaaggtgctctgcagtacataataccgattattcttcaaaaactaacgaaacaagaggaattggacgacgaggacgattggaatcccagtaaagcggccggcgtttgcctcatgcttcttgccacttgctgcgaagacgaaatcgttccgcatgtgctgccttttattaaagaaaatatcaagtcagacaattggcgtttccgagacgcttccttgatggcattcggttctattctgggcggattggaaccaaacactctgagaccgctcgttgaacaagcaatgccgactttgattgaattaatgtacgacaacagcgtcattgtgagagatacggcggcttggacgtttggaaggatatgcgaaattataccggaagccgccatcaacgagaattacttgaaacctttgctggaaagtctgataacagatttgaaagcggagccccgggtggcggccaacgtgtgctgggctttctccggattggccgaagctgcctacgaagcggccgcagttaacgaggaaactggaacaccggatacgtacattttgtcgccgtactacgaattcattatacagagattactcgagacaaccgatagagctgacggggctcaggcgaacttgagaccggcagcgtacgaggccctgatggagatggttaaaaattccccgaaagactgttacgttacggttcagaaaactacgatggttattttagaaagactgcaacaggtactgcagatggaaactcacattaccagccataatgacagatcacaatttaacgatttgcaaagtcttttgtgcgccacattgcagtcggttttaaggaaagtcactccggaggatgccccgcatatttctgatgctataatgacggccatgctgaccatgtttaattcgaattcttgtaaaagtggaggcgtacaagaagacgctctgatggccgtttcaacgctcgtcgaggttctaggtgaaaatttcataaaatacatggacgccttcaagcccttcctctatatcggcttaaaaaatcaccaagaatatcaagtgtgcggcaccgctgtcggtttgacaggtgatatttttcgcgctttaaaactcaaagctctcccttactgcgacgaaatcatgacgctactattggaaaatctccgagatcaatccgttcatcgtagcgtaaagccgcaaattctctccgtattcggcgacatcggtctcagcattggttcagaattcaagaaatacctggacgtcgtgctgtcgacgttggcgcaagcttctcaagcgcaagtcgaccgaaacgatttcgatatgctcgattatctcaacgaattgagagagggcgtattggacgcttacaccggcatcatacaaggtttgaagggcgacggattgacgcccaatccggacgtaatggtactcgaaccacacattccgtttatcgtgcagtttattatcgtcgtggcgcaggataccgaacattccgatggaacggttgccgtcgcggctggtattgttggagatttgtgcacagccttcggcagcccgatggtgcaattgttggatttggcatcgatcaacgatatgttggcgcaaggtagacgcagtcgcgtcagcagaaccaaaacgttggcgacgtgggcatcgaaagaattgagaaaactaaagatgccggctcctgcggcggcagctgctagctggtga

SEQ ID NO: 561 - DNA, 1503 bp, Phyllotreta armoraciae
atggaaacgattttagaacaacaacgtcgatatcacgaagaaaaagagcgtctgatcgacgccatggtgaaagagatgctccacaaaaaaaacacctacagagaagcgataaattcggaccacaggcaaaagtaccttctagacagatacatgacttccacggagagactgatagatttgtacgaagacaaagacgggcagcgtaaggccgaagtggccgctctgacgggccccaacgaattcaacgagttctacagcagattgaagcaaatcaaagatttctacagaagacacccgaacgagataagcgtaccgatgtccgtggagttcgatgaatttgccaaagcgagggaaaaccctaacgaagatatggctaatttcgtagagtttacagacgaagaaggctacggtaaatacttagatttacacgagtgctacgagaagtacataaatttaaaaggcatcgagaaagtcgattatatcacttacttggctatgttcgatcaactgtacgacataccgaaagaacgaaagaccggcgaatacagaaaatatctgttgtacctcatcgaataccttacgtggttcgtgcaacgcatcaggcctctgatggatctcgatagcgatttacaggaacaagtcgatcaggcgatgggtaattgggataacggaacggtgcccgggtggccgaaagaaacaggctcggctttggccaacgtgggcgcccatttggacctatcggccttctccagttgggaggaattggcttcgttgggcttggatcgtttaaaatcagccctcatggcgctaggattgaaatgcggaggaacgttagaggagcgagcccaaaggttgttctcgacgaaaggcaaaggttctctggacccttcgctcatgacgaagaacagcaagaaccgagtgacgaaggagaaggaagcgctcaggcaaagagaactggccacgttagaagcgcaaatttacagattggccgatctggtgtcagcccaacgagcagccaccaaagagaacgtgcagaggaaacaagcccgtacagacggcgaacgggacgacagcgagaacgaagaaagcgaagaagagagccccgacgaggccgacgacgacgtgccctacaaccccaagaacctcccgctcggttgggacggtaaacccattccgtattggctgtacaaattgcacgggttgaatataagctacaattgcgagatatgcggtaactacgtgtacaaaggccccaaggcttttcaaaggcattttgccgaatggagacacgcgcacggaatgcggtgtttgggcataccgaatacggctcatttcgctaatgtcactcagatcgaggacgctttagccctgtgggaaaagctgaaggtgcaaaaacaaagcgaaaggtggcagccggagactgaggaggaatacgaggattcacaagggaacgtagtgaataggaagacgtacgaagatttaaaacgacaaggtttattgtaa

SEQ ID NO: 562 - DNA, 639 bp, Phyllotreta armoraciae
atgacgataggaaagaataataaaatgatccaacacataaactatagggtccgaataacattgcaggactctaggacgtttatcggcaccttcaaagctttcgacaagcatatgaacatgatactcggcgactgcgaagaattccgaaaaattaaacccaaaaactctaaagtcgaacgagaagaaaaacgggtattaggatttgtattgctgagaggcgagagcatagtctcgctgaccgtagaagggcctccaccaccagaagagggacttcccagagtacccattcccggagcagcccaagggccaggtataggaagagcagcaggtaggggaatgccacccggcatggctggagttccagtaggtctccaaggtcccgtgagaggagtcggaggaccgtcccagcaagtaatgacacctacaggtagaggacaggtctcagcgccgccacaaatgaaccaagcgcctccaaggatgggtggccctccgcctggcatgatggggcctccgcccggcatgatgggcatgccgccccaaatgggcatgggccgtggagggccccctccgatgggcatgaggggtcccccgcccggtatgatgagaggcgggccgcccggaccgccgagaccttattaa

SEQ ID NO: 563 - DNA, 387 bp, Phyllotreta armoraciae
tttccacattgtataggagcgatcgatggaaaacatattagattgataagacctgcgaatagtgactctatgttcttcaattataaacaatatttttcaatggtgctttttgcaatggttgatagcaattatttatttacatttgtcgacattggctcatatagaaaatctagtgactctggaattttcaaaaatttcgcactatatgaaaaaatgttaaatggtacactgaacatacccacagcaacgcccatcgaaggagatttggtagaatatccatttgtaatcgtaggagatgaagcctttcccctatctgaaaatttgcttagaccctatggcggaacaaatttatcttttgaaaaaagaattttcaattatagattataa

SEQ ID NO: 564 - DNA, 15711 bp, Phyllotreta armoraciae
atggaggaattaacctcgggtttggatcccgacgatttgatggatctagacgagccagaagggtccgatttggaagaggacgacgaggatctcatcgatgatcacgtctcgtcgcctttcatctcgtcctcggcgccggaatccacggccaactccgtcgcctcctctccgatccacgaagacttccctccgcccttcaatttcaccgggaaacctctacacgttaaacgcggaagaggaagacccagaagagaaggaggtaagccttcggcgccgagaacgacaaggggcggtggaactggagtgtcgagagtacgtaggccgagacctccgggtttttcgagaagaggatcgttaggaggaagtagaagtgttaggcaagtagacagatcggattacgaaatgtctcttttcgccggctcgccggtggatgacggtttgttggatcccgagacgggttcgatgatctttcccgagaagtttgttcctgcgatcgaggagcctccgtattttccggagcattggccagggaaagtttgtgccttgtgtaatttaggtgaacggagccagctaggacaaggtgaaatgctaaggttaaattgtcccgaaggattctcgccggagaaagttattagtgagcaaatattagaaagagccttgcaagctccagataaagaatgcggggataaaagcccgaaaggtcctgtgacatgtagaaggcaaaaaagtttcaataaatgcagacatccttcgataaccagtgaatacgttgatgaattaactataattggatataatgaagtacctgatgtatctagtttgtttgaacccaatggacagttttacgttcaccgtaattgtgcgttgtggtctaatggagtaacgaaagcagaaaattcggcgttgttgaatgtagggcctgtagtttcgcaatgttcttccaaaaaatgttccttctgtaatcattacggagccagcctgacctgccacgttgacaaatgtaccaaaatttaccactttccttgtgctactgctgctggtgcctttcaggacgtttcttcattgacaactttgtgcaacgaccatttaggacaagtggccgtgctcactaacgcatctccatgtttaacttgcgcatctatgggagatatagcaaatttgatgttttgttcgggttgcggcgcgcattatcatggaatttgcgtgggattagctcagttgccaggcgttagatctggctggcaatgtagaaaatgccgttgttgccaagtttgtcgagtcgttggagacgagtctaaactgatgacttgtgaacaatgcgataaaatttaccatgctagttgtcaaagaccgatagttacttcaataccgaaatacggttggaagtgtagatgttgtagagtgtgcggcgattgcggcgcgcgaactcccggagctggtttatcttcaagatggcacgctcactatacagtatgcgattcttgctaccaacaaaggaataaagggttttcttgccctgtatgccataaagcttaccgagctcacgcacatagggaaatggtccagtgttcgagttgcaagaagtttgttcatggaacctgtgatcctgaagcagacgttgtcacctacagtcaaaagaaagaaataagcgtggactacgaatacgtatgcttgcattgcaaaaacagcacagccagacaaataactgcgaaaagagctagtatcgatgatccttctgatgtatctgcttctcatgattccctgtacgacgatacgtccgaattggatcttccctcgcccgatgagttcgccagaaacatgggtttgggaaaaggaaagccgtatagcgcgaataaaatagccaaaaagcgccttagcttcaccgtgaatccggttggcaggccgaaaggcaccggaaaagtgcctcccgggaaaatgggctttatgaaacggtaccgattaacagagttcaacagaaaacgcggccccaaagccaaaatgaggggtattttcggcgtgcccggcgtcggtctgcaaagaccgatttcagacgggaaaaccgatgaagaaccaggagtcgaaaatcgattggtactctgttcagctaaagataaatttacgctcacgcaagatatttgcgtaatgtgcggggcatttggaaccgatcaagagggttgtttgatcagttgcgtacaatgtgggcaatgttaccacccctattgcatcaacgttaaagtaacaaaagtgatcctacagaaaggttggagatgcttggactgcacggtttgcgagggctgcggtcaacgaaacgacgaaggccgtctgatcctctgcgacgactgcgacgtgtcctttcacatctactgcatggacccgccactcgactacgtgccgcacggcaactggaagtgcaaatggtgcgccatctgccaatcctgcggagccaccgatccgggtttcaattgcacgtggatgaacagctcgacccaatgcggcccgtgcgcttcgcacgtgaattgccccagctgcaacgagccctacggcgagggcgatttgatcatacagtgcgtgcagtgcgaaagatggctgcatggagcttgcgattttattaaatgcgaagaagacgcagagaaatgcgccgaagaagggtacaattgcattttatgtagaccgagagacgtgccaccgccgcatatggttcctgctgcagttaccccgaagcctccgactccgacgaagagtcccgagctgggcaagagtaccagctactacatggacggcgtgtgtctcagcgaattcggcagtaatttgatcaaatcattggcgctcgaatatcacggatcgaggaagaaacggaaaaagataccaactgtacaagataaggaagccggtatcatggctacgattgaatctgttgttgccggaggaaatattattcctactaatatggaagacagcgctaaactagagctcgtcgacatcaaagacgagcctcaagagctgtacaaggagggcatgatgtggactaaagaggacggtcctcctcccgaaggttttacgataataacgatggagaacgggttgaacgtgctgcgaaggaagagacaacgcaatctgcagaagctcggcataggcgggttcgtcgtcaggatgagaggtatcagaacgggtcaggataacgatgatgtggattcgaccatcggtcaaagtgggctcaacgccaacgacattgttccatcgcctgcagacgtcgataaacccagaaggaaagctattcgacgaaagccgaagagtaaattagctgaaacgtttcccgcctatctccaagaggctttcttcggaaaggacctcatggacacagtggattgtaaaaaagaagaagtcgattgttatagcagcgatgaggagaaaacggacaagcattataaatccattaatttgtctcaggatgaaataatagcaatcgtggcatcgggtaaaaccgaaaaattggaaaacaataacaaagattcgaccaaagaagtcaaaccaactgtattgaaagaggaagaagaagataatccggaggatttgaaagatgttcttgccttaccgggcgatttgctcgataccgatttggttaatagtattatggaagatgaggaggaactgagcaaaacgactgcatctcttgttgctttagattcaaatttaccgcatgatacggagctaacggacactctgagtagttcaggaaattcaaaagaaaccaaagatgaattgagcgacattttaggccctcatttcaacctcgattccatatcgaacataaacagcaaggacgtcgaagatatatttaagggcgtgttaacggatgagtcgcaagaatcccaagaaagcagcaacttttccttacaaggaaacagtatgttctcgaacaataatgctcaacagaccgttgcccaacaccccattattaatcaaccagtgagaccgaaaactttgcctactgttaaccataatttgaattccccggtcagttttccaccaccgtcaccctatcactcggagtacagcaacagtcctcaatttagtcctgccttcaccgaatcgtcgtgttcgtgggtaagcgggaacgaaacgccggaaattgatagtacgaatgtaacggtgacgtcgacgtacaatcagaggtcctccgataaaatgaaagccgatgaaagtttgggcaaaagcgctacgatttcggctgttttatacgcgaatatcaaccatcctgaatggaaaaaggagtacccgaattggcccgataggtacaagcaaataataaaaaaatggagaacgttgagtcaagaacagaaagcgccgtttttgcaacacgcaagagataataggagtcaattgaggatgaagaaagcgcaacagtcacagaccgtcaaggaaaccgcctctgccgccacgtccccgaacgcgagcaagcctcttcaccaagccggccaagccttagtgacaactctccaggcggtaacgcaacagccggcgggggttcccgcggcccccgcggcgcccgtttcagaggtgtgcactcaaacgaggccaacactaacaccggcttccgttagctctgtgtctgtgccaaccccatcacctaaaccaccttccccgaccacccatcagcaatttaccgtgcacggcagtttcgccgggccgggggaccgcgtcgggcccgcgcccaacgtaacggtcaatcctcattaccaacctaacggcgaaagcgccgcgccgcaccaccccagattaattgcgcagagtagcgcgtcagatcagcaaattcgggtattgactccctcagagatcatgcgtacacttccttccctctatcaggaaaattatgagcctcagggatcggaccaggaaaaaatcgccctccaacaaaaatcagccagggaagcagaacaggaaagacaatggaagcaattgcaggccctcaggcaacagcaaacccaacaaacccagaacatcctgcacgaacagcgcgtacaagccattgctcgcgtacaacgtcagatatcaaccgatcccgcgcaacagttcataaacgagcagcagagcccgttgcaggtgaacacgcctcaggaattgagcccttcgactacaccggcccccagtccccgtcaatttctcggcattaaatccccgacgttccccgtcccctcgcctatccaacaaactagcgtcagggccaacacgccctcacaatcgccccacgacgtctcccaaccgagcacgcccgacggtaacgatcactttatccattcccccaccaatcctaaacctaatttccaacctagattgcccaacgatccgttcgccgcgcaacccgccacgccgcgaccccaattcggaatggcccggccacctctacagaacttcggcggtaccgttcgcaacgagcaacaggacatcaacatcaatcgccaattgagggagctgttgcagcgacagcaggttaagaagctggatgaattgttgcccggcaaagcgccacctcagaggctgtggcacgctaatgatcagcaggagggtagcgatgcttcgatgacgtcgcctgtagctcaaggcgcccagagtgctcaaggcgctgacgccaccttccggcaacctttaccgcccggcgttgtcaaacctaggctggcgatttcttcagttaacaggccgatattgaacgctgttagagtcaatcaattggatcccagaattcaaaatttggatccgaggatgaggttgattttacaacatcagcaacaaaggctcgccacgggtattcagcagcaattcatccgtttcacgtcgaacgtgcgaccgacgaccgtggaacagtacgagcaactgttgcagcgtcagggtaataatcagaatcaaattcacgcggaggaacagcagcagggtgtcgcgcgaatacccataacgcaggccagcgttatacaaaggcctcacgtcgctcaggctgtggtgactggcgctgctgctgctacaaatagttccacagaaagtaatcccagcgaagagggaatcccggataatgtcacagctgaattggagaaactggaacaggaaacaggtactatggtagagcttcaaggcgtgagcgatattttgggcggtttggacgacgacgacgagcttctagccgaaatgggcgcggatttcaacatactcgaatacgctgatcccgaattagaagccttgacgggcggaaaaacgaacattttagacctggagctcgaagaggaaccggtcaaaaaagaaaaactagcctcaaacgcgaacactagcgctccttctcaaaaaccgacgcctaacgtcgccactacggccactagcaacagtacagctgttactacaccgaccgaagccaatacggaacccaaaattgacaatacgattcaacagaacattccgaaaacggtgcaagcggcgcctcaacagctacaacatcccgcttctctgccacagcagcagaacatgccccagcacggcgctcaggttcaagtgcaatcccaacagtctcagccgcatccgccgcagcaaatgcccattcaatcgacgctgcatatccagcagattcaccagcaaatggtgcatcaagtgcaacaagcggctgctcaaggaaggccgatgcctccgggttcgaagatgcaaactactgatgggttcgttggcgtcgtgatggcgaacaacgccgtgcaattgcagattcccccgaattatcaacaacggttgcttcttttgcaacaactgcaaaatcagaagttaatgcgagttggaagcactcagccaagggcagctttgcaagtggcccctaatcaaatacccgtaggtatgaatccgggacctaggatgccggtttcggcaccgccgccgcctccgccaccttatcccggcccgcccccgccttatccgggaaacgcgaatcaacatcagcaggaacaaccgctgttattggaagatctgcttgagcaagagaaacgcgagcaggagaagctgcaaaaccaaccgcctaaccacgaagtcacctcttccaccggcaacgaaaccgaatctgcgctcatgagcgaccaagacttcgaacgtctcaaagcagacgtgttcaacagcgctcccgtaaataatatatcctctacaaatcaagggaacgccgggcaaacgtcgcaagcgtggcctcagttgcaaaaccgtcaagcggtggttcccgcggccgcttctcagcacaccatggaagtgacgactagagtacaaatgtttaacccgaatttggtaccggcgccgcctcttccgccggagaatatcgccaccgagcaggataagcaggcgcagcttttgtacgagcagtggctgaaccatcagaacaacacgctggtgcagcaattgcgctattatgagaccgaagtgcagaaacttcgtaagagtaaaaagtcgttaaatagtaagcaacgccagttgaggaaagctggtaatcagttgactgaggtagatgctactgagcttcaaagaatcacagctgaacaggctatattacaaaagcatctggaatcgagtagaaaacaaaatcgccaacacggaatgttgatacaggaatatagaaacaagcatcccgctatcaagcagcgaaccggaactgatcagatccaatcaccgttgggccatccggcttcttcgcccatacaacaatcgagcgcttcgttatcgcccatgttatcaccatctgtctcgccgatgacccagaacagttcgcctttgaacagccccgggccgatggtgccttcttctcccggccacggtcccgttcagaacattttacagagccctaacggcgccaacgcggctcaaatgtctccgatgcaatcttcgcccagaataggaacgccccattcccaaagtgatgagagtccagggtcggcgcaatcgccttcgcaagtatgcctgccgccgcccatgcctagaatgacgtcgcctcaacacagacgagtcgtgaccagtccggtgggaatgtcgcaaatgcgttttatcaacaacaacatgttgcagcaacgcgttcgcatgcaatcgcccatacaaaattttcaacagaaacccggcacgccttcgccgttgaacagcccgacgtcccaacagatgagcgtcaaccagcaacatcaaatccagaagcagctccagcaacagcagcaacaacagacgttgttgcagcaaaatttggagggcgatcctaacgccattcactcgcagagaaccacgcagttgttgcagcaccggaattttatcaggcaacaggtgtcccagcagcaaatatcgcctcagacgttgaccccgcaacagcatcagttgatgttgcaacagcaaaaacagctggcgcagcagcaacaacagcagattgctcaaatgaacgccgcgagattgcaacaacaacagcaacagcagcagcaacaacagaacaatcctccgcattcgccgatgcctcctaaaagtcctatgatcaaccagcagataatgtcgccgcattctatgccgcaatcgcccatgcagatgccgccgaagagtcccatggtgcctttcaatcccaaccagaatcctaattctccagcggccagaagcccggctttccatcagggcatcaaccagccgacgagtcccatcactcacggccatcaacctcccagttctccgatgcccaggagtccgatgatcaaccaaacgcactctccgcataacgttcggaggcctcccagcgccaacagcagcccggccatgcccgacaggccgcacagcgtagaaaactcttcccctagaatgtactctatagatcaattggtgcaggagagtttggccaatcaaaatgtaaacgcgcagtataattacgcttcggatatgattaatgaaagcggcggagggaattcgaacaacccgataccctgtcccccggagatacccagatttcgttactttaagctcggtttgagaggtggagcacccatgtggagcttcggcagaggtgctaaaagaattccggctcctccgaatgccaaaccggacgaaccgaaggcgaagaaggagtcgcatttgagcaaagtttcgatcctcaaaagaaaaacctcgatcggttctatcggtaaagtgggctcgttagttagttctgattacaacgatttggatgacagttcaacgacgcctccggtaaccccaccgttggcctcgaccagcaggggtatggtgtcgaagaagaagaatctcgagcttcaagcgcaaaaagaatccgtgatcgtcatgcacagtccggacgataacaaacagctcgaaataatggattacgacgacgacaacaatactgttctgtcttcagaagtttctttgagttcagcagctcgaaacgacgacgacttggtggaaatcgaaacgatatcgcaagacctcgccgaagggctatccagcccgttggaatccgatcaaatcggagacgaattcctgttgtttccaggcaatatggtggtggatatgtcaggcgaggggcattactcggagaaagaggaagaagaaaccgaggaattcaccgatcagaacatgcacatcgtgatacgcagcccgacgaccagcgacgacgagttcatcatgccgtgcaaagtcaagcagtacaacgaggacgagcaggaggacaatcccgaatcgccggatcaagaggaattcggcgaatcctccgacatgttgaccggttacgataacgaagaaaccgatattatcctctccgatcaaactaccagcgttcccgaagactcgatatccactaaagaggacttcgaggagctcatcgacgaggggtcacggaaaaacaacatcagcaaacaggaggtgaccgcgaaacacattcaggatttccacaggtacaccgaattgttcgattacggcaaacctgacactcaaacagctaagaaacctgtaaccaaaaaatttcaaccgaaagtgtctgtagttcgaggagtagctttgcctagtaaacccaacaccgagaagattattatcacgcaaaattcgaacgtgttaaacacttctcaggcttcgaaagtgactagcatcattttgactcacaacgccaacgtgaggaggaacattataagcgtgccgaaaatagtgagtaccgtttcaccggctataactatagtgagcgccagtacatcgcaaatggcctcgatattgccttctaaattcacggtgccagtcataagcgccagtgcagtacgccagctttccaacgtcaaagtcatcgataaaccttcctcttcgtccctatcgatttctacgagagataacgtcctgccgaagaagatattcgaggacgattcggtgtctccggatagctctaattgcgaagatgaaaagtcgaaagattcgttcgacgataaagttaaatcggagtctcctccgcaggaaatcaaacagcccgcgttcgtaaaatccgacgctaatccgcaggttatatcgttgaaatcgaaaaactactccgatcaatcgaagaagatcgaacatctccaaatagtaaacatatcttcgaaggacgtggttcaaaggcaaagaataccgagtcccatgatatcgaaggcttctccggtcatcatacacaacacgcccgagttgaaaatgaccgctcaagttattcaagagagccaaactcgcatgaaaattactactactactgatactgaacattacgatgagtctacggacgatacgaagtcggtcgtaatttcaattccctcacctacaccttcgcaagaacaaatgttagatagcatagccttccaagcgctggaaaacaggagaagagaatacgattcaatcgaagacgtattagacatgattgaaaatatagaaaacatcaccgccgaaccgccagagatactagaagaaaacacactgcaaagttccgattccaacagcaatatcgaaaacaaaaacaccgaaacgaaggaattgcaactacctaccagcgaaagcgaaccttctgtcacgaaatcctccatcgtgcctcaattatcgcccctttcccagcccacggaattgaccacgaacatggccaacgcctcgcagcaactcagaactctgctgtcgtcgctacaaaccacctccacgtcgtccccaacgagcgtggagtccatagcgaagagtatcggccagaagatcatcacgtcctcgtcggctaaccagcccatagtcgcttcgagggtgatcagccaacaggccggcaggcaatcgcccgtcgtcaccagcgtctccaccgtcatagtgccgaatttcaagcagaaaatcaccgtcacggcgaccagcacgtccaggagcagccccgtgaaggtggtcaccacctcgcaacaactggcgggatccataataacctcgactctgaattatctaccgaacaggacgatcggtatacaaatggtgccggagcagtcgaaattaccaccggctagcatcgtgactaccatgcaacagatcaactcgattacttccagtcaggagtcgaagaagccttcgttgactcttacggcaatgctgcaaaaccaacccgcggcgaatatgatgaccaaatcatcagctgataccattacagctgctagtttgctaggttcacctatcagtttgccgaaaaccgggttcaccacgtctttggtgcaagcgcaaccgagcgtggtgctttctaacataccgccagcgcctagtcaaccttctgctgtgactaaaaccaccgcggattcgatcacagccgctagtttattgggtaacatcgccaaaagcagtttctcgatgcaaccgagcagcaccgtcggcgtggcgacaagttgccccaacaaaacccctacttccactacgaatttgctacacacgcaactaacgaaagtggtaagaagtaaatcagtcgacgatgttaaagaattggccaaaatcgacgagaacaaaccgaatgttagtaacgaaaacgttgatgatagcagtaatagcgggtgtaagttatcgcaattaactactgctgtttgcaacaaaaccgaggattcgcagaacgtgttgctgaagaaattgctgcaaaatacggcttgtgccagcacgcaatcctccccgcccgcttctaccagcattgtcaccacgagcgctgctaatgctatatctaaagtagctaattccagttctaacgctagcgtagagcaaccgcccgttagcgctccttctatcgttccaatccaaaggagcgcgagcagagacgaattactatccccgccacaagacgtacaaaccatgatagtgattaagaaagagcccccgctcgtgccgctgtcccaacccagtcccgtgatgaattcgaatttaaacgctcacacgcccgaggtaaagaaagaattcatcgacgaatcgtcccagcactctgaagtatccgaccacagcagatctgacgctccaatcaaagaagaactggaaaccatggaaaacgcagcagagaaaatgttgctcgacaaggaggagctgaagaagcagaagcgcaggatgtaccagcagaagcgccgccagaaccagatactcaacaaggagctggcgcaacagcagcctaagaaaaggccgcggaagaattcgaagatcgacgaggactacgacacgtacatcgacggcgtgctggcccagctgaggcaattaccgccgatccaggtctccgagccggtgttgaaccgcaacttcggcgttgtgccgctcttcgggtgcggcgatctgtccaaaatcggcgccaaggactattcgacgcacctgggcgagttgacggggagctacggctacggcgagctgcccggtttcacggatttctactcgacgaaaccgtacggggatatggatcctctgcctgagaaaccgccgtcgtccacgcagcgcggcttctacgaccaggagttcccgctcattagattcgacgcggacgagcacaagaagttcgacgtgttctgcagggaggattcgcccgattcgatattgagcagctcgtctccggagtgcacgcgcgaacccgaaaccaaattcgtcgggttgaagctcatcagcgacagcgaagaggacgaggaagatgatgccaaagaagcggttgcgaaaggaaggatgtcaccggttgttcccgttatcaaacctgtacctattagactgaagcccgcgggagaattgtacttcaaagagagccttaacgagaacaaggagaacatcaacagcgactcgttgcacgtaatgacgaaatccaaattcgacaacaagcagtctccaccggcgaacgtttccggacacgttacagtgactttaactctgacatcgtcggcggccgaagacataatgggcgtgctgagggatttggcgaatattttgcacatacccgcgccgacgagctaccaaatcgtcgagcgaacggcgtcgccgcccagccagaaattgggtttatatcgcaccaaaggcaaggacggtaaagaaggggctccgatcgacatacagagcatcctcaacggcgctacgaagttctgcaagcactgcgacgtgatcattttgagcaatatcatcaggaggaaggtgtccgatttgccgtttctcgccaaagattcggatttactcagcgacggggaggaattgttcttttgcagttcagcttgttacatgcagttcgctttgatgcaccggtcgccttcgatatccgaagataaggctgctgaaattattaatcacctatcgcagaaagacaatttggattcgaagcaaaaattatcctctgcagattcgttggacagcaacaaatcgatagcccagaaattatcttttaacatcaaagattcgaaacgggaattcgagccgatggagacgaacgatgcgttcgcttacttcgcccgtacggctaccaataaacagggtaataacttttacgatggcgctccattcaaaccggtccctgctagggtgcacaggaacgacaggtacaaactctggacgcccgggtgtcttcaacccacccagaaacacaaaacgcccacagataaggagattatggaactactttacaggatgcagatcaccgttacgccttctgtcatgccggaagatactagaaagtgtctgttttgtcacggtattggagatggcgtggctgacggcccggcgaggctgctgaacttcgacgtggataaatgggttcacctgaactgcggcctctggtcggatggagtatacgaaacagtaaacggggcattgatgaacgtcgaaaacgccctacagtccggattactagctacttgcgtacattgccaaagcaacggagccaccatcaagtgcttcaaaacgaggtgctcgagcatataccacttgaattgcgccgtcaaagacaactgcgtgttttacaaaaacaagacggtgttttgtaaagtgcacgcgccgaagaacgaaaaagataacgaactcaccacgctatcggtgtcccgtagagtgtacatcgaacgagacgaaaacaagcaagtagccgccgtcatgcaccattccgattccacggatttactgagagtgggtagtttgatattcctgagcgtggggcagctgctgccgcaccagctgcaaagcttccacacgccgaaccacatctatcccatcggctacaagatcatcaggttctattggagcatgaggaacttgaacaagcgctgcaagtacatttgtaccattagggaggtgtcgggcaagccggagtttcgggtgatgatccaagagcctcccgaagccgacgtggagttctccgattccacgccgaagggcgcctggcagaagatcctggataacgtcgctagcattcgtaaagagaacaactgtttgcacatgttcccgaaattcgccacgggcgaggatttgttcggtctaacggaacccgctatagtcagagtgttagaaagcatgccgggcatcgaaaccctgtcagattacaaattcaaatacggcaggaatcccttgttggagctgccgctcgccataaacccttcgggctcggccaggaccgagccgagactgaggagccagttgcattggaagaaagcgcacactcagagaaccaccggcggtacttcgtcaattcgaccgatgttcggaccgtctctaacagggtctattagtactcccgctcagggcgagctcgcttgtccctacagcaagcaattcgttcattcgaagagttcgcagtacaagaaaatgaagcaggaatggaggaataacgtttatttagcgaggtcaaaaattcaagggcttggtttgtacgctgccagagatttggagaaacacacgatggttatcgaatatataggggaaattattagatccgaattggctgagtgcagggaaaagcaatacgaagcgaggaatcgaggaatatacatgttcagactagacgaagaacgtgttgttgatgctactttatgcggcggtttggccagatatatcaatcactcgtgtaatccgaattgcgtggctgaaaccgtagaagtcgatagggatgttcgaataattatattttctaaacggagaattctaagaggagaagagttggcatacgattacaaattcgatatcgaagacgatcaaaacaaaatatcctgtatgtgcggagctccgaattgtcgcaagtggatgaattaa

SEQ ID NO: 565 - DNA, 2064 bp, Phyllotreta nemorum
atgcctagagaggcttcacttgaaaggcacaaacacaaaagccacaaaataaagaaaagccggtccagtagccgttccgaacgtagtcaagaaaaacgcaaacattcatctagctcaaagaaaaagagtagtttccacgaagatgccgaccgaaagaaaaagaaaaagcgatccaagagctcttcctcctcttccagtgaatccgaatctaccagcagcgaaagttcaggtaaatcggtggaactactaaaaaaactcgaaaaggagagattgcgattagctgaagagaagaagaaggaaaaggagcttctcaaagctacggaaacggccgaggagaagagattgagaagattgatgaagaaagaggcgaaggagagaagacgaaaagaaaaaatgggatgggacaacgaatacttacattacacgaacagcgacaatccattcggagacggaaatttactgaccacattcgtttggaacaaaaaattgtcgaaagagggcatcaaaaacgtcggccatgaagaaatcgaagccataaatcgattaaaacaagaagagaataaaagggaactggaaaaagtcaaaaaacgaagattagaaagagaattggagaggcaaagaagagaagaagaaacgcaaatgatgcaaagaacaaaagaagcagcccaattcgaggaatgggaaaggcaagaagatcaattccacttggagcaagctcgattgagatctcacataagaatacaagacggacgagccaagccgattgacctactagcaaagtacataagcgctgaagaagaagtcgatgctgttgaaatgcacgaaccatatacttacctcaacggtttgcaaatcaaagacctagaagacttagtcgaggacatcaaagtctacaaagaactagaaaggggaaaaaacctagactactggaacgatataaccgtaatagttgaagacgagcttcaaaagcttagaaaaatagaaaaacaaaacgatttcgacttgggattgaaccgaagggaagggatacatcaatcagtcgctaccgatgtaacttcagtatttaaaggcaaaacagccgcacaattagctgcgctagaaaaacaaatcgggagtaaaattagcagcaaagccgatggaatagacataggctactgggaatctctactgtcccaactcaaagcccacatggcaagggccagactacgggacaggcatcaagatagcttgagaaggaaactgcaggttctaaaagccgaacaagccatcacaggagtaggtaaaactcacagcgaaactcattcaaccgataacgaagaaaccactatggaacctaaaccaggcacgtcccaggattccttggaaacgatggaagaaagcaacgaaaaaagcgaagacgctgcccatgcgtggctaagcgaatgcttttcggcataccaagcaggcgggtacagccccaagtttttaactccggacgataccgagcccggcacgattgtagtctcggaggaagacgacgtaaagagactggaattcgccaggatgcaggtgatgggtcaaggaaccaacatcgaaaacgtcattacaaaggaagaattgctgctacaaaaggaggcgaagaaaggaatggatggggatgaggctcagttttcggtcgagcaagccttggataatccggtgtacctttggtcggataagtaccgtccaagaaaacccaggtactttaatagagtgcacacaggattcgaatggaacaaatacaatcagacccattacgacatggacaatcctccgccgaagattgtacaagggtataaattcaacatattttaccctgatttgatcgacaaaaacagtacgcccgagtattacttgacgcctagccccgagaatagagaatttgctatactacgattccatgctggaccgccttatgaggacatcgcttttaaaattgtcaaccgagaatgggaatattcatacaaaagaggatttagatgccaatttcataacaacatatttcaattgtggttccatttcaagagatataggtatcgaagatga

SEQ ID NO: 566 - DNA, 1314 bp, Phyllotreta nemorum
atggacaatttagaagctaacataatggacaagtcgatgagatcggtctttgtgggaaacatcccctacgaagcaaccgaggaaaagctcaaggacattttcggcgaagtaggccaagtattatccttcaagctggtctttgaccgcgaaacgggcaagcccaaaggctatgggttctgcgaataccgagaccaagagaccgccctcagcgccatgaggaatttgaacggttacgaaataggcggcaggaatttacgcgtcgacaacgcctgtacggaaaagtcccgcatggaaatgcaaaacctcctcaaccagccgcccatcgagaatccctacggagaacctattcaagccgaaaaggcgcccgaggccatcagtaaagccgtggcttcgctgcctcccgagcagatgtttgaactcatgaagcaaatgaaaactaccatacaaaataatcccacagaggctagacaaatgttattgcagaatccccagttggcttacgctctattacaagctcaagtcgtcatgaagataatcgatcctcacacggctgccagcctactacaccctgtcaatcaagtaccggccactctgctgccgggcgataagaacgtgaccgtacaagtaccgatcggcaaccagtaccgggaacctccggctccggtacaagcacctcgacaggaataccagccggtaccgccgcccgccgtccatccaaatcacgttcaacaacccgtttttaccggtcaagatgtcgatttgcgatccatgggtaacgtgaccgatccgagaatcaggccgatgatggtcgatcaggatatgagacaaatgccaaatgtcatccagaatcctctaccgcctactataagcgaaagtctcgccaaagcgggagattcgaaatccgataactattcgagggatccccgaagcgtctccggcggtttcccatccgatccaaggcaagctaggatggatccgcgacaaaaaagtttagctccgacgagccagcaagtaccttcgtctgtgaatccgaagataatgccgaatcaagccggtcctgcggctatcagacccgtccagaacgtcatagcgcaatccgcgagtgttgcaccagctgcgtcggctgcagctgcatcggccaacgtgatgagtcctggtataggaggagccggtgctacagatcaagaaaaagccgccttgattatgcaagtcctgcaattgtctgacgagcagattgcgatgttgccgcctgaacagcgaaatagcattttggtgttgaaagaacagattgcgaagagcgcgcatgtgcgttaa

SEQ ID NO: 567 - DNA, 1179 bp, Phyllotreta nemorum
atggcacaaatggatgcagaacgtgaaaagagccgccaagagtacaggaagaaagtgttggagcacaaagaagtggagtccagactaaaagaaatgagagaacagctcaaagacttaaccaagcagtacgataaatcagaaaacgatttgaaagccctccaaagtatggggcaaatagtaggtgaagttttgaagcaactgacagaagagaaattcattgtaaaggcgacaaacggtccccgttatgtagttggctgccgtcgtcagttggataaggccaagttaaaggccggcacaagagtagctctcgacatgaccaccttaaccataatgcggtacttaccgagagaagtcgatcctttagtgtacaacatgagccacgaagatcccggagatgtcacttattccgccataggtggactttccgagcagattagggaactacgagaagtcatcgaattgcctctcatgaatcctgaattgtttatgcgagtgggcattacaccaccgaaaggttgtcttctctacgggcctcctggaactggtaaaactctgctagccagagccgtagcttctcaattggacgcgaactttttaaaggtcgtatcgagtgctattgtagataaatacataggtgaatctgctaggcttattagagagatgtttaactacgccaaagaccatcagccttgcatcatttttatggatgaaatagatgctataggtggtcgtaggttttccgagggtacatcggctgacagagaaattcaaaggacacttatggagctgctgaatcaaatggacggatttgactcgttaggacaagtaaaaatgattatggcgaccaataggccggatactttggatcctgccctgctccgtccgggtcgtttggacaggaaaatcgagatccctctgccgaacgagcaagctcgtcttgaaattttgaaaattcacgcacttcccattgctaaacatggagaaattgattacgaagctattgttaaattgtcggacaccttcaatggggctgatttaaggaatgtgtgtactgaggcaggactcttcgccattagagcagaaagagagtatgtgatccaggaagatttcatgaaagctgtaaggaaagttgccgataacaagaagcttgagagtaaattagattacaaacctgtataa

SEQ ID NO: 568 - DNA, 780 bp, Phyllotreta nemorum
atggctcgccggtatgatacgagaacgacgatattttctcccgaagggaggttgtatcaagtcgagtatgccatggaggccatatcccatgcaggaacgtgtctaggcatcctggcaaacgacggaatccttcttgccgcagaaaggcgtaacaccaacaagcttctggacgaagtttttatttctgagaaaatatacaaacttaatgatgatatggtttgcagtgtggcaggaattacctctgacgctaatgttctaactaacgaattgcgtttgatcgggcaaaggtacttgtatcagtatggggaatcgattccctgcgaacaattagtttcgtggttgtgcgatgtaaaacaagcttatactcagtacggaggaaaaaggccttttggtgtatcgatcttgtacatgggctgggataagcattatgggtatcaattgtaccaatccgatcccagtggaaattattccggttggaaagcgacttgcataggaaacaacagttctgctgccatttcgagtttgaaacaggaatacaaggaaggcgatatgatgttgaaggatgcgaaaagtttggctgtaaaagttctggcaaaaacgttagatatggctaaattgacgtctgaaaaagtggaaatggctacgctgacacgtagaaatgataaaaccatcataaatatattgaatagcaaagaagtggaagaacttatttcagactacgaaaaatccgaagcggccgctgaagccattaagaaacaagagcaaaaatccgctgcttaa

SEQ ID NO: 569 - DNA, 2661 bp, Phyllotreta nemorum
atgagtgaatcaaaagccgaacctataaaggttgaatcaaaagcaaatgatgacaaaaataagaacgatctttctgatgaagataaacaacttcaagaagaattgaacttgtgcgtggaaaaattacaagaaaatgacagtaaactgtatatgcccgcattgcaagctttgggaaaccatattcgggcctcgactacttcaatgacttccgtgcccaaaccactgaagttcatgaaacctcattacgataccatgaaacagattttcgagaaaattactgagcccccagttaagtgtctttgcgcagacattatttccgtactagctatgactatgggagaaggaagagactgcttaaaatacaggctactgtccgatttggacaaaatcggtgaatggggtcatgaatatgtcagacatttggctggagaaattgccggtgaatgggctgaaactgatttcttggtaaacacagaaattagggataagctcatattgttaacaaagcagatcgttccttataatatggcccataacgccgaagcagaagcttgcgatttattaatggaaatcgaaagattagatttgctcgataaatacgtggatgaaaatatttaccctagggtttgcttatatcttacaagctgtgtaccttacgtagctgatccggaaaataccactcttcttcaaactgctttaatgctattcaggaaattcaagcagtaccctcaagcacttcgattggctatgcaattgaacgatcacagcctcattgaagaaattttcctaaattgtcctgatactgatgtacagaaacaattggcattcatgttgggcaggcagcagatttacatagaagtccccgacagcacaccggaatatgaagacctcattgaaataatggcgaattgtcatctaaacaaccactttttgaatctagcacgtgaattagacatcatggacccgaagaccccggaagatgtttacaaatcccacttggaaaacagccgtcctccatttggtggaagccaagttgattctgccaggcagaacttggccgcaagttttgtcaatggtttcgtaaacgctgccttcgggcaagacaagctcctgatggaagatggaaataaatggctctataagaacaaagagcacggtatgcttagcgctaccgcttcactgggtttaatattattatgggacgtcgatggaggtcttacgcctattgataaatacttgtattcttctgaagatcacattaaatctggagctctactggcgtgtggtatcgtcaattgtggagtcagaaatgagtgtgatcccgctctggctctattgagtgactatgtccttcataacacaaatataatgaggataggcgctattgtgggcctcggtttagcttatgttggatcaaacagggaagcagttttaagtctactcactcccgtcttctccgatccaaaatccaacatggaagttatcggtatgtctgcgctggcttgcggaatgatcgcagtaggatctggaaatctccaagttaccaccaccattatgcagacgctaatggaaaaatcagaaaccgaactgaaagatacatacgctagatttttgcccctaggtcttggcttgtgtatgttgggcaaacaagaaggtgtcgattccataatagccgcactggaagttataccggagccgtttaaatctatggcaactacgatggtcgacatttgcgcttacgctggcaccggcaacgtacttaaagttcaacatttacttcacatttgctccgaacattacgatggcgacagctcagacaagagttctaaggataaggacaaaaaagacgcttcagagaaggagaaagatctttcctcgagacaagcagtggccgtgctgggtatagctttgatcagcatgggtgaagacattggtagcgaaatggcctaccgtaccttcgggcatttgctgcgctactgcgaacccgtaattagaagagcggtaccgttagctttaggactcatttcagtatcgaatcctaagttgagcatactcgatactttgagtaaattctcgcacgacagtgatgctgaagtagcccataacgccatatttgccatgggtttagtcggagctggtacgaataacgcaagattggccgcgatgttgaggcaattggcgcagtatcacgctaaagatcctaacaacctatttatggttcgtattgctcaaggtcttacgcatttaggtaaaggaacattgacgctgagtccttatcacagcgaccgtcagctcatgagccctgtagcagtagcaggattaatggctacccttgttggatttttggatgttaaaaatattattttgggaagatcgcattatctcctatacactctagcagcggctatgcaacctaggatgcttgtgacatttgatgaagatttgaatccattgccggtgcctgtgagagtgggattggctgtagatgtagttggtcaagctggtaaaccaaaaactataacgggttttcaaacgcataccactcctgttcttcttgcatacggtgaaagagctgaactggctactgaagaatacttggccctcactccgattatggaaggtttcgttatattgagaaaaaaccccgacttcaatgcataa

SEQ ID NO: 570 - DNA, 1515 bp, Phyllotreta nemorum
atgaccgacagtaatatggaatcgaaagaagagaaacaagcatcacctgagaacgtgaagctaaagccagaagcaaccgagcccgaggctcccccagctcaaaccaccgcaaccggcgtgatccgaagaaacttcatcaccccggcaggaacaatagtagaaaccaacgaagagcaacctcctgaaccaacgacagaggaagtcgtgaaaacgacatcttcgaatccaagtccggccgaacagaaaactgaacccgcagaaatagtcacctacgctgcggaggtcctgccgcaggagcagagagagcaattcgctgacgccaaatcttacgccgtggaaatgccggccgaaaattttcaaaatcccagctttactcaggacattagttacgtgaatatagaaggaactgttgtgcccgtcacaatatcggaaatagaacatcctggggactacgccaatttacaaactgctcaatacaataacggctatactgatggctcacaatatttaaccaatcatcagtaccaaaacatgtatatcgatagaactacagtcgataattctacttctgctacagttttataccgtgatgatccaaatttgggagcttccagattccaaggaaactacgacatatccagttctcaatcgcaagtgaacctccttcccgcttccggtgaagcctactatccatcaacatctaattggacgccaaccagtagcggttcttaccaacaacaatatccatcagggaacataaacgtccttcaagctgattcgactcaagctttcgcaggtccttacataaacgcgacctggtcgtcgaattcgatggaggacggacggcaatctagtcaagaggtactagtgaaagagtgcgttaattgtggtgctagcgttacaccactttggcgtagagacggtacggggcattatctatgtaacgcgtgtggtttataccacaaaattaatggggtgcacagaccgccgactaagccaaccaaaaaaccacaggcgaccggaaatagaagaaacggcgtaacgtgcgcaaattgcaaaactaacaacactacactttggagaagaaacaaccaaggcgagccagtctgtaacgcttgcgggctttactataaattacataatgttaacaggccgatcagtatgaaaaaagaaggtatccaaacgcgcaaaagaaggcccaaaaactcttcggttggaaaccctgccagtgctgcaggtcaagtaagaatggggcttccctcttatcaatatcaagatattgaagtacagcaggatcagtaccaattaccagtgagcgtttattctcaaagaccacaagtatcttatcgacattacggggcagaaaatattggaactataaatgcacaaccactgcagccaattattactcatgaagatgaacaggcaagtgtcattacatcgacttcacaacaggctaggtttaggacgaaggtggaagaggacgaaggaagcaatccatccatgcaatcctaa

SEQ ID NO: 571 - DNA, 2952 bp, Phyllotreta nemorum
atgaacaccgatcgcctgaccatattcgctgcgaacttacaagtatccttcctgctgttcgagtcgttaagagctcatctaaagtaccaattggagtgttatttgaagaagctgacggagatcatgagaagcgaatcgaacaaagtgagctatgagcacaaggagatcgccttggataatctgctgcagctgtggagggtgccggggttccacgcggagctctacgtgaactacgattgcgacatgtactgcgcgaatttgtacgaggagcttacggagctgctggccgaacgggctgtttctaatgtgggagtgtatcactctcatttgctgtcgcttgatgggcttttgattataattgacgggatagggaagagatttgacgaagcgaaggatcgatcagataccgatgagattagcagttatactggggaaaatacgagagttaaaggttgtgttagagctcctgataagaaggttttggctgccaagaaagggattaaaaaatggttgccccaaggtacggagtatttcaatcagaagccgaagaaaggtatacagttcctgcaggagcacggcgttttgaagcaggagctggacgtcgaggagatcgccagatttctgagggagaatcctgcgttgaacaaggcgatgatcggggagtatatcagcaatcgagggaatttgaagatactggaggcttttgtgggcacgttcgatttcacagggatacggatcgacgaggcgctcagagcgtttttggagacgtttcgattgcctggtgaggctccgacgatttcgctgatccttgaacatttcgccgagcattggcataaaagcaacggagaacccttcgccgacgtcgattcagcctttaccttagcgtacgccgttatcatgcttaacgtcgaccagcacaacgaaaacgccaagaaacaaaccattccaatgtcgccgaacgctttcaaaaagaacctgaaaggagtcaatggaggcgacgatttcgaagaagaaatgctcgacgaaatctacacgtcgatcaaaagcgaagagatcgtgatgccgtccgagcgcacggggttggtgcgcgacaactacctgtggaaggtcctgctgcgcaaaggccgatcgcccgaaggcggcgtctacatgcgcgacgacgccggcgcctacgactccgaattgttcagcatcgcctacggccctctggcggccgccctgaattccgtctacgagcgggccgaacacgaaggagtcctgaagaaagtcatgcgaggtttcgaacgatgcgcttcgatagcgtccaatctaaatatgacagcgaacctcgacatgttgctggtcagtttggcgaaattcaccgtattccacaatcaccagaagcaaactgctgtcgtggtgcaattcggttcgaacgctaaagctcaactagctctaaaaacgctttttatgctgatacaccagcacggtaactccacgagggaaggctggaagcacctcttcgacctgctgctggctttgtacagcaacgatttgctcagcaaaggtttcgtggaagtcgaggatttcgtagaaccttccggtaaattgtgtttggtgtacaaggacgcgccgagcgcagccaaacaggatacaggcctgttgagctccttgtactcctacatgatatctgtagagaacctgtccaaaataccttctcccgaagagcagagtttgatagacaaagccagggagtgtataaaagagtgtaatttagagcaaatgattaccgattctaaatttctacaccaacaagccctcttccaactggtcgatactctgatagagttgtccagaggtccggaactgcaagaaggttcttcctacgactacaacgaaaacataacggtcttcttcctcgaattgctcgtgaaaatcgtcatacagaaccgcgacagggtcatgaccatatgggaccgcgtcagggaccacgtctacaccctggtcatgaactcgtcgctgatgagctaccagttcctgctggagagatcggtggtggggctgttgaggatagccgtgcggctgatgcgcaacgaggagatgagccacgtggtgttgcagtcgctgcgcatgctgctgttgctgctgaagggcggcgtgctcgccaggatatcccgccagatggcgttcggcttgtacgagatgctgaagacgtcggcgcagaacatacacacgacggccgattggacggtggtgttcgcgctgttggagtgcgttggggccggggcgaagcctcctaggcctgttttgaccgccgaagaaaacgacgcgaaacccaaacccgacgaagaaacttgctccaaaccagacgaagaaggcgccgaaaaatccaccaaaacagcgtcccaaagaccccaaagccccatgacctcaatcacctcaccggtcggcacgcccaacaccggcggctggatcatcgtcagcgacgaagacgatctccaaccccgccagcaaaccctacccgttcactaccacctgcggctcgacgccgacctctcgccccacgacccgctcagcatgctcaagtgctgcgagagcctggcctttttggtccgcgacgtcgcccacatcacgccgtacaacttcgacgtgtgcgtgcgctgcgtacgcaccttcgtcgaggccgccctcaaaccccccaccgcccaccaatccaacgtcaaaagatccaaagcgagcaaaagcaggaagaagagccccgcggggagccaagaggaagacagcagcggcggagacgaggaagaagacttgcccagcggctaccaccaggtccccatacaactactcgacctcatgcacaccctgccacgcgcacggctcaaatattcaaatggtgggccgaagaaggcggcgagatatccggcgaaacctccctgtggacgcaaggctggtgtcctttgctgcagggcatag

SEQ ID NO: 572 - DNA, 618 bp, Phyllotreta nemorum
atgtcgattttggcgtacaacgggggcgcgatggtggccatgaagggcgagaactgcgtagccatagcggccgaccgccggttcggcatacaggcccaaaccgtcgccaccaacttcgagaaagtcttcgaaatgggcccccacctcttcgtcggcctccccggcctcgccaccgacacccaaacggtcatggagaagctcaggttccgcaagaacctgtacgagttgaaagagaaccgccggatctcccccaaggtgttcgcggccatgatatcgaacatgttgtacgagaagaggttcgggccgtttttcgtggaacccgtggtggccgggctggcgcccgacacgttcgagccttacatatgcaacatggatttgatcggttgtattaacgagcccagcgatttcgtcgtgggcggcacggcgtccgctcagctgtacggaatgtgcgagtcgctgtgggagcccaatctcgcgccggaggacctgttcgaaaccatatcgcaggctttgattaacgctttcgatagggacgctatatccggttggggagctacggtttatattgtagaaaaggataaagtaaccgtaagaaacctaaaaactcgtatggattaa

SEQ ID NO: 573 - DNA, 2805 bp, Phyllotreta nemorum
atggctattggaattacagaaatcggttcacgcgtggaccgtcgccgacgagctgctgcgtcgctgcaccagcgccgacgatctccaaacccgctatttcgccgctcaaaccatgcgcaccaaaatccaccaatccttccacgaactacccagagaggtgcacgagtccctccgagactcgcttctggagcacatgggggcttgcgctggcgtcgacgagggcgcggggccgccatagtgacgcaactatcgctcgcactcgccgatttggccctgcagatgcccgattggcgaacgcctgcgctagatttgatcagcaggttcagtgcggggaacaacgtgtggccgttattggaggtgttgactgtgctgcctgaggaattggagagcagatcagtaagattaggagaaaaccgaagatatgaggtactagaagatatgaaattatgcgctcccactgtgaacgaatttctgaaacattgttccaatttgtacggcagaagaggatcggagaggttagcaacaggtgatagacaaatcgacgtaaaaatcctcagatgtttcgcttcctggatatcagttggggcaattggacctagtcaattgagcgaggatcgggtggtagttgacgtggctttcgacgtgttgaaagcggacataagaggagatgaaaaagtaaacgtaacaggtcaacttcacgaagccgctacagactgtatatgtactttactgttacgtctcgaggataacaacaatcacgtcgcattggaaacccacttatttgaaaatatagtaaatttagaagtgtcctatcacgcgtccgtcgcgctcgaagatcaagcaaagtcgacggattattgtcggttgttcactgagttggccgagtcgtttttgggaaagattgtagacgacggtggaggcgggggcggcgacggcggaggagcgaagaggcgtacagtgtacgccgttaaatgcttagatttggtactgatgtgcgtcggccatcatgactacgaggtggccgagataacttttaacctttggcatatgctgagtgaggaattatatcagaaaaacaataaggagttaacggaattattcaaaccgtacgtagaaagattgattacggccttatgtagacattgtcagatggagcctgacatggagggtctgctcgaaaaaggagatgaatttaaagattttaggatgaaagtctccgatctaataaaggacgtcgtctttatagtaggtagcagcagttgcttcagacaaatgtttatcaatttgcaaacccctggtgtaacgtgggatgccagcgaagccgctctctttgtgatgcaggctgtagccaaaaacgttctacccacggaaaacgaagttgttcctaaagtcgtcgaagcaatactgaacatacccagcagcgcacacgtcgctgtgaagtacacatctgttcttctactgggcgaactggccgaatggatagaaaaacacccggacgctttggatcccgtcctgaatttcctagtttgctgcctccggagcggcgccgaaggaggaggcgtcgccacggcggcggcggcggcgctgcagaacgtgtgcacttgctgtggggctcacatgggcaggcacgttcccattctgttacagttacttcaacagtcggattcgttcggtatcggcaacacggcgatcataggattattgaagggcgtcgcgtcggtggtgagctgcggcattggcagcggcgccgaaacggcttccgccgtacgggaattgtgctccttgcaattgtcgccgctgtgcagtttgatcgaaaacggcgttcgacccgttaagggaactctaacggatccggtgctgtggttggatcgattgagttcagttttgagatacgtcaatgtcaatgtagttgaaggggaaatccatccttgcaaaccggtaataatggagatatggcctatactatcccgcgcattcgacacataccacagcgacgctaggataatggagaggtgttgtcgctcggtgcgtttcatgttgcgttgcgtcgcccgacagctccaagatttgcttccctctttggtcggccaaatcgtgaacatctactgcctctacggccattcgtgttgtttgtacgtcggcagcattctagtcgacgaatacgccggcgatgcgacttgcgttcaaggtctcctcgacatgctgaacgcctttttggagcccacgtttcgcttgttgcaggaagagaacggcttgaagaaccatccggatactgtggacgacttcttcaggttgtgcgctcggtttgtccagagggcgccgaaggcgtttctaagcggagggccccatctggcgcccattatccagtgcgcccttctcgctgccaccttagaccacaaggaggccaacgtgtccgtcatgaaatttttctatgatttgataaatcaaggactgagcggcagaggggagcccgactttgacgagagaaaagccttggtgaggagcttgctaaacgaatacggtcaacaactcgtatctaatttaattcactcttgcgtattttacctgcattcatacatgttgagcgaggtgggcgacgtttttgtgcaattgttggatttcgatagacaaataacgagtgaatggttagcgaacggtttggagttattgcccaaacagcagaatggtgggataatggcggctaagcctaaacaattaaatgacgttcatgcttcgataacgagatcgaacagttcgaaatctgtgacgcacgccctgaaagacctaactaggctatatcgttaa

SEQ ID NO: 574 - DNA, 1509 bp, Phyllotreta nemorum
atggctcaaagatttcccggacccgtatcgaaccaagtcccgggggggccgccgcctcctcaaaggtacccacaaccgccgccgaatcaaggaatgcggcaatacggacaacaggctttccctcccaggccgggctacagtgctccaccgccaagtatgcagtcgagcggaggcacgatgatacaaagaccgcccggggctccctattccccgatgcgcggagggcccatgccgccccagccggtgggcaagaggccttcggacaacaggaatcctctgcagcagaagaacagcgactacagccacggtacgagtaagaaaaaaaagaagcttgcagataagattttaccccaaaaagtaagagatttggtgccggagagccaggcttacatggatttgttggctttcgaacgaaaactcgattccacgattatgagaaaaagattggatattcaagaggctttaaagcgtccgatgaagcagaaacgaaaactgcgaatttttatttccaacactttctacccggcgaaagagccccaacccgagggccccgacggcccttgccaagaaggcacggtagcctcctgggagctcagagtcgaaggcaggctgctcgaagactccaagaacgatccgaacaaagtcaaacgcaaattctcctcgttcttcaagtccctcgtcatcgagctcgacaaagaactctacggccccgacaaccacttggtcgaatggcaccgaacgctgaccacccaagaaaccgacggtttccaagtcaaaagacccggcgacaagaacgtgaggtgcaccatcctgctgctcctcgactaccagccgctgcagttcaagctcgacccgagactggcccgattactcggggtacacacccaaaccagaccggtcattatttcggccttgtggcagtacatcaagactcacaggctgcaagatggccacgagcgcgagtacatcatctgcgacaaatacctcgagcagatcttcaactgtactcgaatgaagttcgccgaaatcccccaacggttgaaccccctgctgcacccgcccgatcccatcgtcataaatcacgttatatcggtcgaaggcggcgctgagagcaagcaaacggcctgctacgatatcgacgtcgaagtggacgatactctgaagacccagatgaataatttcctgttgagcacggccagccagcaggagattcagggattggacgcgaagattcacgagactgtcgacacgataaatcagctgaaaaccaacagggagtttttcctgagtttcgctaaggatccgcagcagttcatacataaatggatcgtgtcccaaacgagggatctgaagagcatgacggatgtggttgggaatccggaggaggagagacggtcggatttcttttaccagccttgggcgcaggaggccgtgtgccggtacttctacactaaggtgcagcagaagagggccgagctggagcaagcgcttggtattcgtaataattag

SEQ ID NO: 575 - DNA, 1044 bp, Phyllotreta nemorum
atgccagcagctactttgggtagcattccacatcctaacaatgaagactgcggcattcgggacgtttgggctcacaatttagaagatgaatttcgaactattaggcaaatagtgcagaaataccaatatgtcgcaatggacaccgaatttcccggagttgtggccaggcccattggagaatttcgaagttcagccgattaccaataccaaatgttaaggtgcaacgtagacttactgagaattattcaactaggtttaacgttcttagacgataatggcaaaacaccgggaggagtttataccacctggcaattcaattttaaattcaaccttcaagaagacatgtacgcacaagatagcattgatttgctgcagaattccgggatccaattcaagaagcacgaagatgaaggtatcgaaccgctagaatttgccgaattactaatgtcctctggaatcgttcttatggaaaatatcaaatggttatcgttccattccggctacgatttcggctatttaattaagttactaaccgacaacaatctcccgcaagacgaaaccgaattcttcgatctgttgaaattgtactttcctaccatatacgacgtaaagtatttaatgaaatcgtgtaaaaatttaaaaggtggtcttcaagaggtggcggaacaactggaattggaaaggatcgggcctcaacatcaagctggatctgactcgcttttgaccttcgatctattgaaattgtactttcctaccatatacgacgtaaagtatttaatgaaatcgtgtaaaaatttaaaaggtggtcttcaagaggtagcggaacaactggaattggaaaggatcgggcctcaacatcaagctggatctgactcgcttttgaccggaatggcctttttcaaaatgaaagagatgttttttgaggatactattgacgattcgaaattttcgggccatctttacggactcggaacatctttcacggttaatggtacaactaacaattacgggaacgataacggcgacacgacaaactcctcatga

SEQ ID NO: 576 - DNA, 1212 bp, Phyllotreta nemorum
atggcggaagttcagaaaaggggcgcttcggttttcgaggacctctcgaacgtcgagttcgagaccagcgagaacctagatgttatcgaaaagtttaaagacatgaagctgaaggaggaactgcttcgcggcatcttcgcatatggtttcgagaagccttctgctattcagcaacgagccatcattcccgtgatgaaaggcagggatgttatagcccaagcacagtccggtaccggtaaaaccgctaccttttccatagctatactacaagctctggatttaacgatgagagaaacacaagtgctgtgtttatcacccacgagagaattggctgtacaaattcaaaaagttatattagctctaggcgatttcatgaacgtacaatgtcacgcttgcatcgggggtacaaatctcggggaagacatcaggaagctagattacggacagcatgttgttagcggtacacccggaagagtttacgatatgattcgtagaagagctttgaggactagatcggtgaaaatgctggtcctggatgaagccgatgaaatgttaaataaagggtttaaagaacaaatctacgatgtgtacagattccttccaccctccactcaagtggttttaatatcagctaccttaccccacgaaattctggaaataacatccaaattcatgaccgatcccatcaggatcctagtaaaacgtgatgaactgacgctggagggaatcaagcagtttttcgtcgccgtggaaagggaagaatggaaattcgacacgctctgcgacctctacgacaccctgaccatcacgcaagccgtcattttctgcaacacgaagagaaaggtcgattggctgaccgaaaagatgcgagaaaacaacttcaccgtgagctccatgcacggggacatgccccagaaggagcgcgacaacatcatgaaagagttcaggtcgggccaaagcagagttttgatcaccaccgacgtttgggccaggggtatcgacgtacagcaggtttctttggttatcaattacgatttgccgaacaatcgtgaattgtatatccatcgaatcggtcggtccggtcgattcggcaggaagggtgtcgctatcaatttcgttaagtcggacgacattaggattctgagagatatcgagcaatattattccacgcagatcgatgaaatgcctatgaatgtagccgatttaatttaa

SEQ ID NO: 577 - DNA, 1602 bp, Phyllotreta nemorum
atgaccgctcctgctgccggtggcgatgcaagaggaagaactcttgcttacaaagacaaaagcaaacccgccgatgtccggactagcaacattaacgccgctaaggctgtctgcgatgcaattcgtacaagtttgggccccagaggaatggataaaatgatacaagctggtaacggagaagtaactattactaacgatggagcaaccattttaaaacaaatcaacgttatccatcccgcagcaaaaatgttggtggaactgtccagagctcaagatatcgaagccggtgacggtacgacttccgtagtggttattgccggagctcttttagatgccgcagaaaaattgctacaaaaaggcattcaccccacagccatctcggagtctttccagagagctgctctactagctgtcgaaattctacaagaaatttcaacgccagtagaaatcaccaacagggagctgttgattaaaagcgcttctacttctctgaattctaaagtcgtgtcccagcagtcgagtctcttgggtcctttggcggtcgatgctgttcttaaagttgtcgaaccaggacaggaacaagcttgtaacttggtggatgtcaaagttatcaagcaattgggcggtactgtggaagataccgagttgattgagggtatcgtgttctcgcagaaatcagccaatgtatcaggccccaagaaaatcgaaaaagccaagattggtttcatccaattctgcatttctcccccgaaaaccgatatggaccacaatgtcatagtatccgattacgctgcgatggatcgagtcctgaaggaagagcgagcgtatatcttgaacattgttaaacaaatcaagaaagccggttgtaacgtactactggttcagaaatcgattctcagagatgccgtatccgacctggcactccactttttggataaaataaagtgcatggtcatcaaggatgtcgagcgagaagacgtcgagtttgtgtgcaaatcgttgggttgcagaccgatcgcttccctcgatcatttcaccgccgaaaatctagtaacagccgatttggtcgaagaagtcggggtgggcggtaaccgaatggtcaaaatcacaggtattcaaaacgctgggcgtactgtgaccctgctcgtaagaggctcgaataaactagtattagaggaggccgagaggtccctgcatgacgctctttgcgtcattcggtgtcttgttcgcaagaaggcgcttatcgcaggcggcggggcacccgagattgaagttgctctcaagctggctgctatggctaataagttggagggcattgacgctatttgcaccagggcttatgctactgccttggaaattataccgtttactttggctgagaatgctgggttgaatcctatacagacggttactgaattgaggaatagacatgcgaaaggggaaacttcggcgggtattaatgttcgtaagggcactattacggatattttggaagagaatgttgtgcagccgctgttggttagcacgtctgctttgagctttgccactgaaaccgtcaggtccatattgaaaattgatgacattgtgaacaccttaaattaa

SEQ ID NO: 578 - DNA, 1143 bp, Phyllotreta nemorum
atggaggatctctacaccaaatacaagaaattacagcaaacgttggagttcctagaagtccaggaagaatacatcaaagacgagcagcgaaatttgaaaaaggaatacctgcacgcgcaggaagaagtgaaacgtatccaatcagtaccgttggttatcggtcaattcctggaagcagttgatcagaataccggcattgttggatcaactacaggctctaattactacgttcgcattctctccaccatcgacagggagttgttgaaaccgtccgctagcgtagccctacacaagcacagcaatgccctggtggacgtgttaccccccgaagcggactcctctatcagcatgcttcaggccgatgagaaaccggacgtgcagtacagcgatatcggaggtatggatatgcaaaagcaggaaatccgagaggccgtggaacttccgctgacccacttcgagctgtacaaacaaataggcatagacccgccgagaggcgtgctgatgtacggcccgcccggttgcggcaagaccatgttagccaaagccgtggctcatcacaccactgccgccttcattcgagtggtcggttcggagttcgtgcagaagtacctgggcgaggggcctcgtatggtgagagacgtgttccgcttggccaaggaaaactcgccggccatcatattcatcgacgaaatcgacgccatagcgacgaagcggttcgacgcccaaacgggggcggaccgcgaggtgcagcggatcctgctggagttgctgaaccaaatggacgggttcgatcagaccaccaacgtgaaggtgatcatggcgacgaatcgggccgatacgttggatcccgcgctgctgaggccgggtcgtttggataggaagatcgagtttccgttgcccgatagaagacagaaacggttgatattcagcactatcacgtccaaaatgaatctgtctgaggaggttgatttggaagattatgttgccaggccagatagaatatcgggggcggacataaacgctatatgtcaggaagccgggatgcacgccgtacgagagaaccgttacatcgtcttgccgaaagatttcgaaaaggggtataagaataacatcaagaaagatgagagcgaacatgaattttat

SEQ ID NO: 579 - DNA, 489 bp, Phyllotreta nemorum
atgccaaacataaagctgcagtcttcggacggcgagacattcgagatcgacgtcgaaatcgccaagtgctcggtgaccataaaaaccatgctggaggacctcggcatggacgaggaagaggaagaggtcgtgccgttgcccaacgtaaactcagccatcctacgtaaagtgatccagtgggccacctaccacaaagacgacccgccgccgcccgaagacgacgacaacaaggagaagcgaacggacgacatatcctcgtgggacgcggatttcctcaaggtcgaccaaggcaccctgttcgagctgatcctggccgcgaactatctcgacatcaaaggcctgctggatgtgacctgcaagaccgtggccaacatgattaagggcaaagcgccggaggagatacggaaaacgttcaatatcaaaaacgatttcacgccgtccgaggaggagcaagtgcgcaaggagaacgagtggtgcgaggagaaatag

SEQ ID NO: 580 - DNA, 930 bp, Phyllotreta nemorum
atggacgataaggcttcatgtaaggaactagatcaatggatagaacagttaaatgactgcaagcaattaaccgaaaaccaagtgaaaactctgtgtgataaggcgaaagaaatactgtccaaagaatcaaatgtgcaggaggttaaatgtcccgtcaccgtctgcggagatgttcacggacaatttcacgatctgatggaattatttaggataggcggtcgaagtccagatacgaattaccttttcatgggcgattacgtcgatcgtggatattattcggtcgagactgttactctgttggtggctctgaaagtcaggtataaagaaagaatcacgattttgagaggcaaccacgaatcgaggcaaatcactcaagtatacggtttctacgacgagtgcctgcggaaatacggcaacgccaacgtttggaaattcttcaccgatctgttcgactacctgcctctgacggcgctcgtcgacagccaaatattctgtttgcacggcggcctcagtcccagcatcgacaccttggaccacattcgagccctagatcgtttacaagaggtacctcatgaaggtccgatgtgcgatcttctgtggtcggatcccgacgatcgcggaggctggggcatttctcctcgcggcgccggttatacgtttggacaggatatatcggaaacgttcaaccacagcaacggtctgacgttggtctcgcgcgcccatcagttggtcatggaggggtacaattggtgtcacgacagaaacgtggtgacgatcttcagtgctcccaattactgctatagatgtggcaatcaggcggccattatggaattagatgatgcgcttaaatattcattcttacaatttgatccagcaccgagacgtggcgagcctcacgtgacccgcagaactccggattatttcctttaa

SEQ ID NO: 581 - DNA, 1341 bp, Phyllotreta nemorum
atgcaaatattcgtgaaaactctcactggtaaaactattactctcgaagttgaaccatctgatactattgagaacgtgaaagccaaaatccaagacaaagagggtattcccccagatcagcaacgtcttatctttgccggaaagcagctagaagatggacgaaccttgtccgactacaatattcagaaagaatctactctacacttggtacttcgtctcagaggaggaatgcaaatattcgtgaaaactctcactggtaaaactattactcttgaagttgaaccatctgataccattgagaacgtgaaggccaaaattcaagacaaagagggtattcccccagatcagcaacgtcttatctttgctggaaagcaactggaagatggaagaaccttatctgactacaatattcaaaaagaatctactctacatttggtacttcgtctcagaggaggaatgcaaatattcgtgaaaactctcactggtaaaactattactctcgaagttgaaccatctgatactattgagaacgtgaaggccaaaatccaagataaagagggaatcccaccagatcagcagcgtctcatctttgccggaaagcaactggaagatggaagaaccttatctgactacaatattcagaaagaatctactctacacttggtacttcgtctcagaggaggaatgcaaatattcgtaaaaactctcactggtaaaactatcaccctcgaagttgaaccatccgatactattgaaaacgtgaaggccaaaatccaagacaaagagggtattcccccagatcagcaacgtctcatctttgctggaaagcagctagaagatggaagaaccttgtccgactacaacattcagaaagagtcaactcttcacttggttcttcgtctaaggggtggaatgcaaatatttgttaaaactcttactggtaaaaccatcaccctcgaagttgaaccatccgatactattgagaacgtaaaggccaaaatccaagacaaagagggtattcccccagatcagcaacgtcttatctttgccggaaagcagctggaagatggacgaacattgtccgactacaacattcagaaagaatctactctacacttggtacttcgtctaaggggtggaatgcaaatatttgttaaaactctcactggtaaaactattactctcgaagttgaaccatctgatactattgagaacgttaaggccaaaatccaagacaaagagggtattcccccagatcagcaacgtctcattttcgccggaaagcagctagaagatggaagaaccttatctgactacaatattcagaaagaatctactcta

SEQ ID NO: 582 - DNA, 1623 bp, Phyllotreta nemorum
atgatgcaacctcagatattactcctcaaagaaggcactgattcgtcgcaaggcaagccgcaattgatatcaaacataaatgcgtgccagaatatagtggacgccattcgcacaaccctggggcccagaggtatggacaaactgatcgtttccaacagaggctcggcgaccatttcaaacgacggagcgacaatattaaatttactagacgtcgtccatccagcggcgaaaactctagtcgacatagcgaagtcacaagacgccgaagtaggcgatggcacgacctcagtcgtgctgttagccggcgagtttctgaaacaactgaaatcctacatcgaagaaggcgtgcaccctcggatcatcatcaaagccgtacgcaaggccacccaaatttgcctcgagaaaatcaactccctcgccgtcaaaatcgacaaatccaaggccgacgaatacagatcgctgctggagaagtgcgccgcgacggcgatgagctccaaactcatcaacaaacagaaatccttcttctccaaaatggtggtcgatgcggttctactgctcgacgaactcctcccgttgaacatgatcggcatcaagaaggtccaaggcggcggtttggaggagtccatgttagtcgccggggtggcgttcaagaaaaccttctcgtacgccggcttcgaaatgcagcccaagatctacaaagactgcaagatcgccctgctgaacatcgagctggaactgaaagccgaacgggacaacgccgagatccggctgagcagcgtcaaggagtaccagaaagtcgtcgacgccgagtggaacatcctctacaacaaactccagaaaatccacgaatccggagcgaacgtcgtcctatccaaactccccatcggcgacgtcgccacgcagtacttcgccgacagggacatgttctgcgccggacgggtccaagaagaagatatgaagcgaaccctcaaggcctgcggcggctccataatgaccacagccaacgatttgaaagacgaggtgctgggccgctgccagctcttcgaagagaaacaaatcggaggcgaacggtacaacttcttcaaaggctgtcccaacgccaagacctgcaccataatcctgcgaggaggcgccgagcagtttctggaggaaaccgagcggtccctgcacgacgccatcatgatcgtacgcagaacgatcaagaacgactcggtagtagcgggcggaggggcgatagaaatggagctgtcgaagttactcagggactattcccgtactattgctggtaaagagcagctcctgataggagccatggctaaggcgctggaaataatccctaggcagctgtgcgacaacgccgggttcgatgctactaatatattgaacaagttgaggcagaagcatgctcagggtaattcttggtatggggttgatgttaacatggaagatattgcggataactatgaaacttgcgtgtgggagccggccattattaaaattaacgctttgactgcggctgcggaggccacgtgcttgatcctgtcggtcgatgagacgattaagaaccagaagtctgaggcgccgccgcagatggggggccggggaatgggcaggcctatgtaa

SEQ ID NO: 583 - DNA, 6804 bp, Phyllotreta nemorum
atgaacagcgagccccaaaagggcgtgttggagaaagtcctgcagcaagtcgagaacactctgaacgtactagccgactccgttctgcaggaacaacctcagttgaggaggaagaaactggagcatttgatcaacgagtttgtgcacaaaagaacggtgaccagaaggctcatcgctaacggggtgtgcagcaacaaggcgttcgaatggctgtgcgaaatgaggttctacttcgatcccagacaaaccgaagtgcttaagcaactaacgattcatatggcgaacgcgaggttctattacggattcgaatacctcggcgttcaggacagattggtgcaaactcctctgactgacaggtgttacttgaccatgacccaagctttggaagcccgactcggaggatcacctttcggacctgccggaactggtaagactgaatcggtcaaagcgctaggaaaccagctagggcgtttcgtgcttgtgtttaactgtgacgaaacgttcgacttccaagccatgggcaggatattcgtcggtttgtgtcaagtgggcgcttggggttgtttcgacgaattcaacagattggaagaaagaatgctgtctgccgtttcgcagcaaatacaaactatacaagaagctctaaaatcccagaaggaagccgctgctgaaggagtcgctaccggcagtataagcgtggagctcgtgggaaaacaagtaaaagtatcccctgatatggctatatttattacgatgaatcctggctatgcgggtcgttcaaatctgccggataatttgaaaaaattgtttagatcgctggctatgactacgcctgacagacagcttatcgccgaagtgatgctgttctctcaaggattcagacaagccgaaaaattggcttcgaatctgccggataatttgaaaaaattgttcagatcgctggccatgactacgcctgacagacagcttatcgccgaagtgatgctgttttctcaaggattcagacaggccgaaaaattggcttccaaaatcgtacccttcttcagattatgtgatgaacaactgtccaatcaatctcattacgatttcggtttgagagctttgaaatccgtgctaatatctgcaggaaacgtaaaaagggatagaattcaaagaattaaagaaggcatgacccaacgaggcgaaaccaacatagatgaagccaacatagccgagaatttacccgagcaagaaatattaattcaatcggtttgcgagactatggttcccaaattagtcgccgaagatattccgttgttattcagcttgctaaacgacgtgtttcccaacgttcaatacaccagagccgaaatggaaggtctcaaggatgaaattagaaaagtgtgcaccgaagaatacctcgtttgcggagaaggcgacgaaaggggttcagcttggatggaaaaagtattacaattgtaccaaatttcaaatcttaaccatggtcttatgatggtcggcccgagcggttcgggcaagagttcagcatggcgagttctgctcaaagctctcgaacggttcgaagggatagaaggtgtggcccacgtgattgatcccaaagcgatcagcaaggagaccctatatggtgttttggatcccaatactagagaatggaccgatggtctgttcacccatattctaagaaaaatcatagacaacgtgagaggtgaaattaacaaacgtcaatggattatattcgatggtgatgtcgatcccgaatgggtagaaaacttgaactcggttcttgacgataacaaactgttaactcttcccaacggagaacgtctctctctaccacccaacattagagttatgtttgaggtacaagatttgaagtacgcgactttagctacagtatcgcgttgtggaatggtatggttctcagaagacgtcctatccactgaaatgatattcgaaaactacattcttcgattgaagaacatcccgctcgaagaaagcgaagatagcttcggcaagaaatccgacctcaaagacgacatgctgtctccgaccctccaactgcaagtagacgtcgttaatctactccaaccgtttttgggacccgacggtctcgtagtacgctgtctagagtacgccatggagcaagaacacataatggacttcacgcggctcagagcgctgagctccttgttctccatgctaaatcaagcagtgaggaacgtcttgcagtacaatcacatgcacccagattttcctctctccagcgaagccctcgacaaatacatacccaaatgtttaatatattcgatcttgtggagctttgctggcgatgctaagctcaaagttagatcggagttgggcgattttatcagatccgtcaccactgtgcccttaccgtccgaccgcaatctgcctattatagattacgaagtgactattgaaggagaatggtcgctttggtccaataaagtaccccaaatagaggtcgaaactcacaaagtcgctacacccgatatcgtggtgcctacgttggacacggttagacacgaatctttgttgtacacctggttggctgaacataaaccgatagtattgtgtggcccacctggttccggtaaaacgatgaccttattctctgcattaagagctctaccagacatggaagtcgttgggttgaatttctcctctgctacaactcctgaattgctgttaaaaacctttgatcactactgtgaatacagaaaaacaccaaatggcgtaattctatcgccaatacagttgggcaaatggctggtcctcttctgcgatgaaattaacctaccggatatggacaactacggaacccaacgcgtcatcatgttcctccgtcaaatagtggagcaaaaaggcttctaccgcgcctcagaccaaacctgggtaacattagaacgcattcaattcgtaggcgcttgcaatcccccaacagaccccggacgaaaaccgctctctcaccgattcctcaggcacgtgcccgtcgtttacgtcgactacccgggagaaacttccctcaaacaaatttacggcaccttcaccagagccatgctgagattagccccgggtctgaagggctacgcggaaccactaaccaactccatggtggaattctacttatcctcgcaggataggttcactcaagacatgcaacctcattatgtctattcccctcgtgaaatgacgagatgggtgagaggcatatgcgaagccatcaggcctttggacaatctttctgtcgaaggtttggtcaggttgtgggcacacgaggcgcttcgactgttccaagataggttagtggaagacactgaaaggcggtggacgaacgaaaacatcgatgccgtcgctttgaagcatttcccttcagcaaattgcgagaaggccttggaacggcctattctatacagcaactggttatctaaagattatgtaccggtcggaagggagcaattgagagaatatgtcaaggctagattgaaagtgttctatgaagaagaactcgacgttcctttggtgctcttcgacgaagttttggatcacgtgctcaggatcgacaggattttcaggcagccccaaggccacttgctcctgatcggtgtgtctggagccgggaaaacgactctatccagattcgtagcttggatgaacggattgtccattttccaaatcaaagttcacaacaaatatacggctgacgatttcgatgaagacttgagatcggtcttgagaaggagcgggtgtaaacacgaaaagatagcgtttattttagacgagtcgaatatgttggactcgagtttcttggaaaggatgaatactcttctggctaacggagaagttcctggattattcgaaggggacgaatacactactctaatgacacagtgcaaagagggagcccaaagagaaggattaatgttggattcgaacgatgaactgtacaaatggttcacacagcaagttatgcgaaatttgcatgtagtttttacgatgaatccatcaacagatgggttaaaggacagggctgctacatctcctgctttattcaacagatgtgttttgaattggtttggagattggtcagatggagctcttttccaggtgggaaaagaatttacgaaccgtttggatctcgacaaacaaagttggaaatgtccagatttcttccctgcttcttgcaaccacatttccgctacgcccaatcacagggaagccgtcattaacgcctgcgtttacgtccaccagacgcttcacaaagccaacggcagattggtaaagagaggaagtcgcaccatggccatcacccccaggcactacttggatttcatacaccatctcgtcaaattgtacaatgaaaaacggtccgatttggaggagcaacagctccatctcaacgtcggtttgaacaaaatcgccgaaaccgtagaacaggtggaagagatgcaaaagagtttggctgtgaaatcgcaagaattgcaagcgaaaaacgacgccgccaacgccaagctcagacaaatggtgaaagatcagcaagaagccgaaaagaagaaggttcaaagtcaggaaatccaacagcagctcgctcagcaaactgtgcacatcaagcagaagaaatccgaagtaatggccgatttggagcaagtagaaccggccgtcatcgaagctcagcaagccgtaaaatccatcaagaaacagcaactggtagaaatccgtaccatgtcgaatcctccagctctagtaaaactagctctcgaatcaatttgcctgctattaggagaaaacgccagcgactggaaatccattcgagctgtgatcatgagagacaatttcatcaacagcgtggttaacttcaacaccgaagacattggtgacgatgtaagagaaaaaatgaagagccgctacctgagcaaccccgattacaacatcgacaaaatctaccacgccagtaacgcctgcggcccgctggtgaagtgggcttgcgcccaagtcgagtacgccgacatgctgaagaaggtcgagccgctgcgtgaagagctcaactctctcgaaacccaagccgaaaccaaccagaaacgcggcgaagacgtcaaagtcctcatcagccaattagagcaaagtatcgcctcatacaaagaggaatacgcccaactgatcgcccaagctcaagccatcaaaaccgatttggagaacgtccaggccaaagtcgaccgatcgatagccctcctcaaatcgctcgttatagaaagggagcgatgggaggccagcagcgagaccttcaggtcccaaatgtctactatcatcggagacgttctgttatcagcagctttcattgcgtacggagggtactttgaccaacattaccgtcagaacctcttcagcacctggtgccaacatctaactttagctaacatccaatacagagccgacatcgctagaacagaatacttatcgaaccccgacgaaagactcagatggcaagctaatgctttaccttcggatgatttgtgcacagaaaacgctataatgttaaagagattcaacagatacccgctcattatcgacccttcaggtcaagctactgaattcataatgaacgagttcaaggacaagaagatcaccaagacgagtttcttggacgattccttcaggaagaacctggaatcagccctgcgtttcggcaacccccttctagtccaagacgtggaaaactacgacgccatattgaacccggtgctcaaccgggaactcagaagaaccggcgggcgtgtgctgataaccctcggcgatcaagacatcgatttatcgccttccttcgtgattttcctctccaccagagaccccactgttgaatttcctccagacatttgctccagagtcaccttcgtcaacttcacggtgaccaggagctcgttgcagagccagtgcttgaaccaagtgctcaaggccgagcgacccgacatcgacgccaagcgatcggacctgctgaagctgcaaggggagttccacctgcggttgcggcagctcgagaagtcgcttttgcaggcgctcaacgacgccaaggggaagattctcgacgatgacagcgtcattactacgttggagacgctgaagcaggaagccgccgagatcgggcagaaggtcgaggagactgataaggttatttcggagatcgagacggtttctcagcagtacttgccgttgtcgcaggcctgcagtaacacttactttactatggatagcttgaatcaagtgcatttcctgtatcagtactctttgaagatgtttttggatgtgtttgctactgtgttgcacaataacgtgaagttggatgggatcaccgattaccaagctagattgaacgtcatcaccagtaacttgttttcggttgtttatgagcgagtagcaagaggaatgctccacaacgaccgcatgacgttcgccattttactatgcagaatccacttaaaaggacgacctacagaacctaacctagaccaagagttcaacttcttcctcagaggcaaagagggcgtcttcagcagcaccaactcggccatcgtcgacggtttgaacagcgaccaacaggaagccatcacgaggctctccaccaagctacccgcgttcaaaaaactccccgagcagatcaaagacatgccggagttcggcgcgtggctgcagcagagcagccccgagcaggccgtgccgcagctgtggatcgaagagaagcagctgagcgccgtgggcaggggcatgtaccagatgctggtgatccaggcgttc

SEQ ID NO: 584 - DNA, 2016 bp, Phyllotreta nemorum
atgcccggaagcagcgaaaagaaagtccccgaactatccgaagtacaaaaaaagaaactcaccatcgaggaaacgaaaaaaagcctacccatctaccccttcaaagacgatctaatacaagccgttaaagagtaccaagtgttgattataaaaggcgaaaccggttccggaaaaaccacccaaatcccccagtacctccacgaggccggcttcaccgccgacggcaagaaaatcggctgcacgcagcctcgcagagtcgccgccatgtcagtagcagccagagtagcccaggaaatggacgtgaagctcggcaacgaagtcggctacgccatcaggttcgaagactgcacgtccgaacgaactatcatcaaatacatgaccgatggtaccctgcacagggaattcctgtcggaacccgacctgcagtcctacagcgtcatgatcatagacgaagcccacgaaaggaccctccacaccgatattttattcggattggtgaaagacatagccaggttcagaccggacttgaagctgttgatatccagcgccaccttggacgtcaccaagttctccgagttcttcgacgacgctccggtctaccaaatcccaggccgtaggttcccagtggacatttactacaccaaagccccggaagcggattacgtagacgcctgcgtggtttccatactccaaatccacgtaactcaaccgttgggggacatcctggtgttcctgaccggccaagacgaaatcgaaacctgccaagaactcctgcaggaccgagtaagacgcttgggctccaaagtaaaagagctgatcgtactgcctttgtacgccaaccttcccagcgacctgcaagctaaaatattcgagccgacccctccgggagccaggaaggtcattctggctacgaacattgccgaaacttcgcttacgatcgataatattatctacgtgattgatccaggtttcgccaagcagaatcacttcaattccaggaccggaatggagagtctgatggtggtgcccatatcgaaagcttcggccaaccagcgagccgggagggctgggagggtggcggccgggaagtgcttcaggctgtacacggcctggtcctataagcacgagttggaggaagcgaccgttccggagatacagaggatcaatttggggaatgcagtgttgatgttgaaggcgttggggatcaacgatttggtgcacttcgattttctggacccgcctccgcacgaaacgctcgtgttggctctggagcagctgtacgctttgggggctctgaatcatcacggggaattgactaaattggggaggaggatggctgagttgccggtggatcccatgatggctaaaatgatattggcgtccgaaaaatacaagtgttctgaagaaatagtcacgataggcgccatgttgtcggtgaacggggccatattttacagaccgaaagacaagattatccacgcagacacagccaggaagaatttcaatcacctggctggcgatcacttgagccttctgaacgtttacaatcaatggagagactccgattactcgctgcaatggtgctacgaaaattttatccaacacaggtcgatgaaacgagccagagacgtcagagagcaactagtcaatctaatgaccagagtagaaatcgaaatagtgtcgggaatcgaagaaaccgacaacattcgcaaagccatcacctccggatacttctatcacatagcgaggttttcgaagggcgggagctacaaaacggtgaagcataatcagagcgttaccattcacccgaacagcgctttgttcgaaacgctgccgcggtgggtgttgtaccacgaattggtgttcacgaccaaagagttcatgaggcaagtcatcgaaatcgagagcaagtggctgctggaagtggctccgcattactacaaggccaaggaattggaggattctaccaataagaaaatgcccaaaactgttggaagaagtaaaatgactgattga

SEQ ID NO: 585 - DNA, 1371 bp, Phyllotreta nemorum
atgaaggtagaagaggtgaaaagcaccgtgaaaactcaaagaataagcgcccatactcacataaagggtttgggtttggatgaagcgggttttgcaatcccctcggcggccggcctggtcggccaggagcaggcaagagaggctgcgggagtcgtcgtggacatgataaggagcaagaaaatggccggtagggctgtccttctggctggccctccaggtaccggtaaaacagccatagctctagcaatcgcccaagaactaggcaacaaagtaccgttttgccctatggtcggctcggaagtgtacagcacagaaataaagaaaaccgaagtgctaatggaaaatttcagacgagccattggccttagaattagagaaacgaaggaagtctacgaaggagaagtcagcgaactgacacctgtcgaaacagaaaatccagcaggaggttacggtaaaactgttagtcacgttgtaatcggtttgcggacagccaagggcagcaagcagctgaaactagatcccagcatttacgaagccctgcaaaaggagaaagtggaagtgggagatgtcatttacatagaagccaccagtggggctgttaaaagacagggaagatctgatgcgtacgctacagaattcgatctagaagccgaagaatatgtgccgcttcccaagggagatgtgcacaagaaaaaggaagttgtacaggatgttactttgcatgatttggatgctgctaatgcaaaaccacagggtggtcaagacgtgttgtccatgatggggcaactgttaaaaccaaagaaaaccgaaatcacagacaaactcagaaaagaaataaataaaatcgtggacaaatacattgatcaaggtattgcggaattggtaccaggagtattattcattgacgaagttcacatgttggatatagaaacgtttacataccttcatagagctttggaaagcgctatagcccctattgttatttttgctactaatagaggtcgttgtcttattagaggaacagatgatgtattttctccgcatggaattccattagatcttctggatagactgctgattatacgcacaattccttacaacaaatctgaaatggagcaaattattaaattgagagctgttacagaaggtttggaaattgaggaggaagcaatctcaagtttgggagaagttgggacaaaggccaccctgagatatgcggttcagcttttaacgccgtcgtttttaacagctaaaattaacggaaggagcaacattctgcaaagcgacgtggaggagattggcactctattcctcgatgccaaatcttctgctaaaatacttactgaacacaaagataaatttatgacgtaa

SEQ ID NO: 586 - DNA, 1581 bp, Phyllotreta nemorum
atgacttcaataataaaagtacaagccttatccggcgccaaagatgaatctcccccttgttatctattacaagtcgacgacgttagaattcttttagattgtggttgggatgaaaaatttgatatggaatttattaaagagctcaagaggcacgtacatacgatagatgctgtgttaatttcttacccggataactatcatttgggggctctaccatacgcagtgggtaaattaggcttaaattgtccaatatacgccactataccagtgtacaaaatgggtcagatgtttatgtacgatctctaccagtctcagtacaatatgaaggaattttgtattttttctcttgatgatgtcgatgccactttcgaaaaggttgttcagctaaaatataaccaaacggtccctttaaaaggtaaaggatacggcataactgttacacctctaccagccggtcatatgatcggaggaaccatatggaagataatgaaagtaggcgaggaagatattgtatactgcaacgattttaaccataaaaaagaaaggcacttgaacggttgcgaactgaagaaacttcaacgaccatcattacttataaccgatgcctttaatgcaacatatcaacaggccagacgacggacgagagatgaaaaattaatgacaaatattctccagactttacgaaaccacgggaacgtcctcatagccgtagacactgctggaagagtactggaattggctcacatgttggatcaactgtggagaaacaaggaatcggggctcttggcttactctttggcttttttgaacaacgtcagttacaatgtagtcgaatttgccaaatcgcaaatagaatggatgagcgataacctgatgaggagtttcgaaggagccagaaacaaccccttccagttcaaatatttgcagctatgccacagtttgggggaactgagcaaagtgccaagtccgaaggtggtactggccagctcgccggatttggagagcgggttttccagggaactgtttctacagtggtgttccaatccaaataacagtattattttaactacgaggacctcacctggaacgttggccagggatttaattgacaatggaggaggaaggaccatagacttgatagtagagcgaagagttaaattggaaggacaagagctcgatgagtatgaaagacgacagcggtctaaatatgacaaactagaggatgaggaagccgattctgattcggattcagatattgaaatgttggtcacaactaaaggcaagcacgacattcttatcaaacaagaaggcaaaatatccacaggattcttcaaagtgaccaaaaaaatgtacccgatgtatcctttcaaggaagataaaataaaatccgacgaatacggcgaaatagtgaaagcagaagattacaagttagctgaaatttcagctgaaacagaagataacaaagagaatatcgtgatcaaaaaagaggaagaagaaataagtaaacattactcatttatttatttatttattttattttttccaagaaaattgcagtacagagaaataaatataaattag

SEQ ID NO: 587 - DNA, 2283 bp, Phyllotreta nemorum
atgcctcctctggaggtaacagcgaacaccaacaacgacgactcggcccccatcaacccggtcgtcggaataatctaccccccgccggaggttagaaatatcgtcgacaaaaccgccagcttcgtcgcccgaaatggccccgaattcgaagcccgcatcagacaaaacgagctcggcaatcccaaattcaatttcctcaatggcggcgatccctatcacgcctactaccagcacaaagtcaaagatttcagagaaggaaaaggacaagaacctacgccgggtttgagccaggccgtggcgaagttgtcggtgagcgcttcggctcagcagaagcagcaggagatattgaagcaggtggagcagccgttcgtgccgaaagacccgccggctgagttcgagtttatagccgatcctccttcgatttcagctctggatttggatatcgtgaagcttacggcccaatttgtagcgagaaacggccgggctttcctcacgcaactgatgaacagggagcagagaaacttccagttcgattttctgagaccccagcattcgctcttccagtatttcaccaagcttctggaacaatacaccaaggtgcttattccaccgaagagcatggagcagaggctcagagacgaagcgaaaagcgccaaggccgtgctggagcaggtcaagtacagggccgaatggttgcggtatcaggaacagcaaaaggccaaggaagaggagatactcgaacgagaaagggtggcttatgctcaaatagattggcacgatttcgtcgtggtggaaacagtggattaccaaccgtttgaaatagggaatttccctcctccgacgacgcccgaagaagtgggagcgaggatattgatacaggagaggatcgaagaaggcgaagatatcgaaatgcagctggagagcgacgaagaagatgatccttcgaacgctgatgatggtttgagctccatgcaggataagacgaaacgcaaaggaggcgatgataataggctgcaggacatggaagaagacacttctgatgaagataatgatgatgaagttggtaaaacttcgacttcgtcttcgctcattcaaccgcctttgccgcccatacccgataaagtgctcgttaaaaaatacgatcccaaacaagctgtcaaagtatccagacccacagtaggcgacgattatttagtatcgccaatcacaggcgagaagataccggccagcaaagtacaggagcacatgcgcatcggcctactagacccgagatgggtcgaacaaagagacaaacaaatgtccgataaaatgaatcaagacacggtatacgcagccggcagcgccatcgacgcctcgctgaagctgctggccgaacgacgtacggacatattcggcgtgggcgacgaggagacggccatcggcaagaaaatcggcgaagaggacgtgcgaaaggacgagaaggtcacgtgggacgggcacacgagcagcgtcgaggcggcgacgagggccgcccgcgccaacatcaccttggaagagcaaatacatcagattcataaggtgaaaggccttttacctgatgaggagaaggagaagatcggtccgaagaacattggttcgaagaaaatcaatatacaaagcgtaattactaccaaaccgcccaatccatctaatcaacaacccaaacagcccgtttcgatcatccaatcgagcgcccagccgatcatgccggttccaacgcaacctacgatgctcgccccgcaaccgtccatcatgatgatgcccgcccctcccatgcctaccatacgtccgccgcctttgatgatgcccggcggtgtggcgatgggagggtattcggtggggccgatgcccggccagccgggtcccggcatgaacatggcgcccatgaaacatcccggcgacggtcccggcgaagaggagcctcctaataagaaattgaggaacgaggattcgttggtgccggaaaacgtgtttttatccaggaatccgagccaagtgtccatcaagatttccataccggttatgccggagaaatccgaatggcggttgaagggccaaacgttgtcgtggactttggcgctcacggaatcggtctcgaatttgaaggcgaaaatccaggaggagacgaacatgccgccggcgaaacaaaagttatttttcgacggaatgttcttcaaggactccaacaccttggcctactacaacgtcacgcaaggcgccgtcatccagctacaaatcaaagaacgaggcggaaggaagaaataa

SEQ ID NO: 588 - DNA, 984 bp, Phyllotreta nemorum
atgccgagtacagaggttacaacgactaaggtaatagtgcacccgctggtgcttctcagcgtggtggaccatttcaaccgaatggggaaaatcggcaatcaaaagcgcgttgtcggtgttctactcggttgctggagggctaaaggagtcttggatgtgtccaacagttttgcagtccctttcgatgaggacgacaaggataaatctgtatggtttttggaccacgactacttggaaaacatgtacggcatgtttaagaaagtgaatgctagagaacgcgtcgtcggttggtaccacacgggccctaaattgcatcaaaatgatattgcgattaacgaattgattcgaagatactgcccgaattccgtgctggtgattattgacgctaaacctaaagatttggggcttcccactgaagcctaccaagcggtagaagaagtccacgatgatggctctcccacgtccaaaacatttgaacacgtcccgagcgaaatcggcgccgaagaagctgaagaggtcggcgtggagcatttactgagagatatcaaagatactacagtgggaactttatcccagaggatcaccaatcagttattaggccttaaagggctgcatttgcaattgagagatataagagactatttgatgcaagtgtgcgataataaattgcccattaatcatcagatcatctatcagttgcaggatattttcaatttgttgcccgatataaaccaagatgcgttcaacaattcgttttatgttaaaaataacgatcaaatgcttgtagtttatttagcggctctcgttcgatctatcgtcgcactgcacaacctaatcaacaacaaactcaccaacagagacgcggaggaaggtaaaaaggaagagaaaaaggacaaggataacaaggataaagatagcaaagacaaagataaggaaaaaacggataaggacaaggaggcgaagaaggacgagaagaaaaaataa

SEQ ID NO: 589 - DNA, 1653 bp, Phyllotreta nemorum
atgtttggaggaggacgcgccccgattttagtgttgagccagaatacaaagcgcgagtcgggccgaaaagttcagttggagaacatcaatgccggcaagcaaatcgcggatgtcattaggacatgtctcggtccacaagccatgttaaaaatgttgatggaccccatggggggcatcgtcatgaccaacgacggcaacgccattctgcgagagatcaccgtgcagcatcctgctgctaaaagtatgatagaaatagccagaacccaagacgaagaggtgggagatggaaccacttctgtaatagtattagctggagaaatgttggccgctgccgaacagttccttgaacagcaaattcaccccacgatcatcatccgacaatacaggcaggccctggaagatatggtgcagtttctggaaggtcctttgagcgtgcccttggaccgaaacgacaaaaacgccatagctgaagtggttaaaggttgcattggaacgaagttcttgagcaaatggtcggatttggccgtcaatatcgctttggatgcggtgaataccgtcttattggaagaaaacggtcgaacggaggtggatatcaagagatacgccaaagtcgaaaagattcctggtggttcggtggaggactccaagattttgagaggcgtaatgttgaacaaagacgttacccatcccaaaatgaagcgacacattaagaatccgagaatcatccttttggattgcgctttggagtacaagaaaggagaatctcaaaccaacgttgaaattagtaccgaaaccgatttcaccaaactcctcgaattggaagaagagcacgtcaagcgccaatgcgaagagattatcgccctcaagccggacgttgtgttcaccgaaaagggagtatccgatatagcccagcacttcctgctcaaggccggcatcactgccatcaggcgtgtcagaaaatccgacaacaaccgaatcgctagagcttgcggcgccgtcatcgtaaacagaaccgaggaactccaggagtccgacgtgggcaccggagctggtgtgttcgatatcaaaaaaatcggcgacgagtacttctgtttcgtcgacgaatgccaaaatccaaaggcttgtacgatcctcctccgaggagccagcaaggacattctgaacgagatcgaaagaaatcttcaagatgccctgcaagtggccaggaacattgtattgtctccgcgtctagtgcccggcggtggggctatcgaaatggccgtagcccaacggttgatgcagaaggctacgcacggtccctacagggcgcttgcgcacgctttggaaatcattccgaggacgttggcgcaaaattgcggcgctaataccatcagaacgttgacggccctgagggccaagcacgccaaccacactgaaaccgacaagccgtgcacttggggtatcgatggtgaaactggggagttggttgatatgaaagttaaaggcttgtgggagccgttatctgtgaaacttcaaacttacaaaaccgccgttgagacagccattctcctgttacgtatcgacgatattgtatcgggatccaaaaagaagggcgacaaggaggtcccgacgcccagccagatgcaacagcaggaaaccaaagagacggattaa

SEQ ID NO: 590 - DNA, 702 bp, Phyllotreta nemorum
atgatgcaaacaggagtacgtccctattatcccgactattctacagttcccatggaacgccagattaatccttacgctgataatggagggagcgtcgtagcgattgcaggaaaagatttcgtggttattggcgccgatacgcgtcttagttccggcttttccatatacactagaaaccagaacaagctgttccctctttctgaaacgactgttttaggatgttcaggttgttggtgcgatactttaacgctgactcgtattttaaagtctcgcatgcaaatgtactatcaagagcataacaagaacatgtctacgacagcggctgctcaaatgttgtcgaccatgctgtattacaagcgatttttcccttattacatatcgaacattctcgttggattggataatgagggaagaggttgcgtctacagctacgatcccgttgggcattgcgagaaagccacctacagagcaggtggttctgcaggggctttgcttcagcccttattggacaatcaaattggacaaaaaaatctgcagaagccttcgcaggaagatcttactcaggaaaaggccatttctacgctgaaagatgttttcatatccgctgcagagagggatatttacactggtgatagtgtactaattaaaatcattactaaagatggaactaaagaagaaacatttgatctgagaaaagattaa

SEQ ID NO: 591 - DNA, 900 bp, Phyllotreta nemorum
atgttccaattcggcttcaacatgttcccggacatcccgcgccccttcaacatgacctacaagtgctactcggtggccatgttcccgggaaacgagcggcaggacgtcgaacgcggaggaaaaataatcatgccgccttcggcgctggaacagctcactagattaaacatcaactaccccatgttatttaagcttgttaacaagaagacgagccgtacgactcattgtggtgttttggagttcgtagccgacgaaggaaaagtctacttaccattatggatgatgcacaatttggtgctgaccgagggagatttagttcaaatggaaagcgtatcgttgccggtcggcacgttctcgaaattccagccgttaaacccggacttcctcgacatcaccaacccgaaagccgtgctggagaattgcctgcggtcctttgcttgtctgaccaccggcgacgtgatagccgtcaggtacaatcaaaaggcgtacgaattgtgcgtgttggaaaccaagccgggcaacgccatcagcataatcgaatgcgacatgaacgttgaattcgcggccccggttggctataaagagcccgagcaggctaaaaaagaagaagaaatgtcggtggatcccgccgacttgatgccggagccgtcggggttcgtggcttttagaggggctgggaaccgattggacgggaagaaacggaaggattcgtcttcgagcgacgctccttcggctaagccggcttacgttcgggggatacccgattacgattatcaaataggcacgctggactttatcaggcgtacgatagcgaagcctaaggaaaaggagggcagcgatgacggggatgattttaaggcttttagcggcaccgggtttagtttgaggagtaggaattag

SEQ ID NO: 592 - DNA, 1623 bp, Phyllotreta nemorum
atgtcggctttaccaggagctatcgctttcgacgaatatggaagaccgtttataattttaagggaccaagacaagcaaaaacgattgaccggaatcgatgccctgaagtcgcacattttagccgcaagtcaaattgctcacactgttcgcacctctctggggcccaaaggcctagacaagatgatggtatcctctgatggggaagttactgttacaaacgatggggctacgattttgaagatgatggatgttgaacatgaagtagctaaattgctagttcaactatctcaatcccaggatgatgaaataggtgatggaaccactggtgtagtagtattagcaggggctcttctggaacaagccggcgctctcctggaccgtggaatccatccgataagaatagctgatggtttcgaattggcatgccaaacggctgtggaacatctagagaaaatcgctgagctgtttccagtttctgctgaaaacaccgagccccttattaaagtcgcgatgactacactaggttcgaaaataattaacaaatgtcacaggcaaatggccgaaattgccgtcaatggcgtattagctgtagcggatctcgaacaaaaggatgtcaactttgaactcattaaagttgaaggaaaggttggtggtaaattggaagacacgacattagtgaaaggtgtcgttatagataaaacaatgtctcatcctcaaatgccgaaggagctaaaggatgttaaattggccatcctcacctgcccgtttgaacctcccaaacccaagaccaagcataagttggatgtcaccagcgtagaagactacagagaactgagattgtacgaacaagaaaaattcaaggaaattgttcgcctggtcaaaaaatcgggagctaccttggctatttgccaatggggattcgatgacgaagctaaccatttgctgttgcaggaggagttacctgctataagatgggttggaggacctgagatagagctgatagctatcgcgaccggaggaagaatagttccacgattcgaggaacttagccctgaaaaacttggttcggccggtttggtgcgtgagatatcctttggaaccaccaaagataagatgatggtgattgaagattgctcgaattcccgtgccgttaccattcttgtcagaggtggtaatcaaatgttggttgatgaagccaagaggagtttacatgatgctctgtgtgttgtgaggagtctcattcaggaaccgagagtcgtgtatggaggaggtgcagctgaaatagcttgcagtttagctgtggcagctcaagccgatcagctagcttctttggaacagtacgcttatcgagcatttgctgaagctttggaaagcattccgctggccctggctgagaattcaggattttctgccatccattctttgggagaaatcaaggcgaagcaagctgcttcgggagatccggcacttggcgtcgattgcatgaatactggcaacataaacatgagggaacagcatgttacagaatctctgcgatccaagagacaacagttgttattggctacgcaattagtgaaaatgattctgaaaattgacgatgtacgtcagcccggctctggctaa

SEQ ID NO: 593 - DNA, 342 bp, Phyllotreta nemorum
atggccaatgctatggacgtcgattccgaagaaattgaattaccaacttcaagcagttcgaaaggcgagaaaaaacgattcgaagtgaaaaagtggaatgctgtagcactttgggcctgggatatcgttgttgataactgcgctatatgccgaaaccacataatggatttgtgcattgagtgccaggcaaatcaggcctctgcaactagcgaggaatgcactgtagcttggggagtttgcaaccacgcttttcactttcactgtatttcaagatggttaaaaactaggcaggtatgccctttggacaatagagaatgggaattccaaaaatatggtcactag

SEQ ID NO: 594 - DNA, 1605 bp, Phyllotreta nemorum
atggtgtcattaaaccccgtaaggattctcaaacaagaggccgaagacgaacggggcgaaatagcgcgtttgagcagcttcgtcggcgccattgccattggagatttggtcaggagtaccttggggcccaaaggtatggacaaaattcttgtatcgagcggcagaaactccgggatggtagaagtcaccaacgacggggctaccattttaaaatccgtgggcgtcgataacccggctgcgaaaatactcgttaacatgtcgaaagtgcaagacgacgaagtaggcgatggcaccacatcagttacagtatttgcgtcagaattattaaaggaagccgaacgtttgatcgagcaaaagatccacccgcagaccatcatagccggttggagaaaatccgtggatatcgcgagaaaagcgcttttggaagcttctgcagacaacagcgccgatttagaagccttccgagaagatctgatgaacatcgcccgaacgaccttgagctcgaaaattctatcccagcacaaagagcacttcgccaagctcgccgtcgacgccgtgctgcgattaaagggatccggcgacttgcaagccatccagctgatcaaaaaaaccggcgggtgcctgcaagattccttcctcgacgaaggcttcctgctcgacaaaaaacccggagtacaccagcccaagcgagtcgagaacgctaaaatcctaatcgccaacactccgatggacacggataaaatcaaagtgttcggctcgcacatcaaagtcgactcgatggccaaaatcgccgaactggagtcagccgagaaagacaaaatgaaagacaaggtcaacaagatcctccagcacaaagccaacgtcttcatcaaccggcaactcatctacaactaccccgagcagttgttcgccgacgccggcgtaatggccatagagcacgccgacttcgacggtatcgaaagactggcgctggtcaccggaggagaaatagtctcaacattcgatcaccccgagctggtgaaacttggaacttgcgacttgatcgagcaagtcatgatcggagaagacactctgctgcgtttcagcggagtggccttaggagaagcctgcacgatagtcattcgaggagccacccagcagattatagacgaggccgatcgttccctacacgacgccctctgcgtactagccgctaccgtaaaagagagcaggattgtcttcggaggcggttgcagcgagactctaatggctaccgctgtggctagagcttccgtgaatacggccggaaaggaagcgttggccatggacgccttcgccagggctctgctgcagctaccgaccatcatagctgataatgcgggttacgattcggctcagttgattagcgagctcaaggcggcgcacaacagcgggcagagcactatggggttgaatatggagaagggggagataggcgatatgcgggcgttgggcatcaccgaatcgttcgttgtgaaacggcaggtgttgatatcggccggtgaggctgccgagatgattcttcgtgttgataatatcatcaaggcggcgcccaggaagcggaccgaagacagaggaatgtgttga

SEQ ID NO: 595 - DNA, 840 bp, Phyllotreta nemorum
atgttcagaaatcaatacgacagcgacgtaacagtatggagtccacaaggacgtcttcatcaagtcgaatatgcaatggaagcggttaatctcggttcggcaacggtaggactaaaaagcaacagtcatgctgttataatagcattgaaaagagcttcatccgaattatccgcttaccaaaagaagatcattcaaatcgacgatcacatcggcattactatatctggtctgacagcagacgcaagaattttaagcagatatatgagaaacgaatgtttaaattacaagtactccttggacgcttacatgccattgaatagattaataaacatattaggtatcaaaatgcagcattgtacgcaaagatacgatcgtagaccgttcggtgtaggtctattggtagccggttacgatgacaacggagcccacatttaccaaacatgtccgtctgctaatttctacaattgcaaggccatgtcgatcggagctcgatctcaaagcgctcgaacttatttggagaagaaactcgacgaattaaatttgtgttctttagaggatttgattaaacacggtttgagagctctcagagatactcttcctcctgaagtcgatttgaatacgaagaacgtctccataggatatgtcggtaaagggattacctttaaaattttggaagaagaagaaactgctccttatcttgctttaatcgagggtgaagaacgtcgaggtggtggcggtggaggagggagttcggaagtacaagctgatcctttgagagaatcgggggacgatggtcccaaggatcccataccgactgtagcaatggatactacggaataa

SEQ ID NO: 596 - DNA, 2613 bp, Phyllotreta nemorum
aaaaaaaaaaaaaaaaaaaaaaaaagagcgatttgttttaaatttatttcaaaaatggttttaaagccgggaagtaaacaggaacctatggaaataactttcaacgacgatgatttgccttacgaggaagaaattttacgaaatccctactcggtgaaacactggcttcgatacatagatcacaagaaaacggctcccaacaacgaaacgaacataatcttcgaaagggccctcaaagaattaccgggttcgtacaaattgtggtacaattatctacggaccagaaggaatcaaatcaaaagcaaatgcatcaccgatccgggtttcgaagaggtaaacaacgccttcgagcgttcgctggtattcatgcacaagatgcctcgtatttggatggactactgcacgttcctcaccgatcaatgtaaaataacgagaactcgaaaggttttcgaccgggcccttcgagccttacccgtaactcagcataacaggatatggcctttgtatttgaaattcgtgcagaaacatgatatatcagaaacggccgttcgagttttcagaaggtatatgaaattgtgtcccgaaaacgccgaagaatacatcgattacctaacgaaagcagaacgattagacgaagccgctataataacagctaaaatagtaaacgacgataatttcgtgtcccaacagggcaaatcgaaacaccaactgtggaacgagctgtgcgagctgatttcgaaaaacccggaaaaagttcgctcgctaaacgtcgacgcgatcataagaggcggcctgcgaaggtacaccgaccaattgggccacctgtggaactctttggccaattattacgttcgcagcggcttattcgaacgggctagagacatttacgaagaggccatccaaaccgttacgaccgtcagagatttcacccaagtattcgatgcgtacgcgcaattcgaagaattaagtctgagcaaacgaatggaagaagtggccggcaagcggaatcccagcgaagaagacgatacggagttggaattgagattggcgcgattcgagtacctcatggaaagacgattgttgctgcttaattcggtgttgttgcgacaaaatccgcacaacgtgcaagagtggcacaaaagagtacaactctacgaaggtaaacctcatgaaatcatcaacacgtacacggaagccgtgcaaacagtcgatcccaaattggcggtgggcaagttgcacacgctctgggtggaattcgccaagttctacgaaagcaacgatcaaatcgaagaggcccggctgatattcgagaaagcctcgcaggtcccctacgtgaaagtcgacgatctggctacggtgtggtgcgaatggaccgaaatggaaattcgcaacgaaaattacgaccaagctttaaaactcatgcaaagagcgaccgtaatgcctagccgtaaagtggcctatcacgatgacaccgaaaccgttcaaagtagactgtacaagtcccttaaagtttggtcgatgtacgccgatttagaagaaagcttcggcagcttcaaatcctgcaaggccatctacgacaggatcatcgaactgaaaatcgccacgccgcagataatcatcaattacgtcgtggttctggaagaaaacaattatttcgaagaagccttcagggcttacgagaagggcatttctctgttcaaatggccgaacgtatacgacatatggaacacctatttgaccaagtttctgaaacgatacggcggtagtaaattggaacgggcgcgagatttgttcgaacaatgtttggacggttgtccctcgcgattcgccaaacacctctatttgttgtacgccaaattggaggaggagcacggaatggccaggcatgcgatggccgtatacgaaagggccactgaagccgtaccggagaatgagatgttcgacattttcaacatatacataaaaagagccgcagaaatatacggcataccgaaaacgaggcaaatctacgagaaagccatccaggtccttcccgaggataaaacaagggaaatgtgcttgagattcgccgacatggaaacgaaattaggcgaaatcgatcgagccagggcgatatacgcgcattgcagccaaatctgcgatcctcgagtgacggccgagttctggcaaatttggaaggagttcgaagtgcgacacggcaacgaggacacgatgagggaaatgttgaggatcaaacgcagcgttcaagccgtttacaacacccaggtgaacatgatgtcggctcagatgttgagctccgcgggcggctcgagcggtaccgtagcggacttggccccgggggttaaagacggcatgaggctgttggaggcgaaggcggccgagatggccggctcggcctcggcggcgcagaaatccaacataatgttcgtcagaggcgaaactcaaggagataataaagacaaagtggtcaatcccgatgaaattgatatcggaagcgaggatgacgaggaagaggaggaggaggtggagattccgttggagaagcaaaacgtgccgtccgaagtgtttggaagtctcaagaaaagagggaacaatgaggatgaggatgattaa

SEQ ID NO: 597 - DNA, 906 bp, Phyllotreta nemorum
atggcgaacggaccgatagccgaaagaaatagagacgctactatatacgtcggcggtttagacgataaagtatcggaatccctgctatgggagctgttcgtacaagccggaccattggtgaacgtacacatgcccaaagatcgcgtcaccatgatgcaccagggctacggttttgtggaattcatgggcgaagaggacgcagattatgctataaaaataatgaatatgataaaattgtacggaaaacccataagagtcaacaaagcttccgctcatcaaaagaacttggacgtcggagccaacatttttatagggaacttggacccggaggtcgatgagaaactcttgtacgatacgttttcagccttcggtgtaatattacaaacgcccaagataatgagagatccagagactgggaattccaaagggttcgcgtttatcaacttcgccagcttcgaagcctccgatgcttcaatcgaggccatgaatggccagtacctctgcaatcgaccgatatctgtttcctacgcattcaagaaggactcgaagggcgagagacacggttcggccgccgagcgattgttagccgcccagaacccgctatcgcaggccgacaggccccatcagctgttcgcagacgctccaccgataggaatgatgccgatgagcatggcgccgcccccaccgcctctaatcaccggcatgatgcctccccctccgccaactcctggcggaatgccgccccctccgccgccggtccctccaccgagctccttccccgctggcataccgccgccgccgttaccgccttctcaaccgcccctgccaccgggcgcgccgcccacgatggcggctgtgcccggcggtggagccagacctccgccgccgcctccgtggtccggtgct

SEQ ID NO: 598 - DNA, 774 bp, Phyllotreta nemorum
atgggtcgtgttattcgagcacaacgtaaaggtgcgggatccgtattcaaatcccacactaaaaggaggaaaggagcacccaagctccgttatttggatttctccgaaaggcatggctacatcaagggtgtagtgaaagacatcatccacgaccccggtcgcggcgcccccttggctctagttcacttcagggacccttacaagttccaaactagaaaggagatattcattgcccccgagggaatgtacacagggcaatttttgtactgtggaaagaaagctaacctccaaattggaaatgtgttgcctgtaggaactatgcctgaaggtacaattgtctgtaatttggaagaaaaaactggtgaccgtggccgattggctcgagcatctggtaactacgcaaccgtgattgcccacaatcacgatacaaagaaaactagagttaaattgccatcaggagctaagaaagttatcccaagcaacaacagagctatggttggtatcgttgccggtggtggtcgtatcgacaagcccatcctgaaagccggtcgtgcctaccacaaatacaaggtgaagcgtaactgctggccgaaggtgcgtggtgttgccatgaaccccgtcgagcatcctcacggaggtggtaaccatcaacacattggtaaagcctccaccgtcaagagaggaacgtccgctggtcgcaaggtcggtcttattgctgcgcgtaggaccggtcgtatcagaggaggtaaggtcgaaactaagaaggacgattaa

SEQ ID NO: 599 - DNA, 411 bp, Phyllotreta nemorum
atggcgcgtaccaagcaaacggctcgaaaatcgacgggaggtaaagctcctagaaaacaattagccacgaaagcggcccgaaaaagtgctccggcaacgggaggagtaaagaaacctcatcgttacaggcccggtacggtagctcttcgagaaattagacgttaccaaaaaagtaccgaactcctgattagaaaattacccttccaacgtttagtgagagaaattgcccaagattttaaaaccgatttgcgttttcagagttcggctgttatggcgttgcaagaggctagtgaagcctatttggtcggtctttttgaagataccaacctgtgcgccattcacgctaaacgtgtaacgatcatgcctaaagatattcaattggcaagaagaattcgtggtgaacgtgcttaa

SEQ ID NO: 600 - DNA, 1593 bp, Phyllotreta nemorum
atggcaataagtttattgaatccaaaagctgaagtggcgagagccgcccaagcgttggccgttaatataactgcagccaaaggtatttctgaagtgatgaaaaccaacttgggaccgaagggaaccatgaaaatgttggtgtccggtgccggtgacattaaaataaccaaagacggcaacgttctcttgcacgagatgcaaatccaacatcccacggcttcgttaatagccagagcttcgacggctcaagatgatatgactggtgacggaaccacatctaccgttttagttatcggggaactcctgaaacaagccgacatatacatcgcagaaggcttacaccccagaacactcacagaaggtttcgacaaagcgagagcaaaggccctagaaattttggagaagctgaaagtacccatcgaaatcaacaaagaatcgttgactgatgtttgtcgaacaagcttaagaacaaaattgcaccaaaatttggctgacctcctcactgatgtgtgcgtcgaggccattctcgccatcaaacagtccgacaaaccagtcgacttgcacatggtggagctcatggaaatgcagcacaaaaccgagaccgacactcagctggtcaaaggattggtgctcgatcacggcgctcgtcaccccgacatgccgaagagcttgaagaattgttacatcctcacctgtaacgtcagcatggagtacgaaaagagcgaagtcaattcgggcttcttctacaaaaccgccgaagagagggagaaactggtgttggccgaaagagacttcattgaacagcgagttaagaaagtcgtcgagttgaagaaggctctttgcaaaggcacaaacaagacgtttgttgttattaaccaaaaaggtattgaccccatgagcttggacatgctggccaaggagggaatcattgctctccgaagggctaaaagacgtaacatggaacgtctggctttagcatgcggtggaacggctgtgaacagtttcgacgatttacaagaatctcaccttggttacgctgggcatgtttacgaacatgttctgggcgaaaacaaatacacattcgtcgaagaatgcaaagtgcctcaatctgtaacgattttaatgaaaggacccaacaagcacaccttgctgcagatcaaagacgccgttagagatggcctgagagctattaataacgcaatcgatgacaaagcccttattccaggtggtggtgctttggaagtggcagtaaacaaggaattgttggcgtacaaggacgaaataaagggaaaagctcgcttgggcgtagccgcttacgccgaagcccttttggttatcccgaaaactctggccgtaaactccgggttcgacgcgcaggataccatcgtgaagctgcaagaagaagctcgactgagtgccgaaccgatcggcctcgacttaacttccggcgaacccatcaatcccaaagatgcgggcatctacgacaactacgtggtgaagaagcagatcattaattcgtgctcgataatcgccagcaacttgttgctcgtcgacgagatcatgagggccggtatgagcagcctgaaaggctaa

SEQ ID NO: 601 - DNA, 3126 bp, Phyllotreta nemorum
atgtctagtgctggaatcgcagacagccccatcgatcctccagcaaaaaagcgaaagctcgactcgaaaaactgcggccccgacatggcgaacaacgaagcttcgggatcctccaacgccggcgaaatcgacgagggactctactcgaggcagctgtacgtgttgggacacgacgccatgcgccgcatggccaccagtgacgtgctcatatcgggtctaggcggcctgggcgtcgaagtagccaaaaacgtgatcctaggcggcgtcaaatcagtgactctccacgacgatgccctctgcaccgtccgggatctatcctcgcaattctacctcaccgaggccgacgtggggaagaaccgagccgaggcctgctgtaagcacctgtccgaactcaacacctacgtccccaccaagccctacacgggccccctcgacgaaaaggtcctacaaaaatacagggtggtagttttaacaaatagtactcgagccgaacagctccgtataagcgagataacgcataataacgatatcgctttgattgtagccgatacgaaaggtttattcgcccaggtgttctgcgacttcggcaaggccttctccgtggtggacgtgaacggggaaccccccgtctccaccatgatagccgatatatcgaacgatacggagagcgtggtcacctgcatagacgatacgagacacggcatggaggagggcgattacgtcaccttctcggagatcctgggcatgaccgagctgaacaactgcaagcccatcaagatcaaggtgctggggccgtacacgttcagcattggcgacaccaccaagttctccaagtacgtacgaggcggtatcgtaacgcaggtcaaaatgcctaaggaggtgcattttaagccgctgaaggaggccttgcagaatcccgaattcgtggtgaccgacttcgccaagttcgatcacccgattcagctgcacctcgccttctccactctccacaagttcgtggagaagaccgggcggttgccgaaggcctggaataaagacgacgcctcggagtttatcgctctggcgaagtcgttggctgtaaacggttctacggataccgaggtcaatactgatattctcaatattttctctaaatgttgctcgggtgatctaaatcctattaatgctactattgggggtatcgtggcgcaggaagtcatgaaagcctgttcggggaagttctaccccatttaccagtggttgtatttcgatgccatcgaatgcctgccccaggacaaggaggagatcaccgaggaactggcggctccggttgatggtagatatgatgggcagatcgctgtgtttggaaaagacttccagaagcgattaggtgagctgaagtatttcattgtgggtgccggggccatcggttgtgagctgttgaagaactttgccatgatgggaataggcacgcaaggaggtcaggtcactgtgaccgacatggatttgattgaaaagtccaatttgaacaggcaatttttattcaggccccacaacgtgcagcaacccaaatcagccactgctgcaaaggtaataaagaagatgaatcccgacgtcaacatagtggcccacgaaaaccgagtgggccccgaaacggaaaacgtctacaacgacgagttcttcgaggtcctagacggcgtagccaacgctttagacaacgtagacgcgagaatatacatggacaggcgatgcgtttactaccgcaaacctctgctggaatccggcacgttgggaaccaaaggcaacacccaagtagtcgtgccgttcctttcggaatcctacagctcgtcccaagacccccccgagaagagcatacccatttgcactctgaagaacttccccaacgccatcgagcacactttgcaatgggccagggacaatttcgagggactgttcaggcagaacgccgagaacgcctcgcagtacctcagagaccccgatttcatcgaacgaaccgtcaagctgccgggtgtacagccactagaagtcctggaatccgtaaaggctgctctgatcgacgaaagaccgaaggattacgacgattgcctggcctgggctcgtctgcattgggaggaccaatacgccaatcagatcaagcagctgttgttcaatttcccaccggatcagctcaccagcaccggccaattgttctggtctggaccgaagaggtgtccagaaccgcttgtattcgatatcaatgaagatttgcacgtggactacgtaatagctgcggctaatttgaaggctcaggtttacggcatccctacgaataggaataggtgttacgccaagcaagtggtcaccggcattgaggtgcccccgttcgtgcccaaatcgggcgtgaaaatcgccgtgacggattcgcagatggccatgaacggtaacaacgtcgacttggatcgtatcaatcagatcaaacaggagctgccctcgatggaggagctcagcgagctgaccctcaccccgttggaattcgaaaaggacgatgattccaatttccacatggacttcatcgtggcggcctcgaacttgagagcggccaactacaagatcccgatggccgatcgccacaaatccaaactcatagctggaaaaattataccagctatagcgactactacttcagtggtggctggtttggtttgtttggaattgtacaagctggccaggagtattaagagtttaacgccgtttaaaaacggttttgtaaacttggcattgccgttcttcgggttctctgagccgatcgcggcccccaaaatggagtactgcggtaaccagtggaccttatgggacagattcgaagtacaaggagaaatgacgctcgccgagtttctggagtatttcaaggagaagcacggtttggagattacgatgctgtcccaaggggtgtgcatgttgtactcgttcttcatgccgaaagccaaagctcaagaaagattaggactaacgatgtccgaggtggtgaggagagtgtcgaagaagaagatagagccgcacgttagagcattggtgtttgagttgtgctgtaacgacgccgacggtgaagacgtggaggttccttacgttaaatacaacttgtattga

SEQ ID NO: 602 - DNA, 1287 bp, Phyllotreta nemorum
atggccgacgctgatgccgccgacgatctattagattacgaagatgaggaaaacccagaacagaccgcaaacgaaaataatgctacagaaggtcagaaaaaaggggttaaaggaacatacgtctcgatacacagttccggttttcgggatttccttctaaaaccagaaatcctccgagctattgcagactgcggtttcgaacacccttcagaagtacaacacgaatgtattcctcaagcggtaattggcatggacatcctttgccaagcgaaaagtggtatgggtaaaacggcggtgtttgtactagccacgctacaacagctagaacccaccgaaaacgtcgtttacgtgctcgtcatgtgccacacgcgcgaattggccttccaaatcagcaaagaatacgaacgtttcagcaagtacatgtccaacatcaaggttggcgtgttcttcggaggcctgcccattcaaaaagacgaagaagtattaaaaaacagctgtccgcacattgtagtcggaacgcccggtcgcatcctggctctcgtcagatcgaagaaactcaatctcaagcacattaaacactttattctcgacgaatgcgataaaatgttggagctactagacatgagacgcgacgttcaagaaatatacagaaatacaccgcacgaaaaacaagtaatgatgttcagtgcgacgctcagcaaagaaattcggccagtttgcaagaaattcatgcaagatcccatggaagtgtatgttgacgatgaagcgaaattgacgttacacggtctacaacaacattatgttaagcttaaagagaacgaaaagaataaaaaattatttgagttacttgatgttttggagttcaatcaggtggtgatatttgtaaaatcggtgcaaagatgtgtagcattggcacaacttttgacggagcaaaatttcccagcgattggaatacaccgaggaatggagcaaaaggaacgattatccagatacgaacaattcaaagatttccaaaagagaatattagttgccactaatctcttcggtcgtggtatggatattgaaagagtaaacattgttttcaactacgacatgccggaagattcggacacttaccttcacagggtggctagagcgggtcggttcggtacaaaaggtttggccattactttcgtttccgaagaaggagatgccaagattttgaatgaagtacaagacagattcgatgttaacattaccgaattacctgacgaaattgatttgagttcatacattgagggacgatag

SEQ ID NO: 603 - DNA, 1473 bp, Phyllotreta nemorum
atgggagctctcgagacagacgtcgagatgaaaaacgccgacagccccacgggactggaagccggagacaacaaacgagacaaagatttgaacagtttcacggaaatccgggaacaggccaagcaaatagaaaaaggcataatcaacaaggagagccgcttcatcctaagagtgctccgctgcttgccgaacaccagacgtaagctgaacggcatcgtcctcagaactctcataaaccacatttaccctgcggtcgaccgagacgtactcctcagcttcatcgaagaatccgccggtgagctagacactactcaaactaaagccagaccggccaccaagtcgcccgtagcagaaatcgacacctacatcaacctgctatgcttagtgcatttaatcgacaccaacaaattggcagaagccgaacgctgctcgcaaatcctcatgaacaagatcaccagtcaaaacaggcgaacattggacctggtcgcagcgaaatgctacttttactactccagagtagcggagctcaccgacaagctggattcgatcaggggcttcctgcactcccgccttcgcacagccaccctccggaacgatttcgaaggacaagccgtactgattaactgcttgttaaggaattacctgcactattccctgtacgatcaagccgataagttggttaataaatgcgtgtttccggagactgccagcaacaacgaatgggcgagattcctgtactacttgggcaggatcaaagcggcccgattggagtacagcgtggctcataaacatctcatacaagcgatgcgtaaagcgccccagaacaccgccatcgggttccggcagaccgtccagaagctaacagttgttgtggaattgctgttgggggacattccggagaggcagatattccggcaggcgagcatgcggcattctctggccccctatttccagctgacgcaggcggtgcgaatggggaacttgcagaggttcggagaggtgttggagaatttcgggccgcaatttaggctggatcatacgtttactttgatcctgcggcttcggcataatgttatcaaaacggctattagatcgatcggtctgtcgtactccagaatatccccgcaggatatagccaagaaactggggcttgactcagcagaggatgcggagttcatcgtagcgaaggccattcgtgatggtgtaatcgaagctattttagatccccaaggaggttatatgaggagtaaagagagcactgatatctactgcactaaagagccccaactagcttttcatcagaggatatccttctgtttggatttgcacaatcagagtgtaaaagccatgagatacccgcccaatgcgtacggaaaggagctggagtcggctgaagagagacgggaaagggaacagcaggacttggagttggctaaagaaatggccgaagatgatgatgatagtttcccttaa

SEQ ID NO: 604 - DNA, 1449 bp, Phyllotreta nemorum
tccagggaggattggcgcaaggccaaagagctagaagaagctcgtaaagccggtacagctcctgcagcagtcgacgaagaaggtaaagatatcaatccccacattcctcagtacatatctactgctccttggtattacgggaccagcggacccactttaaagcatcaaaggccccaggatgaaaaaaacaaagagtattcggatttgaacgattggtacaagagaggcgtagatacttcgaagattgttacgaagtatcgaaaaggcgcttgcgaaaactgtggagctttgactcacattaaaagggactgcatggacagaccccgtaaagtgggagctaagtattccggtgctaatatagcacccgatgagtttattcaaaagaatttatcacttagttttgatggtaaacgagataggtggagtggttatgatccttctgaacacaagacggttatcgaagaatttcagaaagtagaggaagccaaacggcaattaaaatccgacaaattaaatgcaaatgaagagtctgatgatgaagagaaagacgaggataaatacgtcgatgaagtggacatgcccggcacgaaagtagacagcaaacaaagaataacagtcaggaatttgcgtatacgagaagatacggctaaatacttgagaaatttggatcccaactcggcttactacgaccccaaaaccaggtcgatgagggaggatcccaatcccggaaacgacgctacataccatggggagaatttcgttcgcttttccggcgacacgacgaatcacgccagggcgcagctgttcgcttgggaagcacacggcaaaggggtggacgttcatctgctagcggaacccacgaaattggaattgctgaagaaagaatacgagaaaaagaaggatgaggtcaagtcgaatattcagggtactgttttggagaaatacggaggtgaggaatacctcgaagcgccaccgaagagtttgttgttggctcaaaccgaaaactacgttgaatattcgagatcgggtaaggtgatcaaaggagctgaaaaagaagttatcagatcaaaatacgaggaagatgtttatattaataatcacacgtcagtgtggggttcttattggagcgctggacaatggggttacaagtgctgtcattcttttatcaagaattcttattgtttgggagaagctggaaaatcagtaaacgctcaacctacagcagaaataaatactaatgaagagcttaaagaggaaggtcaagaggaagaaaaagaaaagagcgaagcagtagataaggaaagtgaagaatctgattctagtagttcgtctgaagaggaaaaatccaaggcgaaatctaagaaaaagttaaaaaagaagatgaagaagcagaagaagaagcagcaaaagaaaaaggacaaggacaaggaggctaaaatgtctgcttcg

SEQ ID NO: 605 - DNA, 549 bp, Phyllotreta nemorum
ttcgaattgggccgtccggcggccaacacgaaactaggaaccagaaggatccattatgttcgtacgaggggaggcaacttgaagtaccgtgccctaagattagacaccggaaacttttcttggggtagcgaaggtactgcccgtcaaacacgtattatcgatgtcgtttacaacgctagtaataacgaattggtccgtaccaagacgttggtaaagaatgctattgttgtcattgacgccaccccgttcaggcaatggtacgaaaatcactacatcttaccattgggacgcaagaagggtgccaaaatgacgcctgaagaggaggagattttcaataaaaagcgtagcaaaaaagtacagaagaagtacgagactaggcaaaaaaccgctaaagtagaacccgcgatcgaagaacagttccacaccggaagattgttggcatgccttgcatctaggcccggacaatgcggcagggccgatggttatgtcctcgaaggaaaggaacttgaattctacatgcgtaaaattaagtctaagaaagctaaataa

SEQ ID NO: 606 - DNA, 936 bp, Phyllotreta nemorum
atggacagattgcttcgtctcgggggcggcatgcccggtttgacccaggcgccgccgccttccgacgcccccgtcgtcgacaccgccgagcaggtctacatctcctccttagccctgctgaaaatgctcaaacacggcagggccggcgtgcccatggaagtcatggggctcatgttaggtgaattcgtggacgattacacggtgagggtcatagacgtgttcgcaatgccccagacgggtacgggtgtgagcgtagaagccgtagatccggtgttccaggcgaaaatgttggatatgctgagacagacgggcaggccggaaatggtggtcggctggtaccattcccatccgggtttcggctgttggttgtccggagtcgatatcaacactcagcagagcttcgaggccctctcggagcgggccgtggccgtcgtcgtggatccgattcaatcggtcaaaggaaaagttgtcatcgacgcctttaggttaatcaatccgaacatgatggtgttgggtcaggaaccccgtcagactacctccaatttgggacatttacagaaaccatccgtacaggctctgattcacggcctgaaccgccattactactccataagcataaattataggaagaacgagttggagcaaaagatgctgctgaatttgcataaaaaatcgtggatggacgggctcacgttggccgactattcggagaattgcagcgtaaacgagaagaccgtagccgatatgctggaattggcaaagaattacaacaaagcgttggaggacgaggagaagatgactcccgagcaattggctattaagaacgtcggtaagcaggatcccaagaggcatttggaggagaaagtcgatatattgatgaccaataacatcgtgcaatgtttgggcgccatgctggataccgtcgtgtttaagtag

SEQ ID NO: 607 - DNA, 1164 bp, Phyllotreta nemorum
atgactgttattaataagatggaggtcgatggacctctcaagggtgaaggattcaggtcctattatatcaccaaaattgaggaattgcaactaattgttgctgaaaaaagccagaacctccgaagattacaagcccaaaggaatgaacttaatgctaaagttcgaatgcttagagaagaattaatgctccttcaagaacaaggaagctacgtgggggaagtagtcaaacccatggataagaagaaagtacttgtgaaggttcatccggagggaaaatttgttgttgatatcgacaaaaatatcgacattaacgacgttacaccaaattgtagagtcgctcttcgaaatgaatcgtacactttgcataagattttaccgaataaggtggatcctttagtatcactcatgatggtcgaaaaagtaccagattccacttacgaaatggtcggtggtttggacaagcaaatcaaagagatcaaagaagtaattgaattgccagtgaaacatcccgagctctttgatgcgttaggtattgctcagcccaagggtgtgttattgtacgggcctccaggaactggaaaaactctcctggctagagccgtagctcaccacaccgaatgtacgtttattagagtatctggatcggaattggtgcaaaagttcattggtgaaggctccaggatggttagagagctgttcgtaatggccagggagcatgccccttcgatcatcttcatggatgaaatagattctattggatcctcccgtatcgaatcaggttctggtggtgattcggaagttcaaagaacaatgctggagttgctgaatcaactcgacggattcgaagccactaagaacattaaagtcataatggctactaacagaatcgacattttggatcccgctttgctaaggcccggtagaatcgacaggaagatcgagttcccgccaccgaacgaggaagcccgattggatatcttgaaaattcactcgagaaaaatgaatctgaccagaggaatcaatttgaggaaaatcgctgaattgatgccgggtgccagcggtgctgaagtgaaggtattctgttttaatctgttgtttatttttgggtttataatggtgtattgttgcagggagtgtgcactgaggccggcatgtacgcgctaa

SEQ ID NO: 608 - DNA, 600 bp, Phyllotreta nemorum
atggtaaaattatattgtattagtattctctacaaagatactacatacgcgacgtggttgaagtctgctttcgatttgcaaagtttcagttttttccaaagaggatccgtacaggaattcatgtctttcttttgtaagactattgtagaaaggactataccatcatcgagacaatctgtcaaagaaggagaatacatgtgtcatgtttatgtaagacatgataacttagctggtgttgtgatatcagatcacgaatatccctctagggtgtcacatacgctcattacgaaaattttggacgaattcgccgcaaaaatacccgctgccaattggtctaccttgcaagagaaggatgtaacgtttccacagctaaacacataccttgccaaataccaaaaccccaaggaggccgatgcaatgactaaaattcaggaggatcttgacgaaaccaagataattctgcataatacgattcaggctgtcctggagagaggcgaaaaattggatgacttggtaaacaaatcagagggcttaagtatgcagtccaaagctttctacaagactgcaaaaaaaacgaacagttgctgcaatttcacttaa

SEQ ID NO: 609 - DNA, 729 bp, Phyllotreta nemorum
atgtttctaacgagaagcgaatacgacagaggcgttaacacgttctcgcccgaaggaagattattccaagtggaatatgccattgaagctattaaactgggatccacagctatcggaatatgcaccagcgaaggggtcgtgctggcggtcgaaaagcgtattacttctccattaatggagcccacgaccatcgagaagatcgtagaagtagataaacacatcggctgtgctgtttcggggctcatggcagattcacgtacaatgatcgatagggcaagagtagagtgccaaaatcattggtttgtatacaatgaaaacattactatcgaatcgtgtgctcagggagtatcgaacctagctattcaattcggagattcggatgatgatggtgctgctatgtcgaggccatttggcgtggccattttgtttgctggcatagacgaaaaagggcctcaactttaccacatggacccctcaggtacatttgttcagttcgatgcgaaagccataggatccggttcggagggcgcacagcaaagcttacaagaagtgtaccatcgcagcatgactttagaggaagctaccacagcggcgttgactattctcaagcaggtcatggaggagaaattgaactcgtccaatgtagaagtcatgacgatgacgccgaaggatttgttccacatgttcactaaggagcaggtggaggaggtaattactaaattatattaa

SEQ ID NO: 610 - DNA, 1158 bp, Phyllotreta nemorum
atgacagaatactggttgatttccgccccaggtgacaagacttgtcaacaaacatgggatacaatgaataatctgacaagtaaacagaacaatttgtctgcaaattacaagttccaaatacccgatttgaaggttgggactcttgaccaattggttgggctatccgacgatttgggaaagctggatggtttcgtggagcaggttacccggaaggtggctcagtacctgggtgaggttctcgaagaccagagggacaagttgcaggagaatttgcaggcgaacaacaccgatttgccaagttatttaaccagattcacatgggacatcgccaaatatcccatcaagcaatcgctgcgcaacatcgccgatataatcagcaagcaagtcgggcaaatcgatgccgatcttaagaccaagtcgtcagcgtacaataacttaaaggggagtcttcaaaatttggagaaaaaacaaacagggagtttgctaacccgtaacttggcagatctggtcaagaaggagcacttcattttagattctgagtacttgcaaacgttgctcgtcatcgttcccaaagctcagtttaatgagtggaacgccacttacgaaaaaatcacggacatgatcgtccctcgatcgtcgcagctgatcattcaggaccacgattacggcctgttcaccgtgtcgctcttcaagaaggtcgtcgaggagttcaagctgcacgccagagagaagaagttcatcgtgcgagatttcacgtacaacgaggaggaattggcggccggcaaaaacgaaatcaccaagctcgttaccgacaagaagaagcaatacggtccgttagtgagatggttgaaagttaacttcagcgaatgcttttgtgcttggatacacgttaaagcgctgagagtgttcgtcgagtccgtgttgagatacgggttaccagtcaatttccaggctattctgatccatccaaataagaaacaagccaagcgtttaagagatgttttgaatcaactgtatggccatctagatagtagtgcagctctttccgggcctaatgttgatagcgtggacattccaggattaggtttcggccaatcagaatattacccctacgtgtactacaaaataaatgttgatatgatagaatcgaaggtctaa

SEQ ID NO: 611 - DNA, 1674 bp, Phyllotreta nemorum
atgtcgatattagcgagtcctctatccgtagccggttcgcgaacgacgggcgcctcagttcgcacccaaaatgtcatggcagcctcgaccatagccaacgtggtgaagagctccttgggcccggtcggcctcgacaagatgctcgtcgacgacatcggcgacgtgaccgtcaccaacgacggcgccaccattttgcggctgctcgaagtcgagcatcccgccgcccgagtgctcgtcgaattggcccagctccaggacgaggaagtcggcgacggcaccacctcagtcgttatcatagctgcagaacttcttaaaaacgccgatgagcttgtgaagcaaaaaatccatcctacatcgattataagcggttacaggttggcttgcaaggaagcttgccgatacatacaagaccatttgactatacccgtggaggaattgggaaaggaatctatcgtgaacgtagccaagacatcgatgagctccaaaattataggagctgacgcggatttcttttcgcaaatggtagtagacgccgccaacgccgttaaagtcaccgacgccaaaggcaactcgatgtatcccataaaggcggtgaacgtgttgaaagcgcacggcaaaagcgccagggaaagtttcctcgtggccggctacgccttgaactgcacggtcgccagccaggccatgccgaagaagatcctcaacgccaaaatcgcctgtctggatttctcattgcaaaaggccaaaatgaagatgggcgtccaagtgctgataacggaccccaatcaactggaaggcgtgcgcgccagggagctggacatcaccaaggagcgcatccagaagatcctggctactggagtgaacgtggtgcttctgtcgggcggcatcgacgatctctgtttgaagtacttcgtcgagcgcggcgccatggccgtgcggcgagtcaagaaggccgatttgaaacgcatagccaaggctaccggagcggccttcgtcacgtcgctgagcaacatggagggcgaggagaccttcgatgcctccatggtgggcgaagccgccgaggtcgtgcaggacaggatatccgacgacgaattgatcgtcatcaaaggacctaaagctcgtacagcggcttcgataatcctgcgaggtccgaacgatttctactgcgacgagatggagcgttcggtgcacgacgccctgtcggtggtgaagcgcgtgctggaatcgaagagcgtcgtggccggcggcggtagcgtcgaggcggcgttgtcgatctacctggagaatttcgctacgacgttgagttcgcgcgaacagctggccatcgccgagttcgccaaaagcctgttggtcataccgaagacgttggctgtgaacgcggcgcaggacgccaccgacctcgtggccaaattgagagcctatcagaactccagccagaccaagaaggatcacgctcatctgaagtacgtcgggttggatctgattgaaggtactgtgagagataacagaaaagctggggtgttggagccgacaatgtctaaggtgaagtcgttgaaattcgctacggaagctgcgattacgatactcagaatcgacgatatgatcaaattggacgctgagcagaagggtggtaagaactatcacgatgctatgaacagtggtgaattgtacgattag

SEQ ID NO: 612 - DNA, 768 bp, Phyllotreta nemorum
atgtttaattccagccattcggcgcctccgccgttttggagcaacggcccggccccgggagctttctacaacttcccgggcaccgaatggaaacccgcaacgaatccaataactcatactcagtctcctgtgaccacttcaacttcaattgtatccataacgtacgacaaaggagtgctgatagccggagacttgctggcctcttacgggtctctagccaggtacaaaaattgccccagggtgatcgaaattaatcctaatatcatcctgggagccgggggagattacgccgattttcaatacgtgaaaagctttatcgagcagaaaataatcgatgaagattgtttagatgacggtttgaaaatgaaaccgaaatctctttactgctggctgactaggattatgtaccaacgaagaagtaaactcgacccgttctggaacaatttagtagtcggaggaatacaggatggcgtgcctttcttaggaactgtagataaactcggtacagcttacactgataaagtaatttgtacgggttatggggcccatatagctcttccggtgttgcgagatgcgctcgataagaagccgaatttgaatctgaacgaagccaagcagcttattaaaaagtgcatggaagttttgttctacagagacgcgaggagctacccgaagtaccagttggggatgatcgatgcggatgaaggggtgaagatcgaggggccgattgcggttgaggaaaattggaatatcgcttatatgacttaa

SEQ ID NO: 613 - DNA, 2106 bp, Phyllotreta nemorum
atggaattttcgaaagaacccaactttgaattactagcaactaaggacttttcaccagaaaaatatgtaaaaaaattgtcccagaattatgtgggtggatctgaattgcagaatcttcgaagaaaaattcaaggactctccgaagaaactagctctaatttaaagaaaaatgtttacgaaaactacattcaatttattgaaactgccaaagagatttcacatcttgaaagtgaaatgtaccaactttcccacttgctttcggagcaaaaagcattacttaattgtttatcagccacttcgatattggaagacgtacagccagttaacatcgatagggataataaagtgaacgtaaaggatcttgaagaagaaaataaacaaaaaatagctgctattttagaaaaagtagaaggttgtcaggaattattaaaagttccgggaagattttttttgtacgaaggagatttattagaaatcgaacccaccgaaaacaccgccttaaaaatagttcacgtttatttatttaccgacagtttcatgataaccacaagaaattcaaatagtcgaggtctcatgaaatacatctacgaaagcatatacgacctgagcagcctagcagtcgtaaacgtaagagatctggggaacgtcaagcacgcctttaagcttctcattttccccgataccagagtttttcaatgctcctccaactcgaacaaaaaagagtggctggacaagttcgatcaggccaagaaaaccaagctggcccaagaacagcaaaaaagggaatccgtatcggagaaatcgcccactcgcgtctcattcgaatcgcccagctacaatcctttcgatgaagcagaagaagaaaccggcgcgtcgcatccggaatggttcgtggagattcccgaagagctggacgtttgcgtggcccaaaggcatttcgaagacgccatttctctgctgcaaaaagccaaggaatatttggctcgaacgtcttccacgtccggtgataagcgggacaccgtctttacggatatccagagaaaagtggagcaaagacagaacaatttaacggaggtgttgatgaaggaattggaagtgaatccggataaatcgctgcagggcgggctgagggccgctcgcagggctgtgagattgctgaatcaattaggaagggaaacacaatcttgtacgctgtttttgaaattatgcagcagtatgctgaggacgcaatgcaaacgagtcaaaagagaaggttctacgaccacttacataaagcatctttcgagcgtggtttttaccaatatgtgtcacatgtctgatgaatttctaagagcttttcccgattctccggcctgcgcgtcagcgtatgtggtttgggcgagcaatgagctattgcaatttaccacccatttcattaagcaggttttcatgcctcagacttccctatcgacggtcaccgagtgcgtagttttagtcaggcatcaatgcgaaaggctgtacgtttacggattggatctttgttatcaattggacggcgctttgagatcgtccctattgaaggcgttgaaagacgctcgagataaactgatcgattcgattaaattgcgagttctagacgataaatggatacctattaatttacataccaaatcggctttgagccgttatgtgcatgagtattctcaaatgggactcgttaacgtgggaagttatgtttctggcgatacttggttacaattgacggccagtactttatcgttcacgaaaatgtttttgaatttgctcaacgattgcatgaaattgaaaactaccgaattgatgtatacgatcgatgagactttgtataacgtgttcgaaactcaaattaggcacaacgaaaacgctctaaggagcgaattgaatcaagatcaaaggaattttctcacgaaaaacgccgagtttttattagttagtttaatgcaagtggtgcaaaaaaagtacgaggagaacgtcggttacgaatgtccaacgttggcgaaattgcaaaaggaatacgtagcgctgcaaaaaggagttacgcctgcgtcgagaagtacaaaagccaagtattcatcagagtttatttaa

SEQ ID NO: 614 - DNA, 3801 bp, Phyllotreta nemorum
atgtcaaatttcttatgtcggtcattaaaacgttgtgaattgtatgctttatcaattttaaaaattaaattaatattgcatttaaaattcaacacgatgaacgaattagagaaactagaatacctctctttagtctcaaaaatttgcacagaattggacaaccatcttggaatgaacgataaagatttagccgaatttataatacatctttccgaaaagaacaacacgttggaatcctttaagaaggtgctttcagaaaatggcgccgaattctcagactctttcgtttctaacttgttgcgaattatccaacacatgaaaccgaagaaatcgtcgaataaggaagaagccgataaagtggaaaaagagggactggcttttaaatttcccggtttagcgatacctaatgagaaacaaatacccttacaatttgaagaattagacgaggaaaataaaaatgatgaaatagacgttgtagccgacatgatgaaacaacttgaagctgacgcgccttctcataaacaaacaaaagaaaaatccagaagcccgagtgttgaaaggaaatcaagagtacgatctagaagcaggtcgaaggaaaaaagaagatcgagaagcagatcaaaagatagacgaagatccagaagcaggtctagggacagacggagatctagatctaaagatagacattctagaagagataaaaggcatagaagtaggtcaaatgaagactacaagaggagaagaacagaaaacagttactcgagagatagaagggaaaggggtaggtccagagaatctgaaagaagagacaggaatagatcaagagatgatagaaagagggaaagaagtagatcgagaacgagaaggcgagaaaggagtaacgaaaaaaaattcaaaagcgaaaaggataatcctgagttcgaggatgaccctactccaggaaagatttataatggaaaagtatcgaacgtggttccatttggatgtttcgtgcaactagaaggtctaaaaagaagatgggagggtctggtgcatatttctcagctaagagccgagggtagagttaccaatgtttccgatgttgtctccagaggaagcaaagttaaagtaaaggtattaacaataaccggtcaaaaagtatctctttctatgaaagatgtctgccaaacgacaggaaaggatttgaatcctctatcccatgccactacagaacgggaagataaagatcgtaaccccgacaggcccatgaacaacagcacgtcggtgttgaggctaccagttagcatcgacgaaggagaagaagattccaggaaaagagtcacccgaatgtccagcccggaaagatgggaaatcaagcaaatgatttcttctggctgcatagacaaaagtgaattaccagaatttgatgatgaaactggattgctgcccaaagacgaagacggtgaagctgatattgaaattgagctggttgaagatgagccaccatttttgcaaggtcacggtagagctgttcacgatctgagtccagttagaatagttaaaaatccagatggttccctggcccaagccgctatgatgcaatcggctttggccaaagaaagacgcgaacagaagatgctgcaaagagaacaggaagtggattcgcagccttctggaaagaacaaaaactggattgatcctctgcctgaagacgaatccaaatcgatggcaagaggaatcggtcttcagactcaagatttgcctgaatggaaaaaacacgttatcggcggtaaaaagtcatcttttggtaaaaaaactaacttgacgatcattgaacaaaggcagtctcttcctatttacaagctcaaagaagagttacgaaaagcagtaacagaaaatcaaatattgatcgttattggtgaaaccggctcaggaaaaaccacacaaatcacccagtatttagccgaggccgggttcacagccaggggcaaaattggatgcacgcagcccagaagagttgccgcaatgtcagtcgctaagagagtagccgaggagtttggatgcagattaggtcaagaggtcggttacactattagattcgaagattgcaccagtcccgaaacgatgatcaaatacatgacagacggtatgttgctacgtgaatgcctcatggatttggatcttaaacagtactctgtaataatgttggacgaagctcacgaacgtacaattcacactgatgtactattcggactcctgaagcaagctgtcatgaagcgagacgaactgaaattgatcgtaacttctgctaccttagacgccgtcaagttctcgcagtatttcttcaaagccccgatattcacgattcccggcaggacgtttccggtcgaagtattgtacaccaaggagccggagaccgattatttagacgctagcttaataacagtcatgcaaatacatctcagggaacccccgggcgatattttgctgtttctgacgggtcaagaagaaatcgatactgcttgcgaaatattatacgaaagaatgaaaagtttgggtcccgacgtacccgaattaatcattcttcctgtgtactctgctttaccgtccgaaatgcagactagaatattcgaaccggctcctcctggcagtaggaaagttgtgatagctacgaacatcgcagaaacttcactaacaatcgatggaatatattatgtagtagatcctggattcgtcaagcaaaaagtttataattccaagactggaatggattcattggtggttactccaatttcgcaggcacaagcgaaacaaagagcaggtcgagcgggcagaaccggtcctggtaaatgttacaggctttacacggagagagcgtaccgggacgaaatgcttccgacaccggtgcccgaaatccagcgaaccaatttggcgacaaccgtacttcaactgaaaactatgggcataaacgatttgctgcacttcgattttatggatgcccctccggtcgaatcccttataatggccctcgagcagttgcattctctatctgccttagacgatgaaggcttattgactagactaggaagaagaatggccgaatttccactggagccgaatctgtgcaagatgttgatcatgtctgtagctcttcaatgctccgatgaaatattgactatagtgagcatgctatctgttcagaacgtgttctaccgcccgaaagataagcaagcgttggctgaccaaaagaaggcgaagttcaatcaacccgaaggcgatcatttgacgcttctggcggtctacaacagctggaagaacaataagttttcgaatgcgtggtgttacgagaatttcgtgcagatcaggactttgaaaagagcgcaggatgttagaaaacagttgttgggtatcatggacaggcacaaattggacgtcgtgtcggctgaaaggaacacggtgagggtgcaaaaggcgatttgctccgggtttttcaggaatgcggggaaaaaggatccgcaagaaggctacaggactttggtggatagtcaggtggtgtacattcacccttccagcgctttgttcaatcggcagcctgaatgggtaatttatcatgaattggttcaaactacgaaggaatatatgagagaagtcacaacgatagatcctaaatggctggtggaatttgcgcctgcattcttcaagttttctgatcccacgaagttgagcaaattcaagaaaaatcaaagattggaacctttgtacaacaaatatgaagagcccaatgcgtggaggatttctagagttaggagaagacgaaattaa

SEQ ID NO: 615 - DNA, 1248 bp, Phyllotreta nemorum
atggccacaaaaaggaaaaacaaaaaaaacatactggcaaaagtgaattttcccttgtacaccgtccagatgctaacgtcaaggcacgttatcgtaggaggcggcggtggaacttccaagactggggttgaaaacggtttcgaaatttacgaaatcttccacgacggccacaaattctcagccaaagaagttacaagacacgaaactggaggaaacgtagtcatgaattgttgtgcgtttagtgataagaaaaatgcatttctagtagccggccaagaaaactactctcaactttacaaaatcaatacgaaattagtcgagcatgaagaagtagaaacaatcggagacactgcaagcgttcggcatagaaacaccaagcccaaagaacacgtagataataataaaaacattaaaaaggagctggtttttgacctgaatcctttagattgcatacaaaccgattttaaggggtccgaacccctatgtagagtacttagaattaatcactcgggaaagatattagctactggaggaactgacggcgatgtaagactttggaaattccctatgatgcagccattgtccattttaaaggggcatacaaaggaaatagacgatatagatttcagtaaatacgataacctcatcatcactctagcaaaagacggtttggctattctgtgggacgcccaaacgggaaaaatgaaatcaaaactgacatggaaaactccagagggatcaaagtatatgtacaagaggtgcagatttggcgttatcgaagatcaaaaaaacaagtgcatgctatacatgatagcgaacgcgactaattcgaagcaagcatcgtttcttcaacagtggatacctgaggaaaatactttaaaaaagttttctgaattcaatgaaaccctatcggcacttgcagtgagagatgacggacgatttgttgctgtcgggacaatgttcagcggctccgtttccattcacattgcatttagtttacagaaaatattggtagttgtgggtgctcactcgatgtttgtaactggtctggaattcctatctcatgaaaatactaatcattccataagcagtgttgctgagacagctgtattatctatttcggtggataaccagctttgtatacattcagtgccatacagacgaagtatacctttatggattggaataatggtgttagttttagtattatttattacatttatgttatgtgcattcatgggtttgtga

SEQ ID NO: 616 - DNA, 1242 bp, Phyllotreta nemorum
atggctggtgcaatgttattcgaaagagctcagtccgtaccttcccaacacgacaagttgttaaaattaaacccgacagacgaagatgacgaggaggatatcgtcaacaaagagcaggacatcctcaacttgggcgagaagtacaagaaggagggcaaggctaaagaactagcggagctgataaaggctaccagaccatttctgagtcttattagcaaagcaaaagcagcaaaattagttagatcgctggttgattactttttggacttggaggcaggtatcggtatcgaggtgcaactgtgtaaagaatgtatagaatgggcgaaagaggagagaagaacgtttttgcgccaatcgctggaagcgcgcctcatcgctttgtacttcgacaccggcatgtacaccgatgctttacaactggaatccaccttgttaaaagagctgaagaaactggacgacaaaaatctgctggtcgaagtacagctgctcgaaagcaaaacatatcacgccctaagcaatttacccaaagcacgagccgccctaacgtccgctagaacgaccgctaatgctatctattgccctccgaagatgcaggcagccctagacctgcagtctggcgtactacatgcagccgacgaaaaggatttcaagaccgcttactcctacttttacgaagccttcgagggcttcgacagcgtcgagtctcccaaagctctaactgctcttaagtacatgcttttgtccaaaattatgattaatagtcctgaagatgtacagcaaattgttagtggaaaattagccataaagtatgcaggtaaagatatcgaggccatgaaagcagtcgcacaagcagcccacaaaagatctcttgcagattttcaacttgccgtaaaacaattcaagcacgagctggaggatgacgttatcgtaagagcacatttaggaaccctctacgacaatatgttggaacaaaacttgtgcaggatcattgaaccttactcgcgtgtccaagtagaatatatagcaaagacgattaagcttcctgtgttacaagtagagaagaaactatcgcagatgattttagatgccaagtttcatggaattctagaccagggtgatggtgtcctgatagtgtttgaagaaaccccggtagacaaaacctatgaaatggctctagagaccatccagagtatgagtaaagtagtagacactctctatcaaaaagcgaaaaagttgtcctag

SEQ ID NO: 617 - DNA, 1737 bp, Phyllotreta nemorum
atggcttcgcggtcgaaaaaaagctcgacgccgtcggcccaacagcggccggccagcccgctgagcccgacgaggcattccaggttgcaggagaaagcggaactccaacatctgaacgaccgcctggccggttacatagataaagtgagatttctggaggccgaaaacaacaaattatccagagaaatccagacgacccaggaaactgttacacgcgaagtgtccaacatcaagtctatgtacgatcacgaactaggggacgccaggaagctgctggacgacacgcaccgcgagaaggcccgcctggagatcgacgtgaaacgtctcatagaagagaacgaggagctcaaagccgagctggccaaaaagagcaaggatctggttgtagccgagaaccatgccaggatatacgaatccaggtgtaacgagtaccagctcaagtccaaccaagcttctgcagacgccaagaaggccatcgccgatgccaaggagttggaaaaggaaagggacaagctgaagaagctcctcgatgctgctcgtaaacaactggaagaggaatctctggccagagtagaggtcgagaatcacaatcagagcttaagggaagagctaacctttaaagatcagatccatcaacaagagctcacagagacccgcactcgccggcaggtcgagatcagcgaaatcgacggccgtctggcgcagaaatacgaggccaagctgcaagaggccctgcaggatctgcgcgaccagtacgaatcgcaaatggccaacaaccgacaggagatcgaattgctgtacgagcagaaaatcaaaaacctccaagcggccgccgacaggcaccagtcgaccgcctccggcgcgctcgacgaactgagacaggttcgctcgaggatcgacaccttctcgtcgaagatcgacgacctggagaaccagaaccgcggtctggcagctagaaatagggatttggagaaattgctcgagaatgagcgcattcgtcacgccgaagatctggcgttggtcgagagggaattgcacaggctgcgggaggagatggcccagcaacttcaggaataccaggacctcatggacatcaaagtatcgctcgatctggaaatcgcagcgtaccgtaaacttctcgaagcagaagaagctcgattgaacatcacaccaacaggggttgaacacgaggtgcaccacaggagctcctctcaacgtaggacgccggtgagaatgggggccaagaggaaacgagcgctgctcgaggagacgcaggagtcgagcatgtcggattacagcgtgaacagttcgtctaaaggggacatcgaggttgcagcagtcgatccggacggtcagtttgtgagattgcacaacaaaagtaaccaggaggtgccgctcagcggatggcaagtcatcaggcgggccggcgatgaggagactttctacaaattccacaggaccgttaaagtagagggaaatggtacggtaacaatttggagttcggatttaaataaagatcacgagccccccagtaacctggtcatgaaaggccaaaaatgggttactggagataacatgataacgatagtattgaacaacaacggagaagaagtagcgtcatctgaaagggtaaagaggcagatttcgacgtcgcatttaagacacagggaattgggggatgaagagctttatcaccagcagggggacctgcaaggtgaaaagtgcggactgatgtga

SEQ ID NO: 618 - DNA, 2226 bp, Phyllotreta nemorum
atggctgatagcaaaagccccgacgatttagcgactgcgattcttcgcaagaaggaccgtccgaacaggcttttagtagaagaagccgttaacgatgataattccgttgtggccctgtcccaggcgaaaatggacgaactgcagctctttagaggagacaccgttctacttaagggcaagcgccgaaaagaaactgtctgcatagttctgtccgacgatagttgtagtgacgaaaagatccgcatgaacaggaacgttcggaataacttacgagtcaggttgtctgacgtcgtttccattcagccctgtcctgatgttaagtacggtaaaagaatccacgttcttcccatagatgacacagtagaaggacttacaggaaatctgtttgaagtgtatctgaaaccgtatttcctggaagcttatcggcccatacacaaggacgacgttttcatcgtaaggggcggcatgagagctgtagaatttaaggtagtggaaaccgatccggctccttactgcatagtcgcccccgacacggtcatccattgcgacggggatccgatcaaacgcgaagaagaggaggaggctcttaacgctgtcggctacgatgacatcggaggttgcagaaaacagctggcccagatcaaagaaatggtcgagttgccgttgagacatcccagtctctttaaggctattggtgttaagccgcctagaggtattctcttgtacggaccaccaggtaccggtaaaactctgatagccagagccgtcgccaacgaaaccggagctttcttctttttgattaacgggccggaaatcatgagcaaacttgctggagaatcggagagtaacctgcgcaaggcctttgaagaagccgacaagaactccccagctatcattttcatcgatgaattggatgctatcgctcccaagagagagaaaacacacggagaggtggagcgtcgtatcgtttcgcaattgctcactctgatggacggcatgaagaagagctcccacgtgatcgttatggccgctacgaaccgaccgaactccatcgatcccgcgctacgtcgtttcggaagattcgacagggaaatcgacatcggcattccggacgccaccggccgattggaggtgctgagaatccacaccaagaacatgaagttggccgacgacgtcgatttggagcaaatcgcggccgagactcacggtcacgtgggcgccgatttggcctcgctctgttcggaagcggcgctacaacaaatcagagaaaagatggacctgatcgatctcgaagacgatcaaatcgacgccgaggtcctcaattcgttggccgtgaccatggagaacttccgttacgccatgacgaagagcagcccgagcgctctgcgcgaaacggtggtcgaagtacccaacgtcacgtgggacgatatcggcggtctggccaacgtcaagaaggaattgcaggagttggtgcaatatccggtcgagcatcccgataagttcctcaagttcggcatgcagccgtccaggggagtgctgttttacgggccgcccggttgcggtaagaccctgttggcaaaggccatcgccaacgaatgtcaggccaacttcatatccgtcaaagggccggagttgttgacgatgtggttcggtgaatctgaagctaatgttagagacattttcgataaggccagatcagcagctccttgtgtacttttcttcgacgagttggattcgatcgctaagtctagaggtggaaatgtgggagatgccggcggtgcagccgatagggtgattaatcaaattttaactgaaatggatggtatgggagcgaaaaagaacgttttcatcattggtgctacaaatagaccagatatcattgatccggctatattacgtcccggtcgtttggatcagttgatctacatcccgttgccagacgaaaagtccagagaagcaatcttcaaagcgaacttaaggaagtcacctgtagctaaagacgtagatcttgtttatattgccaaagttacacacggcttttcgggtgccgatttaacagaaatatgtcaaagagcttgcaaactcgctataagacaaagcatcgaaacggagatcagacgagaacgagagagagcattgaatcccaacgtagcaatggacgtaagtatttatcatgtatttaaatcatatataaaaaaaatgtgttttctttgcgcagctggatga

SEQ ID NO: 619 - DNA, 825 bp, Phyllotreta nemorum
atgagtgaccaatttgactgtgcactcgatttaatgaggcgcttgcctccgcaacaaatcgaaaaaaatttgagcgatttaattgatttagtgccaagtctttgcgaggatcttctttcatccgtagatcaaccgttaaaaatcgctaaagacaaggattcgggcaaggattttcttttatgtgattacaatagggacggagattcttacaggtcaccatggtcgaatacttactaccccccattagaagacggttcgatgccctccgagaggttaaggaaattagaattagacgccaatttagcgttcgatcaatatagagaaatgtatttcgaaggtggcgtatcttctgtttatttttgggacttggatcacggttttgcaggagtaattttaattaaaaaaaccggagatggtagtaggaaaataaaaggttgctgggattccctgcacgtagtggaggtgcaagagaagagttcgggaagaaattcccactacaaaatgacctccaccgccatgctgtggctgcaaaccaataaacaaggctcggggaccatgaatttgggcggtagcttaacccggcagatcgagcaagatgcagcggtaaatgatatcaacccccacatcgccaacatcggtcgaatggtggaagacatggagaacaaaattcggaatacgttgaacgaaatctactttagcaaaaccaaggacatagtcaatagcttgagatcggtgcaacccttaacggagagccgtcagcagcaggcgcttaaacaagacttggccgccgcccttcagcgtagacaaaataaatccgagaactga

SEQ ID NO: 620 - DNA, 2013 bp, Phyllotreta nemorum
atggaacgtccgccccgtaatgaaccgcccgtggagcctgtcaacggagtggtgcaaccgccggtgcatccgccgccggacagtccgggacgcgtcacgaaccagctgcaattcctgcagaaaaccgtactgaaggccgtgtggaaggacaaattcgcctggccctttcatcagcccgtcgacgctaagaaactcaacctgcccgactatcatagaataatcaagcaaccgatggacctgggaacgataaagaagcgtttggagaacaactactattggacgggtaaagagtgcattcaagatttcaacacgatgttcaccaattgctacgtgtacaaccagccgggcgaggacgtcgtcgtcatggcccaaacattagaaaaagtatttttaaccaaagtggccgacatgcctaaacaagaagttgttgttgaaattccaatgaaaggcaagaaagggcgagttagcgtcggcggcggcggcggcgggagcaccccgtcttccagcggaccggtgccggcagctatacccggaggtgtcagaggcaggccgcccgcgaccgtttcttccaccagtaccacgccaatcgccaccactactggttcgtccgggctaccgttgggcacccaagcgcccgccacgttgccgggaagcaccgccaccacgacgatagcgccggccaacaacaacaacagctctctgacgccccagcagctcggcacgcccgtcaccacgatgcacggaacgcccggagcgcccctgtccaactccctcgatcccaccggcggagtgctgcccggaaacgtcatgccccccgcccaaccagccaaggtaaaaaaaggcgtgaagagaaaggccgacacgacgacgccggcgacggcctacgattatccgacggtattggaatcgaagtcggcgaagatatcgacgcgcagggagtcgggcaggcagataaagaaaccggcgcggcgggaaatcgaccttcatgtacctcaaccggcgatacacaaacccaacgataagttgactgaatcgctgaaagcttgcaatgaaattcttatggaattgttctcaaagaaacattcgaattacgcatggcctttctatcaaccggtcgatgcggaactactgggcctgcacgactaccacgacatcatcaagcgacccatggactttggcacggtcaaagagaaaatggacaacagagagtaccgcacgccgcaggactttgccgccgacgttagactgatttttagtaattgttacaagtacaatccctctgaccacgatgtggtcgccatggcgcggaagctccaggacgtgttcgaagtcaaatttgcgaagatccccgatgagcctgtgaaccggataggaggagttgtaaataatttgcctataaaatccgaatcgagtagttccggttcgagttcggattcgtccagcgaatcggaggattcggaggaggaaaggcgtaacaaacaattgaaagtgctggagaaagagttgacggcgttgcaagagaagatgcgcaagctggtcgaggagagttcgcgccggaaaaaggagaaaaagaaaaacaaaatgaaaaagaaaccgagcggcgcgggggcgctgacggcggcgggcgcgctgccgaacagcagcagcggtctcggtttgcgcggcaacaaacccgccgccgcttcgaacgccgcccccaagcgggcgaaggcgaacaacaagaccggcgccggcaggaagaagaacgccgcccagccgcccccgatgccgttcgactcggaggacgaggacaacgccaagccgatgtcctacgacgagaaacgacaactttcgctagacatcaacaaattacccggggacaaattgggtcgagttgtgcatataatccaatcgagggagccgtctttgagggattcgaatcccgacgagatcgagatcgatttcgagacgttgaaaccgtcgacgttgagagaattggagagttacgtcgcgtcgtgtctgcgtaaaaagcca

SEQ ID NO: 621 - DNA, 1224 bp, Phyllotreta nemorum
atgtctttatccacagctcgccctttagtgagcgtttacaatgagaaatcggaagaagtaaaaggcagcggcgtagctcttccggctgtcttcaaggccccaatcagaccagatgtcgtcaatttcgttcatcagcaggtctcaatgaaccatcgccagccctacagcgtcagcgacaaagccggtcaccaaacctcggccgagtcctggggaaccggtcgcgccgtggcccgtataccgcgtgtacgcggcggcggtacccaccgatcgggccagggagccttcggcaacatgtgtcgcggcggtcgcatgttcgcgcccaccaagccgtggcgccgctggcacagacgcgtcaacgtcaaccagcgtcgctacgcgctggcgtcggccgtcgccgccagcggcgtgcccgccctggtcatgagcaagggccacgtggtcgatcagatacccgagctgccgttggtcgtcagcgataaggtgcaggagatgcgcaagaccaaggaggccgtgcagttcctgaggaggatcaaggcttgggctgacatccaaaaggtttacaagagccagcggttccgtgctggtaaaggaaaaatgcgtaacaggagacgtatccaacgtaaaggacctctaatcgtttactacaaagatcaaggtcttcgtcaagctttccgtaacatccctggcatcgacctcatcagtgtccaaaagttgaacttgctgaaactggctcccggtggtcacgtaggtcggttcatcatctggactgaatctgctttccagcgtttagacaaattgttcggtacatggaagaacccgtcgaccgaaaagaagggttacaatttgccccagcccaagatgtccaacaccgatttgtctaggttgttgaaagctgacgagattagagctgttcttagggctcctcagaagaaggtggtacgtcgtgttcgtcgtctcaatcctttgaccaacactaaggctatgcttaaattgaacccgtatgctgctgtactcaagagggaagccatcttgaagaaccaaaaaaggcagttgcaaagggacgaagctttggctaagaaacgaggaatcactttgactcctgacaacgctgtaatcaggaccaggaaattgcaggaaagacgaagagctcaaattctgaaagataggaagtcgaaacccaagaaggccgcgaaagcgccggccaagcctgctggaaagaaataa

SEQ ID NO: 622 - DNA, 5370 bp, Phyllotreta nemorum
atggcagattacatcaattcagaagcagaggaatctagcgaggaggaagaattagaccatagggatcgaaagaaggcacaaaaagcaaagctcgtagatagttctgacgaggaagaggaagaagacgatgaagagaaaattagagaagaattaaaggatcttatcgacgataatccaattgaagaaagcgatgccgaatccgatgcttcaggccgtgagaaaagaaaaaaatctgacgatgaagacctcgatgatcgattggaagacgaagattacgatctgctggaagaaaatttgggtcataaagtagaaagaaggaaattcaaacgtttgcgtcggttcgatgatgacgaaagtgaaggggaagaagaacatgatcccgagcaagaccgcgatcaaatcgccatggacatattctccgacgatgatgaagaaagaaggtcggaacgaagtcaaagacccgtcgtcgagcaagaatcttttggagtgggcgaagaggaagaagaaggcgattactcagacgccgatgattttatcgtagacgatgacggcagacctttaatcgagaaaaagaggaaaaagaaaccgattttcaccgacgccgcgctgcaagaggcccaagaaacatttggcgttgatttcgattacgatgagttcagcaaatacgaccaagacgagtatgaagacgaggaggacgaagaagaagacgaatacgaagaagatgacaacgaacgaaggaaacatccaaagaaagcggcgcgaaagaagctgacgaaaaagtccattttcgaagtgtacgagccgagcgaactgaaaaggggctttttcaccgatctcgataatgaagttcgtaacaccgatataccggaacgaatgcaacttcgtgacgttcccattacccccgtcacggacgattcgaccgagctggaagacgaggcggagtggatttacagacaagcgttctgtaacaaggcaatatccaatgttgatgcccacctttcggccgaggccagagagaagatgaagaagggttcccaaactgtagggaaaataaagaaagcgctggatttcatgaggaatcaacagctagaggtgcccttcattgccttttacagaaaggagtacgttcaacctgaactgaatattaacgatttatggaaagtttataaatatgatgccaagtggtgtcaactaaagtctcgaaaggaaaatctcctgaagctcttcgacaaaatgaggcattatcaattggatcagctcatcaagaatccggacgctcccattccggacaacgtgcgagtgatgaaagattcggacatcgaaagactgaaaaacgtccaaactgcggaagaactcaatgacgttcacaatcatttcatattgtattattccggagatttgcctgccatgcatgccgcttggagaatcaaggaaagagagcagaggaaatacgagaaacgtcaaaaaagactaaggcaaattgctgaagctgaagaaggggctgagattcctgatgaaccggaagatgacgatgatgatgagccagaaacagaaactttgaagtacgctaatcgatcgggcagttatgcattatgctcaaaagctggattagatcctttggcgaagaagtttggtttatctcccgagcaatttgctgaaaatttaagagataattatcaaagacatgaagtcgatcaagagcccgttgaaccctctgaagttgccaaagaatttatttctcctaaattctctactgtcgatgaagtattacaagcttccaagtatatggtcgccctgcaaatagctagagaaccattagtaagaaaatgcgttagggaagtatattttgaaagagccaggcttagtgtatatcccacaaagaaaggacaaaaagtcattgatgagtctcacaattgttacagtatgaaatatttaaagaacaaaccggtgagagatttgaacggagatcagtttctaaaactgtgcttagccgaagaagaaaaccttcttgctattacaattaacgataatatcgaagggaacacatcaaactcttacatagaggaagttaagcagctctacatcaaggatgaatttagtaaaaatgtgcaagattggaacgcgctgagaatggagtgcgtagaaagggcgctaactaaaagcgttttgcccgatttaaggacagaattgaagaggaccttgttatccgaagccaaagagttcgtccttaaggcgtgttgcaggaaactctacaacagcattaaaattgctccatactctattacatttcccgatgaagacgaagacgaatgggacacatctaaaggcgttagagttatgggcttagcttacgagccagaatatacagtttcagcgtttgcttgtatagcagctcccgatggggatatcaccgattatttgcgtttacctcacatattgaaaagaaaaaacagtttcagaacggaagaaaaattaatgaaggaagccgatttgcaagcacttaagaactttatctttttgaaaaaacctcacgtgattgcgatcggcggcgaatccagggaagctctgatgatagcggacgatttgaaagctctgattaacgaattggtcgaatccgatcaatttcccgaaatcaaagtcgaaatcatcgacaacgaattggccaaaatttacgccaactccaacaaaggccaggcggacttcagagactatcccgagctgttgaggcaggctatttccttggccaggaaaatgcaagatcctctcatcgagtattcgcaattgtgtaacggagacgaagaaatattgagtttaagattccatccactacaagaacaaatagcaaaagaagaactcattgaagctctgtgcctcgaattcgtcaacagaactaacgaagtcggtgttgatataaatttggctgtacaacaggcgcacaaaagtagtcttgttcaattcgtttgcggtctcggccctcgcaaaggacaagctctgttaaaagtccttaaacagaccaaccaaaggctagaaaacagaacacagttggttacggcttgtcacatgggcccaaaggtgttcattaattgttcaggtttcatcaaaatcgataccaacagtttgggtgatagtactgaagcgtatgtggaaatattagatggttcccgtgttcatccggagacgtacgaatgggctagaaagatggctgtagacgcgttggaatacgacgatgacgagggcgccaatccggcaggtgctttggaagaaatcctggaaactccggagagattgaaagatctggatttggatgcttttgctgaagaattggaaagacaaggattcggcaataagagcatcacattgtacgacattagggccgaattgaactgtagatacaaagatttgaggcagccttttcattcggccaatccagaagagttgtttgatatgttaacgaaagaaacgccggaaacattctatataggaaaattggttactgcttcagttataggtattgcgagaaagaagcctaaacctgaccagctcgaccaggccaatcccgtcagaaacgacgaaacgggtctttggcaatgtccgttttgtctgaaaaacgattttccggaattatccgatgtctggaatcatttcgatgccggggcatgtcctggtcaagccaccggagtcaaacttagattagacaatggaataatgggttatatttatattaagaatattagtgataagccggtatctaatcccgaggaaagggtaggagttggtcaattaattagttgtcgtataataaaaatcgatgtagaaagatttagcgttgattgtacgtcgaaatctagcgatttgctagacaaaaatcacgaatggagaccaccaagagatccccattacgatacggaacgcgaagaaaaagacaacagaactgaggcggaaaagaaaaaagaaaaacaacgtttgacgtacataaagagagtaatagttcatccggcttttcacaacatttcctacgccgaagctgaaaaatgcatggtcaacatggatcaaggcgaagtcatcatcagaccttccagcaaaggagccaatcatttgaccattacatggaaagtcgccgataacatttatcaacatattgatattagggaagaaggaaaaactaacgctttttcattgggtaaatcgttgttgataggcaacgaagagttcgaagatttagatgaaataatagcgagacacgtcactccgatggcagcgcacgctcgcgatttgctctacttcagatatttcaaagacttcgaaggcggccacaaggacaaggccgaggagtacctgaaagacgagaaaaagaagaacgcctcgaaaatacattacgtcgttagcgcagcaaagcacatacctggcaaattcttactctcctatttgccgaggaacaaagttagacacgaatacataacggtgactcccgaaggatttagattcaggcagcaaatgttcgattccataacttcactgttcaagtggtttaaggagcattttagagaaccacccccgggcggaatcacacccggaactccgagaatgtccaccggaagaacaccttatgatatgagtactgaagctattcaaagagttgcacaaaatcttcccagcgatatggtccaagctctatctgctgcaacgaaccaaactcctcactatccacacactcctggcggttacggcggtaattacatcaacacaccgtacacccctagcggtcaaacgccctacatgactccataccaaacgcctcacgcccaacaaactccgcggtacggccagcagacgccgtcccagccgtctctgagcaacccgttcctgcatcccggcgccgtgacgccgtcgcaacgcactcccagctacaggaacctgccgactcagagtccgatgataccgcagagcccggtgccgagtccgggatcgcagagttcgtacagcagccacatgagccaccacacgagggcgagttacggggattcgttgagattccaaccgcccgaatcgccgaggaactacccgagcagcagggggtcctatcccgatggaaggtacggcggtagcgagtcgatggattggcagaaggccgctgaagcttgggcttctaggtccaaatcaacgccacgaagcgaaggtcgcgggactcccagatcgtctggtcacagaactcctcgtaactacgataatctgtctgaaagcgaacggtccaggatgaagcatatgagcagtaaaagcccgaaatcggtacggtcgactccccgtaccaactcttcgcctagatccatgtccttgggcgacgctactcctttgtacgacgaaaacatttaa

SEQ ID NO: 623 - DNA, 2586 bp, Phyllotreta nemorum
atgccagaagtggacagcagcgaatcgcgctctcctcgccgcaaacgccgcaggtccaaatccgccgatcgcaaggaagagaaatcgtccaaaaggaagtcatcgaggaaacgttcgtcggacgacgaatacaatgagcgagattatccacgctactacggcgaggatcggccgaacagcgacagctactggaacaaatatcccaggagagataacacgaaagtcggtcgtaggtattacgatcaccctgaccaccagaagaatagggacagggatgtctcgaacgagaggagcagagatagagatagggaaagcactagagagaaaaaggaagagaatgaggataaatccatcatcaaacccagggaacgtaaagtagttgatatgctaacttccagaacaggaggggcttacataccaccagcaaagctccgtctaatgcaagagagtataacagacaaatcttcagctgcttaccaacgtatcgcctgggaggcccttaaaaaatccgtacacggttacatcaacaaaatcaacacctccaacattggaataatcgccagagaaatcctgcacgaaaacatagtaagaggcagaggtctgctttgcaaatcgataatccaagcgcaagccgcctctccaaccttcaccaacgtttacgctgccctagtggccgtaatcaattccaaatttcccaacatcggagagcttttattgaaaagactggtgcttcagttcaaaaggggctataagcagaacaacaagtctatttgcatttcggctactacattcgtggctcacttggtcaatcaacgcgtggctcatgagattttggcgcttgaaattctcactttgctcgtcgaaactcctactgatgattccgtagaagtggctatttcttttctgaaagagtgcgggcagaagcttacggaagtctcaagtaaaggaataactgctatattcgagatgctgaggaacatcctgcacgaaggccagctcgagaaaagaatacagtacatgatcgaggtgatgttccaaattagaaaggacggtttcaaagaccacgctgctgtaaccgaagaattagatttagtagaagaagaagatcaattcacccatttaatcatgctcgatgatgtaaaggaggctaatgctgaagatattctaaatgtattcaagtttgatgaacattatgaagaaaacgaaggcaaatacaaaactctgagtaaagaaatcttgggcagcgatagcgagtcagatacaggatcggaggggtctgaagaggaatccgaaggtgaagacgaggatgaagaagttaaagatgccggaaaaatcatagacaatactgaaacaaatctaatagcccttagaaggacaatatatttgactatacaatccagtttggatttcgaggaatgcgctcataagcttctgaaaatggagttaaaacccggccaagaaatcgaattatgccacatgtttttagattgttgtgccgagcaaagaacatacgaaaaattctacggacttctagctcaaaggttttgccaaataaataaaatatacatcgagcccttccagcagatattcaaagacacctacgccactacccatcgtctggacaccaacagattgaggaacgttagcaaatttttcgcacacctgctcttcaccgacgccataggctgggaggtgttcgagattatgaagctgaacgaagaagacaccaacagctccagtagaatttttatcaagattttgttccaagaattagccgagtatatgggcctaggaaagctgaatgcgagattgaaagatgaaacgcttcagcagcattttgcaggactatttcctagagacaatccgaaaaataccaggttttccattaatttcttcacgtcaatcggtttaggagggctaacagacgaacttagggagcatttaaaaaacgtccctaaaactttggaaattaaaacggccgttgtgaaggaagagagcgatagtagcagtagcagcagcagcagcagcgctagtagcagcagttcgagcgaagaagaaagcagcgatgatagttctggggattcgagttcagaggatgaaaagcaaaaggaaaaatcgaaaaagaagaaaaagaaactcgattcggagagatcttccaaatcagattccaaaagtaatcgtaaagccgaaaagcgcgatactagtaagcacatgaaaaagagagacaaggaagataacaaagaagcccacaaaaataaagagaatagaagcgatgcggacaaacacgcttcaagggagaagcaaaattcgaggcaagataaaagaaaggacgacggcgatagtaaagaaaaacacaggaaagatgatagggaggacagggagaggcaacggaggaacgaagaaaagggtgggaggaaaaaggactacgaatggataaaaagtagacacgaggataacatacatcaattgaaaactactaaaaaagtgtttgaaaaatcgtcaaagcacagatctaggtcgagagacaaaattagcagtaaagaaaaggacagaaggcatagaagtaaagaaaggcgaaaaagttaa

SEQ ID NO: 624 - DNA, 1869 bp, Phyllotreta nemorum
atgcaacatttactacgctctttttctcaatctgctcccatcataatttttattttattcttctctatgatcaatccagtcccaaacaccgagttttgctctatcacagaaataatgaacgaggtgataaaacacaaaccctccaagaagaacgggcctgcagtggcacaaccccacagcgctggcggtgtggactggagaatcctggtggtcgatcaactggcaatgagaatggtatcggcttgttgtaaaatgcacgacatatctgctgagggcattacactggtcgaagatatcatgaagaagagggagccccttgctacaatggaagctgtgtacttgatcactccttccgagaagtctgtccatgctctcatgaacgatttcgaatctccgaggcccatgtatagaggagcacatgtatttttcacagaagcatgtccagacgaattatttaacaaattaagtaagagtcatgcggcaaaatatataaaaacgttaaaagaaatcaacatagcatttgttccgacagagtcacaggtattttctttagattccccagacactttccaatgtagttacgatccttcctttgctgccgcacgaaatgcgaatatggaaagaatggccgaacagattgctacgttgtgcgccactctgggggaatacccgcacgtccgatataggagcgattgggaacgtaacgtagagttggcgcaattgattcagcagaaattggatgcttacaaagccgacgagccgactatgggagaaggtcctgagaaagccagatcgcagctgctgatcttagaccgaggcttcgattgcgtttcgccgttgctgcacgagctgacgtttcaagctatggcttacgacttgcttccaatcgaaaacgacgtgtacaaatacgaagcttccgctggggtacaaaaggaggtcctgttggatgaaaacgacgagctgtgggtggaattgcgccatcaacacatcgccgtggtttctcaaagcgttaccaagaatttgaaaaagttcaccgattcaaagcgcatgacccagagcgataaacagtccatgaaggatttgtccactatgattaaaaagatgccccagtatcagaaggagttgtcgaaatacgctactcacttacatctcgccgaagactgcatgaaggcctaccaagggtacatcgacaagctatgcaaagttgaacaggatttggcaatgggaactgacgccgaaggggagaaaattaaagatcacatgcgcaacatcgttccgattcttctagacaccaaaataacgaacgagtacgacaaaatgcgcatcatagccttgtacgctatgaccaaaaacggaataaccgaggaaaatctttcaaagcttggacaacacgcgtcgattaaagacaaacaaaccatcgctaatcttcagctcttgggagttaacgtcattaatgatggtggtcccagaaaaaagcagtacaccgtaccgcgcaaagagcgaattaccgaacaaacctaccagatgtcgagatggactcctgttattaaagacatcatggaggattgcatcgatgacaaattggatcagaaacatttcccctatctaagtggaagggcgcaaacgaccggataccacgcagcaccttccagtgctcgatatgggcaatggcacaaggatagaggccagcaggccgtaaagaacgtcccgcgtctattggtcttcgtggttggaggcataagtttctcggaaattcgctgcgcgtacgaggtaacaaacgcccagaagaattgggaagttataatcggatcgtcgcatattcttacaccagaaggtttccttagtgatttagcgacgttagccggctag

SEQ ID NO: 625 - DNA, 2139 bp, Phyllotreta nemorum
atgatgcaacaatatatgaaagaattagaacaagagcctttcgatgctgaagaattcgtagaacgtttagcctggagaactttagctgaatcaaaaagcgatggagaggaaaatgaaattaatccggcactgcttcacgaatcctttgttcaagccataaaggaccttaatttattacatgaaagacaacagaaaaaatgcgaaaaattagaagttgccgtcagggaagacgaagcgacgttttttcaagaaatttacaatttattggagcagaataagcaagctatggatacatttcaagaacttgatggcaaaatcaatcatgtagcaactaaagttcttcacttaggagatcagttagacagtgttaatggtcctagatccagagtggttgatgctttaagtttaatgactcatttgagggaattcctgtcaaacgaaccagtttcatccacaatatttaccaatggagaatacattgatgaagcagcagatgtgattcaaaagttatatttaatatcgcaagatttgccacccaagtttgaatcgataaaaagaaagatagaaaggaaatattcagacatcgagaaaacactgatagaagagttcgttggggctatggataatgagaatttaacaagaatgaaggagatagcattggtactgtctcaatttaagggctactctcagtgtgttgatgcttatatagatcacagccaagtgggttgtttatccagtaaagatgtcttctataactttttgaatttgtgcaaatacaacgatgaaattattcgaaaagttttcaagaatccggagcaagtgatggcaaaattcgttttaaatatataccagttgaaattggtggaatatatagatcaaaaactcaattctaaattgggtacatacagctatttacagacgttatatgaattgtattcaaagactaataatctatcaaacgaattgagcgtttttcatatgggaaacgacaaaaactatctcactaaactgacgacaaatatttataacaagtacattaatgattacatttccatggagcttaagtgtctcaaagacaggtgttcagccagcttacaaaaatattatgactcgaaaaatcatcaaaagaagcagattcaatctgggggttttcaagatctaagaagggatttgcaagcggtaataggcactagggcaaacataaacatagctcaaatagaaaattatggtggtgaaacttttgtatcggaggaattggcaataatgattcttcaggatactaagcaagcttttcaacgttgtttattgttatcaaaaggcagcgaaaaagcttccaacgccacccaaattttagacagacttattaacagtttgctcatagaacatgtagactatgcagtagaattgggccttcaagctgtacccgttgtcgaaggcgttagaaatccccctgttttgtatttttttaatgtcgtgcaccaaagcaataatattacccatctcgtcgaaaaacagttcatggatttggtggttccattagtagaaaacactccaaaatacagcgattgcatacagaagaaaaaatttgttttggaggatatagaaagaaaaattaatacgggattggataggtgcttgagtgcgatattaaattgggtgaaattgtatttacaatctgagcagaagaaatccgatttcaagcctgagtctgatgattttgatacagtggcctcaccagcttgcaagaacgtacttaattatgtaaatagcattatcaaagaaatcaaaacaaatttggatggcaataatgtaacagcttttcttcaagaattggggattagactgcatagagttgtttacgaacacttgttgcagtatcaatataacactgcaggtgcaatggtggcaatttgcgatttaaacgaatataggtcttgtactaaacaattaggtcctttggttgcggagctttttgatactttacatgcgttatgcaatcttctgctggttaaaccagaaaaccttcaacaagtttgctctgaagattctttggctaagctagacagagctatactccatagttttatacaattacgaagtgatttcaaagttcaaaagcagactattttgaaagtctag

SEQ ID NO: 626 - DNA, 813 bp, Phyllotreta nemorum
atggatttccaaaaccggcccggtggaaagacgggcggcggcggcgtcgcctcctggtcggaaaccaaccgagaccgaagagaacgactgaggcaactggccttagaaaccatcgatctgcagaaggacccgtattttatgaaaaaccacctgggttcttacgaatgtaagctttgcttgacgctacacaacaacgaaggtagctacttggcgcacacgcaaggcaaaaagcaccaggccaatttggcccggagggcggccaaggaagccaaagatgccccgtcgttgctccaacccgagaagccccgagtggagccgaaaaaattcgtgaaaatcggtagacccggttatcgggtaactaaacaaagggatcccgaaaccggccaacagagtttactcttccaaatcgattatccagaaatcagcgacttggttacgacccgacaccgcttcatgtcagcgtacgagcaaaaaatcgaacctccagaccgcaaatggcagtacttactcttcgcagccgaaccgtacgaaaccatagccttcaaagtaccgagcagagaagtcgagaaaacggataccaaattttggactcactggaacagagacaccaagcagtttttcctgcaattcgctttcaagaacgaaaacaaacgaaacgttaacgcagtcgttcagaggcattcgattgtcggtggagttccaccgcctcccatgctgccggtaccgccgccacccaggcctcccatgtttaatcccataccaccgccacccccgatgatgagggctattttaccagtacctccaccgaattaa

SEQ ID NO: 627 - DNA, 402 bp, Phyllotreta nemorum
atgtctatcggcgtacctattaaagttctccacgaagccgaaggccatataataacctgcgaaaccataaccggcgaagtttacaggggtaaacttatagaagccgaggataatatgaattgccaaatgactcagataactgtaacgtacagagacggacgagtggcgcaattagaaaacgtttacattagaggatccaaaataaggttcttaatattaccggatatgttaaagaatgctccgatgtttaaaaagcaaaccaaagctggaactgcaggtagagggaagtctgcaattctacgagctcaagctcggggaagaggccgagggcagccgcctgtgcgaggaggcagaggtgcttggcagaatcagcaaaatgcccctgcaggtcgagcaaaataa

SEQ ID NO: 628 - DNA, 1329 bp, Phyllotreta nemorum
atggctacaaacttgtcccgaacatcgctcctcagagtccttaacgccaggggctattcagcctgcccgcatccactttctggcattccaaatgcagaagtaaaaagcaccgtcctccccaacaaaacagtcgtagctgctgtagacaacaacgcctctctcaccagagtttcaatcgtattcagggctggaagtcgtaacgaagaccacgaaaatttaggagtagcccaccttttgaggacggccgccggtctgagtacgaaaaactgctcgcaattcgctattatccgcaacatccagcaggtgggagccaatctaacggccacgtccgacagagaaactatctgttacacgttggagggtaccccagaagctgtggaatgcgctataccgttcttaaccgaagtagccacccagcaggaattcagaccctgggaagtttccgaattgtccagtagattgcagttggatattgccactcgaccattgcagttgagagctgtggatttgctgcacaatgccgctttcagaggacgcggcttgggtaattcattgtttatcccgaaaactcaaattggcaaaatttcgaccgaaaccctgcagcattacgtttgctcgaacttcttgagcggacgtacggccgtcgtaggttcgggtatcagcgaaaaggatttgacgtcttttgccaattccttgaaaatagaaaacggcgaaggcgaaaccgccccttctccttacgtaggcggtgaactaagatcgaacaaaggtggtgaactggcgtttattgctgtagcaggagagggagctgctctcaagaaccacaaggaagctctggcttttgccgtgcttcagggagccattggaggaggccctcaggtcagacacggagtttcggacaacggaatcttcaggaaggctcttggaagtaaccccaacgttagttctgtagccataaacgccagttactcggacaccggtctctttggactgctactggccgttcctacgaagtccgccagaggtgctatagaaagcgctgttaaagtactcaagagcgggacggtttctgatgaggatgtcagcagaggtaaaaatcaattgaaagcgtcgatcctcttcaatgctgaaagcggggcagatattgtaagaactcttggacaagaggctgttttgacgcaaaaagttacgagtgttgatgcacgtttggccgaagtggattcggtttctaccagtgatgtcgcaaatgctcttaagaaagcaggcaagaagttatcgctagcatctgttggaaacttggctggagtaccgtttttagatgaactaaagtaa

SEQ ID NO: 629 - DNA, 333 bp, Phyllotreta nemorum
  misc_feature (282)..(282): n is a, c, g, or t
atgagaagatcccatgcaggtaactactacgagccattgccgcagaattcgaacgaaattgaagacgaaaatgatcggatgactaacgaattgcaagagaaaatcggagttctgaaatccctaactatagatatcggaaatgaagttaaataccaggatagaatgctcagggatgttgacgacgatttagaaaagactggagggttcctgggaacaactatgaacaaagtattaaggctgtcgaaaggaggccacaattacattattgtgtatttgtttttnttttcgattgtggtattttttatactgtactttgttattaaatttaggtag

SEQ ID NO: 630 - DNA, 1491 bp, Phyllotreta nemorum
atgtctttcccatcgacgataaacgcaaaacaggccgcacacgagcacgttttggccgtgtccagggacttcgtatcccagccaaggctcacctacaaaacagtgtccggtgtcaacggaccgttggtaatcctcgaagatgtcaaatttccgaaattcaacgaaatcgtccagctcaaactggccgacggcagcttacgatccggtcaagtgttggaagtgagcggctcgaaagccgtagtacaagtgttcgaaggtacttcgggaatcgacgccaaaaacaccatgtgcgaattcaccggcgatattctcagaacgcccgtgtcagaagacatgttgggtagggtgtttaacggctcaggaaaacccatcgacaaaggacctccaattttggctgaggactacctggacatccaaggtcagccgatcaatccttggtcgcgtatctacccggaggaaatgatccaaaccggtatctccgctatcgacgtgatgaactcgatcgctcgtggtcagaagatccccatcttctcggcggccggtctgccccacaacgaaatcgccgcgcaaatttgtagacaagccggtcttgtcaaagtgcccggcaagtccgctctggacgatcacgaagacaacttcgccatcgtgttcgctgctatgggagtcaacatggaaaccgctcgtttcttcaagcaagatttcgaagagaacggttcgatggagaacgtatgtctgttcttgaacttggccaacgatcctaccattgagagaatcatcacgccccgtttggccctgaccgctgccgaattcttggcctatcaatgcgagaaacacgtgttggtcatattgactgacatgtcttcgtacgctgaagctttgcgtgaggtatccgcagctagggaagaagtacccggtagacgtggtttccccggttacatgtacaccgatttggccaccatttacgaacgagccggacgtgttgaaggaaggaacggttccatcactcaaatccccatcttgactatgcccaacgacgatattactcacccgattcccgatttgaccggttacattaccgaaggacagatctacgtcgatcgtcagctgcacaacaggcaaatttacccgcccattaacgtcttaccgtcgctgtcgcgtctcatgaagtccgccattggcgagggcatgaccaggaaagatcactctgacgtttctaaccaattgtacgcttgctacgccattggaaaggacgtgcaggcgatgaaggccgtggtgggagaggaggcgttgacgcccgacgatttgctctacttggagttcctgaccaagttcgagaagaacttcatcacgcagggcggctacgagaaccgtacggtgttcgagtcgctggacatcggctggcagttgttgcgtatcttccccaaggagatgttgaagcgtatcccggccgccacgttggccgaattctacccgagggactcgcgtcattag

SEQ ID NO: 631 - DNA, 1503 bp, Phyllotreta nemorum
atgaacgaaatccgcgaacgcgaacgtgccggcatccgagtcccggacgaactacgagccatgctgctcgaattcacctgcagctacttgctcgaacagcccgaagacgtagtatcatacgcccaagaatacttcaccaaattcaaagaaagccgaggcactgccttgatctacgaccaggacatgtacgatcaggaaacaatgggcatcaaaaccgtcttggctcgccaaatattcgactccagaggcaaccccaccgtcgaagtcgacatcaccaccgacttgggcctcttccgagcggccgtaccatcaggagccagtaccggcatctacgaggcgctcgagcttcgcgacaacatcaaaaccgagtaccacggcaaaggcgtgaaccaggccatcaaaaacatcaacaccatcatcgcccccgagctgatcaaagccggcttcgaggtgacccagcagaaggaaatcgatgagttcatgatcaagctggatggtaccgagaacaagtccaaattgggagccaatgctatccttggagtatccttagctatttgcaaggctggagcagccaggaaaaacgtgccgttgtacaagcatatcgctgatttggctggaaacaaggatatcattttaccagtaccggcttttaacgttattaacggtggatcccatgctggtaacaagctggccatgcaagaattcatgattcttcctacgggggctacaaccttcactgaagccatgcgaatgggttccgaaacctaccatcacctcaagaaggttattcacgccaagttcggcttggacgcgacagccgttggagatgaaggcggtttcgccccgaacatcctcaacaacaaagaggggctcgagttgatcaaggtggccatccagaacgccggatacaccggaaaaatcgacatcggcatggacgtggccgcctcggaattcttcaaagaaggtaaatacgatttggacttcaagaaccccaacagcgacaaatccaaatggataccctccgacgaactggaagctttataccaagaattcatcaaagagtacccgatcgtttccattgaggaccccttcgaccaggacgattgggccgcttggacgaagctcacgggcaacaccaaaatccagatagtaggcgacgatctgacggtcaccaatcccaagcgcatccagacggccgtggagaagaaggcctgcaactgcctgttgctgaaggtgaatcagatcgggacggttacggaatcgatcgaggcccatctgctggccaaggcgaacggttggggcacgatggtgtcgcacaggtccggggcgacggaggacccgttcatcgccgatttggtggtgggcctgtcgacggggcagatcaagaccggggcgccgtgcaggtccgaacggttggctaagtacaatcagattcttcgtattgaggaggagctgggggccggtgctaagtatgccggtaaggcgttccgtaagccgcagtaa

SEQ ID NO: 632 - DNA, 2421 bp, Phyllotreta nemorum
atgagttacatgcagactaaccaaaatagaccaatgtctcaaggttatcatcagggtggcaacgatctcccgatgcagtcgtccaaagagcagactctgctgtggcagcagaactcctacatgggagactccggcatccagtcaggcgctgccactcaagtaccgtcgctctccggcaaagaagaggaagagatggacctcttcgacctcgaccagccctaccaaggattcacgcaagagcaggtagacgaaatgaacaaccagctgaaccacaccagatcccagagggtgagggcagctatgttccccgaaaccttggatgaagggattgagattccttcgactcaattcgatccgaaccatcaaacggctgtccaacgtttggcggagcccagccagatgctcaaacacgctgtggttaatttgatcaattaccaagacgacgctgatttggccaccagggccataccagaattgatcaagctgctcaacgacgaagatcaagtggtggtatcgcaagccgccatgatggtgcaccagctctcgaagaaagaagcttctcgacacgccatcatgaacagcccgcaaatggtggccgctttggttcgagccatttccaactccaacgatttggaaaccaccaaaggcgctgttggtactttacacaaattgtcgcaccacaggcagggtttgctggccattttcaagagcggcgggatcccggcgctcgtgaaattactgagctctccggtcgaaagcgtactgttctacgctataaccacccttcacaacttgttgctccaccaggatggttcgaaaatggccgttagattggccggtgggttgcagaagatggtcgcgttgctccagagaaaccacgtcaaattcctggctattctcaccgactgtctgcaaatcttggcttacggcaatcaagagagcaagctcatcatcctcgcctcccaagggcccatcgaattggtcagaataatgagatcgtacgattacgagaagcttttgtggaccacttcgagagtgttgaaagtgttgtcggtgtgctccagcaataaaccggctatagtagaagctggcggtatgcaagctctcgccatgcatttgggcaaccccagcacgcggttggtccaaaactgcctgtggaccctcagaaatctatcagacgcggctactaaagtagacggattggagagtttgttgcaatctttggtgcaagtgttgcaatcgtccgacgtgaacgtggtgacctgcgcggccggcatcctgtcgaacttgacgtgcaacaatcagcgcaacaaagtgacggtgtgccaggtgggcggcgtcgacgcgctggtgcgcaccatcgtcagcgccggcgatcgcgaggagatcaccgagccggcggtgtgcgcgctgcgccacctgacgtcgcggcacgtcgagtcggagatggcgcagaacgccgtgcgactgaactacggcatacaagtgatcgtcaagctgttgaacccgccgtcgcgttggccgctggtgaaggcggtcatcggcttgatcaggaacttggcgctgtgtccggccaatcacgctccgctgagggagcacggcgccatccatcatctggtgcagctgctcatgagggccttccaagacactcaaagacaacggggtagcgtcgccagcgggggtagccagccgcctgggacgtacgcggacggggttcgcatggaggagattgtagaaggaacggtgggagcgttgcatatattggcgagggaatcgcacaatcgggccatcatcagacagcaaatggtgattccgattttcgtgcagttgctgttcaacgatatcgagaacatacagcgcgtcgccgccggcgttctttgcgaattggccgccgacaaggagggggccgaaatgatcgaaaacgagggcgccaccgcccctttgactgagttgttgcattcgagaaacgaaggtgttgctacgtacgcagcggcggttttgttcagaatgagcgaagacaaaccgcaggattataaaaagcgactatcaatggagctgactaattctttgtttagagaagaaaatctttggaatcccgacctaggcatgggtccggatttgcaggatattttaagtcccgaccaggcatacgacaatatgtatgctcagggtcccccgagtgttcatagtagccatggaggccgaccgtatcaacagcaagggtatgaccagatacccatagacatgcagggtttggagatcggttctcacggaggggggaatgggtccacttacagtgcaatagacgcgatggacgttaccagcggagagcctgatctcaatttcgataccattgatcaactccctacccctcctcaagataacaaccacgctgctgcttggtatgataccgatttataa

SEQ ID NO: 633 - DNA, 801 bp, Phyllotreta nemorum
atggccagaaacgcagagaaggcaatgacgactttggcgagatggcgggcggcccaattgggcgaaatcgacaagcacaaaaaacgccggccctatttggcgtccgaatgcaagagcctctacgcgtgcgagaaatggcgcatgcaaatcatccgagaaatagcgaaaaaagtggcccaaatccagaacgccgggctcggcgagttccgcatacgcgatctcaacgacgaaatcaacaaactcctgcgcgagaagcgccactgggaggaccaaatcaaagagctcggcgggcccgattaccagcgagtcggcccccggatgctcgaccacgagggcaaggaggtccccggcaaccggggctacaagtacttcggagccgccaaggagctaccaggcgtccgggagctgttcgagcaggagccgccgcctccgccgaggaagagccgggccgagctgatgaaggacatcgacgccgattactacggctacatggacgacgatgacggcatactgatacccttggagaacaaagctgaaaaaatcgccgtgcaaaaggccatatcggattgggtgagcaacaaggagaagaacctggactcgagcaaagggatcgaagagagcatttacgtggtggaggagtcggacgaagaggacgctgtccaacagttcgacggttcgcagcagcggttcgtggctcacgtgccggtaccgtcccagcaggacatcgaacaggccttgttgaggaggaggaagcaggagttgatggagaagtacggcgttcaagacgaacaagatgtataa

SEQ ID NO: 634 - DNA, 645 bp, Phyllotreta nemorum
atggctgcgaaagacatgcccacattcaaatgcgtcctagtcggcgacggtggtaccggcaaaacgactttcgtcaaacgccacatgaccggcgagttcgagaaaaagtacgtcgccaccctgggcgtcgaagttcatcccttagtgttcacgacaaaccgaggcaaaatctgcttcaacgtgtgggacacggcgggccaggagaagttcggcggcctcagagacggttattacattcagggacagtgtgccattattatgttcgatgtcacgtccagggttacatacaaaaacgttcccaactggcacagggatattgtcagggtgtgcgaaaacataccgatcgtactatgtggaaacaaggttgatatcaaggataggaaggttaaggctaaaagtatcgtgttccataggaagaagaaccttcagtattatgacatatctgcaaagtctaactacaatttcgagaagcccttcttgtggttggcgagaaagcttattggcgatcccaacttggacttcgtcgccgaatcggcccttctccctccggaagttcaaatggatccgcagtggcagaaacagctagaaaacgatttgaaagaagcttcggagaccgctctgcccgatgacgatgaagatttgtaa

SEQ ID NO: 635 - DNA, 354 bp, Phyllotreta nemorum
gtattaaacttgatatgcataatactatacaggacgggttaccagggatccttcttgggagtaggaggaacatggaacttaaacgaagaaaaaaatcctgatgcggaaattgtggcatctggaatctttgtcggtttcatgatctacactgtcgtatctcttataagtttctgttttgccagcggtgatcacaaaacatctttcaccgatattttaatgaacatagttggagtattcatgtgggtggccgttggggcaacagctcttcactactggctcggttatttgtcagaatataaatactcgaccgtcgattccgagcgacaggtaagtttatcaatgcagcaatattaa

SEQ ID NO: 636 - DNA, 2526 bp, Phyllotreta nemorum
aaattaatcttcaaaatgccgcgaataatgataaagggtggtgtttggaggaacacagaggatgaaattcttaaggcggccgtgatgaaatacggcaaaaaccaatggtccagaatagcatctctgcttcacaggaagtctgcgaaacaatgcaaagcccgttggttcgaatggctagaccctagcatcaaaaaaaccgaatggtccagagaagaagatgaaaagttgctgcatttagctaaactaatgcccactcaatggagaactatcgcgcctataataggcaggaccgcagcccaatgtctagaaagatacgaatatttgctggatcaagcgcaaaaaaaagaagaaggcgaggatgctgtggatgatcccaggaagttaaaacccggagaaatcgatcctaatccagaaaccaaacctgccagacccgatcctaaagatatggacgaagacgaattagaaatgctttccgaagccagagccaggctagccaacacccaaggcaaaaaagccaagcgtaaagctcgcgagaagcaattggaggaagcccgtcgtttggctgctttgcagaagcgtcgagaactgagagcagccggcatcgaagtcaattcgaggcgcaagaagaaacgaggcgtagactacaatgctgaaattccgttcgaaaagcaaccagcaatcggtttctacgacacttccaacgaagccctagacttgatggcgccggatttctccaaaatgagacaacaacatttagacggtgaactcaggagtgaaagagaagagagagaacggaaaaaggacaagcaaaagttgaagcaacgcaaggagaacgacattccgcaagcgatgctgcaaaacgaagaaccggctaagaaacgatcgaaattggtgctgccggaacctcagatatccgatcaagagatgcaccaagtggtcaagctaggcaaagccagcgaaacagcccgagaaatcgctacagaaagcggagtcgaaaccaccgacactcttctcaacgattacatgttcacaccacaagccgctgccaccccaagaacccccgcaccccaaaccgacaggatacttcaagaagctcagaacatgatggccctcacccacgtcgatacgcctctcaaaggcggtctgaatacgcccctgcacaactctgatttcagcggggtcctgccgcaatcgcaagcgataaccactccgaatacagtgctcgcaactccattcagatcatctagaagcgacgggggagcgactcccggaagcacggccgggttcatgactcccaaaagcggagcactgactccggtcggcaaaaacgcgacgccctctgtcagagacaagcttaatataaacgctgaagaaagtttagacgtggcgagtactccggccgaacacagaatgtatcaaatgtcgatgaaggaccagctgaagctgggactgagcagcttgccgcagcccaggaacgattacgagattgtcgtgcctgaaaatgaggcgcaggacgaacccgaagaagcccaatcccaactggttgaagaccaagcggacgtggatgctagaaaacaagaggaactgagagccaaagcggctcaggaattggcgtcgcgttcgcaagtcatccaaagagaactgcccagacctcaagaggtgaacctgaccgtgctccgaccgcccaacgaaagctactccttgactgatcttcagcgggccgaagagttgatcaaatgcgaaatggttaccatgttgcaatacgacaacctgaagaaccctctgccggcccaaagcaagagatcgaacatgtcgcaagcccagcaattggcctttctcgagcagcatccttacgattcgttcaagcaagaagatttggaagtggccaaaacgctgttgagaagcgaaatggaagtagttaaaaacggaatgaaccacggagagctcccattggacgtttacaatcaggtgtgggaagagtgcctgagccaagtgctgtatcttcccaatcagacgaggtacacccgcgcgcatttggcgagcaagaaagacagattagaatccgcggaaaagcggctggaacagaatcgatcgcacatggccaaggaggcgaagcgcgccgccaagatggagaagaaattgaagattttaacgggcggctatcagtccagagcgcaggtgcttattaagcagttgcaggatctatacgagagcatcgatcaatccgctttggagttgaacacgttcaaatttttggccgagcaggaaaagaacgctttgccgatgagaatacagtctcttactgaggatgttaatagacagatggaaagagagaaggtgcttcagaagaaatacgccgattatcaggatcaaattaaacagctacaagaggagtatttagttcaaatgcaaggtgttccgaatgaagagtccaataagtatgacgaagtcacttcgaccacgaatgaggaaaatgttatggatacatcggaaaatgataatgataaaattgttgctgaaaactaa

SEQ ID NO: 637 - DNA, 474 bp, Phyllotreta nemorum
atgatgcaatttatgttactgttcagtaggcaaggaaagttgcgattgcaaaagtggtatgtggctcatccagataagctgaagaaaaaaattaccagggaattaattacaaccattcttgccagaaaaccaaaaatgtgcagttttttagaatggagggatttaaaaatcgtttacaaaaggtatgctagcttgtatttttgctgcgctatagaacagtgcgacaacgaactgttaactttggaaatcattcatcgttacgttgaacttttggacaaatactttggaagcgtgtgtgaattggatataattttcaacttcgagaaagcctatttcatcctggacgagctattgcttggcggcgaggtgcaggaaaccagtaagaagaatgttctgaaagcaatcgctgcacaggatctcctacaagaggaggaaacgccgcaaggattcttcgacgatcacggtttgggctaa

SEQ ID NO: 638 - DNA, 1251 bp, Phyllotreta nemorum
atgtatggattacaacgatattcgtttcgttacaccctcaaaaatgcggtgcgttattactcgagagaacccgccaagagatcgtcgtttctcagtcgattatacgacaatttcaaagacgaaatgaacaaaaacaaagaaatgaaagaatctttaaaaaaattccgtgaagaagcccaaaaactggagcaaagcgacgccttaaaagccgcccgacaaaagttcgaaaccgtagagaaagaggccagcaaaggcggcgaagtcttcaaagagagtttaggttcgattaaagaaagagtcaaaggagttatagacgaggccagcaaatcggatttagccaagaaagccggtaaattcaccgaagaagtaggaaaaaccacacacaaaatcagcgaaaccgcacaagaaattagcaagacaggagccttccaaagcatctcggaagccaccaaagctgttaaacaggaaatcgacaacaccagcatggaaggtcgagtgtacgtgagccctaagaagctgcgaaaacgaaccgaaaccagcgcagtagtccaacagaaatactacgaaccgaacacggacgcgaccggcgtggagctacacaaagactccaaattctacgaatcctggcaaaacttcaaaaacaacaacccgtacgtgcacaaagtcatggactggaagctcaaattcgacgaaagcgaaaaccccatcatccgagcctccagggcgctcaccgaaaaagtcggcgacatcatgggcggcttgttccaaaaaaccgaactgtccgaaaccctcacggagatctgcaaaatcgacccggacttcgacaccaaacgattcctgaaacaatgcgaaaccgacatcatcccgaacgtgctcgaagccatgacgagaggagacctggaggtcctgaaggactggtgccacgaaggacccttcaacctattcgctgtgcccattaaagaagcctacaagaaaggctacaaaatcgagtccaagatactagacgtagaccatgtggacttggtgatgggcaaggtgatggatcagggccccgtgttgattatttcttttacttcgcagcaagttatggccgttagggacgcgtcggggaccgtggtggaaggcgatccggacaaagtgatgagggtgaattacgtgtgggtgttgtgccgggacgtggtggagccggacccaagggcggcttggaggttgctggatctttcggcgagcagtaacgagcaattggtgtag

SEQ ID NO: 639 - DNA, 909 bp, Phyllotreta nemorum
atgagtagcagtgattcagaattaagcgatagtgatgctgagttgcaacaagccttattagatggtaagctgaaacctgggttaaataaaatcgaagaggcccctaaacaattcgtgaacaacataagtggcttaaatcagaaaatcgaagaattcaaattgaaactgccatggatcgaacggctggattgtacgaatgcccaagcccccttggcgcccgaattagcagcagaaatgctagttcacgaggaaaagagaagtaatcaactcaggaacaacaagaaacttccccaattccaaccatccgaagatcccgttctaaacgattttaaacgagagctaatatttcacaggcaagcacaagccacaattctggaggcaatcccgaaaatcaaagagtttgggttacctactaaaaggccagatgattattttgctgaaatggccaaatccgatgagcacatgcacaaaatcagagaaaacctgaagcaaaagcaggagcaacagaagcggattgaacgggtgaagcaattgaggcagcagaagaaagaaggaaagtcgctgcaggtgcagatgaaattgcaacggtccaaggagaagaaagaaatgatggatcaagtgaagaaagcgaggaaaaacttcgactttttggatgacaaaaataagcccatgggaaagaaggcggcggaaaaacgtaaaatgaaggacaagaaattcggtttcggtggcaagaaaaagggaatgaaaaaaaatacaaaggatagtgcgggcgatattagtgagtatagaaatcctgggaagccggccaagaagcagatagggaacaaattcgtcaacaaaaacaaaccgaaaaatcaaagattgggcaaaaataggagaatcaaaactaaggctaaaggaaaaaaataa

SEQ ID NO: 640 - DNA, 3801 bp, Phyllotreta nemorum; identical to SEQ ID NO: 614

SEQ ID NO: 641 - DNA, 1851 bp, Phyllotreta nemorum
atgaatccaggcgccccgaattaccccatggcgtctctgtacgtcggagacctgcattccgatatcacggaggccatgctctttgaaaagttttcatcggctggccccgttttatccattcgcgtctgcagggatttgataacccgcagatctttgggctatgcctacgttaatttccaacaacctgctgacgccgaacgtgccctagacactatgaatttcgacttgatcaaaggcaggcccattcgtatcatgtggtcccaacgcgacccttctctacgaaaatccggagtcggcaacgttttcatcaagaacttggaccgatccatcgacaacaaggccatgtacgacaccttctcggccttcgggaacattctcagctgcaaagtggctcaagacgagagcggagtcagcaagggctacggtttcgtccactttgaaaccgaagaagctgccaataaatccatcgaaaaggtaaatggtatgctgttgaacggcaagaaggtctacgttggtcgattcatcccgcgcaaagaaagggaaaaggaactgggcgaaaaggccaagctcttcacgaacgtttacgtgaagaatttcggagaggacttgtccgaggagcagctgcgaacgatgttcgagaagtacggcaagataaccagctacaaaataatgagcaaggatgacggcaaatccaaagggttcggattcgtcgctttcgagagccccgaggcagccgaatcagctgtcgaggccctaaatggcaaagagttactggaaggcaagcctttgtacgtgggaagagcccagaagaaggccgagcgccaacaggagctgaagcggcgcttcgaagccctgaaaatggaacggctgaaccgctaccaaggcgtaaatctctacgtgaaaaacttggatgacaccatagacgacgaacgcctgcgcaaagagttttccccgttcggcaccatcacctcggccaaagtcatgatggaggaaggccgaagcaagggcttcggcttcgtgtgcttctcctccccggaggaggccaccaaggccgtgaccgagatgaacggccggatcgtcggcacgaaaccgctctacgtcgccctggcccaacgcaaagaggaccgcaaggcccatctgacgtcgcagtacatgcagcgcatggccaacatgcgtatgcaccaaatgggccagttcatccagccgggcggctcgagcggctacttcgtgccgaccattcaagcgacggcgccgcgtttctacgggccggcccagatgccgattcgcactagtccgagatggcaggcgcagacgccggtgcgtcccggcgcccagggcggcaccgccgcctacgcgggaatgcagaacagctacagggccgcggcgaggccgcccggtcaatcgacgatgcgcagcaacatcagcgtgccgcgacccatcaccggacaacaaccaccaagtgttgctgctgctggaaatcgtgcagccaacttcaaatacaccgccaacatgcgtaatccgccgcaggcgttgttgccgggagctcaggctcaagtgcaacaggcagtgcacattcaagggcaggaaccgcttactgcgaccatgttggcagcggctccgccgcaggagcagaaacagatgttgggagagagattgttccctctgattcaaaggatgtattccgatttggctgatgttgcaggtaaaatcaccggtatgttgttggagatcgacaacacggagctgttgcacatgttggaacaccaggaatcgctgaagaacaaagtggaagaggccgtggctgtgctgcaagcccatcaagctaaacaagctgctataaaaaaagattaa

SEQ ID NO: 642 - DNA, 2703 bp, Phyllotreta nemorum
atgaccgactcgaagtattttacaaccaccaaaaagggagaaatattcgaattaaagtcagaactcaacaatgataagaaggagaaaaagaaggaagccgttaagaaggtcattgcttctatgactgtaggcaaagatgtctcggcattgtttcccgatgtcgtgaattgcatgcaaaccgacaatttggaactcaaaaaattggtttacctatatctgatgaactacgctaaatcccagcccgatatggctataatggcagtcaacaccttcgttaaagattgcgaagaccccaacccgctaattagagcactagctgtcagaacgatgggttgcattcgagtcgataaaatcaccgaatatttatgcgaacctctgagaaaatgcctgaaagatgaagatccatatgtcagaaaaacagctgctgtttgtgtcgctaaattgtacgatatttcatcagggttagtcgaagaccagggatttctcgaacagctaaaagaactactaagcgactctaatccgatggtagtagccaatgctgtagctgctttgtccgaaatcaacgaaagcagccccaccggccagcccctagttgaattaagcaccaacacgataaacaagcttctgacagctctaaacgaatgcaccgaatggggccaagtgttcatactcgactccctctcgaactacaccccccgagacgaaagggaagcgcagagcatatgcgaaaggatcactccgcgtttggcccacgccaacgccgctgtagtgttgtcggccgttaaggtgctgatcaaaatgatggagattttggcgggagataccgaattttgcaacacgctcagcaaaaaattagcgcctcctttggttactctgctgagctccgagcccgaagtgcagtatgttgcgctgagaaacattaatttgattgttcaaaagaagccggacatattgaaacatgagatgaaggtgtttttcgtgaaatacaatgacccgatatacgtgaaactggagaagcttgacataatgattcgattggcttctcaagtgaacattgctcaagttctgagcgaacttaaagaatacgcgactgaagtggacgtggactttgtaaggaaagctgtaagagctattggccggtgtgctatcaaagtggagccttcggcggagagatgcgtcgcgacgctgttggatttgattcaaactaaagttaattacgtcgtacaagaagctatagtcgttatcaaagatatatttagaaaatatccgaataaatacgagagtattatcagcaccttgtgcgaaaatttggatactctggatgagccggaagcgagagctagcatggtgtggattataggagaatacgccgagagaatcgataacgccgatgagttactggatagtttcttggaaggtttcggtgacgagaacgctcaagtacaactccagttgctgacggccgttgtgaagctattcttaaagcgtccccaacacacgcaaggtttagtccagcacgtactcagcttagccactcaggactccgacaatccagatttgagagacagaggtttcatatattggagattgttgagtacagatccggccgcagccaaggaggtggttctggcagataaaccgctcatatcagaagaaaccgacctcttggagcccactcttctcgacgagctcatctgtcacatatcatctctggccagcgtttatcacaagccacctacagcgttcgtggaaggtcgaagcgctggtatcaggaagacgttaccggctagacaaggctctgatgaaggcgctaccgctgccgaaacaactgtcatcccgaaccaagagagcctcatcggagatttgctcagtatggatatcaacgctcccgctcctgccgctgctgctcctgcagcccctcagaccagcaacatcgatttactcggaggtggcctggacgttttgttgggaggaggtaccgatattcctgctagcgctgctactgctgctgcgcccactaccacaggattactgggagacatattcgggatacctacagcgcctactatgtacacgccgcccaaagttatctggctgccggccgaaaagggcaagggcatggaaatctacggtaccttttccagaagatcaggccaaatggccatggaaatgaccattaccaataaggctatgcaggctatgtctggtttcgctatacaattcaacaagaacagtttcgggatcaccccgagctcacctttgaacatcccgactttgcagccggggcaaaacctggaatacagcttgccgttgaacactaccggtccggtacaacgtatggatcctttgatgacgctccagattgctataaagaacaacgtggacgtgttttactacgcctgtcagattcccatccagatattgttcggggaggatggtactctggataagagggtgttccttaccacttggagggacattcctggagctaatgaggtgcagtacacgctgaacgatataaaaggcaacacggacacggtttcgaacaaaatgacgttgaacaacatcttcaccatagccaagaggaacgtcgaggggcaggacatgttgtaccagtcgctgaaattgacgaacaacatttgggtgttgttggagctgaagttgcagccgggcgtgccgacggcgacgctcagcttgaagtcg

SEQ ID NO: 643 - DNA, 498 bp, Phyllotreta nemorum
atgccgcctaaattcgatcccacggaagtaaaatacgtttacttgaaatgtgttggaggagaagtaggagctacatcatccttggctccgaaaatcggtcctcttggtttgtctcccaacaaaattggtgacgatattgccaaaggtacagctgactggaaaggtttgaaaatcacggtccaattgaaaattcaaaaccgtcaagccaccatctccgtagtaccgtcggctgcttcattaattattaaggctttgaaggaacctcctcgtgacagaaagaaggtgaaaaacattaaacacagtggaaacattacgtttgatgaagttattgcccttgcccagcaaatgaggcctagatcaatggccaaggccctttctggaacagttaaggaagtgctgggtacagctcaatctgtaggttgcacaattgatggcaaagcccctcacgacgtcatagatgaagtcaatgagggtactgtagaagttccagatgagtaa

SEQ ID NO: 644 - DNA, 1095 bp, Phyllotreta nemorum
atgagcgaagaagggaaaagagcgttaattttagtcgggggttacggcacaagactgaggcctctaactttgagccgtcccaaacccctcgtggaattcgcgaacaaaccaatactattacaccaaatagaggctctagtagacgcgggagtaacggaagtcatactggccgtgtcgtatcgagccaagcaaatggaggaggaacttacagtcgaagcgaccaaactgggcgtttccatagtattttcgcacgagactgagcctctaggcaccgcagggccaatagccttagctagagaacacctttcgaaaagtacaaaaccgttttttgtattgaactccgatataatatgcgacttcccgtttagggagctggccaagttccacgaaggccacggcaaggaaggcaccatagtcgtcacgaaggtcgaagagccttccaagtacggcgtagtagtttacgatgaaaacagctgcatcgagagctttgtggaaaaaccgcaggagttcatttcgaacaaaatcaacgccggcctgtacattctgaaccccagcgtgatcgacaggattgaactccggccgacttccatcgaaaaggaagtgtttccttacatggctaaggacaagcagctgtacgccttcgagctgaaagggttctggatggacgtcgggcagcccaaggacttcttgaccgggatgtgcttgtacttgaaccatttgcgggaaactaacagccagaagctgtacaagggacccggtgtggtcgggaacgtgctggtagatccaactgcaaaaattggcagtaattgccaaatcgggcccaacgtaacaatcggaccagacgtggtaatagaagacggggtttgtataaagcgctcgacgatactgaggggtgcggtcgtgtgctcgaactcttggttggagagctgcattgtggggtggaagtgtcacgtgggtaaatgggtgagaatggaaggaagtaccgtactgggagaggatgttatcgtcaaggatgagacttacataaacggagggcaggttcttcctcataaaagtattgctacatctgttccagagccccagattattatgtag

SEQ ID NO: 645 - DNA, 915 bp, Phyllotreta nemorum
atgaaaaacaaaaaaaaaaaaaaaaaaaaaaaaaaacccaacctaaacatggcgtcggacggtgaagaagtgataagtgaccaagaaaaagtgaaaatagtttcggatttcatcctccattccccgcccggcgaattcaacgaagttttcaatgatgtaaggaaacttttgaataacgacgaccttctgaaagaaggcgtaaccggggcgttcgcccaatacaataaagaccaactcacccccgttaggatagaaaacgccgatcaaatggtgctgattacagaatacaacgatttaggtaacaatagattcttcgacccccgtagtaaacaaagtttcaaatacgaacatttaagaaaggaagcttctgattaccagccttatagtgtcgatacgacggcggagccctggcgggccgctctagataacgagtttattcaatacactagaaaccattataaagacggcgtttgtagcgtattcggtcgcagtcagaacggtgcgatcacccttactgcttgcatcgaagaccaccaatttcagcccaagaacttctggaacggccgatggagatcccagtggtccgttagcttaaccgatgaatccacagctgaagtacgtggcgtcctgaaagtgcaagtccattattacgaagaaggaaacgttcaattggtgagtactaaggagatcaaggagtcgattccggtttctaacgaagctcaaacggccaaggaaatcatccatgtaatagagaatgctgagaatctgtaccaaactgcgatttctgagaattaccagacgatgtcggacacgacttttaaggccctgcgaagactcctgccggtgaccaggacaaaaatggattggaataagattgtatcttatagtattgggaaagaactaaaaacacaatga

SEQ ID NO: 646 - DNA, 4098 bp, Phyllotreta nemorum
atgtcagcgaaaatgctcgtgaaaatgaactttctactagttttaataatcagtgcggtggctcaagagggcgtagcgccggacgtggcgggccaggataatacgggagacgtggaaaccatcggcgtgggtgcagcagggggcgacgattccaggcccgttcctgtgggagaaaacgacggaacggttacgaacagtcctaattacgacgctccagaagtattaacaaatagagatagtactaacagttccaggcccaactggactttccaaaaaaaaactaaatctgggaaatacataactttttatgcccccaattatgaccccatgacatcagatactgcccctcaggacacggaccaaaggggtggaggtatcccttactccataactgaaaccaggttggccgaaatcagaaaaaactttatgtatccgttctacgataaaggaggcaacgtggacaacgagggggattaccagaaggaaatccaatcctccacgccccaagtccacaagaatctgaatttccaattgcctttcttcggattcaggtataattacacaagagtttccatcaatggttatttggaatttagcgatcctccttccaacttaaattatccattggtctttcctataaaagactggcccaagcaaaacgaccctgcgtttatcggtattttctacagtaaatgtaaaatcggtaatcttcgcgacgaagacgtggacaaaagaaaaccgggagtgtacttcagaatggaaagagaccttagggacaggcaagacagaatgggagtggaaataagagaaagattaaaatgggatataagagaaggagtgatcggttcggatacctttaatccaaaacacgctattatcgtgacgtggaagaacgtgtcatttaatggaggatatgccaacgcagtttatcaaaccaatacattccaaatggtcctcgccaccgacgaggtatttacttacgcaatatttaactacttaaatattgattggaccagtcacacagagtccggtggagacactagaaaaggcgaaggaggtgtaccggcatttgtcggattcaatgccggtaacggtacgagaagctaccagtacgcgccctacagtcaagcatctgttattcgagatttgacatcaaccggttggggtaacaacaaacctggaaggcacattttccgaatcgacgagaacatcctgttgggttcttgtaacaaagatatcgatggtgccaatttgccccttcaattcgcaccggagagcggcaatatgctgggcggaaccgtcgttaacatcacaggtccttgctttaaccccaacgataggataagatgtaaatttgacgtgtacgatgaagtcgtgggatacgtggtggacaggaaccgtgcgatttgcattcaaccccgcctttacgcagaaggttgggtgagactccaaatcgccatcaattctgaggccttcaaatggaaaggaaaatattacgtcgaatctcctgccagcgcctcacagaagatctttttcaaagacatgaagtaccacgagaagtcgcccagcgagattcgcatcacgtggcagaagcagaacttgacaaccaacgaaaacgccaacatcaggatctccttgtggggctacagggaaaccaccatgaggcccacgttcgtttacataacggaaatagccgataatgttcaaaataccggagagtacaccatcgtaccatcgcagtacaggggcaaagtcaaccagtttttgtccgacatcaagttcggattcctgcagataaatctgaccgaatcgataaaggtcaacacttacactacaaacaatcaaaacgtcgatatcacaccaataatatggagcaggccgattccgctgggttggtacttccaattccaatgggagaatcaatacggtaaaaattggcccaaatacctctgcgatgattggctcagaacggacagatatctgaagaattttgcccatgaattgccgcaatgtccttgcacggtgcagcaagctttggcggacaaaggaaaattcatgcctgactttgattgcgacaaagattcaaatcctgtttgttattacaacaatcaagctttacattgcgtcaaaactggtgctcccacaatggaaggttccgaacaacaatgttgctacgacaaaaacggctacctgatgctgtcctacgatcaacaatggggttcaagtcctcgtcgatgccacaacctcggcaaaatgccttacaacgaggccaccaaggtccccacgctatctcaatggttcaacgacgtcgtgcccaagtacctctgttgcctctggcaggaagagcaagccgtcggctgcgaaacactgcgattcgagagaaggccgtcgcaggactgcgtcgcatatcaagcgcccgccgtagcgggagtttacggtgacccccacatagtcaccttcgatgatgtggaatacacgttcaacggcaaaggagagtactccttggtgaaatcggttaaagtggacgataacttggaaatacaggccagattcgagcaaatggatcccaatgcttacggtgaagttagagcaacgcaacttacggcgatcgtggctaaaggaaacaagaccattcctattgaagtcagaagaagaccgccagaagccagatggaggtacagattggatgttatagccgagaacaggaggctgtatttcgatagaccttcgttgaaatttcaacattttcaaggcgttactgtttacacaccaacctacattctgaaccaatctgaagtactaataatgttcgataacggagccggtgttgaggtactggacaatcaaggatacatgagtgctagagtatacctaccctggtcatttataaacaaaacggtgggcctgttcggcaactggagcttcaacaaagaagacgacttcacgctaccggacggatccaaggcggccgtggcgagcaacatcaacgacatggaaagagtctttaatgatttcggttcgaaatggatgctcgacgacgtctcggacgcgaacaaaggccaatctttgttctacagggaattcggccgcacctcggccacctacaacaacaagaccttcagaccgcagttcctcatgctgcccgaggacatcctgccgccgaacagatcggagcaaatacagcgcacgtacgacgtgtgctcgacgaagatgtacgaatgctactacgactacgccatgacgttgaacagggatctcgcccacttcacgcaaaactacaaggcgaccatctacgagctgaaacaaaccacgagggagaaaatcacgtcgtgcggcgtgctggaaacgccgaggttcggcaggaagagcacgttcttgttcgtacccggcaccaaggtgacttacgaatgtatacaggatttcgtgctgatcggtgatcctcgaagagagtgcaaggcagatgggaaatgggacacgccggaatttggatatacttattgtttgcgtcaagaagaatattcttcccgccaagcggcaatagcgtccggtatcgtactcgcgattctcataccactcatactgctattcctttacttaggctataaaatatacaaaaggttgttcggcaacgacgacggctcgtggaagtaccaatcgactgcgcagaaatccggcggcccgcaaacgttccgacgcagcttttctccctaccgggacgaggacgacgacgacatcccgcaaagcccttccgacagcaattcgctgccgaagaagcgcagaagctacgagaaatcgtacaggacgcacgagccgttgaccgatcggccgagcatcgagttcgaggacaaacctttggatcccaatgatcccaattacgacgatatcgataggacttcggcggctccgtcgagccccgcgagtcccacgagtcccacgtctagcgtgcagtacacgactccgtacaacgcgaggcccgatgttttattggggaatagtgatggaaatttggggtatacggagaacgattacgcgatgcccattaaaaggcctaagaataggttcagtcatagtcagagcagtattgttacggatgtttga

SEQ ID NO: 647 - DNA, 387 bp, Phyllotreta nemorum
  misc_feature (267)..(303): n is a, c, g, or t
atgcgttacgtggctgcttacttattggccgttttgggcggaaacgcttccccaagcgctgctgatgttgaaaaaattcttggttctgtaggagttgaagccgaagctgaaaaggtcaaaaaagttttgggcgaactcaatggcaaatccatcgaagagctcatcactaaaggtcgcgagaaattgagttccatgccagtgggtggtgctgctcctgtagctgctgctgctgttgccgctgctcctgctgccgccgaagaaaagaannnnnnnnnnnnnnnnnnnnnnnnnnnnnnnnnnnnncagaagacgacgacatgggctttggtctttttgactaaaagttactttgtaagattcaacatgatttttgtaatatatttctaa

SEQ ID NO: 648 - DNA, 2724 bp, Phyllotreta nemorum
atgatgactgaccgttttggattaaaatgggaccccaaaaatctagaaattagaaccatgtcagtggagaaaactctggagccccttgtgctgcaagtaacaacccttgttaacacgaaggggcccagcaagaagaaaaagggcaagtcaaaacgtgctaatgctctcgtcagcacagtagagaaggccactgagaatttcatcgagaaaggtgagcaaattgcttatgagaatcctgacataacggatgagatgatagctgctgttgaagaagtcaggaagactggcaatgcaatgagcatagctgccagggaattttcagaagatccttgttcttctctgaaaaggggcaacatggtacgtgcagctagaaatctactatctgctgtcacgagacttctcattctcgctgatatggttgacgttcatcttctattacaatctctgcacgtagtcgaagatgatttggagaaactaaaaaatgcttcaagccacggggaacttcttgacaatattaaggccttcggtcacaatgcaaacgaacttatgaatcaggctgctaaaagacaacaggaactaaaagatccacagctacgcgacgatttggctgccgccagagcagtattaaagaaacattccacaatgcttctaacggcttctaaagtttacgttcgccacccggagctagccgcagctaaggctaacagggactacgtgctgaagcaagtttgcgaagctgttaatacgataaacgatgttgctcagggaagaacaccccagcccgcttccggtccctacgatggaccaggggaactcgcagctgctttagatgatttcgatgaccacatggttatggagcctctggcttataacgaggttcatacgagaccgtcgttggaggaacgtctggaaagcatcatcagcggggctgctttaatggctgattcgagttgcactagagatgagagaagagaacgtatcgttgctgaatgtaatgctgtcaggcaggctttgcaggatttgctgtccgaatacatgacgaacatgggcaagaaggataagagcgacaatctaaacagagccattgacaatatgggcaggaagacccgcgacctcagaaggcagctcagaaaggccgttgtcgaccacgtctcagacagcttcttggagaccaacgtgcctcttttggtcctgatcaaagcagctcaaaacggcaacgagaaggaagtggaagagtacgccgtcgtgttcaccgaacattccaataaactggtagaagtggccaacctcgtctgcagcatgtcgaacaacgaagacggcgttaagatggttcgatacgctgccgctcaaatcgacaatctctgtcctgaagtaataaacgccgccaggatcctggcggcgagaaaccgcagtaaagttgctcaagaaaacatggaagctttcaaacaatcatgggagaaccaagtgcgcatcctaaccgaagctgtcgatgatatcacaactatagacgactttttggctgtgtccgaaaaccacatcctagaagacgtcaacaaatgcgtgctagcccttcaagaaggcgatgctgatacgttggaccgcacagccagcggcataaagggccgttcaaacagagtttgcaatgttgtaacagctgaaatggataactacgaaccttgcatttacaccaaacgcgttttggaagcggtgaaagttttgaacgatcaagtgatgcccaagttcacccaaagagtgcaggtggctgtacaggccttgggtaacagcccgcctaaggaagtcgacgaaaacgatttcatcgatgcttccagattggtttacgacggtgtcagggagataagaagagctgtgctcatgaacagagccgatgaagatttggatcctgaagacgtcgagctcgatgagaattacctgattgagaccaggagtaaatcgagtgctcatactggggaacatggcgttgatgagtatcctgatatcagtggaattaccaccgccagggaagctatgggtaagatgccggaagaggacaagcaaaaaatattgcagcaagtggagtttttcaagagcgagaagctcaagttcgatcgcgaagtcgctaaatgggacgacaccggcaacgacatcatcgttttggctaagcacatgtgcatgattatgatggaaatgacagatttcaccaggggaaaaggtcctctgaaaaccaccatggacgtcataaacgcagccaagaaaatttcagaagcaggcactaaattggacaagctcaccaggcagatagccgaacagtgtccggaaagttcaacgaagaaagacttactcgcctatttacagcgtatcgctctctactgccatcagatgaatattacttctaaagtcaaagccgatgttcagaatatcagtggagaattgattgtgtctggtcttgacagtgctacatcattgatacaagcggccaaaaatttgatgaacgctgtcgttctgaccgtgaaagcttcatacgttgcatctaccaagtatcctagacaaggaactgtagcttctccgattgtcgtgtggaagatgaaggctccagagaagaaacctctggtgagaccggagaaacctgaagaagttcgtgccaaagtgcgcaaaggctcacaaaagaaagtgcaaaatcccattcacgctctatccgaatttcaaagccccacagagtctgtgtaa

SEQ ID NO: 649 - DNA, 1254 bp, Phyllotreta nemorum
atgtctttcaatttcggaaatactagtgctccaaaaccagctgctacaggcttcacattaccgtcaaatccggccactaccagcgcaacaggattgcagtttaatttcggaggaggcgacaccaaaaccgaggtaaaaccgtcatctaccttatttcccacagccacaagtgccgctccggcaccagctttcgggatcgccccgaaacctgcgactccttcatctgctgctgctgctgcaccgtcttttaattttggcacgcccacgacccaacagacaacagcgtccgctttcggaactaccacaccagcctcgtttagtactccaaatgcttctactctgcaattcgtaacctctcgaccgcaaacagacgtgtctgggttgtttggatcaactgcaactgcagctgcgacgcctatttcagcttcgactggacttagtttcggaacaacagtttcaacaaccccagtttcagcaactccagctgctacagggacccccctttttggagctgctcctacctcaagcagcactactacaatatccagtgtgcccgctttaggtttatcgactacagtttcttcagctgcttcaacaactccgtctacttcattaagtaacacaacatcagctcctcctcctgcttattcggcatcgacacttccttcaaccggttcgttgactttcagccaactggaagattctattaacaagtggactattgatttggaggagcaagggaagtttttcattaatcaagcgaagcagctgaacgcttgggactcgttacttatttcgaacggggaaaaaattctcaatctgaacggtagcatcgagagagttaagcagcagcaacagcaattggaccaggagctcgatttcgtgttggctcagcagaaggagttggaggagttgataacgccgctggaaaaggagttgttggaaattcctgttacggacatagatcgaaatcaaatgtatcaattttcggaaataattgactcccaactgaagcaaatgtctgatgatctgaaagaaattatcgagcatatcaatgaatctaataaaagcgaagaaatttcgaatcctttgacgcaaattagccgcataatgaatgcccacatgaattcactccagtggttagacagaaatacggcccaaatagtttcccacctcgaacagatcagcaaaatgcaggactccaacagaagaaattttcccctaaatcattcttttaataattcactactttaa

SEQ ID NO: 650 - DNA, 582 bp, Phyllotreta nemorum
atgttcatatgggattggttcacgggagtgctgggctacttaggactatggaagaagtccggaaaactgctctttttaggactggataacgctggtaaaacgaccctattacacatgcttaaagacgacagactggcccagcacttgcccacgttgcacccgacctccgaggaattgtccatcggtaacatgagattcaccacgttcgatttaggagggcattcgcaggccaggagagtgtggaaagactacttccctgccgtagacgctatcgtatttctcattgacgccaacgacagatcgagattcgtagaaagcaagcaggaattagacgctttgttaacggacgaaactctagccaattgccccgtgctaattttaggcaataaaatcgatttgccggacgccgcgtctgaagatgagctgcgaaacgtttactctttgtacggccagacgaccggtaaaggtaaagtcgctcgatcggacctgcccggccggcctctcgagcttttcatgtgttccattttgaagaggcagggatacggggagggttttcgctggttggcgcagtacattgattaa

SEQ ID NO: 651 - DNA, 564 bp, Phyllotreta nemorum
atggatccgattatgggattggaaaaacaaatcgaagcattggaattgcaagctttacaaaacgaagacgaatctcaaatcaaaagcaaaatccacgcaattaccgggctattgttgcaaactagaatgatgataaattcagctctcagttgccgagaagcattaacatcaatgttacaacctttaacgactgttaacgattatttgaatccttcgactagtagcaatgatgtagaagtggaagcaaaaaggcagtatttactcgaatcgtatcccgaattaataggtaccgtacaaacaataggaaccttcgaatcgctcttaccgtttcttggatcgattaatatatctaaagtggtggagttttgcgagattttggaagaattggcttcgaacaacactgaactctacggagaatgtagagatgttataaaggaagttcttggtgcattgcaagattataatgatatatcaaattcaattaaagcattactttcacagtgggattttaccatatctaatcttgagcatgctttgcaacctaaatttcttgatgttccgtga

SEQ ID NO: 652 - DNA, 1752 bp, Phyllotreta nemorum
atgagcaacgctaaattccaagaagtgtacagtgacctaacgctctacaccactccagataaattcttcatcgagccgaaggccggcgaggaattgatggtgatagagcgaaattccgagaatataatatgcttcaaaagcgaccacagacatctgatacctgcagcgaacagccggaaggatttctgcgggttaataggtataatccaactgttagcttgtccctacttagtaatagcagttcaaagagaattggtcggctacatagccggctgcgctatctggcggctcgccaaagctgagctaataccatacaggagctccgctcacttaacacccgaaaaacaagccgacaacgacgtctatttgtccatggtttactccgtactatccactccattcctatacttttcctacgactacgacctaacgcattccttgcaacgcttgcacggcattagccccgatttttggaagcaatccttgttcgagcgggccgaccagaggttcgtctggaacggaaacctattgtattcgttcaagggattctccatacacagattctgcttgcctctaatgcacggattcgtttcgattaacttctgcgtagtgaacgggcacagcctaaactggtcgattgttagtagaaggagcgttcaacgagccggcaccaggttgcaccgaagaggcttggacaaggaagggaacgtggccaatttcgtcgaaaccgagcagatagtcgagtaccaaggcgaccgggcgagtttcgtgcaaatacgaggaagcattccgctgttttggcaacaagatccggacctgaggtacaaaccgccgcctactttgctcgacgtcgacccgcaggatcagcactcgatgtgtctgaagcacatgaacgatttaatgactctctacgggaaggtggtttgcgtgaatctagtagatcaaaaaggagccgaaggaaacatggaagtcgcgtttaaggacgccgttagcaacgtgtcgtctccttcggttaagtacgaatcgttcgatttccacgccgagtgcagcaaaatgagatgggacagactgtcgattctgatcgatcggttggcgcacgatcaggacgagatgagcttctttttgttgctcagagacggctcgttgagttcgctgcaagacggtgtgttcagaacgaactgcatcgattgcttggaccgcacgaacgtggtgcaaagcatgctggcccatcggaatctcgagggcgtgttgaggaaattgcaaatcctccatcagaatcaaacgttggaattccagtattcgttcgaggtgttgtttaagaacgtctgggcggacaatgcggatataataagtacccagtatacgggtaccggtgctttgaagacggacttcacgaggaccggcaagcgtacgcattacggactgcttcaggacggtataaactccgttacgaggtactacaagaataatttcgcggacgggctccggcaggacgccatcgatctgtttttgggccacggtaagcccgtttcgccgttgcacatcgacaaaggttggaagtacgtgacttatccgtcgattctgctgatcgctgtggcgatgttcgtggcctgcgctgtcactccttccgagtattcgacggattccttgctgtttctcttgttctggggttcgatggtctatgcaactttgcacactattttcaagtacggttcggagtttgtcgataaacctaggctcacccaatcttag

SEQ ID NO: 653 - DNA, 1497 bp, Phyllotreta nemorum
atgcctcctacgatccaacagaataaccagaacgccgcgaatggcgtggaaaaaagacaagtaaagactgtcgaaaaaaggtcagatttattatgtaaagtaaaatattgcaacacactgcccgatataccattcgatttgaagttcataacctaccctttcgaatccataagattcatccagtataaccccacgtccttggaacgcaattacaagtacgaagtattaaccgaacacgatttaggagtaagcatagacctaattaacaaagatatatacgccatcggagcgggcgcctccttggatccggccgacgagaaactcctagaagaagacatcctcacgccccaggactccaagcggtcccgtcaccatgccaaatccgtgtcgtggctccgacgaaccgagtacatctccaccgaacagacccgattccagccgcaaaccatggacaaagtcgaagccaaagtgggctacagcatcaagaagtccctcaataacgagaccctttacatggacagagattcccaaatcaaggctatcgaaaaaacgttcgaagacaccaaaacgatcatcgacaagcattacagcaagcccaacgtagtgcctgtggacgtcctgccggtctatccagatttcagcttgtggaaatatccttgtgctcaggttattttcgattccgatccggccccagtgggcaaacaagtaccggctcaaatcgaggagatgtcgcaagccatgatcagaggtgtaatggacgaaagcggcgagcagttcgtagcctacttcctccccacagaggaaactctacaaaagcgcagggaagacgtcgcgaaccaggtccaataccaagacgatgaggaatacgagtacaaaatggccagggagtacaactggaacgttaagagcaaggcgagcaaaggctacgaggagaactacttcttcgtcgttcgatcgagcggtatctattacaacgaattagaaaccagagtcaggttgagcaagcgaaggcagaaagtgggccagcccccgagcaacaccaggctcatcgttaaacacaggcctatggatgctaatgaattcaggatgcaacggtacagggagaagcagctcgaacctacaggcgaggatgatgaagagatggaaatcgacgagccccaagacgaggaaaacgtgctggagccggataacggcaaggaaacggagagcgacaacgaaaagaaacgatccagagcttcctcggtgtcttcccaaagaaggtccagatccaggtcgaattcttcggctaaatcgaattcgagatctagttccaggtccgcgtcgaagtccaggtctcggtcgagatcgaagtcgtcgtcgaggtctcggtccaggacgccgtcgaagtctcctactaggtccaggtcagcttcgaagtcgccttctaggtctagatcgccgtcgagcgccagatccaaatcggcttccagttccggctcgaattcagatagcgagtga

SEQ ID NO: 654 - DNA, 1170 bp, Phyllotreta nemorum
atgccgattgaaaatttggaagatcaaggtttagaaaagaacccagacctagagctagctcactacaagtttctcctgacgctcccagaatatcgcagcgaccgcaatgtccattcgaagatcactgaagccatcaagaaggatgatatggccccatggtatgaactcctttgcaaagaagtaggctggaagttagactctgccttgctgaagaccctcaaagccaagaatgccgaaaaggtcaagcttctggacgaagccatcgaggacgcggagaagaacttgggagagatggaggtgcgggaggcttatttgcgtaaagcggagttttacagcaggatcggcgacaaagaaaacgccgtgagcacctttaggcagacttacgataaaaccgtgtctttgggccaccgcttggacatcattttccacttaattagaataggcttgttctttatggaccacgaccttatcaccagaaatatcgacaaagcaaagaccctcatagaagaaggaggcgattgggacaggagaaaccgattgaaagtctaccaaggtgcttactgtatgtcggtaagagacttcaaaaccgccgctaacctatttttggacaccgtgagcaccttcacgtcctacgagctcatggactacaaggctttcgtcagatacaccgtctacacttccataatcagtctgccgagaaaccagcttagagataaagtaataaaaggctcggagatactggaggtactccactccgagccgttcgttaaagactacctgttttcgttgtacaactgccagtacgcagagttcttctcgaatttggccgaggtcgagacgattctgaggaaagactactttctgaatccgcattaccggtattacgttagggaaatgaagatttcggcttacacgcagctgctggagtcctatcgatctctcacattgcagtacatggccgaagcttttggggttactatcgagtacatcgatgaggagttgtcgactttcatcgcggccggaaggctgcattgtaaaatcgatcgagtcggaggcatcgttgagacaaacaggcctgatttgaaaaacgctcagttcaattccgtcgtgaaacaaggggatttgttgcttaatcgagttcagaaactctccagagttattaatatttag

SEQ ID NO: 655 - DNA, 8325 bp, Phyllotreta nemorum
atggaggaattaacctcgggtttggatcccgacgatttgatggatctggacgagcctgaagggtccgatttggaagacgacgacgaggatctcatcgatgatcacgtctcgtcgcctttcatctcctcctcggcgccggaatccacggccaactccgtcgcctcctctccgatccacgaagacttccctccgcccttcaatttcactggcaaacctctacacgttaaacgcggaagaggaaggcccagaagagaaggaggtaagccttcggcgccgagaacgacaaggggcggtggaactggagtgtcgagagtacgcaggccgagacctccgggtttttcaagaagagggtcattaggaggaagtagaagcgttaggcaagtagagagatcggattacgaaatgtctcttttctccggctcaccggtggacgatggtatgttggatcccgaaacgggttcgatgatctttcccgagaagtttgttcccgcgatcgaggagcctccgtattttccggagcattggccggggaaagcttgtgccttgtgtaatttaggtgaaaggagccagctaggtcaaggtgaaatgctaagattaaattgtcctgaaggattctcgccggaaaaagttattagtgagcaaatattagaaagagccttgcaagctccggataaagagtgcggggataaaagcccgaaaggtcctgtgacttgtagaaggcaaaagagtttcaacaaatgcagacatccttcgataaccagtgaatacgttgatgaattaactataattggatataatgaagtacctgatgtatctagtttgtttgagcctaacggacagttttacgttcaccgtaattgtgcgctgtggtctaacggagtaacgaaagcagaaaattcggcgttgttgaatgtaggacctgtagtatcgcaatgttcttccaaaaaatgttccttctgtaatcattacggagccagcctgacctgccacgttgacaaatgtaccaaaatttatcactttccttgtgctactgctgccggtgcctttcaggacgtttcttcattggcaactttgtgcaacgaccatttaggacaagtggctatgctcactaacgcgtctccatgtttaacttgcgctactatgggagatatagcaaatttgatgttttgttcgggttgcggcgcgcattatcatggaatttgcgtgggattagctcagttgccaggcgttagatccggctggcaatgtaggaaatgccgttgttgccaagtttgtcgagtactaggagacgagtctaagctgatgacttgcgaacaatgcgataaaatttaccatgctagttgtcaaagaccgatagtaacttctataccgaaatacggttggaagtgtaggtgttgtagagtgtgcggcgattgtggcgcaaggaccccaggagctggtttatcttcaagatggcacgctcactacacagtatgcgattcttgctaccaacaaagaaataaaggattttcgtgtcctatatgccataaagcttaccgtgcacacgctcatagagaaatggtccagtgttccagttgcaagaagtttgttcatggaacctgcgatcccgaagcagacgttgtcacctacagtcaaaagaaagaaataagcatggactacgaatacgtttgcttgcattgcaaaaatagcacggccagacaaataaccgcgaaacgagcgagtatcgacgatccttccgacgtatccgcttctcacgattccctgtacgacgatacgtccgaattggaccttccttcgcccgacgagttcgccagaaacatgggtttgggcaaagggaagccgtatagcgcgaataaaatagccaagaagcgccttagtttcacagtaaatccggtcggcaggccgaaaggcaccggaaaggtgcctcccgggaaaatggggtttatgaaacgctaccgacttaccgaattcaacagaaaacggggccccaaggccaaaatgagaggtattttcggagtgcccggcgtgggtctgcaaagaccgatttcagatggaaaaaccgacgaagaaccaggagtcgaaaaccgattagtactgtgttcagctaaagataaatttacgcttacacaagatatatgcgtaatgtgcggggcgttcggaaccgatcaagagggctgtttgatcagctgcgtacaatgcgggcaatgttaccacccctattgcatcaacgtcaaagtaactaaagtgatcctacagaaaggatggagatgcttagactgcacagtctgcgaaggctgcggccaacgtaacgacgagggccgtctgatcctctgcgacgactgcgacgtgtcctttcacatctactgcatggacccgccgctcgactacgtgccgcacggcaactggaagtgcaaatggtgcgccatctgccaatcctgcggcgccaccgaccccggtttcaactgcacgtggatgaacagctcgacgcaatgcggcccgtgcgcttcgcacgtcaactgccccagctgcagcgagccctacggcgagggcgatttgatcatacagtgcgtgcagtgcgaaagatggctgcacggcgcgtgcgatttcatcaaatgcgaagaggacgcggagaagtgcgcagaagaagggtacaattgcattttgtgtagacccagagacgtgccgccgccgcatatggttcctgcggcggtcacgccgaagcctccgaccccgacgaagagccccgagctggggaagagcaccagctactacatggacggcgtgtgtcttagcgaattcggcagtaacttgatcaaatcgctggcgctcgaataccacgggtctaggaagaagcggaaaaagatacccactgtgcaggataaggaagccggtatcatggctactattgaatctgtagttgctggaggaaatattattcctactaacatggaagacagcgctaaattggagctcgtcgacatcaaagacgagcctcaggagttgtacaaagaaggcatgatgtggaccaaagaggacggtcctcctcccgaaggcttcacgataataaccatggagaacgggctgaacgtgctgcgaaggaagaggcaacgcaatctgcagaagctcggcatcggtgggttcgtggtaagaatgagaggtatcagaacgggtcaggataacgatgaagtggattcgaccatcggtcaaagcgggctcaaccccaacgatattgtcccatcacctgcggacggtgataaacctaggaggaaagctattcgtagaaagccgaagagtaaattagctgaaacgtttcctgcttatctgcaagaggctttcttcgggaaagatcttatggatacggtcgattgtaaaaaagaagaagtcgattgttatagcagcgatgatgagaaaactgacaagcattataaatccattaatttgtctcaggacgaaataatagcaatcgtggcatcgggtaagaccgaaaaattggaaaccaataacaaagattcgaccaaagaagtcaaaccgactgtattgaaagaggaagaagaagataatccggaggatttgaaagacgttcttgccctaccgggcgatttgctcgataccgatttggttaatagcattatggaagatgaggaggagcttagcaaaaccacagcgtctcttgtcgctttagattcgaatttaccgcatgatactgagctcaccgacactttgagtagttcgggaaattcgaaagaaaccaaagatgaattgagcgacattctgggccctcatttcaacctcgattccatatcgaacataaacagcaaggacgtcgaagatatatttaagggggtattgacagacgagtctcaagaatcccaagaaagcagcagcttttccttacaaggaaacagtatgttctcgaataataatgctcagcaaaacgttgcccaacaccccattattaaccaaccagtgaggccgaaaactttgcctactgttaaccttaatctgaattccccagtcggttttcctccaccctcaccttatcactcagagtacagcaacagcagtcctcaatttagtcctgcgttcactgaatcgtcctgttcgtgggtaagcggaaacgaaacgcccgaaatcgacagtacgaacgtaacggtgacctctacgtacaatcagaggtcctccgataaaatgaaagccgacgaaagtttgggcaaaagcgccacgatttccgctgtattatatgcgaacatcaatcatcccgaatggaagaaggagtacccgaattggcccgacaggtacaagcaaataataaaaaaatggagaacgttgagtcaagaacagaaggcgccgtttttgcagcacgcaagagataataggagtcaattgaggatgaagaaagcgcaacagtcacagaccgtcaaggaaaccgcctctgccgccacgtcccccaacgcgagcaagcctctccaccaagccggccaagccctagcgacaactctccaggcggtagcgcaacagccggcgggggctcccgcggcccccgcggcgcccgtttcagaggaccaagaaaaaatcgccctccagcaaaaatccgccagggaggccgagcaggaaagacaatggaagcaattgcaggctctcaggcagcagcaaacccaacaaacccagaacatcctgcacgaacagcgcgttcaagccattgcccgcgtacaacgccagatatcgaccgatcccgctcagcaattcataagcgatcagcaaagccccttgcaggtgaacactccccaagaattgagcccctcgactacgccagcccccagtccccggcaatttctcggcatcaaatccccgaccttccccgtgccttcacctattcagcaaaccggcgtcagggccaacacgccctcgcaatcgccccacgatatcgcccaaccgagcacgcccgacggtaacgatcactttatccattcccccaccaatcctaaacctaatttccaacctagattgcccaatgatccgttcgctgcgcaacccgccacgccgagaccccaattcgctatggcccggccacccctacagaatttcggcggtacggttcgcaacgagcaacaggatatcaacataaatcgacagttgagggagctgttgcagcgacagcaggttaagaagctggacgagttgttgcccggcaaagcgccgcctcagaggctttggcacggcaatgatcagcaggagggcggcgacgcttcgatgacgtcgcctgtagcacaaggccccggtgcccaaggcacagacgccaccttccggcaacctctaccgcccggagtggtcaaacctaggctggccatttcgtcggtaaataggcccgtattgaacgctgttagagtcaatcaattggatcccaggattcaaaatttggatccaaggatgaggttgattttacaacatcaacaacaaagactacccacgggtattcaacagcaatttattcgtttcgcttcgaacgtacgaccgactaccgtagaacagtacgagcaattgttgcagcgtcagggtaataatcagaatcaaattcacgctgaggaacagcagcagggcgtcgcgcgaatacccatagcccaggccagcgtcatacaaagacctcacgtcgctcaagctgctgcgactggcgctgctgctgccacaaccagttccacggaaagcaatcccagcgaggagggaatcccggataatgtcacagctgaattggagaaactcgaacaggaaacaggtactatggtggagctacaaggcgtaagcgatatactaggcggattggacgatgacgatgagcttttagcggaaatgggcgctgatttcaacatactcgaatacgctgatcccgaattggaagctttaacaggcgggaaaaccaacattctagacctggagctcgaagaggaaccggtcaaaaaagaaaaactcgcttcaaacgcaaacactagcgctccttctcaaaaaccaacgcctaacgtgaccactacggctattagcaacagcaccgctgttactacaccgaccgaagccaacacggaacccaaaatggacaatacgattcaacagagcattccgaaaacgcagcctcaacagctacaacatcctgcgtcccttccacagcagcagaacatgccccagcacaacgcacaagttcaggtgcaatcccagcaacagtctcagccgcatcctccgcagcaaatgcccattcaaccgacgctgcatatccagcagattcaccagcaaatggtgcaccaagttcaacaagcagctgcgcaaggaagaccaatgcctccgggttcgaagatgcaaaccaccgatgggttcgttggggtggtgatggcgaacaacgccgtgcaattgcagatccccccgaattatcagcaaatggtgcaccaagttcaacaagcagctgcgcaaggaagaccaatgcctccgggttcgaagatgcaaaccaccgatgggttcgttggggtggtgatggcgaacaacgccgtgcaattgcagatccccccgaattatcagcaaagattgcttctgttgcaacaactacaaaatcagaaactgatgcgagtgggaagcactcagcccagggcggccctgcaagtggcgcccaatcaaatgcccgtaggtatgaatccgggcgccaggatgccggtggcggcgccgccgccgcctccgcccccttatcccggcccgccgccgccctatccgggcaacgcgaatcaacatcaacaggaacaaccgctgctgttggaagatctgctcgagcaagagaaacgcgaacaggagaagctgcaaaaccaacctcccaaccacgaagtcacctcttccacaggaaacgaaaccgaatcggccctcttaagcgaccaagacttcgaacgcctcaaagcagacgtgttcaacagcgctcccgtgaataatatatcatctacaaatcaagggaacgccgggcaaacgtcgcaagcttggcctcagttgcaaaaccgtcaagcggcggttccggctaccgcttcgcagcacaccatggaagtgacgacaagagtacaaatgttcaatcccaatttgataccggcgccgccgcttccgccggagaatatcgccaccgagcaggacaagcaggcgcagctcttgtacgagcaatggctgaaccatcagaacaacacgctggtgcagcagttgcgctattacgagaccgaagtgcagaagcttcgtaagagtaaaaagtcgttaaatagtaagcaacgccaattgaagaaagctggtaatcagttgactgacgcggatgcgacggagcttcagagaatcacggccgaacaggctatactacagaagcatctggagtctagtagaaagcaaaatcgccagcacgggatgttgatacaggaatatagaaacaagcatcccgccatcaagcagagaacaggaacggatcagatccaatcgcctttgggccacccggcttcttcgccaatacaacaatcaagcgcctcgttatcgcccatgttatcaccgtctgtctcgccgatgacccaaaacagctcgcctttgaacagtccggggcctatggtaccttcttcacccggccacggtcccgttcagaacatcctacagagccctaacaatgccaatacagctcaaatgtctcccatgcaatcttcgccccgaataggaacccctcattctcaaagtgatgagagtcccgggtcggcgcaatcgccttctcaagtctgcctgccgccgcccatgcctcgaatgacgtcgcctcaacacaggcgagtcgtgaccagcccggtgggaatgtcgcaaatgcgtttcatcaacaacaacatgttgcagcaacgcgttcgcatgcaatcgcccatacagaatttccaacagaaacccggcacgccgtcgccgttgaacagcccgacgtcccaacagatgagcgtcaaccaacagcatcaaatccagaagcagctccagcaacagcagcagcaacagacgttgttgcagcaaaatttggaaggagatccgaacgctatacactcgcagagaactactcaattgctgcagcaccggaacttcatcagacagcaggtgtctcagcagcaaatatcgccgcaaacgttgacaccgcaacagcaccagttgatgctgcagcagcagaagcagctggcccagcagcaacagcagcagatcgcccaaatgaacgccgccagattgcaacaacaacagcagcaacaacaacaaaataatcctccgcattctccgatgcctcctaagagccccatgatcaaccagcagata

SEQ ID NO: 656 - DNA, 4524 bp, Phyllotreta nemorum
atgggagattctcctcaggaaggaaggagtagcaggaggagtaagacgttcaaagctaaggcttcggagaagtttaagcagttcaagaagggcgtgaaaaataagtatgagatcggtgaagtggagaacgtgtacgaagtcgtggaggagaaacagtatattaaagaagttatgtcgagatatgatgatgattggatagttggtgactccagtgggtatattgaggatggtagagatatatttgatgatgacttggacgtggagtctgtagcccaagcttcaagtaaaggcaaaggtttgaagagaaaacataaaaatgtatcggaaaatgctggcaagggaaaattgcagcaaatgttttccaccatgccaactaaacagaaaacggcagcaaaagtcgatgacgacgaaatgctctcagaaatcttgggtgaaatcgattccgacacaccaaatacctctaccgttgagaaaccgaaaatatcccagtactcttcactagccattaacttatcggccaaggattacatgaaaaatttggcacagcctgttaaaaaacgcgcaatcgaaaaaagtaccaaagtaccaaaatttctgcccagtgtatccaaaccgattgaaaaagtaccaattaaaccagtaccaattaaaccagtaccagataaaaccgtaccagttgaaattcaaaacaccgcaaaggaacaggtcaatcctgatgaaaatgtcgaaaaagaaataataaatccagctaaaaatgttgaagaggaaaagacagatccagatacatcacacttacaatttgatgatgatttggatgaaactttactagaagaatttagcgaagatctaaatgaaaccgccactacatcccaaacaacagaatctgaaatgaacggggacgatttcacaggggaaatggatacaacactaatagacgaaattgaggaacgaattaatgttgctggtgaacaactgattaacgacattcaagcggaagtcgagacggaatggcagtactttaatgcagcaaacggtatggagtccttcaaattagcatccgaaagttttgaaagttcccaaggtcccgattctcccgctgaaactatggatgatattccattagaaaaagtcgaagggaaaaacgtgtttaggttcttttggtgggatgcttacgtggatccccagcatcagcaaggaactgtgttcctgttcggtaaaacatactgcgaagcttccaagaaatacgaaagttgctgtgtagctgtaaagaacatagaaaggacactgtttgttttgcctagacctttcgaactggatgagaacaagaagcccacagataaaccggtgacatttaagtcggttcacgacgaattcaacaatcagattttaaagcgaatgggcattgtctctttcaaatccagactgatcacgaagaaatacgcgttcgatccgagcgtaccagccgaatccgaatacttggaagtcagatattcggcatcatttccacggatattttccaacgaagatgtcaaccaaaaagtgtccgatggagatattgataccgatgatctcggctacagcacattttcaaaaatattcggcataaaaacgagtttcctggaatcgctcttcctcgaacgcaagatcaaaggcccctgttggatcgacatatccgatcccgaacccgccgctaaccctatgagtttctgcaaattcgaagtgaattgcctcaagcccaccaacttgaaagtcgcctcgttcgagaaaccgcttcctccgccgccgttagtagtcgccactataaacatgaggaatttcatcaatcacggatcgtccgctcaagaaatcgtcatgctctcgtgcttggtgcaaaaccagtacgctgtgaacaaaccgcctccggaacccgcctttcaaaaccatttttgcgtatttagctgcccgcgaggagaagtcttacctctaaatttgttcgatgccctgcaaaactacaaaataacgaaagtgctgaaaaccgacaacgaaaaggccatgctgaattgcttcgtcaacaacatcgtacaaatcgacccggatctaatagtcggccacaatttgcaaggattccaaaccgccatattggccgatagattgctgaaatcgaactgccgcttatacaacagactgagcaggctcaagaagcgatcaacgctatccagacagctggagagaaatctgtttttgggccgactagtgtgcgacataaaaatatccgcgaaggagctgatcaaatccagatcgtacgatctgggcacgctctgccaggtcgtgttgaagttgaaggagaaccaacgggtggacctggagcccgaggacgtgatgaaaatgttcaaaacgtcgcaggatttgatcaagctgatttcttttactatgcaggacaccggctacattttgaaaatgatgtacaatctgaacatcataccgctggctttgcaaatcacgaacatagccggtaacgtcatgtccaggacgttgatggggggaaggtccgaaaggaacgagttcctgctgctgcacgctttccacgagaaagggtatattcctcctgataaggtttataggaaaaatgaagacccagagtccaaagggagttctaagaagaaacccacgtactcaggaggtttggtattggagccgaaagtaggcttctacgacaagctaatactcctgatggatttcaattctttataccccagcataatccaggaatacaacatttgcttcaccacgctcccagtaatggattcagacgaaaatttggtacttccagacagcaatttaccgcccggaatactgccaacagaaatcaggaagttagtcgaaagccgtcggcaagtgaaatccctgatgaaaaatccggacatctcgaaagatttgaaattgcaatacgacattcgccagatggcgctgaaactgaccgccaactcgatgtacggttgcttgggcttcggccattccagattctacgcgagaaatctagccgccctggtcacccaaaagggacgggagattctcgtgaacaccaaggatttgatcgaaaagatgtgtttggacgtcgtgtatggggacactgacagtcttatgatcaacaccaacattttagaatacgatcaagtgttcaaagtgggcgttaagatcaagcaagaagtcaacaaattgtacaagcaagtcgagctcgacatcgacggagttttcaagtacctgttgctgttgaaaaagaagaaatacgccgctgtaacgctcactaaaagcccttcgggcgaactgatagccaccaaagagtacaaaggattagatatagtgcgcagggattggtcgcaattatcttcagaaaccggaaaactggtcctggaacatctactgagcgacgagtcttcagacgaaaaggtacaaaacatctacgaccacttggccaaaatcaaatcggatttgatcgaggggaaagtaccggtacccctgttggtgatcaccaagcagctgaacaagtccccgcacatgtacaccgacaagaactccatgccgcacgtccaggtggcgctgcgctacaaccagaagagccgggaccacttcagaatgggcgacacggtgccctacgtgatctgcctcgacggcaccgagaacggccccacgcagcgcgcctatcacctcgacgagttgaagaacaacccgaacctgaaggtcgattacgactattatttggagcagcagatttatccggtgataacgaggatatgcgagcccatcgagggtttggactcttaccagttggcggagtgtttgggcgtgaacatgaaacgggtgaggaagcctaagattccagggagcaacgagaacattcagggagagaacgtggttgacgcagaagtaaaattcaagaacgctgagaaatttacgttcgtttgttacatttgtaaacacgaaaatgtcgttagcgagccattaatcaaaaatgtacctttcctggaggtgtgtcagaaccccgaatgccaatcgaagcccatcgactacctaccgagcgtccagaatcaactctaccgaaccatccgttctcacataaccaaatattacagaaaaattctgacgtgcgaagaccccagttgcccgaacgctccgagacgattaccgctgaacttcctgaagaaacgtcccatatgcggcttgtgcggcaacgctgtaatgtataaagtttacaccgaattccacttgtacaaccaactggcctactaccggtacatgttcgatttgagcaaacttaaaaataagcctgcgatggatggggaaaccgaatcggggtatcaggcgcttcaagatattgtggataaattcatgaatcaatctgaatactcgctcattaatttgggtgacgttttcagtcaactcggttggcccgttccaagtcaggcaaatcgaaagattgaattggaagagtcgaaaactggtatcctgtttaacgaagaaggtaatggagatgcctatgatgaatga

SEQ ID NO: 657 - DNA, 1398 bp, Phyllotreta nemorum
atggcggctgctgcagcggcaaaaattgccgaagtacgcgagacaacacgcgtagaaagaataggggcccattctcatattagaggcctaggattagacgacagtcttgaagctagacatgtctctcaaggtatggttgggcaagtctcagctagaagagcagttggtatagttttgcaaatggttcgcgacggtagaattgcaggaagagctgttttgttagctggacagcctggtactgggaagactgcgattgcaactgctttagctcatgctttagggcaagatacaccattcaccagcatggctggatcagagatatattcgttggagatgagtaaaaccgaggcattgactcaagccattagaaagagcatcggagtaagaataaaggaggagagcgaaattatcgaaggagaagttgtcgatctgagcattgaacgtccagccacaggagttggtactaaagtgggtaaactaattcttaaaactaccgatatggaaactgtatatgatttgggcggtaaaatgattgatagtattcttaaagaaaaagttcaatctggtgatgttataaccattgacaaagctacaggaaagattacgagattgggtagatcttttgctagagctagagattatgatgccaccggtcaacaaacaaggttcgttcaatgcccggaaggtgaattgcaaaaacgaaaagaagttgtccacacggtgactttgcatgaaattgatgtaattaacagtcgtacccacggattcttggcactcttttctggtgatacgggagaaattaaatcagaagtaagagagcagattaatggcaaagtagctgaatggcgcgaagaaggcaaggctgaaattataccaggcgtactctttattgatgaggttcacatgttggatatagaatgcttctcctttttaaacagagccttagaaaacgaaatgtctccaatcgtcataatggccaccaacagaggaatcacgaaaattcgaggcacaacttacaaatctccgcacggcataccattggacttgctggatcgaacaattattgttcctactcagccgtatgacgaaaaggaactgaaagaaatattgaatatccgatgcgaagaagaggactgtcagatgtctgataatgctttggtggttttaacgagaatctgtaaggagacgtctttgcgttacggcatgcagctcattatgacatcgagtttaatcgctagaaagcgtaaagcccacgaagtcgatgtagaggacattaaaagagcctatcaattattctttgatgaaggtcgctctgtgcaatttctcaaggaataccaacaagaatttatgtttaacgaaattgatgagaaagatgatatggaaattgaaacggtttaa

SEQ ID NO: 658 - DNA, 1170 bp, Phyllotreta nemorum
atggcgttaagaacttacggagataaaccgatcagtttccagttggaggaaaatggagaatactactgtgttggatctgaagtaatttttatcggcatcttctggatatgcttgatgatacgttcgaatttacaggtgggaaattatcttcgactcttcagaggatctctgtacaaaaagtaccctggaatgttcaggaggtctatcactaatgaagaaagaaggaggttgattgaactcggtttgagccagcacgttctagcgagcagcgtatcactgcttagagcagaagaagttgaagatataattgaaggaaatgatgaaaagtataaagctgtatctgtacacacttcggagcctcctatgccaagagaggggaaatccaagaaaaacatgcagtgggtaccttcgttacccaactccagtcatttagatgcagttccacaagctacacccattaataggaacagagtagctgctaaaaaggtgaggacatttccactatgttttgatgacaccgatccccaaataaacatagaaaacgcttgtcaacaagaattgctggttcctattagactagatatggaaatcgaaggccagaagctcagagatacgtttacttggaataaaaatgagagtttaataacgcctgaacaatttgctgaagtcctttgcgacgatcttgatttaaatcctttaacatttgtgccagcaattgctcaagcaataagacaacagctcgatgcgtttccgactgaacctcccagtattatagaggaaacctgcgatcaaagagtcattattaagttaaatattcacgtgggaaatacttctttagtcgatcaagttgaatgggatatgagtgaaaaacagaataatcccgaagaatttgcgttgaaactttgcgctgaattgggtcttggcggtgaatttgtcactgcgattgcttattctattagaggtcagctctcttggcaccagaggacttatgctttcagtgaagcaccccttcctactgtagaagtaccattcagaaatcctagtgaatctgatcaatgggctccgttcttggaaaccctgactgatgcagaaatggagaagaaaattcgcgaccaggacagaaatactcgtagaattagaagattggctaacactacgccgggttggtag

SEQ ID NO: 659 - DNA, 489 bp, Phyllotreta nemorum
ccggaagtgtacgtgcccaccgtattcgaaaattatgtggccgacatcgaggtggacggcaagcaagtggaactcgccttatgggatacggcgggccaggaggactacgaccgcctgcggcccctttcctacccggacacggacgtgattttaatgtgtttctcgatcgactcgcccgactccctagaaaacatcccggaaaagtggacgccggaggtgaaacatttttgtccgaacgtgccgattaccctggtaggcaagaagaaggatctgcgtaacgatcccactaccattaacgaactgaaaaaaatgaagcaggagcctgtcaagccgcaagacggtcggtcgatggccgaaaagataaacgccttcgcctacttggaatgttcggccaaaagcaaggagggcgtcagagaagtgtttgagaacgccacccgggccgcgctgcaggtcaaaaagaagaagaagcatcgttgcgtaatgttttga

SEQ ID NO: 660 - DNA, 4017 bp, Phyllotreta nemorum
atgaatacaaccactttcaatccaagaatggatgccgctcaaaacccggtgcaaaaaatggaattggcgtccaggaacgtggaaaattccttgttaatcgacaacaacgctccgagattgatcgattttatgaatatcagtccacaaagcggttccactgcaagcggtttcgctgaccatgattatccaactttgagtggattatcgcatattatcaacagtatgacccaaatcaagtgtgtaagcaatgttcctataccttcggaaattgtcgaccactttgcccgtgtgcaatgccattgcatgatgggtttgttttccgaaataaacagggcttggttaactgtcgatagtgatatttacgtatggacttacgaggaaaacaccgacttggcttatttcgatggtataagtgaaacgattgtttgcgtgggactagtgaaacccaaagcaggagttttccacgcctttataaaatacctcctaattttagcgacatccgtggatattgtcgtattaggagttactttcactgaacgacccggtgacaatgctgatgaaattcaactaatacctgatcctgttttcatattacctaccgatggttctactgtcacgataatcaccagtactgatgatggtaggattttttatggtacaaaagaaggaaatttgttcgaaattgcttatcaagctgaaagtggttggttcggcaagagatgcaaaaaaatcaatttatcgaccagcactttgtcgttcctggtcccttcctttattaacgcggcattgagtgaagaggatggaatatcgcaaatttcaattgacgatagcagacacattctctacattctaacggaaaaaggatccatagaagtttgcgacctgggagaaaaggggaactcgttttccagaattagcaaaatgtctcaaaacacgttggttaaccaagcaatgaatactgtcaaaactctcgacagtcaaaattttcgaccaatcgtgagcatatccgccatcgaagcctcagaatcggtcaatttaaatttagtggccgtttctcaaacgggtgtaagattttacatgtctgtaactagtttatcgaaccaaaatcccaatcaaagaccgtacaccctaaccctagctcacgtaaggcttccaccgggttattcagccaacattactgtaagaccaagggcggtacatgtctcccagtacagagacagaaacttggtattaatatcaactgttaacgaaaaagatgtgttgtggtgtatgagctcagacttgtttccattcggccaaggactgacagaagcttacacagctattaatttagatggaccggccttagctatctctgaggtgagaaacgctagtcctcttcaaataaaggatttacacgaagcgcctcctttagtggtcaggcaacacgccgaacctccgaaaaagtacattgtccttacttcgcacagcattcagattttcatcaagttaagaccagtggacgtattgaaacaaattttgaaagacagccatgggcaagatacggaggcattgaaagccttcttcactattcaaaaagaggatcaagcgtgcgctaccgctttgattctagcttcactggaaaacgaagataacatggacatagccgagtttgcaaccagagctttcttcttgttcggaggcgagccgaaattggcggctccaatgaatactttttctggaccgtccgtattctgcccgcccgtcatgtctactccaaatatacaccaatatcatcaacaacagcagcaatatcaaacttcaccacaataccagcataactttccgcatggcatctcgcccgcagcgaacgcatacgaattgaccagtccgttcgttttttctcccaagcacaacggcctctatttatatttaagtagaatattaagacctatatggaaccgaagaacagtcgataagctttgtttggatggaaaaattgttactaatcacagtactgtgaccagcgaagactgcatattcatattgaactacgtaacgtccctacataatttcctgatgcgtaatactcagctttcaactttgagcgccgcgcccggtcagaatcctcaaaccctcaataatactacgatgaatatgactagattgaaccataccattcaagacgttcaactagaggaaagggcatctctggatgctttgaaaacatttgtgtgccactgttgtcaaatattaggtctgtggagaattctttgcgaacatcaattccacacgttaatagcttccttgcctgaaactgagcagcagattttgcaaaataccacctttaaggatctacttttacacagacatgatatctgtacgttgttgattgcgacattagtggacagttatttaggtgataacgcctcagtggattcgattagcagcaaattgagagaagtgtgtccgctgttttataaaactgaagatgcagcattttcaaaggctgtcgagatattaaagatgacacggacaattcaaaacaacgatgagaaggaagagatgatccaatcggctctgcagatttgcaaatcaatcggccccactatcaacataaccgatatatgcaaggaattcgctaatcttaaagcgtacaaagccgttacggaattgtgcgcgcatttcggcaagaaaattgatccggataaaatagcagaaagctactataacgccgaagacaacagcggtgaccaagaagggtacaattattatcaaagaaggttggaaatttatcgtcatattttgaatatgttggatcagttatacaacgaacaaaatcaaacacaagtcgttagtagagatcctgcatactcagttaatcagaccatattactggatggtgtcgaacagtcccaagtaggatacgtgatgaagcaagtaataaaagacgttatggaaacgcccgatgaaattatgcacttcgccctttacgattggctggtgttcaagaacatgactggagatttgataaacatccaaaatccgtctttggaaacgtatttgaagcgaacatccacccagaatcccaacaacatcgaggccatgaatttgttatggaaatactacgaaagttgtaacaatcacgcagcagctgccaaaattttgaacaacctcgcctcgagaaccggcataaacgttccattgaaagagaggctgtcttacttagcgagagctatcatgtgcatgcgaagcgataaaataggttacgcgccctaccttggtgtgttcctgagagatcttgaagacaaaatggaggtagcgaaggtgcaagaacaaattttggacgccattgtaaatctgcaaggacaaatacctaacgctcaggaagtaataagcgcgctaaattctggcttgtacgaaatttcgcagttgtatgaaaatttcgctgaaccattcaaactattagaatgccaattggcaatcattgagtgcgccggatacactgaccaagttttgatcgagtccatttggcagcaaattttgactgaagaactcaggaaaacctatgggacaggtacagataaagtctgtcagcttttgaacaaagtgaagcagttgtccaagcaatatgctcaatctgcaaattgctttcccttgagttacattgtttatgaattggagatagtgaacgcaaaacttagaggagacaagcaactcgttccctgtgccttggaaagtatgaatattccattcgaaaatttaatcaacgtttacaatagtttgaatacgatttctataaatgatcacttttggcaattagaggaaaacgaatttcatctttctgaagctacagctgcgttaataaattgtttcctgagccatcttgaacagtacagcagcgttgaaaagcggaaaataacttcgctctgccaagatgcagtggttgctttactatccaacttgtatagcaagcccaacactgacgtgctagttaataagttaagaaatatacaagccaagttgtcgagaatttag

SEQ ID NO: 661 - DNA, 4140 bp, Phyllotreta nemorum
atgagcgagttcactttgagctacagagaagtcactccggaacaaatagatttcgaaaactggaaagaaataaccctcactacaggagggacgcaaagcaccctgcaagatataaaagtagccgagaaagccaatggatactgttacaaagactccgctaaacactgcacgaggaatagatttatctactggagaattaatcacaacgttttggaattggtggagcacagtttggatataaatcttacaggaaatcggatcagatacaagttcgatactccgattttggatggtgtttcgatacatgaagtactcgataatgttgttattttggtacctacagtatgtagtgtacacaggctgatattcccccatccaaatgtgtttcacgctcaggacgatttactgggcatatacccggatttaacagctttatccatattttcgaaagcatcgatcgttgataccagaaacccgaacagcttttacgttttcaacaatcccagcactgccaacgatcaattaccgaatttggccaactcgtactttgtacccgaaacaggagaagcctacttcattttggcgtttccttcgaccgaactcttgctaatcaagcaaagccctgatcaagtgacctgtgcggaactcaaaggggagtctttagttcccagatttttcgctggaatagccgacaagttcaggcataagaattcggatagcgaaaatatagtgagcttgttattctacgatttggatgaagaaacttacgtgttgtcactaacccaagatgctcatttgaaattttggtcctgcagtaaagctcaatgtgtagcagtaatagatgttcgtgagaaaataacgaacttgaaatatagagttcagtcggcgattttaaagaaagccgaagatggaaacagttccgaaaacattctggttctattcctgagtttcggaaataaatgccagtttcatgtattgaaaccttcagttagagaccaagaaatctctctgcatagattagccactctcgaatcgcctctgaacgatttgatagacttcgccgcacaagtagactgcttgtggtcggtatggcggtcggacgtgggcgaaacggtggtgtacatggcttcgttcaaatccaaccgatggactcaagtaatactcgaatccgaaccgaccgataaatttttccctgtaaaatgcaacgacgtcaagacgctttacctacagcacattttccatccaggcagattccctctgcacgtcattaacaaaactctttcgatttataaaatgcctacgattgggtcagacagccacatgtccatttcagcgctgaagcaaagagtttgtatggccgtggaaaatgacatacaaaacctgttcaataaagacggtactgatattaacagcgttgaagttgatgagtatgtagagtgtgctgaatggtgttggcaaaagttcgactcctgctgcgttcagtaccagatagccagcaggaaaccgctgggtttgatgcttctaccgtccgtatcgggagctatgttgctgaagaaatcggctttttcgttcctgcgacccgtagattcgttggaacacatgactttgtctactgatttgtacagggagcagttctttaatttttccatgttatccgatgatttggataccgtagaagacgtgataaacgtgttcaaagtgatcgtttacatcgaacaacagttaaaggatgatttcatgcaatcgttcgaaactgaacttctcaatctccaatcgcccgatgtggtcatagaagatctgctgaagaagatttacgtagaaatggattcagattttttttcgcacattttgcacctgatcaaagacgtcaatgacttgtacaaagccattcacaaaatcctggagctgttgagatacgaaaacaccttgtccaatcccgataacgacatcaatccagccgctatgtactatttcaattctcttctaggcacctccttggtggcccaaagcttccgacaacaagctgaaatcagatttcaaatttgtcgtaatttgttgctcctgtgtaacttcttggtgatggacaggactttgaatgggggcgttttagaaggagtccgatcggtctgtatgccggacattgtcgttttaacccaagccagttacgtcgtgctgtggctgagcggcctgacgatgttcgaaagcgattcggttcgggattcttccatgagcactctaaatccgttgaaattgactcccgtttacaatttgttgccgttcactcgttgcacgtcgttattggaagtgtttatatcttcttcgggcgttcaggacgccaggaaatcgttcgctagagtttcctgcaaggacgaggccttggctcgttggcattggtcgctgttgccatacgtgaaccacatcaggcatctcatttggcccataagcggttgtacggtgttcgaggaatggctcctgtcgagcggccagcacgtgtggctgcagcagtacgtaaggctgctgagcaattggtgcgaatggaacgtttgtacacgaaatttcttattggcctcgtcgtttctgactaccggtgaattttacaaggccgaagagctgttcgagaccgcttcgaaaggcgtttttaccgatacatttttacaaaacagaatcaaaagtgtcgacgaaaataattttagaaccaccattcattattatttaaaggtgatccagttattcgagctatgtaacgccagaagtcatgtgatcaatgtggccaatacggccctgtgcgtagtcaaacgggacgatccattagccgctacgttgttttcgatcaaattcaagcaccatttggctctgaagcactaccagctggccttcgactcgctgaattcgaacccggacggcgaacggaggaaggacaatctcagggatttggtgaagacgttgctggacgagaaaaagctgaatgtgttgttgaattttacgtacggaagcatggatgaattcttcgctaacatcgttttgaccagagccagagcggcagacgttatgaataacgtattttacgattttctgtattcgtaccaaatcaagaaaggcccgccatctttcagattagccgcttcggccatgtacgaacaagcgtttcgattgagccaaaaaaccaccatcgaagccttggaaaagcaagtgaaatgctacttggcggccaaaaacgttctccatttgtgccccgcccaacacgcttgggtcgtcaggcctgctgatccggacgaagaagacgaacaagtcatttttcaacccctagccggctcaaacggggaaatccgtacgttcaaaatcaagaaacaaatcgaagtggtggacatcgaaaccataggaaaagaattgacgttcgccagcgccaaattgaaattgctgcaattcaacccgtcggtttcgataaacgtttgcgatccgttggagttggtgatatcgctgaacaactcgggcatgttcaaaacggccttcgagatttgctcgacgttcgatttgccctattcgctggtgttcgaggcgcttacgaaacgttgcgttttgctcaccgaagccgaggatcccaacgcttggaattggctggtcgagaacgatctgcaagatttgccggttaatagagagtccgctgcggatgtggtttggaaattcctgcaggattgtttggagaagtacgaagagcctaacatgtcttgtttgcataacgtggtttgcaagaaaattatcaacatgcaaatttacctgcctcattggttgaaagcttcttataaggctcgaaatccttcggagctgttgaggttgctgcacgcctccgggcgtttggaagaagccttcgaattggccaaagactacattttgtcagcgatgggatacggtaaagaagaattcggtttctcacagcctttggcgcctacttcgccggctttctgtcttcccgtctacgccatacagcggcttgtagacgaattggatatacaaaattctatgaatatagaaaagccttatgttcacgagcacgatgatttgaaggtgttgttttccaagtatctcgaaactgccataagagtttccaatcaaatgtgccaggttaagggtaaagttatttaa

SEQ ID NO: 662 - DNA, 2247 bp, Phyllotreta nemorum
atggaagtctccgacaagaatttagaaactttgagcagatatttgcaggaaacgctcaatccggacccgaacgtgcgtagaccagcggaaaaattcctggaaggagtcgaagtgaaccaaaactacccgctgctgctgctcaacctggtgcacaagcccgaagtggacatgacgatcagggtggccggctcggtggcgttcaaaaattacataaaaagaaactgggtggtggaggaggatcagaccgatcgtatccacgaatccgatcgactggccatcaagaatctcatagtgactttgatgctgagctcgcccgagtccattcaaaagcagctcagcgacgccatcagcataatagggaaaaccgactttcctttgaaatggccggaactcatcacggaaatggttgaaaaattttctacgggcgattttaacgttattaatggcgtgttgagaacggcccattcgctgttcaagaagtaccggtacgagttcaagtcgaacgagttgtggactgaaatcaaatacgtgctcgagaagttggccaaacctcttacagatcttttagtcgccacaataaacttgtctgtaacccattcgaacgatgtagccgctctgaaaataatctacagttcgctagtgctcatctgcaaagtgttctactcgctgaatttccaagatttgccggaattcttcgaagataacatccaagtctggatgaccaacttccacacgctgctgtccgtcgatgtcaaagcactacaaagccaagaagacagcgaagccggcgtattggaacagctaaaatcccaagtgtgcgataacgtggccttgtacgcccaaaagtacgacgaagagttccagccttacttaccccaattcgttacggacgtttggagtctgctagtcgctacgaatttacaacccaaatatgatttgctggtctcgaacgccctgcagttcctttcgtcagtcgccgaacgttcgcagtacaggaacctcttcgaggacgataacgtgctgagcagcatatgcgagaaggtcatcatacccaacatggagttcagaacttccgatgaagaattgttcgaagacaacccggaagagtacacgagaagggacatcgaaggctccgatatcgacacgcgccgacgggccgcctgcgatttggtcaacaccctcagccagaacttcgagcagaggatcgtggaaatattcgggagatatctacaagtgatgctggcgaagtacgcggagaatccgaaggagtattggcgcagcaaagacgcggccttgtacttggtaacgtcgctggtcagcaggggatccactcaaaagcacggcgtcacgcagaccagccagttagtggacattacgcagttctgtcagcagcatattttgcctgaattggaacgacccgacgttaacgatttaccggtattgaaagccgacgctatcaagtacgtaatgacgttcagatcggtacttcccagcgatctagtcgtatcgactttacctcaactaatcaggcacatgccgagcgaaagctgtgtggtccacacgtacgctgcctgcacgttagaaaagatcctcatgttgaaattcaacaatcagcccattgtgaccggagccgagctggagcctttggcctcggaattgttgaccaatttgttcgccgtgctccagaagccggtctccgaggagaacgagtacataatgaaggcgctgatgaggacgttcgctaccctacaggacaggatcataccgtatttgaacgtggccttacccaaaatgaccgaaaagctgcaaatggtcgccaagaatccatccaaaccgctcttcaatcattatctgttcgagtgcttttcgttggccataaagatcgtttgcaaggtgaatcccacagcggttacttcgttcgaagacattttgtttcccatatttcaaggaattttgcaacaagatatacaagagtttattccatacgtgttccaaattttgtctttattgatggaaaataccccacaaggctcgttatccgatccctacatgcaactgctgccttgcctgttggctccggtgctgtgggaacgtccggccaacatcagcccgttggtgaactattggcggctttcgctactcaagctgcccctcagatcgtgctgcaggataaagtgggcggtttcttgggggtgttccagaagctgttggcttcgaaatcgaacgaccacgaaggttttcggctga

SEQ ID NO: 663 - DNA, 600 bp, Phyllotreta nemorum
atggcaaaagtacaattatgcaatatcacagttatggacaatccgagtcctttcctaaacccatttcaatttgaaatcacgttcgaatgcatagaggaattaaaagaagatttagaatggaagatgatttacgtaggttcagctgaaactgaagaacacgatcaagtcttagactctgtgttcgtaggacctattccagaaggtaaacacatgttcgtctttcaggcagatcctccgaacgtctcccgtatacctgaaaatgatgccattggtgtaacagttgttctgctaacttgctcttacaggagccaagaattcattcgcgtaggctattttataaataacgaatacagcgatccggaaatgagggaaaacttgcctagtccaccccagttcgataaggttataagaaatatattggcgtccgagccgagggtgacgaggttcaaaatcaactgggaggaatctagcggtactcaggaaaacggaactacagttgccgaagcacccgctaaccaaacagccgaaacttccgcttcggtggaagtacctgctttcaacgagaattcaaattcgtgggccaccatggagtgttcataa

SEQ ID NO: 664 - DNA, 957 bp, Phyllotreta nemorum
atggatcaaatgctaccgagccctggtttcagtatacctagcataggtacacctcttcatcaacccgaggaagaccagcttatattaccaaacgccatacaacaacaacaacagcagcaacaacaacaaagtctacctactactaactcacaagtgcctcctctagctccaatgggaggttctactccaacacttggtctaggtttaggccatgctatgtccatgccacatacgaagtatgtaactggatattcactgcccatcagttctatggctcctcaaacaccccaacatacaatgatgagccctatggtgaatgtaggaggaactggtaccactagttctggtgtaacgcctacgttaggtccctctacaccttcaccaatgactcctatgacaccgcattcagcagatcctggaattgttccacaattacaaaacatcgtctcgactgtaaatttgagctgtaaattagacttgaagaaaattgccttgcacgcgagaaatgccgaatataatcctaaacgttttgccgcagtgattatgaggatacgagagccgaggacgacagctttgatattttcgtcgggtaaaatggtgtgtacgggtgcgaaaagtgaagaagactcgagactagctgcgagaaagtacgctcgaattatacaaaaattgggattccctgcgaaatttctggatttcaaaatacagaacatggtgggcagttgtgatgttaaatttccaatacgattggaaggattggttctaactcacagttcgttcagcagttacgagcccgaattgtttcctggtcttatatatcgtatggtgaaaccaagaattgttctgttaatatttgtgtccggtaaggttgttctgactggtgctaaagtcagacaggaaatttacgaagcatttgataatatttatccaattttaaagagttttaagaaacaatga

SEQ ID NO: 665 - DNA, 654 bp, Phyllotreta nemorum
atgatgattgattattcttcttttaatcgttatccgtttctaacttctcactcctctgctgttgctgtcatactcatctgtcatatttataattttttgacagttttggggttattgaagatttttgaagaatcttttatattttatctaccaaagtcccctttcaaagctcacaaaatggctgcaattcgttccatgtctcgcctgttattctccagatcattacaaactactgtaaaaaggggctacgccgatcaaatgagcttcacctttgctgctggaaaccaggtcttctatgacgcaaaatctgtaaaacaagtagacgttccttctttctccggtagcttcggtatactgccagcccatgttcccacccttgctgttctaaaacctggagtagttactgtttacgaagacggcggttcagtccaaaaaattttcgtatccagtggtactgtcactgttaatgacgattcatcagttcaaatcttagctgaagaggcccacccagtagaaaacttagatgtcagtgcggcccgagatcttctccacaaagcacaaggtcaattgtcatcggccactactgatcaggtcagagctgaagctgccattgccattgaagtgggagaagcacttgtaaaagctgctgaatag

SEQ ID NO: 666 - DNA, 972 bp, Phyllotreta nemorum
atgagcggcgatggcagccaaaacgagcatttcgacacgttatttctatcaatcgcccagcatcatccgcatggtcccacgcaactcctggatacttttgtgaacttcctgagcagaaaaacggactttttcacgggcggaaaggaaggagaatgggaaaagctagtgttgaacacattcaagaaatacgagaagtccagcagggagcagcacgcggccgaattgaaggagaaactcgagcaggaagcgcgcaggaaggcgaaaaaagaggccgaatcggccaaacaggctcaaataaccgaattgacggaagaacaagctgagaaattacaagccgagctcgacgctaaaaagtcccctgcttcggcagcaccttcgaatagctccgatactccttcgacttctactgcgaagattgaggaagacgaggacgagtccgagaagggtaaattattgccgaacagagggaacggctgcgatttagaaaaatacaattggacacagacgcttagtgatatagagctgcgcgtgccgctcaaatgcgatttcagagtaaagcaaaaggatctcacggtgaacattactaaaaagcacctcacctgcggcctgaaaggccacccgcccatcatcgacgatgatttccagcacgagatcaaactagaagagaccaattgggtcatagaagacgggaaatcgttgctcttctccatagaaaaggtgaacaaaatgaactggtggagtaaaatcgtcaagtccgatccggagataagcaccaagaaaatcaatccggagccatcgaagctgagcgatctggacggcgagacgcgcggcatggtcgagaagatgatgtacgatcagcgacagaaggagatggggctgcccaccagcgacgagcgcaagaaacaggacgtgctcaagaagtttatggaacagcatccggagatggacttttccaaatgtaagttcaactga

SEQ ID NO: 667 - DNA, 477 bp, Phyllotreta nemorum
atgcagtctcccagtggaatggtgcacggttatccccaggcctcaatactacaatggagccctgataaaaaatacagcgatagagaaaggtggatttgcgtttatccagcgtacattaattgcaaaaagaccatagcccaaggcaggaaactaaacaaagataaatgcgtggagaatcccactcatcaagagatcagagacgttttggtcgcagcaggtttgaaggttggcgtggaaaataaattgtacagcagagaacgaagcaaagaattgctgtatcgagggcgaataagagttcaattgaaaaacgacgatggttcgttgtgcaatccaaattttcccactagagatgccattatgctccatttaggagacatgattcctaagttgaagagtagacagaacaagggcagtggagatcctcaaccgcagaccaccagctcgaaaggaaagggaaaaggcaaaggaagacgttaa

SEQ ID NO: 668 - DNA, 1971 bp, Phyllotreta nemorum
atggaggaaccggagcctactaaacgccagaagatgcccaaagtggctaaagtgaaaaacaaagccccagccgaaatccagatcacagccgaacagctattgagagaggcgaaagaaagagacttggagatcctcccgccgccgccgaagcagaaaatttccgatccggccgagttggccgactaccaattgaggcgcagaaagcaattcgaagataacatcagaaaaaaccggacggtcatttcgaactggatcaaatatgcccaatgggaggaatcgcagaaggaaatacaaagggccaggtccatatgggagagagccctcgatgtggaccaccggaacattacgatctggctgaaatacaccgaaatggaaatgcggaacagacaagtaaatcatgccaggaatttgtgggatagagctaccgttcttttacccagggtaaaccagttttggtacaagtacacttatatggaggaaatgttggaaaatgtagccggagcgagagcagtattcgaaagatggatggattggcaacctgacgaacaagcttggcaaacatacatcaacttcgaactgagatacaaagaaatcgatagagcccgacaaatatacgaaagattcgtaataacccatccggaagtaaaacattggattaaatatgctcgtttcgaggaaaatcatggtttcattcattcctccaggcaaatttacgaaagagctgtccagttttatggagacgatcatttggacgagaagctttacatagccttcgccaaattcgaggaaaaccagaaggagcacgacagagcgagagttatctacaagtacgctttagaccacattcctaaggatgaaacgaaagaactgtataaggcgtataccatccatgagaagaaatatggagatagaagcggtattgaggaagttataatgtccaaaagaaagctgcagtacgaacaagaaatactccaaaatcctacaaactatgatgcttggttcgattatctcaggctggtagaaggagaagcagatttggaaacgacccgagaaacttacgagagagctattgcaaatatacctccgtcaaaaaacaaacaatactggagaagatacatctatttgtggatcaattatgctttattcgaagaacttgatgctaaggattacgaacgaaccagacaggtatataaagcttgcctggaaatcctgccgcacaaaaccttcacattttccaaaatatggctgctctatgcgcagttcgaagtgcgccagaaaaatctaacagccgcccgtaaagttctaggcatgtccataggaatgtgtcccagagataaattgttcaggggctacatagagctagagatccaactcagggagttcgatagatgtcgaaaactgtacgagaaattcctggagttcggcccggagaattgcgttacctggatgaaattcgccgaactggagacccttctgggcgacaccgaccgagcgagaggcatctacgaactggccataaaccagccgagactagacatgccggagttgctctggaaagcttacatagacttcgagatatcccaagaggagccgaacaatgccaggcaaatttacgagcgattgctggagagaacgtctcacgtgaaagtgtggctttcgtacgccaaattcgagctgaacaatccgagcgaagaagattttaacgtacgtttggccagaaggattttcgagagagccaacgagaatttgaaaaacttccccgagaaagaagccagagtgttactgtggaaaattggaaggagttcgaaagcaaccacggcgatgacgagcacaaggaaaaagtcaacgccaagatgcccaggagaatcaaaaagaggcagaaggtcatcgacgaggacggcgtggagcaaggctgggaagaagtgtttgactacatattccccgaagacgaggccagcaggcctaacttga

SEQ ID NO: 669 - DNA, 1431 bp, Phyllotreta nemorum
atgggaatcaaatttttggaagttatcaagcctttctgcagtatcctgccagaaattgccaaaccggagcgaaagattcaatttagagagaaagtgctatggacggcgataacactatttatctttctagtatgttgtcagattcccctattcgggatcatgagttcggattccgcggatcccttttactggattcgtgtcatcctcgcgtccaaccgaggcaccctcatggaattgggtatctccccgatcgtaacatccggcttgatcatgcagctcttggccggagcgaagatcatcgaagtaggcgacacccctaaagacagggctctttttaacggcgcacagaagctgttcggtatggttataacggtcggtcaagccatcgtgtacgtaatgacggggatgtacggagacccagcggaaattggagccggagtctgccttctgatcatcatccagctgtttgtggccggtctcatcgtgctgctgctcgacgaattgctgcagaaagggtacggtctgggttccggtatttctcttttcatcgctacgaacatctgcgagacgatcatttggaaggctttctctccggctactgtcaacaccgggagaggaaccgaattcgaaggggctgtaatcgccttgttccacttgctcaccaccagacaggataagatcagagggttacgagaggctttctaccgccagaaccttcccaatttgatgaacctcttggctacagttttagtgtttgctatagtaatatacttccaaggttttagagtcgatttgcccataaagagcgccaggtaccgtggccagcattcgagctaccccatcaagcttttctacacttccaacattcccatcatcctgcaatccgctctggtgtccaacctgtacgtcatatcccagatgttggccgttaaatttcaaggcaacttcttcattaatctcctgggggtgtgggctgacgttgggggcggcggcccggctaggtcgtacccgataggcggtttgtgctattacttgtccccgcccgaaagcgtgagccacattttggaagatcccgtccacgctgttatgtacattatattcatgttgggttcctgcgctttcttctcgaaaacgtggatcgaagtgtccggcagttcggctaaggatgttgccaagcagcttaaggagcaacagatggtgatgaggggtcacagggacaattctatgatacacgaactgaacaggtacattcccacggccgctgctttcggcggtttgtgtatcggggcgctgtctgttctcgccgatttcatgggagctatcggttctggaaccggtattttactcgctgttacaatcatttatcaatatttcgaaatatttgtcaaggaacaaagcgaaatgggcggcatgggcgctttacttttttaa

SEQ ID NO: 670 - DNA, 486 bp, Phyllotreta nemorum
atgtcgatggtttcatcttcagccgttgaattaagttcatacagggatcagcatttcaagggtagtcgagcagagcaggacaagttattaaggctttctacgacgttgtatgtaggaaatctatcattttacaccacagaagaacaaatatatgaattattttcgaaatgcggcgacattaggcgaatcgttatgggtctggacaagtacaagaaaacaccttgtgggttttgtttcatcgagtattacaaccgcgaagatgcggaaaattgcttaaggtacatcaacggtaccagattggacgatagaatagtacgtacagattgggatgcgggtttcatagaaggcagacaatacggaaggggaaaaaccggtgggcaggtaagggatgaatacaggactgatttcgattccggcagaggagggtatggtaaaataacccaacaaagaattggacctatggacacgcctagttatttcagaaaa

SEQ ID NO: 671 - DNA, 921 bp, Phyllotreta nemorum
atggctgccaccgtagggcgaatttgtggtgttgggctattaaagccgaataatttagccaccatcggtcagatcggctcttattcgacggccaaagaatggactagaggtaaaaaggctcttttaggaacattagggatgttagcaggcggcacgggagccgtattagtagctctcgaccaatccgtcaaagcatcggatttagaattgcacccgcccaagaacatctggagccacagcggaatattcagctcgttggaccacgccagcgttcgaaggggctacgaagtgtacaaacaagtctgcgccgcctgccactcgttgcgtttcgtcgcctatcgcaacctgatcggcgtgtcccacacggaggccgaagcgaaggccgaagccgaagagcagatgatccgagacgggccgaacgacgtaggcgaaatgttcacgcgccccggaaagctatccgactacttccccagcccgtaccccaacgaggaggcggcgcgcgccgccaacaacggggcatacccgcccgatttgagctacattacggccgccaggcacggagccgaggattacatattcgcgctgttgacgggttactgcgaggccccggcgggcgtggtgctgagagaagggcaatattacaatccgtacttccccggcggggccatttcgatggctcaggctctgtataacgagacgatcgagtacggagacggtacgccggcgacggcgagccagctggccaaagacgtgtcgactttcttgaagtggaccgccgagccggagcacgacgacagaaaaaggatgctgattaaagttattggaatattctcgttcctgttagggttgacttggtatattaaaaaggtgaaattcgcttcgctcaagtcgcgcaagatcgaatttaggccgaaaaattga

SEQ ID NO: 672 - DNA, 1734 bp, Phyllotreta nemorum
atgttggccttgcaacaatactcaggaagtagcgacgaagaagaggataaacaaaaatcgaccgctaataacgagccctcaactccttctgaattttctttaaaaagccagctcgcaatttgcgcagcaccagaagtccttcccaccggactagaggaagatcaaatgcacatcgacgtagacacaaaagagctagcgtttaatcccaagtacgacgtactattcgcaccgtccctgggccctgccaatccatttaaaacgcagcaacagttggtagaacgaaacatgctctcgggccacatagaaagagcccacgtcagcgaatttcaattcgaaaaccagaggagaacgttcgccagttacggttacgctttggacccttccgtaactaacgacgggcaaataaaagtggtcggatcctcggaagccgacgatagcagcattaagactgtgttcgaagcttccaaaacgagaccgttagataaacgaaaaaggaagaaaaacgacgatcccagtgatgtggacgggttcttaggcccatggggtgggttcatagacgaacaaaaaatatctaaaccgaccgaggaggagcaaatcgaactggacgagatatcgtccaaaaagaataaaaagggtaaacccaacgaagataaacccctcgaagaaaaatcagtcctgcacatcaaagacgccgtggattaccaaggacgttcgttcctccacgcgccccaagatgtcggcgtcaacctcagatcggacacaccgcctgataaatgtttcctaccaaaggctcacattcacacttggactggccactcgaagggcatcgctgctatccgattgttccccaggacggctcatcttctcttatcagccggaatggactgtcgcattaaaatctgggaggtctacaacgaaagacggtgtgtaaggacctactatgggcaccgacaagctgttagggatattaatttcaataattccgggaagcattttctttctgctggttatgacaggtatataaaattgtgggatacggagacgggtcaggttctgtctcgttttactagcagaaaaataccctattgcgttaaattcaatccggataagaacaaacaacatttgtttgtggccggtacatcggataagaagatcatttgctgggatacgaggtcaggggatattgtacaagagtacgacaggcatttgggcgctgttaatagtattacgtttgtggatgaaaatcgacgattcgtgacgacatcagacgataaatcgttgagagtatgggagtgggacattcccgttgatatgaaatacattgctgatcctaccatgcacagtatgccttcagtaacaccagcaccaaacggtaaatggttagcttgccaaagtatggacaacaaagtggtcatattctcttccatgaacagatttaagattaatcgtaagaagacattcagcggtcatatggtggccggttacgcatgctccttggacttttcgcccgacatgagttacctgacgtccggagatgccgacggtaaagtttacatatgggactggaaatccactaagcttttcaagaagtggaaggctcacgataacgtttgcatcagcgtcctgtggcatccgcacgaaccgagcaaactgatatcggctggatgggacggcctcataaaatactggaaatccactaagcttttcaagaagtggaaggctcacgataacgtt

SEQ ID NO: 673 - DNA, 807 bp, Phyllotreta nemorum
atggtgcagaaaaagcccaagaagaaggtgggaaagaaggtagccgcagctcctttggcagtcaagaaagtcgagccgaaaaaagaagtcaatcccttattcgaaaagagacccaggaattttggaataggtcaagacatccaaccccctagggacttatcgaggttcgtgaaatggcccaaatacatccgcatccaaaggcagaaagccgtcttgcagaaacgtctgaaagtgccgccgccgatcaaccaggtctcccagaccatcgacaaacaaacagccacccaattattcaaagtgttggagaaataccgaccggaaaccgccttgcagaaaaagaaccgactgaaggccaaagccgaagctaaagtggccaaaaaggaagaggccccgactaaaagacccaacaccttaagagccggtaccaacacggtcaccaagttgattgaacagaaaaaagcccaattggtggtcatcgcccatgacgtagaccctattgaattggtgctcttcctccccgccctgtgcagaaaaatgggagtcccctactgcatagtcaagggcaaagccaggttagggctgctggtcaggcgtaaaacttgtgcgactgtcgcccttacccaagtcgattccggagacaggtcgaacttcaacaaactcctggaggtcgtcaagaccaacttcaacgaccgcgccgatgaaatcaggaggcactggggaggcggtatcctcggttccaaatccgctgcccgtattgctaaattggaaagggccaaggccagggcactcgcccagaagcagggttaa

SEQ ID NO: 674 - DNA, 1002 bp, Phyllotreta nemorum
atggcaacaataattaaggatataacactacaagaaaacattccgcaaaatatacttttcaaaaaacacatcgaattcataaaggaatacggtcaaaaggaaaacaacttcgaatacgcaatgaccgattacttgaggatatccggcatgtactggggccttacggctctcgaattgatgaatgcctcgcctccgcacacaatagaagagatttcagattacatcaaaaactgtcaagaccccgaaagcggcggcataagctcctgcctgaaccacgatcctcacatactccacaccctgagcgccgtccagatactctgcatgtacgacaatctaaaagccatcgacgtggagggcgtcgtgaagtacgttaaaaacctacagctacccgacggtagcttcacgggagacaaatggggcgaagtggacacgaggttttcgttttgcgctgttgccacgctgtcgcttttaaacagaatggacgctattgatgttaataaagctgtggagttcgtagcttcctgtaaaaacttcgacggaggcttcggatcgaggccactctccgaaagccacgccggcttgatttactgctgcttaggattcttgtcagttaccaatagattggatattgtggatcgggacatgctggcttggtggctgtgcgaacggcagctaccttcggggggtttgaacgggcgtccggagaagctgccagacgtctgttactcctggtgggtgctgtcttcgctgaccatactgggcaagctgcattgcatcgacgccggcgctttgaagagattcatattggcctgccaggacacggagagcggagggttcgctgataggccaggggacattccggatccttttcataccgtgttcggtatatcggcgctttctttgttggggaacgataccgtgcagaaggttaatcctacttattgtatgccccagcatgtcatcgataggctgcagctgaaacctcaaattttagatagttaa

SEQ ID NO: 675 - DNA, 2667 bp, Phyllotreta nemorum
atgcaccaagaaaccttgcaactaatccaaatattagaaaaaacagtttcacctgacaaaaatgaattggagcaagcttcgagctttttggaacaagcatcccaaacaaatctattaggattcataaagactctgtcagatatactgcggcatggcgggaacagtccggtggccagaatggcagcaggtctgcaactgaaaaatcaactcacatcgaaagattcaaccatcaaagccacctaccaacaacgctggcttctattttccgaagaagtcagagactacatcaaaaagaatgtggtcggtgcccttgggactgaaaccaacagaccatcttcggccgcccaatgtgtcgcttacatagccgtaaccgaattaccgcaaggacaatggcctgatctcatatcgacgctcgtcagtaacatttgcaatggaaattcgacggaaatgcaaaaggaagccacgctggaagccatcggttacatctgccaagaaattgaatctgatgttttggtatcccaatcgaatgatatactgacggccattgttcacggtatgagatcgtctgaaccgagcaatcacgttcgattagctgcaacccaggctttactcaactcgttggaattcaccaaggctaactttgatttgaccacagaaagaaattacattatggaggttgtttgtgaagcaacacaatcgccggtgtcgcaaatcaaagtggccgctttacaatgtttggtgaaaataatgtcgctgtattatcaacacatggaaccctacatggctcccgctttgtttcccataacgttagaggccatgaaatccgagaacgacgccgtcgccctgcaaggtattgaattttggtcaaacgtaagcgacgaagaagtcgatttggccattgaagatacggaagccactgaagccggaagaccacctacgagagtatcgaggcattacgccaaaggtgcactgcagtacatcataccgattattctacaaaaactcacgaaacaagaagaattggacgatgaagacgattggaatcccagcaaagcagccggcgtttgtctcatgcttctagccacttgctgcgaagacgaaatcgttccgcacgtgctgcctttcatcaaagaaaacatcaagtcggacaattggcgtttcagagacgcttccttaatggcgtttggttctattctgggcggattggaaccaaacacgctgagaccgctcgtcgaacaggcgatgccgactttgatcgaattaatgtacgacagcagcgttattgtgagggatacggcggcttggacatttggaaggatatgcgaaataataccggaagcggccattaacgagaattacttgaaaccgctgctggaaagtttgataaccgatttgaaagcggagccccgcgtggcggccaacgtgtgctgggcattctccggattggccgaagctgcttatgaagcggccgctgttaacgaggaaacggggacgccggatacctacattttgtcgccttactacgaattcattatacagagattactcgagacaactgatagagccgacggggctcaggcgaacttgagaccggcagcgtacgaggccctgatggagatggttaaaaattcacctaaagattgctacgttacggttcagaaaactacgatggttattttagaaagactgcaacaggtactgcagatggaaactcacattaccagccacaacgacagatcacaatttaacgatttgcaaagtcttttgtgcgccacattgcagtcggttttgaggaaagtcacgcctgaggatgccccgcatatttccgatgccattatgacggccatgctgaccatgttcaattcgaattcttgtaaaagtggaggcgtacaagaagacgctctgatggccgtttcgacgctcgtcgaggttctaggtgaaaatttcataaaatacatggacgccttcaagcccttcctctatatcggcttgaagaatcatcaggaatatcaagtgtgcggcaccgcagtcggtttgacgggcgacatttttcgcgcattaaaactcaaagcgcttccctattgcgacgaaatcatgaccttactgttggaaaatctccgcgatcaatctgtccatcgtagcgtaaagccgcaaattctgtctgtattcggcgacatcggtctcagcatcggttcggaattcaaaaaatacctagaagtcgttctgtcgacgttggcgcaagcctctcaagcccaagtcgatcgaaacgattatgatatgctcgattatctcaacgaattgagagaaggcgtattggacgcttacacgggcatcatacaaggcttaaagggcgacggattgacgcccaatcctgacgtaatggtactggaaccacacattccgtttatcgtacagttcattaccgtcgtggcgcaagataatcaacattccgatggaaccgtcgccgtcgcggctggtatagtcggtgatttgtgtacggcctttggcagtccgatggtgcaattgttggatttggcatcgatcaatgatatgttggcgcaaggtagacgcagtcgggtcagcagaaccaaaactttggctacgtgggcatcgaaggaattgagaaaacttaaaatgcctgcacccgctgcggcagctgctagctga

SEQ ID NO: 676 - DNA, 1383 bp, Phyllotreta nemorum
atggaaacgattttggaacagcaacggcgataccacgaggaaaaagagcgactgatcgacgccatggtgaaagaaatgctgcacaaaaaaaacacctacagagaagcgataaattcggaccacaggcaaaagtaccttctagacagatacatgacttccaccgaaagactgatagaactctacgaagacaaagacgggcagcgtaaagccgaagtggccgctctcacgggccccaacgaattcaacgagttctacagcaggctgaagcaaatcaaggatttctacaggaggcaccccaacgagataagcgtaccgatgtctgtggagttcgatgaatttgctaaagcgagagagaatcctaacgaagatatggctaattttgtagagtttaccgatgaagagggctatgggaagtatttggatttacacgagtgctacgagaagtacataaatttaaaaggcatcgagaaagtggattatatcacttacctggccatgttcgatcagctctacgacataccgaaagaacgaaagacgggggaatacagaaaatatcttctataccttattgaatacctcacgtggtttgtgcaacgcattcggcccctgatggacctcgacagcgatctgcaggaacaagtcgagcaggctttggtcaattgggataacggcatggtcccgggatggccgaaagaaacaggctcggctttggccaacgtgggcgcccacttggacctatcggccttctccagttgggaggaattggcttcgttgggtttggatcgcttaaaatcagccctaatggctctaggattgaaatgcggaggaacgttagaggagcgagcccaaaggctgttttccactaaaggcaaaggctccttggatccttctctcatgaccaaaaacagcaagaatcgaataactaaagagaaagaagccctgaggcaaagagaactggctactctagaagctcaaatttacagattggctgatctggtctcagcccaacgagcagccaccaaagagaacgtacaaagaaagcaagctcgtacagacggcgaaagagatgatagcgagaacgaagagagcgaggaagagagcccggacgaaggtgacgatgacgtcccgtacaatcccaagaacctcccgctcggctgggacggtaaacccattccgtattggctgtacaaacttcacgggttgaatataagctacaatttgagatatgtggtaactacgtttataaaggccccaaggcttttcaaaggcattttgctgagtggaggcacgcgcatgggatgcggtgtttgggtataccgaatacggctcatttcgctaatgtcactcagatcgaggatgctttggccttgtgggagaagctga

SEQ ID NO: 677 - DNA, 639 bp, Phyllotreta nemorum
atgacgataggaaagaataacaaaatgatccaacacataaactatagggtccgaataacattgcaggactctaggacgtttatcggcactttcaaagctttcgacaagcatatgaacatgatactcggcgactgcgaagaattccgaaaaattaaacccaaaaactcgaaagtcgaacgagaagaaaaacgggtattaggatttgtattgctcagaggcgagagcatagtctcactgactgtagaagggcctccaccaccagaagagggacttcctagggtacctatccccggagcagcccaagggccaggtataggaagagcagcaggtagaggaatgcctcccggtatggctggagttccagtaggtctccaaggccctgtaagaggagtcggaggaccgtcccagcaagtaatgacgcctacgggtagaggacaagtttcagcgccaccacaaatgaaccaagcgcctccaagaatgggcggcccaccgcctggtatgatgggaccaccgcccggcatgatgggcatgccaccgcaaatgggcatggggcgcggaggaccgcctccgatgggcatgaggggtcccccgcccggtatgatgagaggcgggccgcccggacccccgaggccatattaa

SEQ ID NO: 678 - DNA, 1173 bp, Phyllotreta nemorum
atgttggaggacatagaaatagtgtgtatagcgtatgcaatacacaagagaaaaaaaaaacaaagaagttgttgtgttcatccgctaaatacacaacgtttaaatttaggacaatttcactgcttattcggtgaattgcggaagtatccggaaagatttttcaattattacaggatgtcgatcacttccttcgacgaattagttttgtttcttcgacctcggctgcaaaagaacaatactcgattttgcaaagtaataagcgtagaggagaggttaacaataactctaagatatttggcgacgggtacgaattttgctgcaatgcagcactcattcgttatgggaagaactacaatagcggaaatagttaaagatacgtgcactgctctatggataacattacaacccattgaaatgcctgaacctaccacagaaagatggttgcaatatgctaacgaattctggtcgcgttctaattttcccaactgtattggagctgttgacggaaaacatattcgtctaatgtctccacaacatagcgggtcacaatactttaattacaaaaagtatttttcactaatgttaatggcaattgctgatgcaaactactgttttattgctgtcgatattggtgcctatggcagagaagccgattgtaacgtttttaagcaatctaccttgggagtgaaaatgtataataatactttaaatcttcccccccctcgaggtttgcccggaaccaatgaaccatgtcagccatttgtgtttgttggggatgaagcgttcggactccatactaatctactgcgaccttattccagacgtaatttggatgaaaagacccgtatttttaattacagacttacacgtgctagacgctttgttgaatgcacttttggtatacttagcaacaaatggcgagtatttcacacccctatattagtacagccggatttcgctgttaaaatcgttcaagcagcttgtgtacttcacaatttcgttagaaggagagatggatatcagtttgaagacactttatcttgtaatttggaggatatccaggtgcgtggcaccggcggaaggcgaacagagggacattgtgttcgagacaattttgctgactaccttgttagtccggagggagctattccttggcaacaacgtatgatctaa

SEQ ID NO: 679 - DNA, 438 bp, Phyllotreta nemorum
aagcagtacaacgaggacgagccggaggataaccccgaatcgcccgaggaattcggcgaatcctcggatatgatggccggttacgatcacgaagaaaccgatataatcatctcagatccaaccaccagcgttcccgaagactcaatttccactaaggaagacttcgaggagctcattgacgaaggatcgcgcaaaaacaacatcagcaaacaggaagtgaccgccaaacacattcaggatttccacaggtacaccgaattgttcgattacggcaaacctgacgcagttaagaaaccgggcggcaaaaaattccaaccgaaagtgtctctcgttggaggagtagctttgccgagtaagcccaacgcagagaagattataatcacgcaaaattcgaacgtgttgaatacttcccaagcctcgaaggttactagcatcatt

SEQ ID NO: 680 - DNA, 1476 bp, Phyllotreta cruciferae
atgaagaaagaggcgaaggaaagaaggcgaaaagagaaaatgggctgggataacgaatacttacattacacgaacagcgacaacccattcggagacggcaatttactaaccaccttcgtctggaataaaaaattgtccaaagaaggcatcaaaaacgtcggccatgaagaaatagaagccataaatagattaaaacaagaagagaataaaagggaactcgaaaaagtgaagaaacgaagattagagagggaactggagaggcaaaaaagagatgaagaaacgcaaatgatgcaaagaagtaaagaagcagcccaattcgaggaatgggaaaggcaagaagataaattccacttggaacaagctcgattgagatctcacattagaatacaagacggacgagccaagccgattgatctactagcgaagtacataagcgccgaagaagaagtcgatgccgttgaaatgcacgagccttacacttacctgaatggcttacaaatcaaagacctagaagacttagtagaagacatcaaagtctacaaggaactagaaagaggaaaaaacctagattactggaacgatataacagtaatagtcgaagacgagcttcagaagttgagaaaaattgaaaaacaaaacgattttgacttgggattgaaccgaagggaaggaatacatcagtctgtcgccactgatgtaacatcagtatttaaaggcaaaacagccgcacaattagcagcgttagaaaaacaaatcggaagcaaaatcagcagcaaagccgatggaatagacataggctattgggaatctttgctatcgcaacttaaggcccacatggcgagggccagactacgtgacagacatcaagatagcttaagaaggaaactgcaagtacttaaagcagaacaagccatcacaggagtaggtcaaagccatagcgaaacccattctactgataacgaagaaaccacttcggaacccaaaccaagcacttcccaggatactttggaaacgatggaagaaagcaacgaaaagaccgaagacgctgctcatgaatggctcaacgaatgcttttcagcctatcaagcaggcgggtacagtcctaagtttttaactcccgatgacaccgagcctggtacgattgtagtctcggaggaagacgacgtaaatagattggaattcgctaggatgcaggttctaggccaaggaaccaaaatcgaaaacgtcattacgaaggaagaattgctgctgcaaaaggaggcgagaaaaggaatggatggggatgaggctcaattttcggtcgagcaagccttggataatccagtgtatctttggtcggataagtaccgtccaagaaagcccaggtacttccatagagtgcacacaggattcttatggatcaaatgcgatcaggcccgttctcccatcgacaatccccctctggtattccgacttgtgcttgaaaaaaacatattt

SEQ ID NO: 681 - DNA, 1266 bp, Phyllotreta cruciferae
atggataatctcgaagcgaacataatggacaagtcgatgagatcggtcttcgtgggaaacatcccatacgaagccaccgaagaaaagctaaaggacatattcggtgaagttggccaagtgttgtcgttcaagctggtcttcgaccgagagaccggcaagcccaaaggctacgggttctgcgaatacagagaccaggagaccgccttgagcgccatgaggaacttgaacggctacgaaatcggcgggaggaacttgcgcgtggacaacgcttgtaccgaaaaatcccgaatggaaatgcaaaacctgctgaatcaaccgcccatcgagaacccgtacggggagcccattcaagccgaaaaggccccagaggccatcagcaaggccgtggcttccctgccacccgaacagatgttcgagctcatgaagcaaatgaagactaccatacaaaataatcccacagaggctagacaaatgctattgcagaatccccaactggcttacgctttattacaagcccaagtggtcatgaagattatcgatccccatacggccgccagcctactgcacccggttaaccaagtaccggccactttgctgccgggggacaagaacgtggccgtgcaagtaccaataaacaaccagtaccgggagccccctgcccccgtacaaccgcccaggcaggagtaccagccggtaccgccgcccttagtacatcccaatcacgttcaacaacccgtgtttaccggtcaagatgtggacttgcgatcgatgggaaatgtgactgatccgagaatcaggcccatgattgtggatcaggatatgagacaaatgccggccgttatccagaatcctctaccgcctactattagcgaaagtttttcgagggatccccgaagcggcaccagtttcccatcggatccaaggcaagctaggatggacccgcgtcaaaaaaatatagtaccaccgacgagccaacaagtacccccaacggtgaatcccaagataatgccccctcaagccggccctgtcgtcagaccggcgcagaacgtcatcgcccaatcagctgcagctgcatccgtatcagctgcaacagccaacgttagcccgggaattggaggggcaggagctactgatcaagaaaaagccgccctgatcatgcaagtgctgcaattatccgacgagcagattgcgatgttgccgcctgaacagagaaacagcattttggtgttaaaggagcaaattgcgaagagtgcgcacgtgcgttga

SEQ ID NO: 682 - DNA, 1179 bp, Phyllotreta cruciferae
atggcgcaaatggatgcggaacgtgagaagagcctccaagagtacagaaaaaaattgttggagcacaaagaagtggaatccaggctgaaagaaatgcgagagcagctcaaagatttaaccaagcagtacgataaatcagaaaacgatttgaaagccctccaaagtatggggcaaatcgttggtgaagttctgaagcaactgacagaagagaaattcattgtaaaggcaacaaacggtcctcgttacgtagtcggttgccgtcgtcagctggataaagccaagttaaaggccggcacaagagtagccctcgacatgaccaccttaaccataatgcggtacttaccgagagaagttgatccgttagtttacaacatgagccacgaagatccaggagatgtcacttactcagccatcggtggactttccgagcagatcagggaattgagagaagtcatcgaattgcctctcatgaatcccgagttgtttatgcgagtgggcattacaccaccaaagggttgtctgttgtatggaccgcctggaactggtaaaactctgttagccagagcagtggcgtctcaactggatgcgaatttcttgaaagtcgtatccagtgctatcgtagacaaatacatcggtgaatctgctaggcttattagagaaatgtttaactacgccaaagaccaccaaccgtgcatcatttttatggatgaaatcgatgctattggtggccgaaggttctctgaaggtacatcggctgatagagaaatccaaaggacgcttatggagttgctgaatcaaatggatgggttcgattcgttaggacaagtaaaaatgattatggcgaccaataggcctgatacattggatcctgctctgctccgtccgggtcgtttggacaggaaaatcgagattcccctgccgaacgaacaagctcgtcttgaaattttgaaaattcacgcacttcctattgctaagcacggggaaattgattatgaagctatcgttaaattgtcagacaccttcaatggggctgatttaagaaatgtgtgtactgaagcaggactattcgccattagagcagaaagagagtatgtaattcaggaagatttcatgaaagctgtaaggaaagttgccgataacaagaaactggagagtaaattagactataaacctgtataa

SEQ ID NO: 683 - DNA, 780 bp, Phyllotreta cruciferae
atggctcgccggtatgatacgagaacgacgatattctctcccgaagggagactatatcaagtcgagtatgccatggaagccatatcacatgcaggaacatgcctaggcattctggcgaacgacggaatccttcttgccgctgaaagacgtaacaccaataagctgctggacgaagtttttatttcggagaaaatatacaaactcaacgatgatatggtttgcagcgtagcaggaattacttctgacgcaaatgttttaacaaacgaattgcgtctgataggacaaagatacttgtatcagtacggcgaatcgatcccttgcgaacagttagtttcttggttgtgcgatgtaaaacaagcttatactcaatacggaggaaagcggccttttggtgtatcgatcttgtacatgggctgggataagcattatggttatcaattgtaccaatcagatccgagtggaaattattctggttggaaagcgacttgcataggaaataacagttctgctgccatttcgagtttgaaacaggaatacaaggaaggcgatatgactttgaaagatgccaaaggtttggctgtgaaagttttggcaaaaacgttagatatggctaaattgacttcagaaaaagtggaaatggctactctgacacgtagaaacgataagaccatgataaatatattaaatagcaaagaagtggaagaacttatttctgagtatgaaaaatccgaagctgccgctgaagctaccaagaaacaagaacaaaaatccgctgcttaa

SEQ ID NO: 684 - DNA, 2550 bp, Phyllotreta cruciferae
atgagtgaatcaacaaaagccgaacctataaaggtggaatcaaaaacaactgatgacaaaaataagaacgaactgtccgatgaagataaacaactccaagaggaattgaacttgtgcgttgaaaaattacaagaaaatgacagtaaactttacatgcccgctttgcaagctttgggtaaccacattcgggcctcgactacttcaatgacctccgttcccaaaccgctgaagttcatgaaacctcattacgatacaatgaaacagatcttcgagaagataactgagccttcggttaagagtctgtgtgcagacatcatctccgtattagctatgactatgggagaaggaagggattgcttaaagtacaggctggtctccgatttggacaaaatcggtgaatggggtcacgaatatgtcagacatttggctggagaaattgctggcgaatgggccgaaactgatttcttagtaaacacagaaattagagataaactcatattattaacaaaacagatcgttccttataatatggcccacaatgctgaagcagaagcttgtgatttattgatggaaatcgaacgactagatttgctagaacaatacgtagatgaaaacatttaccctagagtttgcttatatcttacaagctgtgtaccttatgtcgctgatcccgaaaatactactcttcttcaaactgctttaatgctgttcaggaaattcaagcagtaccctcaagcacttcggttggctatgcaactgaacgatcacagtctcatcgaggaaatattcctaaattgccccgatactgacgtacaaaaacagttggcgttcatgttgggcaggcagcagatttacatcgaagttcccgacagcacgccggagtacgaagatctcatcgaaattatggcgaattgtcacctgaataaccactttttgaatctagcacgtgaattggatattatggaccccaaaaccccagaagatgtttacaaatcccacttggaaaacagccgtcctccattcggtggaagccaagtcgattcggccaggcagaacttggctgcaagttttgtcaacggtttcgtaaacgctgccttcgggcaagataagctcttaatggaagatggaaacaaatggctgtataagaacaaagaacatggcatgctaagcgctactgcctctttgggtttagtattattatgggatgtagatggtggtcttacgcctattgataaatacttgtactcctctgaagatcacattaaatccggagctctattggcatgtggtattgtcaattgtggagtcagaaatgagtgcgatcctgccttggctctattgagcgactatgtccttcatagcacaaatataatgaggataggcgctatcgtgggcctcggtttagcttacgttggatctaacagagaagcagttttaagtttactgactcccgtcttttctgatccgaaatccaatatggaagtgatcggtatgtccgcgctagcttgcggaatgatcgcagtgggatctggaaatcttcaagttactaccacaattatgcagacattaatggaaaaatcagaaactgaactgaaagatacgtacgctagatttttgcctttaggtctcggcttgtgcatgttaggtaaacaagaaggcatcgattccataatagctgcattggaagtcataccggagccttttaaatccatggcaactacgatggtcgacatttgcgcttacgctggtactggcaacgtacttaaagtccaacatttactgcacatttgctctgagcattacgatggcagcgacagctcagacaagagttccaaagataaagacaagaaagatgctacagagaaggagaaggatctttcctcgagacaagcagtggctgtactcggtatagctttgatcagtatgggtgaagacattggtagtgaaatggccttccgtactttcgggcatttgttgcgctactgtgaaccagtaattagaagagcagtacctttagctctaggactcatctcagtatcgaatcctaaattgagcatcctcgatactttgagtaaattctcgcacgacagcgatgcggaagttgcccataacgccatatttgctatgggtttggtcggagcgggtacgaataatgcgagattggccgcgatgctgagacaattggcgcagtatcacgctaaagatccgaacaatctgtttatggttcgcattgctcagggtctaacgcatttaggtaaaggaacgttgacattgagtccttatcacagcgaccgtcagctcatgagccccgtggcagtggctggattaatggctactcttgttggatttttggatgttaaaaatattattttgggaaggtcgcattatctcctatacactttagcagcggctatgcaacccaggatgcttgtgacattcgatgaggatttgaatccattaccagtacctgtgagagtgggtttggtaagtttgattatagaaagtttaaattgcaatttggttaaaaaaatgttttattttaggctgtag

SEQ ID NO: 685 - DNA, 1521 bp, Phyllotreta cruciferae
atgaccgatagcaacatggattcgaaagaagagaaacaagcctcaccggaaaacgcccagctgaaaccagaagcaaccgagcccgaggctcccccagctcaagcatcccccgccgccggcgtcatccggaggaatttcatcacccccgccggaaccatcgtcgaaaccaacgaagaacaaccgccagaaccgaccacagaagaggtcgtcaaaacgacatcttcgaatccgagtccggccgaacagaaacccgaatccgagatagtcacctacgcagcggaggtcctgccgcaggagcaaagagaacaattcgccgaagccaaatcctacgcagtggaaatgccagctgaaaattttcctaataacaacttcacccaggacattagctatgtgaatatagaaggaactgttgtaccagttacaatatcagagatggaacatcctggagattacgccaatctacaaactgctcaatacaataatggctatacggatggtacgcagtacttaaccaaccatcagtaccagaacatgtacatagagagaactacagttgataattctccttctgctactgttttgtatcgggatgatcccaatttgggagcttctagattccaaggaaattacgacatatccagctctcaatcgcaagtgaaccttcttccatccgcaccaggagaaacctactatacatcaacacctaactggacgccgacgagcagcggtacttaccaacagcagtacccatctgggaccataaacgtccttcaggcggattcgactcaagccttcgggagtccatacataaacgcgacatggtcgtcgaattcgatggaggacggacggccgtctagtcaagaggtactagtgaaagagtgcgttaattgtggtgctagcgtcacaccactttggcgtagagacggtacggggcattatctatgtaacgcgtgtggtttataccacaaaattaatggggtgcacagaccgccgactaagccaaccaaaaaaccacaggcgactggaaatagaagaaacggcgtaacgtgtgcaaattgcaaaactaacaacacaactctttggagaagaaacaaccaaggcgagccagtttgtaacgcttgtggactctattacaaattacataatgttaacaggccgatcagtatgaaaaaggaaggtatccaaacgcgcaaaagaaggcccaaaaactcttctgtgggaaaccccgccagtgctgcaggtcaagtaagacttgggattccctcttatccatcatattcagaaatggatgtacagcaagatcaataccaattaccaatgaacgtttattctcaaagaccacaagtttcttatagacagtatggaacggaaaatcttggaactttaaatgcacagccattgcagccaataattactcacgaggatgaacaggcaagcgtcattacatcgacttcacaacaggctaggtttaggacgaaggtggaggaggacgagggtagcaatccttcaatgcaatcctga

SEQ ID NO: 686 - DNA, 4866 bp, Phyllotreta cruciferae
atggcactaccggggaatgggatcttcgtcgtcaaaggcgaaatatcgaacttgatggccgccatgaagaggggccccaaatggtcgtcgcactcttatcaagacgacgacgtcgacgcgctgctgaggaacttccacgagctgcgggatattctacacaatgtaaacgatttaggatacgttgaacccaacacgtttttggccccttttttaaacgtaatccgttcggaagagaccacaggccctgttactagcttagcgctctcagctgttaacaagttcctctcctacggtctcttagatcccgtacaaacatccataccgcaaaccatccacaccatcgcagatgccgtgactcacgctcggtttgtgggcaccgatcaatcctccgatggggtagtcctgatgcgcatactgcaagtactgcgaactctcactctatcccccgagggcgccacgttgaccaacgaaagcctctgcgagataatgctgtcttgcttccggatatgcttcgagacgaggctgtcggagctgctccgcaaaactgccgaacattatctgaaggacatggtgcaattgatattcatgcggctgccccaattctccgaagatcccaagctgtcctacgtcaagcgattgcggatgcagcccggggatctcgagcagacgcgaacgaagaggaaaaagtactcgaagaaggagcacaaagaggttgctaaagcgccggcgcaggaagttaacgttgaaagtaccccgcagactgatatagtagatatgcagggtactattcttcgtaataacgaagttactacgccttctagtccaaatctagttgatacagatgttgctatagacattcctacggatgacagtatgaagacttcggaaacctctacgtctaatttagaagatagtgctgagaaagaaaccgatgaaccgtttcaagactacgtcaatcaaagaggtattcggtttacgcctcaattccaacaggaaaccaatctatctccttacggactagcctgtgttcgcgaactattcagattcctgatcagcctgtgcaatcctttagacaagcagaacacagacatcatgatacatttaggactcagtttgctcacagtagcgttcgaaattagcgcagataacataggcaaatacagcacattgttgaccctagtggaagacgatttgtgcaggaatctgttcgctttgatgaacaccgatcgtttgacgatattcgctgcgaatctgcaagtgtcgtttctgctgttcgaatcgctgagagcccacttgaagtaccaattggaatgctatttgaagaaactgatggaaatcttgcgtagcgaatcgaacaaggttagctacgagcacaaggaaatcgcgctggataatttgctgcaattgtggagagtgcccgggttccatgcggagctgtacgtgaactacgattgtgatatgtattgtactaatttgtacgaagagctcaccgaactgctggccgaacggtccatttccactatagtaggtgtctatcatgcgcatttactgtcgctcgatggacttctgattataatcgatggcatagggaagagattcgacgaagcgaaagatcgtacagacaccgatgagattagtagttatataggagagaatacgagaattaaaggttgtgttaaagttcccgataagaaggtgctggctgccaagaaagggatcaaaaagtggttaccgcaaggtacggagtatttcaatcagaagccgaagaaaggtatacagttcctgcaggagcacggcgttttgaagcaggagctggacgtggaagagattgctagattcttgcgggagaatcccgcattgaacaaagcgatgattggggagtacatcagcaatcgggggaatttgaagatacttgaggctttcgtgagcacgttcgatttcactgggattcgaatcgatgaagcgcttagagcgtttttggagacgtttcgattaccaggcgaggctcccacgatttcgttgattctcgaacatttcgccgagcattggcacaaaagcaacggagaaccattcgctgatgtggactcggcttttacgctagcctatgctgttattatgctaaacgtcgaccagcacaatgaaaatgccaaaaaacaaaccattccgatgtcgcctaacgcgttcaagaagaatctgaaaggcgtaaatggaggcgacgacttcgaggaggacatgctggacgaaatctacacttcgatcaaaagcgaggagatcgtgatgcccgccgagcggacgggcgtcgtgcgcgacaactacctgtggaaggtgctgctgcgcaaagggcgctcgcccgaaggcggcgtttacatgcgcgacgacggcggcgcctacgacgccgatttgttccgcatagcctacgggccgctggcggcggcgttgaactccgtctacgagcgcgcggaccacgagggcgtccagaagaaagtcatgcgaggtttcgagcgatgcgcctccatagcgtccaatctcggcatgactgcgaacctcgacatgttgttggtcagtttgtcgaagtttacggttttccacaaccatcagaagcagaccgccgtcgtggtgcaattcggctcgaacggcaaggcccaattggctctgaagacgctcttcatgctgatccaccagcacgggaactccaccagggaaggttggaagcacctcttcgatctcctgctcgctttgtacagcaacgatttgctcagcaagagcttcgtggaagtggaagattttgtggagccatcggggaaattgtgtttggtgtacaaagatgctccgagcgcagccaaacaggataccggattgttgagctctttgtattcctatatgatatctgtagagaatttatccaaaataccatcgcccgaagagcagagtttaatagataaagcaagagaatgtatcaaagaatgcaatttagagcaaatgatcacagattcgaaattcctccaccaacaagccctattccaactggtcgatactctaatcgaattatccagaggtccggacgtacaagatggctcatcgtacgactacaacgaaaacgtaacggtctttttcctcgaattactggtgaaaatcgtcatccaaaaccgggacagggtgatgaccatatgggaccgcgtcagagaccacgtgtacaccctggtgatgaactcctcgctgatggactaccagttcctgttggagaggtccgtggtgggtctgttgaggatagccgtgcgattgatgcgcaacgaggagatgagccacgtggtgttgcagtcgctgcgcatgctgctgtttctgttgaagggcggcgtgctggccgggatatccaggcaaatggcgttcggtttgtacgagatgttgaagacgtcggcgcagaatatccacacgacggccgattggacggtggtgttcgcgttgttggagtgcgtgggagcgggggcgaagcctcccagacccgttttgaccgtcgaagaaaacgacgcgaaacccaaacccgacgaagaacatccccagacgaaagaccacaaaaaagacgaagaaggcgccagcgcgttttccgaccctaaaacgaacgaaacccccaaaaacccgacccaaagaccccaaagtccaggaacagccctaacatctcccgtcggcaccccgaacaccggcggatggatcatcgtcagcgacgaagacgacctccagccccaccgcggcccccaacacaccctgcccgtccactaccacctgcgcctcgacgccgatctctcgccccacgacccgctcagcatgctcaagtgctgcgagagcttggccttcctagtccgcgacgtcgctcacatcaccccgtacaacttcgacgtctgcgtacgctgcgtgcggacgttcgtggaggcggccctgaaaccgcctcccaacaaccaccccaacaccagaagatccaacctaaagaaaaccaggaagaagagccccgctggaagccaagaagaagacagcagcggtggagatgaagacgaagacctccccagcggctaccaccaggtccccatacagctactggatttgatgcatacattgcacacccgcaccgcgcagatattcaaatggtgggccgaggaaggcggcgaaatttccggggaaacttccctgtggacgcaaggttggtgtcccttgctgcaaggcatcgcgaggtcctgctgcgatacgcgcaggacggtcagaaccagcgccatagcctacctccaaagagccctgctggtgcacgatctccaaacgctcacccccaaggaatgggagcagtgcttccgaagagtgctgttcccgttaatgaactacctactgcaaaccaccggccctcgagacgccgtctccaccgaggaaaccaggataagagccgccggggtgctgtcgaaggtgttcctgcaccatctggcgcctctttcgtcgctgcagggcttcgcggacctgtggtcgacggtgctggagctgatggacgggtacatgcacgccgacggcagcgagctgctgctggaggccgtgcccgagagcctgaagaacatgctgctggtgatggaggcggccggagtgttcgacgggcccgacgggaagaagaacgccctgtgggcggcgacgtgggagcgcatcgggaagttcctgccggggttgaaggacgagttgtttagggagatggggtcgaggaggaaggtggtggaagaagcgaaggacgtggaggaggctttccccaaggagaaggaggccgagtgttgggagaagaacgtcggggggcgggagcaggatgtggatggtagggagaaggaggagctggttgcgtgttga

SEQ ID NO: 687 - DNA, 618 bp, Phyllotreta cruciferae
atgtcgattttggcgtacaacgggggagcaatggtagccatgagaggggacaactgcgtggccatagcggcggaccgcaggttcggcatacaagcccaaaccgtcgccacggatttcgagaaagtcttcgaaatgggcccccatttattcgtgggcctccccggcctcgccaccgacacgcaaacagtcatggagaagctcagattccgcaagaacttatacgaattgaaagagaaccggcggatctcgcccaaagtgttcgcagccatgatatcgaacatgctgtacgagaagagattcgggccgttcttcgttgaaccggttgtagcaggtctagctcctgacacattcgagccttatatatgcaacatggatttgatcggttgtataaacgaacccagtgatttcgtcgtaggaggcacagcctccgcgcaattatacggaatgtgcgaatctttatgggaacctaatctagcccccgatgatttattcgagactatatcgcaggctttgattaatgctttcgatagagatgctatatccggttggggcgctacggtttatatcgtagaaaaggataaggtaaccgtaaggaatctaaagactcgcatggattaa

SEQ ID NO: 688 - DNA, 2898 bp, Phyllotreta cruciferae
atggaaggaaaaccggaattagaagtggtcaaatcagccgtatcaactctatacaacaaccccgatggtggagaaaaagaaagagcctcccgatggctcttggaactacagaaatcggttcacgcatggaccgttgcagacgaattactccgacgttgcacgaacgccgacgatctccaaacccgctacttcgcagctcaaacaatgcgaaccaaaatccaccaatccttccacgaactaccccgagaagtgcacgagtctctcagggactcccttctggaacatatgggagcttgcgccggcgtcgacgagggcgctggggccgccatagtgacccaactgtcgctagcactggcagatttggctctgcagatgcccgattggcgaacgcctgcgttggatctgatcggcaggttcagtgcggggagcaatgtgtggcctttgctagaagtgttgacggtgctacctgaagaattagagagcagatcagtgagattaggagaaaatcgacgatacgaggtattagaagatatgaaattctgtgctcccactgtaaatgaatttctcaagcattgttcgaacttgtatgggagaggaggctctgagaggttagccgcaggtgatagacaaatcgatgtaaagatactcagatgtttcgcttcgtggatatcggtcggagcgatcggaccaagtcaattgagcgaggatcgggtagtagtcgacatggcgttcgacgtgttgaaagcgggcgtacggggagatgaaaaagaaaccttaacaggacaactacacgaagccgccacagattgcatttgcaccttactactacgtctcgaggataacaacaatcacgtggcattggagacccacttattcgaaaatatagtaaatctagaagtggcctatcatgcatctgtcgccctcgaagatcaagcaaagtctacggattattgtcgactgttcaccgagttggctgaatcgtttttggggaagattgtagacgatgggggaggcggaggcggcgacggtggcggagctaaaaggcgtaccgtgtacgctgttaaatgtctagatttagtactgatgtgtgtcggccatcatgattatgaggtggccgagataacgtttaacctttggcatatgctaagtgaggaattatatcagaaaaataacaaggaattaacggaattattcaaaccgtatgtggaaagattgataactgccttatgtaggcattgtcagatggagccggacatggagggtctactcgaaaaaggagacgaatttaaagattttaggatgaaagtttcagatctaataaaggacgtcgtctttatagtaggtagcagcagttgcttcaggcaaatgttcatcaatttacaaacctctggtgtaacgtgggatgccagtgaagccgctctctttgtaatgcaggccgtagccaaaaacgttcttccaactgaaaacgaagtcgttcccaaagtcgtcgaagccatactaaacatacccaacagcgcacacgtggcagtgaaatacacctccgtccttctactgggcgaattagccgaatggatagaaaaacacccggacgccctggaccccgtcctgaatttcctagtatgctgtctccgcagcggcgccgaaggaggaggcgtcgcgacggcggcggccgcggcgctgcagaacgtctgcacgtgctgcggcgctcacatgggcaggcacgttcccattctgttacagttacttcaacagtcggattcgttcggaatcggcaacacggcggtggtgggattgttgaagggcgtcgcgtcggtggtgagttgcggcatgggaggcggcgccgagacggcctccgccgtcagggaattgtgttctatgcaattgtcgccgctgtgcagtttgatggagaacgacgttcggccggttaaagggactctgacggatccggtgctgtggttggatcgattgagttcggttttgcgatacgttaacgtcaatatagtcgaaggcgaaatccatccttgcaaaccggtaatattggagatatggccgatactatcccgcgcattcgacacctaccacagcgacgttcgaataatggaaaggtgctgtcgctcggtgcgtttcatgttgcgttgcgtggcccgacaactccaggatttgctgccctctttggtcggacaaatcgtgcatatttactgtctctacgggcattcgtgttgtttgtacgtgggcagcatcttagtagacgaatacgccggtgacgcgtcttgcgttcaaggtctactcgacatgttgaacgcctttttggagcctacgtttcgtttgttgcaagaggagaacggcttgaagaaccatcctgatactgtggatgatttctttaggttgtgcgctcgattcgtacagagggcgcctaaggcgtttctaagcggtggggcccatctggcgcccattatgcaatgtgctctactcgcggccactttagatcacaaggaggccaacgtgtctgttatgaagtttttctacgatttgataaaccagggattgagcggtagaggagagcctgacttcgatgagaggaaagcgttggttagaagcctgctaaatgaatatggtcaacaactggtgtctaatttaattcactcttgcgtattttacttgcattcgtatatgttgagcgaagtgggtgacgtttttgtacaattgttagatttcgatagacagatcacgagtgaatggttagcgaacggtttggaattgttgcccaaacaacagaatggtggaataatggcggctaagcctaagcaattaaatgatgttcatgcttctataacgagatcaaacagttcgaaatctgtgacgcacgccctcaaagacctaactaggctatatcgttaa

SEQ ID NO: 689 - DNA, 1509 bp, Phyllotreta cruciferae
atggcgcaacgattgcccggaccggtgtcgaatcaagtcccaggagggccgccgccgcctcaaaggtaccaacaacagccgcctaatcaaggaatgaggcaatacggccaacagagtttccctcctaggccgggctacaaccctccacccccaaatatgcagtctagcggaggcaccatgattcaaagacctcctggggcgccgtattcgccgatgcgtggggggcccatgccgccgcagccagtgggtaagaggccttcggataacaggaacccgttacaacagaagaatagtgactatagtcacggtactagtaagaagaaaaagaaacttgctgataaaatcttaccccaaaaagtaagagatttggtgccagaaagccaagcctacatggacctgttagctttcgaacgtaaattagattccaccattatgcgaaagcgattagacatccaagaagccctaaagcgccccatgaagcagaaaagaaaactacgaatcttcatttctaacactttctacccggcaaaagaaccccaacccgaaggccccgacggcccttgccaagagggcacggtagcctcatgggaactgagagtcgaaggcaggcttctcgaagattccaagaacgatccgaacaaagtcaaacgcaaattctcctcgttcttcaagtctttagtcatcgagctcgacaaagagctatatggccccgacaaccacttggtcgagtggcacagaaccttaaccacccaagaaaccgatggatttcaagttaagagacccggagacaagaacgtgagatgcacaattctcttgctcctcgactaccaacctctgcaattcaagctcgatccgaggctggcccgattgcttggtgtacacacacaaacaaggccagtgattatctccgctctgtggcagtacatcaaaacgcaccggctacaagacggccatgaacgcgagtatatcatttgcgacaagtatttagagcagatcttcaactgtactcgcatgaagttcgctgaaatcccccaacgattgaaccccctgctacacccacctgatccgatcgttataaaccacgttatatcagtcgaaggcggcgctgagagcaaacaaacggcttgctatgatatagatgtggaagttgatgacactctgaagactcaaatgaacaatttcttgctgagtacagcgagtcagcaggagattcaagggctagacgcgaagattcacgagacagttgacacgataaatcagctgaaaaccaacagggagtttttcctgagcttcgcgaaggatccgcagcagtttatacataaatggatcgtgtctcagacgagggatctgaagagtatgacggatgtggtggggaatcccgaggaggagaggcgatcagatttcttctatcagccgtgggcgcaggaggctgtgtgccggtacttctacacgaaggtgcagcagaagagggccgagttggagcaggccctgggtattcgtaataattag

SEQ ID NO: 690 - DNA, 414 bp, Phyllotreta cruciferae
atgcctaaagtacgaagaagtaagaaaccaccaccagagggttgggaacttatcgagccaactttagatgaattggaacaaaaaatgagagaggccgagaccgaatcacacgaaggaaagcgaaagaacgaatcattgtggcccatattcaaaattcaccaccaaaaatcccgatacatcttcgacctcttttacagaagaaaggcaatcagccgggaattgtacgaatattgcttactggaaaacatcgcagacaagaatttaatcgcaaaatggaagaaacaaggctatgaaagcctttgttgcctgagatgcatccaagcaagagacactaatttcggaacgaactgcatctgcagggtacccaaatctaagctagaagaaggaaggattgtcgaatgtgtacattgcggt

SEQ ID NO: 691 - DNA, 885 bp, Phyllotreta cruciferae
atgccagcagctactttgggtagcatttcacatcctaacaatgaagactgcggcattcgggacgtttgggctcacaatttagaagatgaatttcgaactataaggcaaatagtgcagaaataccaatatgtcgcaatggacactgaatttcccggagttgtggctaggcccataggtgaatttcgaagttcggccgattaccaataccaaatgttaaggtgcaacgtagacttactgagaattattcaactaggtttaacgttcttagatgataatggtaaaacaccaggaggtgtttatactacctggcaattcaattttaaattcaaccttcaagaagacatgtatgcacaagatagcattgatttactgcaaaattcaggaatccaattcaagaagcacgaagatgaaggtatcgagccgttagagtttgccgaattactaatgtcatctggaatcgttctcatggaaaatatcaaatggttatcgtttcattccggctacgattttggctatttaataaagttactaaccgacaacaatctcccacaagatgaaactgaattcttcgatctgttgaaattgtattttcctacgatatacgacgtgaagtatttaatgaaatcgtgtaaaaatttaaaaggtggtcttcaagaagttgccgaacaattagaattggaaaggattgggcctcaacatcaagctggatcggactcgcttttgaccggaatggcctttttcaaaatgaaagagatgttttttgaggatactattgacgattcgaagttttcgggccatctttacggcctcggaacgtctttcactgttaatggtacaactaacaattacggaaacgataacggcgacacaacaaattcctcatga

SEQ ID NO: 692 - DNA, 1212 bp, Phyllotreta cruciferae
atggcggaagctcagaaaaggggggcctcggtgttcgaggacctctcgaacgtcgaattcgagaccagcgagaacttagatgtgatcgaaaagttcaaagacatgaagctgaaggaggagctgcttcgcggcatcttcgcatatggtttcgagaagccttcggctattcagcaaagggccattattcctgtgatgaaaggccgagatgttatagcccaagcacagtcaggtaccggtaaaaccgctacattctccatagctattctgcaagctctggatttaacgatgagagaaacgcaggtgttgtgtttatcccctacgagagaattggctgtacagattcaaaaagttatattagctctaggggatttcatgaacgtacaatgtcatgcttgcatcgggggtacgaaccttggagaagacattagaaagttggattatggacagcatgttgttagtggtacacctggaagagtttacgacatgattcgtagaagagctctgagaactagatcagtgagaatgctagtactagatgaagctgatgaaatgctaaacaaaggcttcaaagaacaaatctacgatgtgtacagatttcttccaccgtccactcaagtggttctcatatctgctacgttaccccacgaaattttggagataacatccaaattcatgaccgatcccatcaggattctagttaaacgtgacgaactgacgctggagggaatcaagcagtttttcgtggccgtggagagggaagaatggaaattcgacactctatgcgatctctacgacaccttaaccatcacccaagccgtaatattctgcaatacgaagagaaaggtggattggttaaccgagaagatgcgagagaacaacttcactgtgagctctatgcatggagacatgcctcagaaagagcgtgacaacattatgaaagaattcagatcaggccagagtagagttttgattactactgatgtatgggctagaggtatcgatgtgcaacaagtatcgttggttatcaattacgatttgcctaataatcgtgagttgtatattcatcgaattggtcgatctggtcggtttggaaggaagggtgttgctatcaatttcgttaaatccgatgatattaggattttgagggatattgaacaatattattcaacacaaattgatgaaatgcctatgaatgtggctgatttaatttaa

SEQ ID NO: 693 - DNA, 1599 bp, Phyllotreta cruciferae
atgaccgctcctgctgccggtggagatgcaagaggaagaactcttgcctacaaagacaaaagcaaacccgccgatgtccgaactagtaacattaacgccgctaaggctgtttgcgatgcaattcgtactagtttggggcccagaggaatggataaaatgattcaagctggtaacggagaagtaactatcactaacgatggagcaaccattttaaaacaaatcaacgttatccatcctgcagcaaaaatgttggtggaactgtcaagagctcaagatatcgaagccggtgatggtacgacttccgttgtagttattgccggagcccttttagatgctgcggaaaagttgctacaaagaggaatccacccaacggctatttcggaatctttccagagggctgctcatttagctgtcgaaattctacaagaaatttcaacacccgtagaaatcactaacagggagttattaatcaagagtgcatccacttcgttgaattctaaagttgtatctcaacagtcgagtctcttaggacctttggcagtcgatgctgttcttaaaattgttgaaccaggacaagaacaagcatgtaacttattggatgtcaaagtgattaaacaattgggcggtactgtggaagataccgagttgattgagggtatcgttttctcgcagaaatctgctaacgtatctggcccgaagagaatcgaaaaggctaagattggtctcatccaattctgcatttctcctccgaaaactgacatggaccacaatgttattgtatcagattacgctgcgatggatcgagttttgaaggaagaaagagcttacattttgaacattgttaaacagatcaagaaagccggttgcaacgttcttttggttcagaaatcgattctcagagatgctgtatctgatctagctcttcactttttggataaaataaagtgcatggttgtcaaggatattgagcgagaagatatagaatttgtatgcaaatcgttgggttgccgaccaattgcatcactcgatcatttcaccgcagagaatctagtaactgctgatttggtcgaagaagttggagtaggcggtaaccgaatggtaaaaataacaggtattcaaaacgccgggcgtactgttaccctactcgtgagaggctcgaataaactagtattagaggaggctgagaggtctctgcatgacgctctttgcgtcattcgttgtcttgttcgcaagaaggcgctgatcgcaggtggcggggcaccggaaatcgaagtcgcccttaagctggctgctatggctaataagttggagggcattgatgctatttgcaccagagcttatgctactgctttggaaattataccgtttactttggcggaaaatgctggattgaatcccatacagacagttacagaattgaggaacagacatgcgaaaggtgaaacttctgctggtattaatgttcgtaagggcaccattacagacattttggaagaaaatgttgtacaaccgctgttagttagcacatctgctttgagctttgccaccgaaaccgtcagatccatattaaaaattgatgatattgtaagtatattctaa

SEQ ID NO: 694 - DNA, 1074 bp, Phyllotreta cruciferae
atggaggctatggatattgtaataccagagaaagaggaaggcagcccttccgaagtcaagcaagtcctgcaagatctagacatggaggatttgtacacgaaatacaagaaactacagcaaaccttggaattccttgaagtccaggaagagtacatcaaagacgagcagaggaacttgaaaaaggagtacctacacgcacaagaagaagtcaaacgtatccaatcagtaccgctggttatcggccaattcctagaagcagtagatcagaataccggcatcgttggatcaactaccggttcgaattactacgttcgcattctctccaccatcgacagggaattactgaaaccctctgctagcgtagccctacacaagcacagcaatgctttggtggacgtgctaccccccgaagcggactcctcgattagcatgctccaagccgacgagaaaccagacgtacaatacagcgacatcggaggtatggatatgcaaaagcaggagattcgagaggccgttgagctgccgttgacccacttcgagctgtacaaacaaatcggtatagaccccccgaggggtgtgctgatgtacggaccacccgggtgtggcaaaaccatgctagctaaagccgtagctcatcacaccacagctgctttcattcgagtggtgggttcggagttcgtgcagaagtacctgggcgaggggccgaggatggttagagacgtgttccgtctggctaaagagaattcccctgctattatattcatcgatgaaatcgatgcgattgctactaagagattcgatgctcagacgggagccgatcgggaggtgcagaggattctgttggagttgttgaatcagatggacgggttcgatcaaaccaccaacgtgaaggtaataatggctacgaatcgagctgatacattggatcctgctctacttaggccgggtcgtttggataggaaaatcgaattcccattgcctgatagaaggcaaaagcgattgatttttagtactatcacttcgaaaatgaatctatccgaagaggttgatttggaggattatgttgccaggcct

SEQ ID NO: 695 - DNA, 489 bp, Phyllotreta cruciferae
atgccaaatataaagctgcaatcttcggacggcgagaccttcgaaatcgacgtcgaaatcgccaagtgctcggtgacgataaaaaccatgctggaggacctcggcatggacgaggaagaggaggaagtggtgccgttgcccaacgtaaactcagccattctacggaaggtcatccaatgggccacctaccacaaagacgacccacccccgcccgaagacgacgacaacaaagagaagcgaacggacgacatatcctcgtgggacgcggatttcctgaaagtcgaccaaggcacactattcgaactgatcctagccgcgaactatctcgatataaaaggcttgctggatgttacttgtaagactgtggccaacatgataaagggcaaagcgccggaggaaatacgtaaaacgtttaacatcaaaaacgatttcacgccgtccgaggaagagcaagtgcgcaaggagaacgaatggtgcgaggagaaatag

SEQ ID NO: 696 - DNA, 930 bp, Phyllotreta cruciferae
atggacgataaggcttcatgtaaggaactagatcaatggatagaacagttaaatgactgtaagcaattaaccgaaaaccaagtgaaaactctgtgtgataaggcgaaagaaatactgtccaaagaatcaaatgtgcaggaggtaaaatgtcctgtcaccgtttgcggagatgtacacggacaatttcacgatctgatggaattatttaggataggtggccgaagtccagatacgaattacctttttatgggtgactatgtcgatcgtgggtattattccgtcgagactgttactcttttggtggctttgaaagtcaggtataaagaaagaattacgatcctgaggggaaaccatgaatcaagacaaatcactcaagtatatggattctacgacgagtgcctgcgaaaatacggaaacgcgaacgtttggaaattcttcaccgatttgttcgattacttgccgcttacagcgctcgtcgatagtcaaatattctgtttgcacggagggctcagtcctagcattgataccttggaccatattagagccttagatcgtttacaagaggttcctcatgaaggtccgatgtgcgatcttctctggtcggatcccgacgatcgcggaggttggggcatttctcctcgcggtgcaggatatacctttggacaagatatatcggaaacgttcaaccacagcaacggtttgacgttggtctctcgggcccatcaacttgtcatggaggggtacaattggtgccatgacagaaacgttgtaacaatcttcagtgctccaaactactgctatagatgtggtaatcaagctgccattatggaattagatgatgcgcttaaatattcattcttacaatttgatccagcaccgagacgtggtgagcctcacgttacccgcagaactccggattatttcctttaa

SEQ ID NO: 697 - DNA, 918 bp, Phyllotreta cruciferae
atgcagatcttcgtaaaaacgcttactggaaagaccatcacccttgaagtcgagccatccgacactattgagaatgttaaagccaagatccaggacaaagaaggtatcccaccagaccaacaaagattgatcttcgccggaaagcaattggaagatggccgtactctttccgactacaatatccagaaggaatctacccttcacttggtacttagacttcgtggtggtatgcagatcttcgtaaaaactctcactggcaagaccatcacccttgaagtcgagccatctgacaccattgagaatgttaaggctaaaattcaggacaaagaaggtatcccaccagaccaacagagattgatcttcgcaggaaaacaattagaagatggccgtactctttccgactacaatatccagaaggaatctactcttcacttggtacttagacttcgtggtggtatgcagatcttcgtaaaaactcttactggaaagaccatcacccttgaagtcgagccatctgacaccattgagaatgttaaggctaaaatccaggacaaagaaggtatcccaccagaccaacagagattgatcttcgccggaaaacaacttgaagatggccgtactctttccgactacaatatccagaaggaatctaccctccacttggtacttagacttcgtggtggtatgcagatcttcgtaaaaactcttactggcaagaccatcacccttgaagtcgaaccatccgacaccatcgagaatgttaaagccaagatccaggacaaagagggaattcccccagaccagcaaagattgatcttcgcaggaaaacaattagaagatggccgtactctttccgattacaacatccagaaagaatctacattgcatttggtactccgtcttagaggaggacagtaa

SEQ ID NO: 698 - DNA, 1623 bp, Phyllotreta cruciferae
atgatgcaacctcagatattactcctcaaagaaggcactgattcgtcgcagggcaagccccaattgatatctaacataaatgcgtgccagagtatagtggacgctatacgcacaactctgggccccagaggcatggacaaattgatcgtttccaacagaggctcggccaccatctcaaacgacggagcgacaatactaaatttactagacgtggtgcatccagcagcgaaaactctagttgacatagcgaagtcacaagacgccgaagtaggcgatggcacgacctcggtggtgctgttagccggcgagtttttgaagcaactcaagtcctacatcgaagaaggcgtccacccgaggatcatcatcagagccgtgcggaaggccacccagatctgcttggagaagatcaacgcgctggccgtcaaaatcgacaaatccaacgccgaggagtacagatcgctgctggacaaatgcgccgccaccgcgatgagctcgaaattaatcaacaaacagaaatcgttcttctccaaaatggtagtcgatgccgtgttactcctcgacgaacttctaccgttgaacatgatcggtataaagaaggtccaaggcggtggtttggaggaatccatgttggtagccggagtggccttcaagaaaaccttctcgtacgccggattcgaaatgcagcccaagatctacaaagactgcaagatcgccctgttgaacatcgaattagaactgaaagcggagagggacaacgccgagatccgcctgagcagcgtcaaggagtaccaaaaagtagtcgatgcggagtggaacatcctgtacaacaaactcgagaaaatctacgaatccggtgctaacgtcgttctatccaaactacccatcggcgacgttgccacgcagtacttcgctgatagagacatgttctgcgccggaagggtccaagaagaagacatgaagaggactttaaaagcctgcggtggctccgtgatgaccacagccaacgatttgaaagacgaagtgctaggtaaatgccagctgttcgaagagaaacaaataggaggcgaacgatacaacttcttcaaaggctgtcccaacgccaaaacctgcaccattatcctaagaggaggagccgagcaattcttagaagaaaccgaaagatccttacacgatgctattatgattgtccgcagaacaatcaaaaacgactccatcgtagcaggcggaggagcaatagaaatggagctgtcgaaattacttagggattactctcgtactattgctggtaaagaacaactcctgattggagctatagcaaaagcgctagaaataatccctagacagctatgtgacaatgctggtttcgatgctacaaatatactgaacaaactgcgacagaagcacgctcagggcaattcttggtatggagtggatgtcaacatggaagatattgcggataactacgaaacttgcgtgtgggagccagccattataaaaattaacgctttaacagcagctgcggaggccacttgcttgatcttgtctgtggatgagacgatcaagaaccagaaatctgaagcgcccccgcaaatgggaggtcgtggaatgggtagacccatgtaa

SEQ ID NO: 699 - DNA, 2673 bp, Phyllotreta cruciferae
atgagtcgtcagggccccagcaaacgttacgactcggattcggattccgatagcgtggacagcgcggaggaggcccgcaagcgggacctgcaggaacgagacgaattcgccaatcgtctcaaaaagcgggatgaggatcgtacgagaaacgtagtgcagaatttcgataaaagaacctacgaagaggcggcgaagcgcctcaagttagacaacgctggaagagataaggtgatatcggagcttcgaaagacctcgagatggaagtacctggagaagaggaaggacgacaagctgcaggaattggaggctgatattgtggatgatgagtacttgttcgaagaggaaatattaacggagagggagaagaaggagcgccagcacaagaaggaattgttacagctagcccaggagcatgagaaggcgcgggaactggagcgcattcaacgctaccacatgccgagggacttgggtaaagactcgactgcggattacatcgaagtggacgagctcgagaaagtaccgcaatccgagcagaagaaatgggagaaagaccaaatggcttcggctgtgttcaagtttggagcgaaagatgtcaagaaaaccgacgattacgaactactactggaggatcaaatcgatttcatacaagcgctacaaatgccgggaagcagcgagaagaaagtacccgaactatccgatgtacaaaagaagaaacttaccatcgaagaaacgaaaaaaagcctaccgatttaccctttcagagacgatctaatacaagccgttaaagagtaccaagtgctgattataaaaggtgaaaccggttctggtaaaaccacacaaataccgcaatatctccacgaagccggtttcactgctgatggtaaaaaaatcggttgtacacagcctagaagagtcgcagctatgtcagtagcagccagagtagcccaagaaatggacgtaaagctaggcaacgaagtcggatacgccatcagattcgaagattgcacttccgaacgaaccgttataaaatacatgaccgatggtacattacacagggagtttctatcagaaccagacttgcaatcttacagtgtaatgattatagatgaggctcacgaacgaacactgcacactgatatattattcggtttggtgaaagatatagccagatttagaccagatttgaagctgttaatatccagtgctacgttagatgttaccaagttttcggagttcttcgatgatgctccggtgtatcaaatcccaggcaggagatttccagtggatatctactacacgaaagcccctgaagccgattacgtagacgcttgcgttgtctctatactacaaatacacgtaactcaaccattgggtgatattttagtattcttgaccggtcaagatgagatcgaaacttgccacgaactcctgcaggatcgagtacgacgtttgggttcaaaagttaaagaactgattatacttcctttatatgctaaccttccgagtgatctgcaagctaaaatattcgaaccgactccaccaggtgctagaaaggttattcttgctactaatatcgcagaaacttcactaacaatcgataacattatctatgtaattgatccaggttttgccaagcaaaaccacttcaattccagaacgggcatggagagtttgatggtggtgcctatatctaaagcttcggctaaccagcgagctggaagggctggaagagtggctgccggtaaatgctttaggctgtacacggcctggtcctataagcacgaattggaggaaactaccgttccggagatacagaggatcaatttggggaacgctgtgttgatgttgaaggcgttggggattaacgatttggtgcatttcgattttctggatcccccaccgcacgaaacgctggtgttggctttggagcagttgtacgctttaggggctttgaatcatcacggcgaattgactaaattgggaagaagaatggctgaattaccggtggatccgatgatggccaaaatgatattggcatcagagaaatacaagtgttccgaagaaatcgttactataggagcaatgttgtcagtgaacggggccattttctacagaccgaaagataagattatccatgcggatacggctaggaagaatttcaatcacttggctggcgatcacttgagtcttttgaacgtttataatcaatggagagactccgattactcgttgcaatggtgttacgaaaacttcattcaacacagatctatgaagcgagccagagacgtcagagaacaactagtcaacttaatgaccagagtagaaatcgaaatagtatccggaatcgatgaaaccgataacgtccgcaaggctatcacatccggatacttctatcatatcgccaggttttccaaaggtggtagttacaaaactgtgaagcataatcaaagcgttactatacacccgaacagtgctttgttcgaaacgttgccaaggtgggttttgtaccacgagttagtgttcacgactaaagaattcatgaggcaagtcatcgaaatcgagagtaagtggctgttggaagtggcgccgcattactacaaggccaaggaattggaagattccaccaataagaaaatgcctaaaactgtcggaagaagtaaaatgactgattaa

SEQ ID NO: 700 - DNA, 1371 bp, Phyllotreta cruciferae
atgaaggtagaagaggtgaaaagcaccgtgaaaactcaacgaataagcgcccatactcacataaagggtttgggattagatgaagcgggtttcgcaatcccttcggcggccggcctggtcggtcaggagcaggcaagagaggctgcaggagtcgtcgtggacatgataaaaagcaagaaaatggctggtagggctgttcttctagccggccctccaggtacgggtaaaacagccattgcactagcaattgcccaagaattgggtaacaaagtgccattttgtcccatggtgggctcggaagtttacagcacggaaataaagaaaaccgaagtccttatggaaaatttcagacgagctattgggcttagaattagagaaacaaaggaagtctacgaaggagaagttagcgaactgacacctgtcgaaacagaaaacccagcaggaggttacgggaaaactgtcagtcatgttgtaatcggtttgcgaacagccaaggggagcaagcaattgaaactggatcccagcatatacgaagccctgcaaaaagagaaggttgaggtgggggatgtcatttacattgaagccaccagtggggctgtgaaaagacagggaaggtccgatgcttatgctacggaattcgatttggaagccgaagaatacgtacctcttccgaagggagatgtgcacaagaagaaggaagttgtacaggatgttactttacatgatttggatgctgctaatgcgaagccacagggtggtcaagacgtgttatccatgatggggcaactcttaaaaccaaagaaaaccgaaattacagataaactcagaaaagaaatcaataaaattgttgacaaatacattgatcaaggtattgctgaattggtaccaggtgttttattcatcgacgaagttcatatgttggatatagaaacattcacttatctccatagagctttggaaagcgctatagccccgattgttatttttgctactaatagaggtcgttgtcttattagaggaaccgatgatgtattttctccgcatggaattccattagatcttctagataggctgctgattatccgtacgattccttacaacaaatccgaaatggagcaaattattaaattgcgagccgttacagaaggtttggaaattgagccggaagcaatctcaagcttgggagaagttgggacaaaggccaccctgagatacgcagttcaactattaacgccatcatttttaacagctaaaattaatggaaggagtaacattctccaaagcgacgttgaagagattggttgtctattccttgatgccaaatcttctgctaaaatacttaccgagcacaaagataaatttatgacgtaa

SEQ ID NO: 701 - DNA, 1977 bp, Phyllotreta cruciferae
atgacttcaataattaaagtacaagccttatccggcgccaaagatgaatctcccccttgttacctattgcaggtcgacgacgttagaattctattagattgtggttgggatgaaaaatttgatatggaattcataaaagagcttaagaggcatgtacatacaattgatgcagtgttaatatcttacccggataactatcatttaggagctctgccttacgcagttggtaaattaggtttaaattgtccaatatacgccactataccagtgtacaaaatgggtcagatgtttatgtacgatctgtatcaatctcagtacaacatgaaggaattttgtatattttctcttgatgatgtcgatgccactttcgaaaaggttattcagttaaaatataatcaaactgttcccttaaaaggcaaaggatatggcataactgtgacacctttacccgccggtcatatgatcggaggaaccatatggaaggtaaataaagtaggcgaagaagatattgtttactgcaacgattttaatcacaaaaaagaaaggcatttgaacggttgtgaactgaagaaacttcaaaggccatcgttactcataacagatgcatttaatgctacatatcagcaggctagacgaagggcgagagatgaaaaattaatgacaaatattctccagactttacgaaaccacgggaacgtccttatagccgtagacactgctggtagagtactggaattggctcacatgttagatcaactgtggagaaacaaggaatccggacttttggcttattcattggcttttttgaacaatgttagttataatgtcgtcgaatttgccaaatcacaaatagaatggatgagcgataatttaatgaggagtttcgagggagccagaaataatccattccagttcaaatatttgcagctatgccacagtttaggggagttaagcaaagtgcccagtccgaaggtcgtattggctagttcgcctgatttggaaagtggattttctagggaactgtttttacaatggtgttctaatcctaataacagtattatattaactacaaggacctcacctggaactttagccagggatttaattgacaatggaggaggaagaaccatagacttgatagtagagcgaagagttaaattggaaggccaagaactcgacgattatgaaaggcgacaaaggtctaaatatgacaaattagaagaagatgaagccgattctgattcggattccgatattgaaatgtcagtcacctccaaaggcaaacatgacattgttatcaaacaagaaggcaaaatatccacgggattttttaaagtcaccaaaaaaatgtaccccatgtatcctttcaaggaagataaaataaaatccgacgaatatggcgaaattgtgaaagcagaagattacaaattagcggaaatttcagctgaaggcgaagataacaaagagaacatagtgattaaaaaagaggaagaggaaataactgaaattactgagcaaccaaccaaatgtataattcttcaacgaacagttcaagtaagttgtcaagttcaatacatcgatttcgaaggtagatcagatggagaatcgttgatgaagattttaacgcaattgaaaccgagacgagtgattgttgtacatgggactgaagaaaatacatctgttatagaaaagcattgcttggataatttagaagctagagttttcactccgtccagaggtgaaataatcgatgccaccagcgaaactcacatttaccaggtgaggttgacggacgctttggtttcacaattgagttttcagaaagccaaggaagctgaagttgcttggctgggagctcacatagtactaagagaaagccaagctgacgctaaaaggatgaatttggataatgaagaaatggaaggtaattcttgcagcttctatcagcagctcttcttgcagctctctaaagtttaa

SEQ ID NO: 702 - DNA, 2274 bp, Phyllotreta cruciferae
atgcctccgttggaggtaacagcaaacaccaacaacgaggaatcagcgcccataaacccggtagtgggcataatctaccctcccccggaggttagaaacatcgtcgacaaaaccgccagtttcgtggcgcgaaacggccccgaattcgaagcccgcatcagacagaacgagctcggtaaccccaagttcaacttcctcaatggcggcgatccctaccacgcctactaccaacataaagtcaaagatttcagggaagggaaaggtcaagagcccactccgggcttgagccaagccgtagccaaactatcggtgagcgcctcagcgcagcaaaaacaacaagagatattgaagcaagtcgagcagccgttcgtaccgaaagatcctccgtctgagttcgagtttatagccgatcccccttcgatttctgctttagatttggatatcgtgaagcttactgctcaattcgtagctagaaatggtcgagcttttttaacccaattgatgaatagagagcagaggaacttccagttcgatttcttgaggccgcagcattccttgttccaatatttcaccaagctgttggaacagtacactaaagtactaatacctccgaagagcatggagcagaggctcagagacgaagccaaaagcgccaaagccgtcctagagcaagtcaagtacagggccgaatggttgcggtatcaggaacagcaaaaggccaaggaagaggagatactcgagagagaacgggtggcgtacgcgcaaatagattggcacgatttcgtggtggtggaaactgtcgattaccaaccgttcgaaatagggaatttcccgccgcctactacccccgaagaagtgggtgctaggatactcatacaggagaggatcgaagaaggcgaagatatcgaaatgcagttggagagcgatgaagatgacgatacgaacgctgatgacggtttgagttccatgcaggataagacgaagcgcaaaggaggcgatgataatcgtttgcaggacatggaagaggatacttctgatgaagataatgatgatgatagcggtaaaacgggagcggcttcatcgctcattcaaccgccattgccgcctataccggataaagtgctggtgaagaaatacgatcctaaacaagccgtaaaagtctccagaccgacagtaggcgacgactatctagtatcccccatcacaggcgaaaaaatcccggccagcaaagtccaagagcacatgcgcatcggcctactagacccccgatgggtcgaacaacgagacaagcaaatgtccgataaaatgaaccaagacacggtgtacgcggccggcagcgccatcgacgcttcgctgaagcttctagccgaacgacgtacggatattttcggagtaggcgacgaagagactgctatcggtaagaaaatcggcgaagaagacgtgagaaaggacgaaaaggtgacgtgggacgggcacacgagcagcgtggaggcggcgacgagggcggccagggccaacatcacgttggaggagcaaattcatcagatacacaaagtaaaaggcctgttgcctgacgaagagaaggagaagatcgggccgaagaatatcggctcgaagaagatcaatatacagagcgttatcactacgaagccggcgaatcaagccacgcagcaacccaaaccgcctgtctcgataatccaaaccagcgcccagccgataatgccggttccaacgcaacctacgatgctggccccgcaaccttccatcatgatgatgccagcgccgcctatgcccactattcgaccgccgccgttgatgatgcccggaggtgtagcgatgggtggttatcccgtaggccccatgcccccggggcccggcatgaacatggcccccatgaagcatccgaacgaaggtcccagcgaagaggagccgagcaataagaagttgcgaaacgaggattcgttggtgcccgagaacgtgttcttgtccaggaatccgagtcaagtgtctatcaagatttcgataccggtgatgccggagaagagcgaatggaggttgaagggacagatggtgtcgtggacgttggctttgaccgagagcgtgtcgaatttgaaggctaaaatacaggaggaaactaacatgccgccggcgaaacagaagttgttcttcgatgggatgttcttcaaggattccaacacgttggcctactataatgtaacgcaaggagccgtcattcaattgcagatcaaagagagaggcggaaggaagaaatga

SEQ ID NO: 703 - DNA, 1005 bp, Phyllotreta cruciferae
  misc_feature (971)..(971): n is a, c, g, or t
atgccgagtacagaggttacaacgactaaggtgatagtgcacccgctggtgcttctcagcgtagtggaccatttcaatcgaatgggcaaaatcggcaatcaaaagcgtgttgtcggtgttctactcggttgctggagggccaaaggagtcttagatgtatccaacagtttcgcagtccctttcgatgaggacgacaaagacaaatctgtatggtttttggaccatgactacctggaaaacatgtacggcatgtttaagaaagtcaacgctagagaacgcgtcgttggttggtaccacaccggtcctaaattacaccaaaacgacatcgctatcaacgaattaattcgaagatactgccccaattcagtcttggtgattatagatgcgaaacctaaagatctggggcttcctactgaagcataccaagcggtagaagaggtccatgatgatggctctcctacatctaaaacgtttgaacacgtcccgagcgaaataggcgcagaagaagctgaggaagtcggagtagaacatttactaagagatattaaagacactacagtgggaactttatctcaaaggattactaatcagttattaggccttaaagggttgcatttgcaattgagagatataagagactatttgatgcaagtgtgcgataacaaactgcccatcaatcatcagatcatctatcaattgcaggatattttcaatttgttgcccgatataaatcaagatgcgttcaacaattcgttttatgttaaaaataacgatcaaatgcttgtagtttatttaggggctctcgttcgatctatcgttgcattgcacaacctaatcaacaacaaactcaccaacagagacgcagaagaaggcaaaaaggaagagaaaaaggacaacaaggataaagatagcaaagacaaggataaggaaaaaacggacaaagagaaggaagcgaagaaggacgagaagangaaaaaggacaacaaggataaagatagcaaagac

SEQ ID NO: 704 - DNA, 1653 bp, Phyllotreta cruciferae
atgtttggaggaggacgcgccccgattttagtgttgagccagaatacaaagcgcgagtcgggccgaaaagttcagttggagaacatcaatgccggcaagcaaatcgcagatgtcattagaacatgtcttggtccgcaagccatgttaaaaatgttgatggaccccatggggggcatcgtgatgaccaacgacggcaacgccattctgcgagagatcaccgtgcagcatcctgccgctaaaagtatgatagaaatagccagaacccaagacgaagaggtaggagatggtactacttctgtaattgtattagctggagaaatgttggccgctgctgaacagttcctcgaacagcaaattcaccctacgatcatcatcagacaatacaggcaggccctcgaagatatggtgcaatttctggaaggacccttaagcgtgcccttagatcgaaacgacaaaaacgccgtagcccaagtggtcaaaggctgcataggaacgaaattcttgagcaagtggtcggatttggccgtcaatatcgctttagatgcggtaaataccgtcttattagaagaaaatggtcgaacggaggtggacatcaaaaggtacgccaaagtcgaaaagattcccggtggttcggtggaggaatccaggatattgagaggcgtaatgttgaacaaagacgttacccatcctaaaatgaagcgacacatcaagaatccgagaatcatccttttggattgcgctttggaatacaagaaaggagaatctcaaaccaacgttgaaattagcaccgaaactgattttaccaaactcctcgaattggaagaagagcacgtcaagcggcaatgcgacgagataatcgccctcaagccggacgtagtgttcaccgaaaagggagtatccgatatagcccagcacttcctgctcaaggccggcatcaccgccatcaggcgtgtcagaaagtcggataacaaccgaatcgctcgagcttgtggcgctgtcatcgtcaacagaacagaggaactccaggagtccgacgtcggcaccggagccggcgtattcgaaatcaagaaattcggcgacgagtacttctgtttcatcgacgaatgcaaaaatcctaaggcctgtacgatccttctgcgaggagccagcaaggatattctgaacgagatcgagcggaacctccaagatgccctgcaagtggccaggaacatagtgctgtctccgcgtttggtgcccggcggtggggccattgaaatggccgtagcccaacggttgatgcaaaaggccacgcacggcccctaccgggcgctcgcccacgctttggaaatcattccgagaacgttagcgcaaaattgcggagccaataccatcagaacgttgacggctctgagggccaagcacgccaaccacactgacaccgagaaaccgtgcacttggggaatcgatggcgaaagtggggaattggtcgatatgaaaatcaaaggcttgtgggagccgttgtctgtgaaacttcaaacctacaaaacagccgttgagaccgccattctcctgttacgtatcgacgatattgtatcgggatccaaaaagaagggtgacaaggaggtcccgacgcccagtcaaatgcaacagcaggaagcccaaggaggggactaa

SEQ ID NO: 705 - DNA, 702 bp, Phyllotreta cruciferae
atgatgcaaacaggagtacgtccctattatccagactattctacaattcccgttgaacgccagattaatccgtacgctgataatggaggaagcgtagtagcaattgcaggaaaagattttgtggttattggcgcagatacgcgtcttagttccggcttttccatatacactaggaaccagaacaagctgtttcctctatctgagacaactgttttaggatgttcaggttgttggtgcgatactttaacgttgactcgtattataaagtctcgtatgcaaatgtactatcaagagcacaacaagaacatgtctacaacagcggctgctcaaatgctgtcgaccatgttgtactataagcgatttttcccttattacatatcaaacattcttgttggattggataatgagggaaaaggttgtgtctacagctacgatcccgttgggcattgtgaaaaagctacctatcgagcgggtggttctgcaggggctttgcttcagcccttattggacaatcaaattgggcaaaaaaatctacagaagccttcgcaagaagatcttactcaggaaaaggccatttctacactgaaagatgttttcatttcggctgcagaaagggatatttacactggtgatagtgtacttattaaaatcattacaaaagatggaatgaaagaagaaacgtttgatttgagaaaagattag

SEQ ID NO: 706 - DNA, 900 bp, Phyllotreta cruciferae
atgttccaattcggcttcaacatgttcccggacatcccgaggcccttcaacatgacctacaagtgctactcggtggccatgttcccgggaaacgaaagacaggacgtcgaacgtggtggaaaaataatcatgccgccttcggcactggaacagcttactcgattaaacattaactaccccatgttgtttaaactagttaataagaagacaaatcgtacgactcattgcggtgtattggagttcgtagcggacgaaggaaaggtctacctaccattatggatgatgcacaatttggtactaaccgaaggcgatttggtgcaaatggaaagcgtttcgttgccagtgggaacgttttccaaattccagccgttgaatccggatttcctcgacatcaccaacccgaaagccgtactggagaattgcttgcggtcttttgcttgtctgaccaacggcgacgtgatagccgtgaggtacaatcaaaaggcctatgaattgtgcgtgttggaaaccaagcccggtaacgccatcagtataatcgaatgcgatatgaatgtggaattcgcggctcctgttggctacaaggaacccgaacatgctaaaaaagaagaagaaatgtcggtggatcccgcagatttaatgcccgaaccgtcgggattcgtggcttttaggggggccgggaatcgattggatggtaaaaaacgcaaagattcttcctctaatgatactccttcggttaaaccggcttacgttaggggaattcccgactacgattatcaaattggcactctagatttcatcaggcgtacgatagcgaagcctaaagagaaggagaatagtgaagatggggacgatttcaaggcttttagtggtactgggttcagtttgagaaataggaattag

SEQ ID NO: 707 - DNA, 1623 bp, Phyllotreta cruciferae
atgtcggccttaccaggagctatcgctttcgacgaatatgggagaccatttataattctaagagaccaagacaagcaaaaacgattgaccggaatcgatgccctgaagtcgcacattttagccgcaagtcaaattgctcacactgttcgcacctctttggggcccaagggcttggacaagatgatggtctcctctgatggggaagttactgtaacgaacgatggggctactattttgaagatgatggatgttgaacatgaagtagctaaattgttagttcaactatctcaatcacaggatgatgaaataggagacggaaccactggtgtagtagtattagcgggggctcttctggaacaagccggcgccctcctggaccgtggaattcatccgataagaatagcggatggtttcgaattggcatgccaaacggcagtggatcatttggagaaaatcgccgaactgtttccaatttccgctgaaaacaccgagccccttgtaaaagttgcgatgactacattaggttcgaaaatcattaacaagtgtcacaggcaaatggccgaaattgccgtaaatggcgtgttagcagtagccgatctccaacaaaaggatgtcaactttgaactcattaaagtagaaggaaaggttggtggtaaattggaagacacgacattagtaaaaggcgtcgtcatagataaaacaatgtctcatcctcaaatgccgaaggaacttaagaatgttaaattggccatcctcacctgcccgtttgaacctcccaaacccaagaccaagcataagttggacgtcaccagcgtcgatgactacaaagaactaagattgtacgaacaagaaaaattcaaggaaattgttggcttagtcaaaaaagctggagctaccttggctatttgccaatggggatttgacgatgaggccaaccatttgctgttgcagcaggagttacctgctataagatgggttggcggtccagaaatagaactcatagctattgcgaccggtggaagaatagttccacgattcgaggaactcagccccgagaaacttggttctgccggtttggtacgtgaaatatcgtttggaactaccaaagataagatgatggtgattgaagaatgctcgaattcccgtgccgttaccattctcgtcagaggcggtaatcaaatgttggttgatgaagccaagaggagtttacacgatgctttgtgcgtagtgaggagcttgattcaggaaccaagagtcgtgtatggaggaggtgcagctgaaatagcttgcagtttagctgtggctgctcaagccgatcagttagcttctttggaacaatacgcttatcgggcatttgccgaggcattagaaagcattccgctggctctagctgagaattcgggtttctccgccattcatactttgggagaaatcaaggcaaagcaagctgcatctggggatccggcacttggcgtggattgcatgaatattggcaacataaacatgagagaacagcatgttacagaatctctgcgatctaagaggcaacaattgttgttggccacgcaattagtgaaaatgattctgaaaattgacgatgtacgtcagcccggctccggctaa

SEQ ID NO: 708 - DNA, 342 bp, Phyllotreta cruciferae
atggccactgctatggacgtcgattccgaagaaattgaattaccaacttcaagcagttcgaagggcgagaaaaaacgatttgaagtaaaaaagtggaatgctgtagcactttgggcttgggatattgttgttgataactgcgctatatgccgaaaccacataatggacttgtgcattgagtgccaggcaaatcaggcctctgcaactagtgaagaatgcactgtagcttggggagtatgcaaccacgctttccactttcactgtatttcaagatggttaaaaactaggcaggtatgccctttggacaatagagaatgggaattccaaaaatatggtcactag

SEQ ID NO: 709 - DNA, 1605 bp, Phyllotreta cruciferae
atggtgtcactaaacccggtgaggattctcaaacatgacgccgaggatgaaagagcggaaattgcgcgtttgagcagtttcgtcggcgcgattgccattggagatttggttagaagtaccttgggccccaaaggtatggacaaaatccttgtatcaagcggcagaaactccggaatggtagaagtcaccaacgacggagccactatattaaaatccgtgggtgtcgataaccctgctgcgaaaatcctcgtcaacatgtcgaaagtacaagacgacgaagtaggcgatggaactacgtcagtaactgtattagcatcagaattattaaaagaagctgaacgtctaatcgagcaaaagatccatccgcagactatcatagcaggttggagaaaagccgtggatatcgcgagaaaagcccttttggacgcttcgaacgacaacagcgccaacttggaagccttccgagaagatctgatgaacattgctagaacgaccttgagctcgaaaattctatctcaacacaaagaacacttcgcgaagctcgctgtcgatgccgtgctgaggttgaagggctccggcgatttgcaagccattcaattgatcaaaaaaaccggaggaactttgcaagaatcgttcctcgacgaaggtttcctgctcgataagagacccggcgtgcaccagcccaagcgagtcgagaacgctaagatcctgatcgccaatactccgatggacaccgataaaatcaaggtattcggctcgcacatcaaagtcgattccatggctaaaatcgcggaattggaatccgccgagaaagataaaatgaaagacaaagtcaacaaaatcctcaagcacaacgccaatgtattcatcaaccggcaactcatttacaactatcccgaacaactgttcgcagatgctggcgtgatggccattgaacacgctgatttcgatggtatcgaaagactggcgctggtcaccggaggagaaatagtctcaactttcgatcacccagagctcgtgaagctgggaacttgcgatctaatcgaacaaatcatgataggagaagatactctcctgcgtttcagcggagtggccttaggtgaagcctgcacgatagtcattcgaggggctacccagcaaatcatagacgaggcagatcgttcgctacacgatgcgctgtgcgtattagccgcaacagtgaaagaaagcagaatcgtattcggaggcggatgcagcgagactctaatggctacagcagtagccagagcttccattaatacagcaggaaaggaagctctcgctatggacgccttcgctagagctctgttacagttaccgaccatcatcgctgataatgccggttacgattcggctcaattgattagcgaactgaaagccgcccacaacagcggcctcaacactatgggcttgaacatggagaagggcgagttgggcgacatgcgagcattgggcattaccgaatcgttcgttgttaaacggcaagtattaatatcggccggcgaagcagctgagatgattcttcgtgttgataatatcatcaaagcggcgcccagacagcgaaccgaagacagaggaatgtgttaa

SEQ ID NO: 710 - DNA, 840 bp, Phyllotreta cruciferae
atgttcagaaatcaatacgacagcgacgtaaccgtatggagtccgcaaggacgcctccatcaagtcgaatatgccatggaagcggtcaatctcggttcggctacggtaggcctaaaaagcaacagtcatgctgttataatagcattgaaaagggcttcatctgaattgtccgcttaccagaagaagatcattcaaatcgacgatcacatcggcatcaccatttccgggctaacggctgatgcgaggattctaagcagatacatgagaaacgaatgtttgaattacaagtactccttggacgcttacatgcctttgaatagattaattaacattttaggtatcaaaatgcaacattgtactcaaagatacgatcgtagaccgttcggtgtgggtctactagtggccggttgcgatgacaacggggcccacatttaccaaacctgtccgtcggcgaatttctacaattgcaaggccatgtcgatcggtgcgagatcccaaagcgcccgaacgtatttggagaagaagctcgacgagttgtcttcgtgttcgctggaagatttgatcaagcacggtttgagagctctgagggacactcttcctcccgaggtcgatttgaacacgaagaacgtttccattggttacgtcggtaaagggattacctttaagattttggaggaagaggagactgctccttatctggctctaatcgagggcgaggaacgtagaggaggagccggaggaggcggtagttcggaaggacaagccgatcctttgagagaatcgggggacgatggtcccaaagatcccgtaccggctgtagcgatggatactacggaataa

SEQ ID NO: 711 - DNA, 2550 bp, Phyllotreta cruciferae
atgggtttaaagccaggaaataaccaagaaccgatggaaataaccttccacgacgatgatttgccctacgaggaagaaattctacgaaacccctactcggtgaagcattggcttcgatatatagaccacaagaaaacggctccaaacaacgaaatgaatataatattcgaaagggccctcaaggaactaccgggttcgtacaaattgtggtacaattacctacgaaccagaagaaatcaaatcaaaagcaaatgcatcaccgatccgggctttgaagaggtaaataacgccttcgagcgttcgttggtgttcatgcacaagatgcctcgaatttggatggactattgcacgtttctcaccgatcaatgcaaaataacgagaacacgaaaggtgttcgacagggctcttcgagccttgcccgttacgcagcacaacaggatatggcctttgtatctcatgttcgtacagaaacatgatatatcagaaactgctgttagagtattcagaaggtacatgaaattgtgtcccgaaaacgccgaagagtacatagattatctaacgaaagtggaaagattagacgaagccgctataattacagctaaaatagtaaacgacgataatttcgtatcgcaacagggcaaatcgaagcatcaattatggaacgaactgtgcgaattgatttccaaaaacccggaaaaagttcgctctctaaacgtcgacgccatcatcagaggcggcctgcgcagatacaccgaccaattgggccacttgtggaactctttggccaattactacgttcgcagcggtttgttcgaacgggctagggacatctacgaagaggccattcaaaccgttaccaccgttagagatttcacgcaagtgttcgatgcttatgcgcaattcgaagagttaagtttgagcaaacgaatggaagaagtggccactaagcagaaccccagcgaagacgatgataccgaattggaactacgtttggctcgattcgaatatcttatggaaaggagattgttacttttaaattcggttttgttgcgacagaacccgcacaatgtgcaagagtggcacaaacgagtgcaactttacgaaggtaaaccacacgaaatcatcaatacatataccgaagcggtgcaaactgtggaccctaaactggccgtaggaaagctgcacacgttgtgggttgaatttgccaagttctacgaaagcaacgagcaaatcgaagaggcccgattgatattcgaaaaagcctcccaagtgccttacgtgaaagtcgacgatttggctaccgtttggtgcgaatggaccgaaatggagattcgcaacgagaactacgacgaagctttgaagctcatgcaaagggcaactgtaatgcctagccgtaaagtggcttaccacgatgatacagaaacagttcaaagtagactttacaagtcgctgaaagtgtggtcgatgtacgcagatttagaggaaagcttcggcagcttcaaatcctgcaaagccatctacgacaggatcattgaactgaaaatcgccacgccgcaaattatcatcaattacggcgtatttctagaggaaaacaattacttcgaagaagccttcagagcctacgagaagggtatttcgttgttcagatggcctaatgtatacgacatatggaacacctatttaaccaagtttttgaaacgttacggtggcagtaaattggaaagagctcgtgatttgttcgagcaatgtttagacggttgtccccctcaattcgccaaacatctctatttgttatacgctaaattggaggaggaacacggaatggccaggcatgcgatggctgtatacgaaagatcaacaaaagcagtaccggagaacgagatgttcgacattttcaacatatacatcaaaagagccgccgagatatacggcataccgaaaactagacaaatttacgagagagccatcgaagtcctgccggaggacaagaccagggagatgtgcttgagattcgccgatatggaaaccaaattaggcgagatcgatcgagctagagccatctatgctcactgcagccaaatttgcgatccacgcgtaacggccgagttctggcaaatttggaaggaattcgaggtgagacacggcaacgaggacaccatgagagagatgttgaggatcaaacgtagcgtacaagctgtatacaacactcaggtgaatatgatgtctgctcagatgctgagctctgcaggtagctcgagcggcaccatagcggatttagcgccgggagttaaggatggtatgaggctcttggaggctaaggcggccgagatggctggttcggtggcgcagaagcccaatattatgttcgttagaggggagactcaaggggataaaaaggataaagtggtgaatcctgatgaaattgatataggaagcgaggatgaggaggaggaagaggaggaagagatttcggtggagaagcaaaacgtgccatctgaggtgtttgggagtcttaagaagaagggaactgatgaggatgaggatgattaa

SEQ ID NO: 712 - DNA, 1116 bp, Phyllotreta cruciferae
atggcaaacggaccgatagctgaaagaaatagagacgctacgatatacgttggtggtttggacgataaagtatcagaatctctgctatgggaactcttcgtacaagcagggccattagtgaacgtacatatgcccaaagatcgcgtcaccatgatgcaccagggctatggtttcgtcgaattcatgggcgaagaggacgccgattacgctataaaaataatgaacatgataaaattgtatgggaaacccatacgagtcaataaggcttccgctcatcagaagaatttggacgtcggagcgaacatatttataggaaatttggatccagaagtcgatgagaaactcttgtacgatacgttttcggcctttggtgtaatattacaaacgcccaagataatgagagatcccgagactggaaattccaaaggctttgcgttcataaacttcgccagtttcgaggcctctgacgcttccatcgaggcgatgaacggccaatatctttgcaatcgaccaatatctgtgtcgtatgcattcaagaaggattccaaaggcgagagacacggttcggcggccgagcgattactggccgcacagaatccattatcacaggccgataggccccatcaattgttcgcagacgcaccgccgataggaatgatgccgatgagtatggcgcctccacctccgcctttaatcaccggcatgatgccccctcctccgccaacgccgggcggaatgccgcctcctcctccgccagtaccgccgccgagttcattcccagctggtataccgccgccgccattaccgccatctcaaccgccgttgccgcccggcgctccgcccgctatggcaccggtgccgggtagcgcgactaggccgccaccgccacctccgtggtcaggagcggcagctaacgttccgatgccgcccggcccgccatcgtcgaacgctggtggcggatttggggggatgctaccacctcctccgccgccgggcggcaggccgctaccgtctaattggaggcccccgcctccgccgccgccgaatttcggcagcgctagacccccgtttccgccacgtggaccacctccaccacctcctactttcgaagggtaa

SEQ ID NO: 713 - DNA, 774 bp, Phyllotreta cruciferae
atgggtcgtgttattcgagcacaacgtaaaggtgcgggatccgtattcaaatcccacactaaaaggaggaaaggggcacccaagctccgttacttagatttctccgaaaggcatggctacatcaagggtgtagtgaaagacatcatccacgaccccggtcgcggcgcccccttggctctagttcacttcagggacccctacaagttccaaactaggaaggaaatattcatcgctcccgagggaatgtacacagggcaattcttgtactgtggaaagaaagctaacctccaaattggaaatgtgttgcctgtaggaactatgcctgaaggtacaattgtctgtaatttggaagagaagactggtgaccgtggccgattggctcgagcatctggtaactacgcaaccgtgattgcccacaatcacgatacaaagaaaactagggttaaattgccatcaggagctaagaaagttatccccagtaacaacagagctatggttggtattgttgctggaggtggtcgtatcgacaagcccatcctgaaagccggtcgtgcctaccacaaatacaaggtgaagcgtaactgctggccgaaggtgcgtggtgttgccatgaaccccgtcgagcatcctcacggaggtggtaaccatcaacacattggtaaagcttccactgttaagagaggaacttccgctggtcgtaaggtgggtcttattgctgcgcgtaggaccggtcgtatcagaggaggtaaggtcgaaactaagaaggacgattaa

SEQ ID NO: 714 - DNA, 522 bp, Phyllotreta cruciferae
atgaaacccatgcctatgaactaccaccgcccatcaacgccatgccaggccagtgaggtcgaggtggagcccaagtttgtgaatgttgttgaagcgagacgcttaagaacgctcaccgcggagacggcgggcgagctggatgtccttgctctggatggtgacacgcttggcgtggatggcgcagaggttggtgtcctcgaagagggagacgaggtaggcctcgacggactcctgaagagcaccgatggcggaggactggaagcggagatcggacttgaagtcctgggcaatctcacgaacaagacgctggaagggcagcttgcggatgaggagctcagtcgacttctggtagcgacggatctcacggagagcgacagtaccgggcttgtagcggtgaggcttcttgacaccaccggtagacggggcggacttgcgagcggccttggaggcgagctgcttacggggagccttgccaccagtggacttacgggcagtctgcttggtgcgagccatgacgactga

SEQ ID NO: 715 - DNA, 1593 bp, Phyllotreta cruciferae
atggcaataagtttgttgaatcccaaagccgaagtggcgagagccgcccaagcgctggccgttaacataaccgcagccaaaggtatttcagaagtgatgaaaacgaatttgggacccaagggtaccatgaaaatgttggtgtccggtgccggcgacattaaaataaccaaagacggcaacgttctcctccacgaaatgcaaatccagcatcccactgcttcgttaatagctagagcctctacagcacaagatgatatgaccggtgacggaacgacctctactgttttagtaatcggtgaactcctgaaacaagctgacatatacatcgcagaaggcttgcaccccagaacactcacagaaggcttcgacaaagcgagagcaaaggccctcgaagtattggagaagctgaaagtacccatcgaagtcaacaaagaatcgttaaccgatgtttgtcgaacgagcttgagaacaaaattgcatcaaaatttggctgatctccttaccgatgtctgcgtcgaggccattctcgctatcaaacagtccgacaaaccggtcgatttgcacatggtggagctcatggagatgcagcacaaaaccgagacggacactcaactggttaaaggaatagtgatggatcacggtgctcgacaccccgatatgcccaagagcttgaagaattgttacatcctcacctgcaatgtgagcatggagtacgaaaagagcgaagtcaattccggtttcttctacaaaactgccgaagaaagggagaaattggtgttggctgaaagggatttcatcgagcaaagagttaagaaagttgtcgagttgaagaaggccctttgcaatggcacaaacaagtcgtttgttgttataaaccaaaaaggtattgacccgatgagcttggacatgctggccaaagagggaatcgttgctctgcgaagggccaagagacgtaacatggaacgtttggctttggcatgcggcggaatagccgtgaacagtttcgacgatttacaggaatctcaccttggttacgccgggcatgtatacgagcatgtattgggcgaaaacaaatatacgtttgttgaagattgcaaagttccccaatcggtgacgatcttaataaaaggacccaacaagcacactttgatgcagatcaaagacgccgttagagatggcttgagagctatcaataacgctatcgatgacaaagcacttatacccggtggtggcgctttggaagtggccgtaaacaaggaattgctggcttacaaagacgaaataaagggtaaatctcgcttgggcgtagccgcttacgccgaagctctgttggtcattcccaaaacgctggctgtaaactccggattcgacgcccaggataccatcgtgaagctgcaagaagaagctcgactgagcaccgaaccgatcggcctcgacttaacctctggagaacccatcaatcctaaagatgcgggcatctacgacaactacgtggtcaagaagcagattctcaattcgtgctcgataatcgccagcaacttgttgctcgtcgacgagattatgagagctggtatgagcagcttgaaaggataa

SEQ ID NO: 716 - DNA, 3126 bp, Phyllotreta cruciferae
atgtctagtgctggaatcgcagacagccccatcgatcctccagcaaagaagcgaaagctcgactcgaaaaattgcggccccgacatggcgaataacgaagcttcgggatcctcgaacgccggcgaaatcgacgagggactctactcgaggcagctgtacgtgttgggacacgatgccatgcgccgcatggccaccagtgatgtgctcgtatcgggtttaggcggtttgggtgtcgaaatagctaagaacgtgatcctaggcggcgtcaaatcagtgactcttcacgacgatgccgtttgcaccgttcgagacttgtcctcgcaattctacctcaccgaggccgatgtggggaagaaccgcgccgaggcctgctgcaagcacctctccgaactcaacacctacgtccccaccagggcctacgcgggccccctcgacgagaagatcatccagaagtacagggtggtagttctaactaacagcactcgagccgagcagctgcgtatcggcgagataacgcacaacaacgatgtagctttaatcgtagccgatactaaaggtctgttcgcacaggtgttctgcgacttcggcaaggccttctctgttgtggacgtcaacggggaaccacccgtgtccaccatgatagcggatatatccaacgatacggagagcgtagtcacctgcattgatgacactaggcacggcatggaggaaggagattacgttaccttctccgagatattaggcatgaccgaattgaacaactgcaagcccattaaaatcaaagtattgggtccctacacgttcagcatcggagacaccactaaattctcgaaatacgttcgagggggtatagtcactcaagttaaaatgcccaaggaggtgcactttaagtcgttgaaagagtctttgcagaatcccgaattcgtggtgaccgatttcgccaagttcgatcaccccattcaattgcatctcgctttctccactctacacaagttcgtggagaagacgggtcgattgccgaaaccctggagcaaagatgacgccaccgagttcatcgctctggcgaaatcgttggctgtaaacggttctacggataccgaagtcaacaccgatatcctcaacattttctccaagtgttgttcgggcgatctgaaccccatcaacgctacgatcggaggaatcgtggcgcaagaggtcatgaaagcttgctcggggaagttctaccccatttaccaatggttgtacttcgatgccatcgaatgcctgccccaggacaaggaggagatcaccgaggaactcgctgcacccgttgatagtagatacgatggacagatcgctgtgttcggaaaagacttccaaaagcgattaggcgaactgaaatatttcatcgttggtgccggagcgatcggttgcgagttgctgaagaacttcgccatgatgggactgggcacgcaaggcggtcaagtcaccgtaaccgacatggatttgattgaaaagtcgaatttgaataggcaatttttgttcaggccccacaacgtccagcaacccaaatccgctaccgctgctaaggtaatcaagaagatgaatcccgacgttaacatagtggcccacgaaaaccgagtgggccccgaaactgagaacgtctacaacgacgagttcttcgaggttttagacggggtagccaacgccctggataacgtagacgcgagaatatacatggacagacgttgcgtttactatcgcaagcctctcctcgagtccggtacattgggaacgaaaggcaacactcaagtagtggtaccgttcctctctgaatcgtacagctcatcgcaggaccctcccgaaaagagcataccgatttgtacgttgaagaatttccccaacgccatcgagcacactttgcaatgggccagggacaatttcgaggggctgttcaggcagaacgccgagaacgcttcgcagtacctcagagatccggacttcatcgaacgaactgtcaagctgcctggcgtacagccgctggaagtgctggaatccgtaaaggctgctataatcgacgaaagaccaaaggattacgacgattgtctggcctgggcgcgtctgcattgggaggaccaatacgccaatcagatcaagcaactgctgtttaatttcccgccggatcaactcaccagtaccggccagctgttctggtctgggccgaagaggtgtccggaaccgctcgtgttcgatatcaatgaagatttgcacgtggattacgttatagcggccgctaatttgaaggctcaagtttacggtattcccacgaataggaatagatgctacgccaaacaagtcgtcactagcatcgaggtgccggagtttgtgcccaaatcgggcgtgaaaatcgccgtgaccgactcccagatggccatgaacggcaacaacgtcgacttggatcgcatcaatcaaatcaaacaggagctgccttcgatgcaggagctcagcgggctgacgctcactcccttggaattcgaaaaggacgacgatagtaatttccacatggacttcatcgtggcggcctcgaatttgagggccgccaattacaagattcctatggccgatcgacacaaatctaagctcatcgctggtaaaattattccggctatagctacaactacatcggtggtggccggtttggtttgtttggaattgtacaaactggctaggagcatcaagagtttaacgccgtttaagaatggttttgtaaacttggcgttgccgtttttcggattctctgaaccgatagcagcccccaaaatggagtactgcggtaaccagtggacgttgtgggatagattcgaggtgcaaggtgaaatgactctcgctgagtttctggagtacttcaaggagaagcacggtttggaaatcacgatgttgtcccaaggggtgtgcatgctctattcgttcttcatgcctaaagccaaagctcaagaaagattaggactaacgatgtctgaagtggtgaggagagtgtcgaagaagaagatagagccgcacgttagagcattggtgtttgagttgtgctgcaatgatgctgatggagaggacgtggaggttccttatgttaaatacaacttgtattga

SEQ ID NO: 717 - DNA, 1350 bp, Phyllotreta cruciferae
atggccgacgctgatgccgctgacgatctattagattacgaagatgaggagaacccagagcagaccgcaaatgaaaataattcaacagaagttcagaaaaaaggggttaaaggaacctacgtctcgatacacagttccggttttcgggatttccttttaaaaccagaaatcctccgagctattgcagattgcggtttcgaacacccttcagaagtgcaacacgaatgcattccacaagcagtaatcggcatggacatcctttgccaagctaaaagcggtatgggtaaaacagcggtctttgtattagccacactacagcaactcgaacccaccgaaaacgtcgtttatgttcttgtgatgtgccatacgcgcgaattggccttccaaatcagcaaagaatatgaacggttcagcaagtacatgtccaacatcaaagtcggcgtgttcttcggcgggctgcccatccaaaaagacgaagaagtattaaaaaacagctgtccgcacatcgtcgtcggaacgcccggtcgcatcttggctctcgtcagatcaaagaaactcaatctcaagcacataaaacactttattctcgacgaatgcgataaaatgttggagcttctagacatgagacgcgacgttcaagaaatatacagaaatacgccgcacgaaaaacaagtaatgatgttcagtgcgacgctcagcaaagaaattcggccagtttgcaagaaattcatgcaagatcccatggaagtatatgtcgacgatgaagcgaaattgacgttacacggtctacaacaacattatgttaaacttaaagagaacgaaaagaataaaaaattatttgagttacttgatgtgttggagtttaatcaggtggtgatatttgtcaaatcggtgcaaagatgtgtagcattggcacaacttttgactgaacaaaatttccctgcaattggaatacacagaggaatggagcaaaaagaacgattatccagatacgaacaattcaaagatttccaaaagagaatattagtggctactaatctatttggtcgtggtatggatatcgagagagtcaatatcgttttcaactatgacatgccggaagattcggacacttaccttcacagagtggcgagagcaggtcgtttcggtacgaaaggtttggccattactttcgtttccgaagaaggtgacgccaagattttgaatgaagtacaagacagattcgatgttaacattaccgaattacctgatgaaattgatttgagttcgtacagtaagtttatcaagtttgattacgatttatggaagtattacatgttcaccgtttttgtttcagttgagggacgatag

SEQ ID NO: 718 - DNA, 1500 bp, Phyllotreta cruciferae
gcgttagttttcactagtaaacaaaacatgggagtcgtcgagacagacgtggagatgaaaaacgccgacagccccacggggctggaggccggagacaacaagagagacaaagatttgaacagtttcacggagattcgagaacaggccaagcaaatcgaaaagggcataatcaacaaagaaaaccgcttcattctccgagtgctccgctgcatgccgaacaccagacgaaagctcaacggcatcgtcctcagaagtctcatcaaccaaatttacccggtggtcgaacgagatgtactcctcagcttcatcgaagaatccgccggtgagctcgacaacactcaaactaaagccagaccggccaccaagtcccctgtggcagaaatcgacacctacatcaacttgctatgtttagtccatttaatcgacaccaataaactagcagaagccgaacgctgctcgcagatcctcatgaacaaaatcaccagccagaacagacgaacactggaccttgtcgcagctaaatgctacttctactactccagagtagccgagctcaccgacaagctggactcgatcagaggcttcttgcattcccgcctgcgtacagccacactcagaaacgatttcgaaggacaagccgtactaattaactgcttattgaggaattatttacactattcgctgtatgatcaagccgataagttggtgaacaaatgcgtttttccggagacagccagcaacaacgaatgggcgagattcttgtactacttgggcaggatcaaagcggctcgattggagtacagtgtagctcataagcatctcatacaagcgatgcgtaaagcgccccagaacactgcgatcggcttccggcaaaccgtccagaaactaacagtcgtagtggagttgctgttgggggatattccggagaggcagatattccggcaggcgagcatgcggcattcgcttgccccgtatttccagttaacgcaggctgtgagaatggggaacttgcaacggttcggggaggtgttggagaattttgggccgcaatttagggtagatcatacgtttactttgatcctgcggcttcggcataatgttatcaagacagctattaggtcgattggtttgtcgtattccaggatatctccgcaggatatagctaagaaattgggcctggattcagcggaggatgcggaattcatcgtagcgaaggccattcgagatggtgttatcgaagctactttggacccacaagggggctacatgaggagtaaagagagtactgatatctactgtactaaagagcctcaattggcctttcatcagaggatatcattttgtttggatttgcacaatcagagcgtgaaagccatgagatacccgccgaatgcgtacggaaaggaactggaatcggctgaggaaagacgggagagggagcagcaggatttggaattggccaaggaaatggctgaagatgatgatgatagttttccttaa

SEQ ID NO: 719 - DNA, 1683 bp, Phyllotreta cruciferae
atggcctccagccatcaagcccttccagtgtcggccatcctaaaatcgaaaagcgaagtcgaggatgagcccaagaagaagtccagggaggactggcgcaaggccaaggagctagaggaggcccggaaggccggtacagctccggcggcagtcgacgaagaaggtaaagatatcaatccccacattccgcaatacatatcttcggctccttggtattacggaacctctggacccacgttgaagcatcaaaggccccaggatgataaacagaaagagtattcagatttgaacgattggtataagagaggcgttgatacttcgaagattgtaacaaagtatcgtaaaggggcttgtgaaaactgcggagcgctaactcacaaaaagagagattgtatggacaggccacgtaaagtcggagcgaaattttcaggtgctaatatagcccccgatgagtttatccaaaagaacttatcactaagttttgacggtaaaagagataggtggagtggttacgatccttccgaacataaaacagtaatagaagaattccagaaagtggaggaagccaaacggcaactaaaatccgacaaattgaatgccaacgaagagtccgaagacgaagaaaaagatgaggataaatacgtcgatgaagtggacatgcctggtacgaaagtcgacagcaaacaaagaataacagtgaggaatttgcgtatacgagaagatacggccaaatacttgagaaatttggatcccaactcggcatattatgaccccaaaaccagatcgatgagagaagatccgaatgctggaatggacgctacataccatggggaaaattttgttcgcttctccggagatactacgaatcacgccagagcccaactgttcgcttgggaggcacacggtaaaggagtcgacgttcatctactagcagaacctacaaaattggaattactcaagaaggaatatgagaagaagaaagatgaagttaagtcgaatattcagggtacagtattagagaaatacggaggtgaagaatacctcgaagcgccaccgaagagtttgttgttagctcaaactgaaaactacgtagaatattcgagatcgggtaaagttattaaaggtgctgaaaaagaagttattagatcaaaatatgaagaagatgtttatattaataaccatacatcagtttggggttcttattggagtggaggacactggggttatcgctgttgccattcttttattaagaattcttattgtttgggagaatcaggaaaattagtaaacgctcaacctacggcagaattagtaactaatgatgagcctaaagaagaacagagtcaagaggatgatgagaaagatacggttgaagcattagaaaaagaaagcgaagaatctgaatctagtagttcatcagaagaggaaaaatccaaagcgaaatcgaagaaaaaactaaaaaagaaaatgaagaagcagaagaagaagcaaaagaaaaaagataaggacaaggaggttaaaacgtcttcattcatgaatgatgaagatgaagaagtggttttagacgatagaaagcggccttacaacagcatgttcgaagcgaagaaacccacagaagaacaaatggaggaatactacaagaagcggcgaagagacgaagatccgatgaaccaattcatgtag

SEQ ID NO: 720 - DNA, 627 bp, Phyllotreta cruciferae
atgggtataagccgagatcattggcataaacgaagggccaccggaggcaagaggaagcctcttcgcaagaagaggaagttcgaattaggtcgtccggcggccaacacgaaactaggaaccagaaggatccattatgttcgtacaaggggtggcaacttgaagtaccgtgccctaagattagacactggaaacttctcttggggaagcgaaggaactgcccgtcaaacacgtattatcgatgtcgtttacaacgctagtaataacgaattggttcgtaccaagacattggtaaagaatgctatcgttgtcgttgacgctaccccgttcagacaatggtacgaaaaccactacatcttaccattgggacgcaagaagggtgctaagatgactcctgaagaggaggagattttcaataagaaacgtagcaaaaaagtacagaagaagtacgaaactaggcaaaaaaccgctaaagtagagcctgcaattgaagaacaattccacaccggaagattgttggcatgcctagcatcaagacctggacaatgcggcagggccgatggttacgtcctcgaaggaaaggaacttgaattctacatgcgtaaaattaagtctaagaaagctaaataa

SEQ ID NO: 721 - DNA, 960 bp, Phyllotreta cruciferae
atggatagattgcttcgacttgggggcgggatgccgggcttaacccaagcaccgccgccttccgacgcccccgtcgtggacaccgccgagcaagtctacatttcatccctagccctactaaaaatgctgaagcacggcagggccggcgtccccatggaagtcatgggtcttatgttaggtgaattcgtcgacgattacacagtgagggtcatagacgtgttcgccatgccccagacgggtactggagtgagcgtagaagccgtggatcccgttttccaggctaaaatgttagatatgctacgtcaaaccggccggccggagatggtggtcggttggtaccattcccatccaggtttcggctgctggttgtcgggaggcgatatcaacactcaacagagctttgaagccctctccgagagggctgtggctgtagtcgtagatccaattcaatccgttaaaggaaaagtcgtcatcgatgcctttaggttaatcaatcctaatatgatggtgttgggacaggagcccaggcaaacgacttcgaatttggggcatttgcagaaaccgtctgtacaggctctgatccacggtttaaatcgccactactactccataagtattaactataggaagaacgagttggagcagaagatgttgctcaatttgcacaagaaatcctggatggatgggctaacgttggctgattattcggagaattgcagcgttaacgagaaaaccgtcgccgatatgttggaattggctaagaattacaacaaagcgttggaagaagaggagaaaatgaccccggaacaactcgctattaagaacgtgggcaaacaggaccccaagaggcatttggaggagaaagtggatatattgatgaacaacaatatcgtccactgtttgggagccatgttagatactctcgtgtttaaatacttcaaagtgtatcgaacggttttt

SEQ ID NO: 722 - DNA, 1260 bp, Phyllotreta cruciferae
atgactgttattaataagatggaggtcgatgggcccctcaagggggaagggttcaggtcctactatattaccaaaatcgaggaattgcaactaatcgttgccgaaaagagccagaacctccggagattgcaagcccaaagaaatgaacttaacgccaaagttcgtatgcttagagaagaactaatgctccttcaagaacaaggaagctacgtcggggaagtagtcaaacccatggataagaagaaagtactcgtgaaagtccacccggagggcaaatttgtcgttgatatcgacaaaaatatcgacattaatgacgttacaccaaattgtagagtcgctctacgaaatgaatcgtacactttgcataagattttgccgaacaaggtggacccattagtatctcttatgatggtagaaaaagtgccagattcaacttacgaaatggtgggtggtttggataagcaaatcaaagagatcaaagaggttatcgaattgccggtgaaacatcctgagctctttgatgctttaggtattgctcagcccaagggtgtgttgttgtatggacctccaggaactggcaaaactcttctggctagagctgtagctcaccacacagaatgcacgtttattagagtatcaggatcggagttggtgcaaaaattcattggggaaggttctaggatggtaagggaactgttcgtaatggctagggagcatgccccttcgatcattttcatggatgaaatcgattctattggatcctctcgtatcgaatcaggttctggtggcgattccgaagttcaaagaactatgctggagttgctgaatcaactcgatggatttgaggctacgaagaacattaaagttataatggctacaaacagaatcgacattttggatcccgctttactcaggcccggcagaattgacaggaagatcgagttccctccaccgaacgaggaagcccgattggacatcttgaaaattcactcgagaaaaatgaatttgaccagagggatcaatttgaggaaaatcgccgaattgatgccaggtgccagcggtgccgaagtgaagggagtgtgtactgaggcaggcatgtacgccctaagggagagaagggtacacgtaacccaagaagatttcgaaatggctgtggccaaggtcatgcagaaggattcagagaagaatatgtcgattaaaaagttatggaaatacgtttgccaaatttatattcttttgtatttatgttataagaaataa

SEQ ID NO: 723 - DNA, 639 bp, Phyllotreta cruciferae
atggtaaaattatattgcatcagtatactctacaaagatactacatacgctacgtggttgaagtctgctttcgatttacaaagtttcagttttttccaaagaggatccgtacaggagtttatgtcattcttttgtaagactatcgtggaaaggactataccatcatccaggcaatccgtcaaagaaggagagtacatgtgtcatgtttatgtaagacatgataacttagccggtgttgtaatatcagatcacgaatacccgtctagagtgtcacatacgcttatcacaaaaattctggatgaatttgctggtaaaataccagctgttaattggcctaccttgcaagagagagacgtagcgtttccacaattgaacacataccttgccaaataccagaaccctaaagaagccgatgcgatgactaaaatacaagaggaccttgacgaaaccaagattattctggtgagaaaaatgttaattatcttgcgttatttatctaagcataacacgattcaagctgtcctggagagaggggaaaagttggacgacttggtaaataaatcagagggcttaagtatacagtccaaagctttttacaagactgcaaggaaaacgaacagttgctgcagtttcacttaa

SEQ ID NO: 724 - DNA, 729 bp, Phyllotreta cruciferae
atgtttctaacaagaagcgaatacgatagaggtgttaacacattttcgcctgaaggaagattatttcaagtggaatatgccattgaagctattaaattgggatctacagctatcggaatatgcactagcgaaggggttgtgctagcagtcgaaaagcgtattacttctccattaatggaacccacaacgattgaaaagatcgtagaagttgataaacacatcggctgtgctgtttcggggctcatggcagattcacgtacaatgatcgatcgggcaagagttgaatgccaaaatcattggttcgtttacaacgaaaacatcaccatcgaatcatgtgctcagggagtatcgaacctagctattcagttcggagattcggatgatgatggtgctgctatgtcgaggccatttggtgtggccatcttgtttgctggcatagacgaaaaagggcctcaactctaccacatggacccatcaggtacatttgttcagttcgatgcaaaagccataggatctggatcagagggcgcacaacaaagcttacaggaagtatatcatcgtagcatgactttagaggaagctaccacagcagcgttgactattctcaagcaggtcatggaggagaaattgaactcttctaatgtagaagtcatgacaatgacgccaaaggatatgttccacatgttcactaaggaacaagtggaggaggtaattactaaattatcttaa

SEQ ID NO: 725 - DNA, 1158 bp, Phyllotreta cruciferae
atgacagaatattggctgatttccgccccaggtgacaagacctgtcaacaaacatgggatacaatgaataatctgactagtaaacagaacaatttgtctgcaaattacaagttctcaatacccgatttgaaggttggaactcttgaccaattagttgggctatccgacgatttgggaaagctggatggtttcgtggagcaggttacccggaaggtggctcagtacctcggtgaggttcttgaagaccagagggacaagttgcaggagaatttgcaggcgaacaacaccgatttgccaagttatttaaccagattccaatgggacatcgccaaataccccatcaagcaatcgctgcgcaacatcgccgatataatcagcaagcaagttggacaaatcgacgccgatcttaagaccaagtcgtcagcgtacaataacttaaaaggcagtcttcaaaatttggagaaaaaacaaacagggagtttgttaacccgtaacttggcagatctggtcaagaaggaacactttattttagattctgagtacttgcaaacgctgctcgtcatcgttcccaaagctcagtttaatgagtggaacgccacttacgaaaagatcacggacatgatcgtccctcgttcgtcggagttgatcattcaagaccacgactacggcctgttcaccgtgtcgctcttcaagaaggtcgtcgaggagttcaagctgcacgccagagagaagaagtttatcgtgcgagatttcacgtacaacgaggaggaactggcggccggcaaaaacgaaatcaccaagctcgtcaccgacaagaagaagcaatacggtccgttagtgagatggttgaaagttaacttcagcgaatgcttttgtgcttggatacacgttaaagcgctgagagtgttcgtggagtccgtgttgagatacgggttaccagtcaattttcaggctattctgatccatccaaataagaagcaagccaaacgtttaagagatgttttgaatcaactgtacggtcatctagatagtagtgcagctctttccggacctaacgttgatagcgtagacattccaggattaggtttcggccaatcagaatattacccctacgtgtactacaaaataaatgttgatatgatagaatcgaaggtctaa

SEQ ID NO: 726 - DNA, 1674 bp, Phyllotreta cruciferae
atgtcgatattagcaagtcctctatcagtagccggttcgcgaaccacaggcgcctcagttcgcacccaaaatgttatggccgcttctaccatagccaacgtagtgaagagctcattaggcccggtggggctcgacaagatgctcgttgatgacatcggagacgtcaccgtaaccaacgatggggccaccattttgcgcctactggaggttgagcaccccgccgccagggtgctggtggaattggcgcaattgcaggacgaggaagtaggcgatggaaccacctctgtcgtcatcatagccgcagaactacttaaaaatgcagatgaacttgtaaaacaaaaaatccaccctacatcgattataagcggatacaggctggcttgtaaagaagcttgccgatacatacaagaccatttgactatacccgtggaggaattaggcaaggagtctatcgtaaacgttgcgaagacttccatgagctcgaaaattataggagctgatgcggatttcttttcgcaaatggtagtcgatgctgccaccgcagtgaaagtcacggactccaagggcaactcgatgtaccccattaaggcggtgaacgtgttgaaagcccacggcaaaagcgcccgggagagcttcctggtggccggctacgccttgaactgcaccgtcgccagccaggccatgcccaagaagatcgtcaacgccaaaatcgcgtgtctggatttctcgttgcaaaaggccaaaatgaagatgggcgtgcaagtgctgatcacggaccccaatcaactggaaggcgtcagagccagggagctggacatcaccaaggagcgcatccagaagatcctggccaccggcgtcaacgtggtgctgctgtccggcggcatcgacgacgtctgtttgaagtacttcgtggagcgcggcgccatggccgtgcggcgcgtcaagaaggccgatttgaaacgaatcgccaaggccaccggggccgccttcgtcacctccttgagcaacatggagggcgaggagaccttcgattctaatatggtcggcgaagccgccgaggtagtgcaagagaggatttccgatgatgaattgatcgtcattaaaggccccaaggctcgcacggccgcctcgatcatcctgcgaggccccaacgatttctactgcgacgagatggagcgctccgtccacgacgccctctcggtggtgaaacgcgtactggaatcgaagagcgtggtggcgggaggcggtagcgtggaggcggcgctctctatatacctggagaacttcgccacgacgttgagctccagggagcagctggccatcgccgagttcgccaggagtctgctggtcataccgaagacgttggctgttaatgctgcgcaggacgcgaccgatttggtggcgaagctgagggcctatcagaactcgagtcagaccaagaaggatcatgcgcatttgaagtacgtgggattggatctgctggaaggtactgtgagagataacaggaaagctggcgtgctggagccgactatgtctaaagtgaaatcgttgaaattcgctacagaggcggcgattactatactcagaatcgacgatatgattaaattggatgctgagcagaagggcgggaaaaactaccaggatgctatgtctagtggtgaattgtacgattag

SEQ ID NO: 727 - DNA, 768 bp, Phyllotreta cruciferae
atgtttaattcttcccaattaaaccctccaccgttttggagtaacggtccagctcccggggccttctataacttcccaggaacagaatggaaacctgtaacaaacccaataactcatacccaatctccagtaacgacttcaacctcaattgtatctataacctacgataagggagtactaattgccggagacttgctggcctcttacgggtctttagccagatacaaaaattgcccgagggtaatcgaaattaacccaaacatcatcttaggcgctggaggagactacgctgatttccaatatgtaaaaagctttatcgagcagaaaataatcgacgaagattgcttagatgatggtttgaaaatgaaaccgaagtctctttattgctggctcactagaattatgtaccaacgaagaagtaaactcgacccgttctggaacaatttagtagtaggagggatccaagatggagtacctttcctaggaacagtcgataaactgggcactgcgtacacagataaagtaatctgtactggttacggggctcatattgcccttcctgtcttgagggatgccctcgacaagaagccgaatttgaatctaaacgaagctaaggcgctcattaaaaagtgcatggaagttttgttctacagagacgcgagaagttacccgaaatatcagttaggcataatcgatgtggacgaaggtgttaagattgaggggccgattgctgttgaggagaattggaacattgcttatatgacataa

SEQ ID NO: 728 - DNA, 2106 bp, Phyllotreta cruciferae
atggaattttcgaaagaacccaactttgaattactaacagccaaagatttttcaccagaaaaatatgtgaaaaaattgtcccaaaattatgtgggtggatccgaattgcaaaatcttcgcagaaaaatccaagggctctccgaagaaactagctctaatttgaagaaaaatgtttacgaaaactacattcaatttatcgaaaccgcgaaagagatttcacatctcgaaagtgaaatgtaccagctttcccacttactttcagagcaaaaggccttactcaattgtttatcagccacctcgatactagaagatgtccaacccgttaacatcgatagagataataaggtaaacgaaaaggatatcgaagaagaaaataaacaaaaaatagctgctatattagaaaaagtagaaggttgtcaggaattgttaaaagtgccgggaagaatttttttgtacgaaggagatttattagaaatcgaacccaccgaaaacactgctttaaaaatagttcatgtttatttattcactgatagtttcatgataaccacaagaaattcaaacagtcgaggcctcatgaaatacatctacgaaagcatatacgacttaagcagcctagcagtcgtgaatgtaagagatttgggaaacgttaaacacgcctttaagcttctcattttccccgacaccagagttttccaatgctcttcgaactccaataaaaaagaatggttagacaagttcgatcaagccaagaagaccaggctagcccaagaacaacaaaaaagggaatccatatcggaaaaatcccccacccgcgtttccttcgagtcccccagctacaatcccttcgatgaagtggaagaagaaacgagcgcgttgcatccggaatggttcgtggacattccggaagagctggacgtttgcgtagcccaaaggcatttcgaagacgctctatctttactacaaaaagccaaagaatacttgaatcaagcgtcctccgcgtctggtgacaagcgggacaccgtcttcacggacatccagcgaaaagtagagcaaagacagaacaatttaacggaggtgttgatgaaggaactggaggtgaacccggataaatccttgcaggggggactgagagcagctcgcagggctgtgagattgttgaatcaattaggaagggaaacacaatcttgtacgttgttcctgaagttatgcagcagcatgttaagaacgcaatgcaaacgagttaaaagagaaggctccactactacttacataaagcatctttcgagtgtagttttcactaatatgtgtcacatgtctgatgaatttctaagggctttccccgactctccggcttgcgcttcagcgtatgtggtttgggcgagcaatgaactactgcaatttactacccattttatcaagcaggtctttatgccgcagacttccttatcaacggtgaccgagtgcatagttttagttagacaacagtgtgaaagactgtacgtttacggattggacctttgttatcaattggacggggctttgagatcgtcgctgatgaaggcgttgaaagacgctcgagataaactcatcgattcgattaaattgagagtgttagatgataaatggataccgattaatttgcattccaaatcggcgttgagccgttgcgtgcaagagtattcgcaaatgggactcactaacgtaggaaattacgtttctggcgatacttggttgcaattaacagctagtactttgtcgtttacgaaaatgtatctgaacttgttaaacgattgcatgaaattgaaaactaccgaattaatgtatacgatcgatgagactttgtataacgtgttcgaagctcaagttaggcacaatgaaaatgctcttagaagcgaattgaatcaagatcaaaggaactttcttacgaaaaatgcagagtttttgttggttagtttaatgcaagtggtgcagaaacagtacgaggaaaacgtcggttacgaatgtcctacgctagcgaaattgcaaaaggaatacatagcattgcagaaaggcgttacgcccgcgtcaagaagtacaaaagccaagtattcatcagagtttatttaa

SEQ ID NO: 729 - DNA, 3705 bp, Phyllotreta cruciferae
atgaacgaattagagaaactagaatacctctctttggtctcaaaaatatgtacagaattggagaatcatctgggaatgaacgataaggatttagctgaatatataatacatctttccgaaaaaaacaacacattggagtcctttaagaaggtccttttagaaaatggcgccgaattctcggactcttttatttctaacctgttgcgaattatccaacacatgaaacccaagaaatcatcaaataaagaagacaccgataaagtcgaaaaagaaggattggcttttaaattccccggtctagcaatacccaatgagaaacaaaaacctttaaatttagaagaatttagtaaggaaaatgaaaatgatgaaatagacgttgtagccgatatgatgaaacagctcgaggccgatgcaccttctcaaaaacaaacaaaagaaaaatccagaagcccgagcattgaaaggaaatcaagaataagatctagaagtcgatcaaaggaaagaagaagatccagaagcagatcaaaagatagaagaagatctagaagcaggtcgagagacaggagaagatctagatctaaagatagacattctagaagagacaaaaggcatagaagtaggtcaaatgaagactacaagaggagaagaagagacaacagttactcgagagatagaagagaaagaggtaggtccaaagaatcggaaagaagggacagaaatagatccagagatgatagaaaaagagatagaagtcgatcaagaacgagaaggagagaaaggagttacgaaaagaaattcaaaagtgaaaaggataatcctgaattcgaggatgaccccactccaggaaagatttataatggaaaagtatcaaatgtggtaccatttggatgttttgtgcaactagaaggcctaaaaagaagatgggagggtttagtgcacatctctcaactaagagccgaaggtagagtcaccaacgtttccgaagtagtctctagaggaagcaaagttaaagtaaaggtgttaactataactggtcagaaagtatccctttcgatgaaagatgtctgccaaacgacaggaaaggatttgaatcctctatcacacgccactacggaacgagaagataaagatcgtaaccctgacaggcctactaataatagcacatcagtgctgaggctaccggttagtatcgatgaaggtgaagaagattccaggaaaagagtaaccagaatatccagtccggaaagatgggaaattaagcaaatgatttcttccggatgtatagacaaaagcgaattacccgaattcgatgatgaaactggtttgctgcccaaagatgaagatggtgaagctgatattgaaattgaattggtcgaagatgagccaccatttttacaaggtcatggtagagctcttcatgatctaagcccagtgagaatcgttaagaatccggacggttcgctagcccaagctgccatgatgcaatcggccttggccaaagagagacgcgagcaaaaaatgctgcaaagagaacaggaagtggattcccagccatctggaaagaacaaaaactggatagatccccttcccgaagaggaatctaaatcgatggcaagaggaatcggtctgcaaagtcaagatttacccgaatggaaaaaacatgttatcggtggtaaaaagtcatcttttggtaaaaaaactaacttaacaatcatcgaacaaaggcagtctcttcctatatacaaactcaaagaagagttacgaaaagctgtaacggataatcaaatactgatcgttatcggtgaaaccggctctggaaaaaccacacaaatcacccagtacttagccgaagccggtttcacagccagaggaaaaattggctgtacacaacccagacgagttgcagccatgtcggttgctaaacgagtggccgaagagtttggttgcagattaggccaagaagttggatataccattcgattcgaagattgcaccagtcccgaaacgatgatcaaatacatgacagacggtatgttgctgcgtgaatgcctcatggatttggatcttaagcagtactccgtaataatgttggacgaagctcacgaacgtacaatccacactgacgtactatttggattgttaaaacaagccgttatgaagcgggatgaactgaaattgattgtaacttcagctactttagacgctgtgaagttttcgcagtatttcttcaaagctcccatattcacgattcctggtaggacgtttcctgtagaagttttgtacaccaaggagccggagactgattacttagatgctagtttaataacagttatgcaaatacatctcagggaacctccgggtgatatattactgtttctgacgggtcaggaagaaatcgatacggcttgcgaaatattatacgaaagaatgaaaagtttaggtcccgatgtacccgaattaatcattctaccggtatactcggctttaccatcagaaatgcaaactagaatattcgaaccggcgcctcctggtagtagaaaagttgtaatagctactaatatagcagaaacttcattaacaatcgatgggatatattacgtagtagatccgggattcgtcaaacagaaagtttataactccaaaactggaatggattcattagtagttacaccaatttcgcaggcacaagcgaaacaacgagctggtagagctggcagaaccggtcctggtaaatgttacaggctttacacggagagagcctaccgagatgaaatgcttcctacacctgttccagaaatccagaggactaatttggcaacgacggtacttcaactgaaaactatgggtataaatgatttgctacatttcgattttatggacgcccctccggtggaatcgcttataatggccctcgagcagttacattctctatctgctttagacgacgaaggtctattaactagattaggaagaagaatggctgaattcccgctggagccgaatttgtgtaaaatgttgatcatgtcagtggctcttcaatgctccgatgaaatattgactatagtgagcatgttgtccgttcagaacgtgttttaccgtccgaaggataagcaggcgttggctgatcagaaaaaggccaagttcaatcaacccgaaggcgatcatttgacgctgttggccgtttataatagttggaagaacaataaattttcgaatgcttggtgttacgagaatttcgtacagatcaggacgttgaaaagagcgcaggatgtgagaaaacagctgctgggtattatggacaggcacaaattggacgtggtgtcagctgaaaggaatacggtgagagtgcagaaagccatttgttccggatttttcaggaatgcggggaagaaggatccgcaggagggctacaggactttggttgatagtcaggtggtgtacattcacccgtccagcgcgttgtttaatcggcagccagaatgggttatctatcacgaattggttcaaactacaaaggaatacatgagagaagtgacaacaatagatccgaaatggctggtggaatttgcgcctgcattcttcaagttttctgatcctacgaaattgagcaaattcaagaaaaatcaaagattggagcctttgtataataaatatgaagaacccaacgcgtggagaatttctagagttaggagaagacgaaattaa

SEQ ID NO: 730 - DNA, 1248 bp, Phyllotreta cruciferae
atggcctcaaaaagaaagaacaaaaaaaacatactggcaaaagtgaatttccctctgtacaccgtccagatggtaacgtcacggcacgttatcgtaggaggcggcggtggaacttcgaagactggggttgaaaacggtttcgaaatatacgaaatctatcatgacggtagcaaattctcagcgaaagaagttacaagacacgaaaccggaggaaacgtagtcatgaactgctgtgtgtttagtgataggaaacattcatttttagtagcaggtcaagagaactactctcaactttatggagtcaatacgaaattaatcgaacatgaacaagtagaaacaattggagacacggcaagtgttcgacatagaaataccaagcccaaagcgcacgtagacaataacaaaaacattaaaaaggagctggttttcgacatgaatcctctagatagcatacaaaccgactttaagggatctgaacccctatgtagagtagttcgaattaatcactcgggaaaaatattagctactggaggaactgacggcgatgtaagactttggaaattccctacgatgcagccattgtccattctcaagggacatacgaaggaaatagacgatatagatttcagtaaattcgataacctcatcataactttagcgaaggacggtttggctattttgtgggacgcccaaacgggtaaattgaaatcgaaactgacatggaacactccagagggatcgaaatatttgtacaagaggtgtagatttggcgtaatcgaagatcaaaaaaataagtgcatgctatacatgatagcgaatgcgactaattcgaagcaaaaatcgtttcttcagcaatggatacctgaagagaatactttaaaaaagttctctgaattcaatgaaacactgtccgcacttgcagttagagatgatggacgatttgtagctgtcgggacaatgtttagcggttctgtttcgattcacattgcatttagtttacagaaaatattagtagtcgttggtgctcattcgatgtttgtaactggtctggaattcctatctcatgaaaatactaatcattccataagtagtgtggcagaggccgctgtattgtctatttcggtggataatcagctttgtatacactcagtgccatacagacgaagtatacctttatggattggaattatggtgttaattttagtattattttttacatttatgttatgtgcatacatgggtttgtga

SEQ ID NO: 731 - DNA, 1242 bp, Phyllotreta cruciferae
atggcgggtgcaagggtattcgaaagagctcaggccgttccttcccaacatgacaagttgttaaaattaaatccggcagacgaagatgacgaggagaatattgttaataaagaacaggacatcctcaacttgggcgagaagtacaaaaaggagggcaaggctaaagaactagcggagctgataaaggctaccaggccatttttgagtcttattagcaaagcaaaagcagcaaaattagttagatcactggttgattactttctggacttggaggcaggtatcggcatcgaggtgcaactgtgtaaagaatgtatagaatgggcgaaagaggagagaagaacgtttttgcgccaatcgctggaagcgcgtctcatcgccctgtatttcgacaccggcatgtacaccgacgccctgcaactggaatccaccttgttgaaagagttgaagaaactggacgacaaaaacctgctggtcgaagtgcaactgctcgaaagcaaaacatatcacgctctaagcaatttacccaaagcccgggccgccctgacgtccgccagaacgaccgcgaatgccatctattgccctccgaagatgcaggccgccctcgatctgcagtcgggcgtactgcatgcagccgacgaaaaggacttcaagaccgcttactcctatttctacgaagccttcgagggttttgacagcgtcgagtcccccaaagctctgaccgctctgaagtacatgcttttgtccaaaattatgatcaatagtcctgaagatgtacagcaaattgttagtggaaaattagccataaagtatgcaggtaaagatatcgaggccatgaaagcagtcgcacaagcagcccacaaaagatctcttgcagattttcaactggctgtaaaacaattcaaacacgagctggaagatgacgttattgtaagagcacatttaggaacactctacgacaatatgttagaacaaaatttatgcaggatcattgaaccttactcacgtgtccaagtagaatatatcgcaaagacgattaagcttcccgtgttacaagtagagaagaaactatcgcagatgattttagatgccaagtttcatggaattttagaccagggtgatggtgtcctgatagtgtttgaagaaaccccggtagacaaaacctatgaaatggctctagaaaccatccagagtatgagtaaagtagtagatactctctatcaaaaagcgaaaaagttgtcatag

SEQ ID NO: 732 - DNA, 1737 bp, Phyllotreta cruciferae
atggcttcgcggtcgaaaaagagctcaacgccgtcggcccagcagcggccggctagcccgctcagccccaccaggcattccaggttgcaggagaaagcggacctgcaaaatttaaacgaccgcctggccggctacatcgacaaagtgcggtttctggaagcggaaaacaacaaactatccagagaaatccaaaccacccaggaaacggttacacgcgaagtgtccaacatcaagtctatgtacgatcacgaactatcggacgctaggaaactgctggacgacacccaccgcgagaaggcccgcctggagatcgacgtgaagcggctcattgaagagaacgaggagctcaaagccgagctagccaagaagagcaaggacctcgtcatagccgagaaccatgccaggatatacgagaccaggtgcaatgagtaccagctcaaagccaaccaagcctccgccgacgccaagaaggccatcgctgacgccaaggagctggaaaaggaaagggacaagctgaagaagctcctcgatgcagctcgtaaacaattggaagaggagtctctggccagagtcgaggtcgagaatcacaatcagagtttaagggaagagatcggcttcaaagatcagattcatcagcaagaactcacagagacccgcactcgccggcaagtcgagatcagcgaaatcgatggccgcctggcgcagaagtacgaggccaagctccaagaggccctgcaggacctgcgagaccagtacgaatcgcagatggccaacaatcgccaggagatcgaattgctgtacgaacagaaaatcaaaaacctgcaggccgccgccgacaggcatcaatcgaccgcctccggcgctctcgacgagttgagacaagttcgaacgaggatcgacaccttctcgtcgaggatccaggatctggagaaccagaaccagggcctggcagctagaactagggatttggagaagttgctcgagaacgaacgcattcgtcacgccgaagacctagcgctagtcgagagggaattgcacaggctgcgagaggaaatggcgactcaactgcaagagtaccaagacttgatggacatcaaagtgtccctcgatttggaaatcgccgcctaccgtaagcttctcgaagcggaagaagctcgattgaacatcacaccaacaggtgttgagcacgaggtgcaccaaaggagctcctctcagcgccggacgccggtgagaatgggggccaagaggaaacgggccctgctcgaggagacgcaggagtcgagcatgtcggattacagcgtgaatagttcgtctaaaggggacattgaagtggccgcggccgatccggacggtcagtttgtgagattgcacaacaaaagtaaccaggaggtgccgctcagcggatggcaagtcatcaggcgggcgggcgatgaggagaccttctacaaattccacagaaccgttaaagtagagggaaatggtacagtaaccatttggagttctgatttaaataaagatcatgaaccccctagtaacctggttatgaaaagccaaaaatgggttactggagacaacatgattacgatagtattgaacagcaatggagaagaagtagcgtcatctgaaagggtgaaaaggcagatttcaacgtcgcatttaagacacagggaattaggggatgaagaactttttcaccagcagggggacctgcaaggtgaaaagtgcggactgatgtga

SEQ ID NO: 733 - DNA, 2412 bp, Phyllotreta cruciferae
atggctgatagcaaaagccctgacgatctagcgactgcgattcttcgcaaaaaggaccgtccgaacaggcttttggtcgaagaagccgttaacgatgataattccgtggtggccctgtcccaggcgaaaatggacgaactgcagctctttagaggagacactgtactacttaagggcaagcgtcgaaaagaaactgtctgcatagttctctctgacgatagttgtagtgacgaaaagatccgcatgaacagaaacgttcggaataacttaagagtcaggttgtctgacgtcgtttctattcagccctgccctgatgttaagtacggtaaaagaatccacgttcttcccatagatgatacagtcgaagggcttacaggaaatctgtttgaagtgtatctgaaaccgtatttcctggaggcgtatcggcccatacataaggacgacgtttttatcgtaaggggcggtatgagagctgtagaatttaaggtagtggaaactgatccggctccttactgcatagtcgctcccgatacggtcatccattgcgacggggatccgatcaaacgcgaagaagaagaggaggctcttaacgctgttggctacgatgacatcggaggttgcagaaaacagctggctcagattaaagagatggtcgagttgccgttgagacatccgagtctgtttaaggctattggtgttaagccgcctcgaggtatcctcttgtatggtccaccgggtactggaaaaaccctgatagccagagccgtcgccaacgaaaccggagctttcttctttttgattaacggcccggaaatcatgagcaaacttgccggagagtcggagagtaacctgcgcaaggctttcgaagaagccgacaagaactccccggctatcatcttcatcgatgaattggatgccatcgctccgaagagagagaaaactcacggagaggtggagcgtcgtatcgtttcgcaattgcttactctaatggacggcatgaagaagagctcccacgtcatcgttatggccgctacgaacaggccgaactccatcgatcccgctctgcgtcgattcggaagattcgacagggaaatcgacatcggcattccggacgctaccggtagactggaagtgctgagaatccacactaagaacatgaagctggccgatgacgtcgatttggagcaaatcgcggccgagactcacggtcacgtgggcgccgatttggcttcgctctgttcggaagcggcgcttcaacagattagggagaagatggacctgattgatctcgaagacgatcaaatagacgccgaggttctcaactcgctggccgtgaccatggagaacttccgctacgctatgacgaagagcagcccgagcgctctgcgcgaaactgtcgtcgaagttccgaacgtcacttgggacgatatcggcggtttggcgaacgtcaagaaggaattgcaggagttggtgcaatacccggtcgagcatcccgataagttcctgaagttcggcatgcagccgtccaggggagtgctgttttacggaccgcccggttgcggtaaaaccctattggccaaggccatcgctaacgaatgtcaggccaacttcatatccgtcaaaggaccggaattgttaaccatgtggttcggtgaatctgaagctaatgttagagacattttcgataaggccaggtcagcagctccttgtgtgcttttcttcgatgagttagattcgatcgctaagtcgagaggtggaaatgtgggagatgccggcggtgcagccgatagggtgattaatcaaattttaactgaaatggatggcatgggagctaaaaagaacgttttcataattggtgctacaaatagaccagatattattgatcccgcaatattacgtcccggtcgtctggatcagttgatctacatcccgttaccagacgaaaagtctagagaagcaatctttaaggcgaacctaaggaaatcacctgtagctaaagacgtagatcttacatatattgccaaagttacacacggcttttcgggcgccgatttaacagaaatatgtcaaagagcttgcaaactcgctataagacaaagcatcgaaacggagatcagacgagaacgagagagagcattgaatcccaacgtagcaatggatctggatgacgacgatccggtcccagaaataaccagggctcactttgaagaggcgatgcgtttcgccagacgctcggtctccgataacgacatcagaaaatacgaaatgtttgcacaaactttacaacaatctcgaggattcggaacaaacttccgtttcccgacggcccagggagggccgcaagccccgggaggcaccggcggggatcaggccaacttccaagatgctcctgaagacgacctatatagctaa

SEQ ID NO: 734 - DNA, 825 bp, Phyllotreta cruciferae
atgagtgaccaatttgactgtgcactcgatttaatgaggcgcttgcctccgcaacaaatcgaaaaaaatttgagcgacttaatagatttagtgccaagtctctgtgaggatcttctatcgtctgtggatcaacctttaaaaatcgctaaagacaaggattcgggcaaggattttcttttatgtgattacaatagagacggagattcttacaggtcaccatggtcgaatacctactatcctccattagaagacggttcgatgccctccgagaggctaaggaaattagaattagacgccaatttagcgttcgatcaatatagagaaatgtatttcgaaggtggcgtatcttctgtttatttttgggacttggatcacggtttcgcaggtgtaattttaattaaaaaaactggcgatggtagtagaaaaattaaaggttgttgggattccctgcacgtggtggaggtacaagagaagagttccggaaggaattcccactacaaaatgacgtccactgctatgctgtggctgcaaaccaataaacaaggctcgggaaccatgaatttgggcggtagtttaacccgacagatcgagagtgatgcagccgtaaacgacatcaatccccacatcgccaacatcggtcgaatggttgaagacatggaaaacaaaattcggaacacgttaaacgaaatctactttagcaaaaccaaggacatagtcaatagcttgaggtcggtgcaaccgttaacggagagccgtcaacagcaagcgcttaaacaagacttggctgccgcccttcagcgtaggcaaaataaatccgaaaattga

SEQ ID NO: 735 - DNA, 2106 bp, Phyllotreta cruciferae
atggaacgtccaccccgcaatgaaccgcccgtggagcctgtcaacggtgtggtacaaccgccggtgcacccgcccccggacagtccaggacgcgtaacgaaccaactgcaattcctgcagaaaaccgtactaaaggctgtatggaaggacaaattcgcctggccttttcaacaacccgtcgacgctaagaaactcaacctgcccgactatcatagaataatcaaacaaccgatggacctgggaacgataaagaagcgtttagagaacaactactattggtcgggtaaagagtgcattcaagatttcaacacgatgttcacgaattgctacgtctacaaccagcccggcgaagatgtggtggtcatggcccaaacattagaaaaagtatttttaaccaaagtggccgacatgcctaaacaagaatttgtcgttgatatgccgatgaaaggcgccaaaggcaagaaagggcgagttagcgtcggtggcggcggcggcagcacgccatcctccagcggaccggtaccagcagctatagtaccaggaggtgtcagaggcaggccgcccgcgaccgtttcctctaccagtaccacaccaattgcgaccactaccggttcgtccggtttgccgttgggtacccaagctcctgcgacgctgccgggaagtaccgccaccacgacgatagcgccggccaacaacaacaacagctctctgacgccgcagcagctcggcacgcccgtcagttcgatgcacggcaccccgggggcccccctatcgaattccctcgatcccagcggagtgctgccctccaacgtcatgccgccggcgcaaccagccaaggtaaaaaaaggcgtgaagagaaaggccgacacgacgacgccggcgacggcctacgattatccgacggtattggaatcgaagtcggcgaagatttcgacgcgcagagaatcgggcaggcagataaagaagccggcgcggcgggaaatcgaccttcatgtacctcaaccggcgatccacaaacccaacgataagttgtcggagtcgctgaaagcttgcaatgaaatccttatggaactgttctccaagaaacattcgaattacgcttggcctttctatcaaccggtcgatgcagaattattgggcctgcacgactaccacgacatcataaagagaccgatggactttggtacggtcaaagagaagatggacaacagggagtaccgcaccccgcaggactttgccgccgacgttagactgatttttagtaattgttacaagtacaatccctctgaccacgatgtggtcgccatggcgcggaagctgcaggacgtgttcgaagtcaagttcgcaaagatccccgatgaacccgtaaaccggataggaggagctgtaaataatctacccataaaatccgaatcgagtagttccggttcgagttccgattcgtccagcgaatccgaggattcggaggaggaacgacgtaataaacaattaaaagtactggaaaaagagctgacggcgttgcaagagaagatgcgcaagcttgtggaggagagctcgcgccggaaaaaggagaaaaagaagaacaagatgaaaaagaagccgagcggcggcggcatgaccgccgccggggcgggagcgctgccgaacagcagcagcggtctcggtaagccatcggggcacggcgccctaaagtcaaacaacaattcgatcgcggacagcgttgacgacagcatcgccagtgttgtgtccggcgccgatatgaagatgtccggcgccggggcgaccgtcgccggggaatcgcaccatcacgcggtcggggcgcagggcgcgggggcgctccatcccgccggcaagtcgatcaacatgcatcacaacatggcggcagctggcgccaacgcttccgcccagcctaaaacacctaagagcaaaggtgagattctatttaatcgttttttattcatttatttctatctactacgttattatgctctgctgcaaattcttcaacgcatgttcgtatctcgttttgggtctgccgtatacgcaatagtttgtattttttttgctgtattcgattcaataattttgtctggcattgtattgtaa

SEQ ID NO: 736 - DNA, 1227 bp, Phyllotreta cruciferae
atgtctttatccactgctcgccctttagtgagcgtttacaatgagaaatcggaagaagtaaaaggcaacggggtagctctacccgctgtctttaaggccccaattagaccagatgtcgtcaatttcgttcatcagcaggtctcaatgaaccatcgccagccttacagcgttagcgacaaagctggtcaccagacctccgccgagtcgtggggaacaggtcgcgccgtggcccgtatacctcgtgttcggggtggcggtacccaccgatcgggccagggagccttcggtaacatgtgtcgcggcggtcgcatgttcgcgcccaccaagccgtggcgccgctggcacagacgcgtcaacatcaaccagcgtcgctacgccctggcgtcggccgtggccgccagcggcgtgcccgctctggtcatgagcaaggggcacgtggtcgatcagattcccgagctgccgttggtcgtcagcgataaggtgcaggagatgcacaagaccaaggaggccgtgcagtttctgaggaggatcaaggcttgggctgacatccagaaggtttacaagagccaacggttccgtgccggtaaaggaaaaatgcgtaataggagacgtatccaacgtaaaggaccactcatcgtttactacaaagatcaaggtcttcgtcaagctttccgtaacatcccgggcattgacctcatcagtgtccaaaagttgaacttgttgaagctcgctcctggtggtcacgttggtcgatttgtcatctggaccgaatcggcattccaacgtttagacaaattattcggtacatggaaaaacccatcgaccgaaaagaagggttacaacttacctcaacccaagatgtccaacaccgatttgtctaggttgttgaaagctgacgagattaaagctgttcttaggactcctcagaagaaggtggtacgtcgtgttcgtcgtcttaatcctttgaccaacactaaagctatgctgaaattgaacccgtatgctgctgtactcaagagagaagcaatcttgaagaaccaaaaaaggcagttgcaaagagacgaagctttggctaagaaacgaggaatcactctgacccctgacaacgctgtaatcaggaccaggaaattgcaggaaagaaggagagctcaaattttgaaagataagaaatcaaaacccaagaaggccgctaaagcgccggccaagaagcctgctggaaagaaataa

SEQ ID NO: 737 - DNA, 5394 bp, Phyllotreta cruciferae
atggcagattatcttaattcagaagccgaggaatctagcgaggaggaagaattagaccatagggatcgaaagaaggcacaaaaagcaaaactcgtagatagctctgacgaggaagaggaagaagatgacgaagaaaaaattcgagaagaattaaaagatctaatcgacgataatccaatcgaagaaagcgatgctgaatccgatgcttcaggtcgtgagaaaagaaaaaagtctgacgatgaagacctcgatgatcgattggaagacgaagattacgatctgttggaggaaaatttgggtcataaagtagaacgaaggaaattcaaacgtttacgccggtttgaagatgaagaaagcgaaggggaagaagaacatgatcccgagcaggatcgtgagcaaattgctatggacatattttccgatgatgaaaaagacgatcgtcacaagaaggatgaagaaagaaggtcggagagaagtcaaagacccgtcgtcgagcaagaatctttcggagtgggcgaggaggaagaagaaggcgattattcggacgccgatgattttattgtagacgatgacggtagaccgttaattgagaagaagaggaaaaagaaaccgattttcaccgacgccgcgctgcaagaggcccaagaaacgttcggcgttgatttcgattatgacgagttcaccaaatacgatcaagacgaatacgaagacgaggaggacgaagaagaggacgaatacgaagaagatgacaacgaacgaaggaaacatccgaagaaagcggcgcggaagaagctgacgaaaaagtccattttcgaggtgtacgagccgagcgaattgaaaaggggtttcttcaccgatctcgataatgaagttcgtaacactgacatacccgaaaggatgcaacttcgtgacgttcccattacgcctgtaactgacgattcgactgagctggaagacgaggcagagtggatttacagacaagctttttgtaataaggctgtgtccaatgttgatgcgcacctttcggccgaagcgagagagaaaatgaagaaaggctcccaaacggtggggaaaataaagaaggcgttggattttatgaggaaccaacagctcgaggtgccctttatcgctttttacaggaaggaatatgtacaacctgaactgaatattaacgatttatggaaagtttataaatacgatgcaaagtggtgtcaactaaaatctcgaaaggaaaatctccttaaactctttgataaaatgaggcattatcaactggatcagctcgtaaaaaatccggacgctcctattccagacaacgtgcgagtgatgaaagattcggatatcgaaaggctgaaaaacgtccaaactgcagaagaactcaatgatgttcacaatcatttcatattgtattattccggagacttgcctgccatgcatgcagcttggagaatcaaagaaaaagagcagaggaaattcgagaagcgacagaaaagactcaagcaaattgccgaagcggaggaaggtgctgacattcctgatgaaccagaggatgacgatgatgatgaaccagaaacagaaactttgaaatatgctaatcgatcgggcagttatgcattgtgttcgaaagctggattagatcctttggcaaagaaattcggtttatcacccgagcaatttgctgaaaatttacgagataattatcaaagacacgaagttgatcaagagcctgtcgaaccttccgatgttgccaaagactttatttctcctaaattttcaactgccgatgaagtattacaagcggctaaatatatggtcgccttgcaaatagctagagaaccgttagtgagaaaatgtgttagagaagtttattttgaaagagccaggattaatgtatatccgacaaaaaaaggacaaaaagtcattgatgagtctcacaattgttacagcatgaaatatttaaaaaacaaacctgtgagagatttgaatggagatcagtttttaaaattgtgcttggccgaagaagagaaccttctaactattacaattaacgataatatcgaaggaaatacatcaaactcttacatagaggaagttaaacagctctacatcaaggacgaatttagtaaaaatgtacaagattggaatgctttaagaatggagtgcgtagaaagggcgctaacgaagagtgttttgcccgatttgcgaacagaattgaagaggaccttgttatcagaagccaaagaattcgtccttaaggcgtgttgcaggaaactctacaacagcattaaagttgctccatactctattacatttcccgatgaagacgaagacgagtgggatacatcgaaaggcgttagagttatgggtttagcttacgttccagaatatacagtttccgcatttgcttgcatagcagctcccgatggagatatcacggattatttgcgtttaccgcacatattaaaacgaaaaaacagtttcagaaccgaagaaaaattaatgaaggaagctgatttacaagccttgaagaactttattttcttgaaaaaaccccacgtgatcgcgatcggcggtgaatccagagaagcgctgatgatagccgatgatttgaaggccttgattaacgaattggttgaatccgatcaatttcccgaaatcaaagtcgaaattatcgacaacgaattggccaaactgtacgcaaactccaataaaggccaggcggactttagggactatcccgagttgctgagacaggccatttccttggctaggaaaatgcaagatcctctcatcgagtactcgcagttatgtaacggggacgaagaaatattgagtttgagattccatccattacaagaacaaataggcaaagaggagctcatcgaagctctctgcctcgaattcgtcaacagaactaacgaagttggcgttgatattaatttggctgtacaacaggcgcataaaagtagtctcgttcaattcgtgtgcgggctaggccctcgcaagggtcaagccttgctgaaagtccttaagcagaccaaccaaaggctggaaaatagaacacagttggttacggcgtgccacatgggtccgaaggtgttcattaattgttctggtttcatcaaaatcgatactaacagcttgggagatagtactgaagcgtatgtggaaatattggatggttctcgtgtacatccggagacttacgaatgggctagaaaaatggctgtagacgctttggaatacgacgatgatgaaggcgctaatcctgccggtgcactggaagaaatcctggaaacgcccgagagattgaaagatctggatttggatgcttttgccgaagaattggaaagacaaggattcggcaacaagagtatcacattgtacgatataagagccgaattgaactgtagatacaaagatttgaggcaacctttccattcggctaatcctgaggagttgtttgatatgttaacgaaagaaacgccggagacgttctatataggaaaattggttactgcttcagttataggtatcgcgagaaagaagcctaaaccagaccaactcgatcaggccaatcctgtcagaaatgacgaaacggggctttggcaatgtccgttttgtttgaaaaatgattttccggaattatccgatgtctggaatcatttcgacgccggtgcatgtccaggtcaagctactggagtcaaacttagattagacaatggaataatgggttatatttatataaagaatattagtgataaaccggtgtcgaatccggaggaaagggtaggagttggtcaattaattagttgtcgtataataaaaatcgacgttgaaagattcagcgttgactgtacgtcgaaatctagcgatttgttggataaaaatcacgaatggaggccaccaagagatcctcattatgatacagaacgcgaagaaaaagacaacagaactgaggctgaaaagaaaaaggaaaagcaacgtttgacatacataaagagagtaatagttcacccggcttttcacaacatttcttatgccgaagctgaaaaatgcatggtcaatatggatcaaggcgaagtcatcatcagaccatccagtaaaggagccgatcacttgaccattacatggaaagtcgccgataaaatttatcaacacattgatattagggaagaaggaaaaactaacgcgttttctttgggtaaatcgttgttgataggcaacgaagagttcgaagatttagatgaaataatagcgagacatgtcactccgatggcggcgcacgctcgtgatttgctctacttcaggtattttaaagaattcgagggcggtcacaaagacaaggccgaggagtacctaaaagacgagaagaagaagaacgcctcgaaaatacattacgtcgttagtgctgcaaagcacttacctggtaaattcctactttcgtatttaccgagaaataaagttagacacgaatacataacggtgactcccgaaggatttagattcagacagcaaatgttcgattcgataacgtcgctattcaagtggtttaaggagcactttagagaaccaccgcccggcggaatgacacctggaacaccaagaatgtccaccggaagaacaccttatgatatgagtaccgaagctattcaaagagttgcgcaaaatcttcctagcgacatggtccaagctttatccgctgcaacgaaccaaactcctcactacccgcacactcctggcggttatggtggtaattacatcaatacaccgtacaccccgagcggccaaacgccctacatgactccattccaaacccctcacgctcaacaaacgccgcggtacggccaacagacgccgtcccagccgtctctgagcaacccgttcctccatcccggcgccgtgacgccgtcgcaacggacgcccagttacaggaacctatcgagccaaagtccgatgataccgcaaagtccggtgccgagtccgggatcgcagagttcgtacagcagccacatgagccaccacacgagggcgagctacggggattcgatgaggttccagccgccggagtcgccgaggaattacccgagcagcaggggctcctatcccgatgggaggtacggtggcagcgaatcgatggattggcagaaggcagctgaagcttgggcttctaggtcaagatcaacgccacgaagcgaaggtcgggggactcccaggtcgtctggccacagaactcctcgtaattatgataatatgtctgaaagtgatcggtctaggatgaagcatatgagcagtaagagcccgaaatcggtacggtcgactcctcgtactaattcttcgcctagatcaatgtccttgggcgacgctactcctttatacgacgaaaatatttaa

SEQ ID NO: 738 - DNA, 2592 bp, Phyllotreta cruciferae
atgccagaagtggacgacagcgaaacgcgttcccctcgccgcaaacggcgcaggtccaaatccgccgatcgcaaggaagaaaaatcgtctaaaaggaaatcgtcgagaaaacgttcatcagacgacgattacaatgagcgagactatccacgctattatggcgaagatcggcccaacagcgacagctactggaacaaatatcccagaagagaaaacatgaaagtcggtcgtaggtattacgatcaccctgagcacgagaagaatagggatagggatagggatgcctcgaatgagaggagcagagatagagaaagcgccagaggaaaggaatactccaagaaagaggagaatgaggacaaatccataattaaacccagagaacgtaaagtcgttgatatgctaacttccagaacaggaggagcttacataccaccagcaaagcttcgtttgatgcaagagagtataacagacaaatcttcagcggcttaccaacgtatcgcctgggaggcccttaaaaaatcagtacatggttacatcaataaaatcaatacatctaacatcggtataatcgccagagaaatcctgcacgaaaacatagtaagaggcagaggtctgctttgcaaatcgataatccaagcccaagctgcctctcctactttcaccaacgtttatgctgccttagtggccgtaatcaattccaaatttcccaatatcggagaattattattgaaaagactggtgcttcagttcaaaaggggctacaagcagaacaacaagtctatttgcatttcagctactacattcgtagctcacttggtaaaccaacgggtggctcacgagattctggcgcttgaaattctgactttgcttgtcgaaactcctactgacgattccgtagaagtggctatttcttttctcaaagagtgcggacagaagctcacagaagtgtcgagtaaaggaattactgccatattcgagatgcttaggaacatcctgcacgaaggccagctcgagaaaagaatacagtacatgatcgaggtgatgttccaaattagaaaggacggctttaaggaccacgccgctgtaacggaggaattagatttagtagaagaagaggatcaattcacccacctaatcatgcttgatgatgtaaaggaggttaatgctgaagatattctaaatgtattcaagtttgatgaacattacgaagaaaacgaaggcaaatacaaaactctgagtaaagaaatcttgggaagcgatagcgagtcggaatcaggatcggagggatctgaagaggaatcagatggcgaaggcgaggacgaagaaatcaaagatgccgggaaaatcatcgacaatactgaaacaaatctaatagctcttagaaggacaatatatttgactatacaatccagtttggatttcgaggaatgcgctcacaagcttttgaaaatggagttaaaacctggtcaagaaatcgaattatgccatatgtttttagattgttgtgctgagcaaaggacatatgaaaaattctacggactgctagctcaaaggttttgccagataaataaaatatacatcgagccttttcagcaaatattcaaagacactttcgcgactacccatcgcttggacaccaatagattgaggaacgttagcaaatttttcgcccatttgctctttacggacgccataggttgggaggtgttcgagattatgaaactcaacgaagaagacactaacagctcgagtaggatttttattaaaattttgtttcaagaattagccgaatatatgggcttaggaaagttgaatgcgagattgaaagatgaaacgcttcaacaacattttgcgggattatttcctagagacaatcctaaaaataccagattttccattaatttcttcacgtccatcggtttaggaggtttaacagacgaacttagagagcatttaaaaaacgtccctaaaattatggaaattaaaacgaccgccgtgagggaaaaaagcgaaagtagcagtagcagcagcagcagtagcagtagttcaagtgaagaagatagcagtgatgatagttctggggattcgagttcagaggatgaaaaacaaagggaaaaatcgaaaaagaagaaaaagaaacgcgagtcggaaagcaaatcttcaaaatcagattcgaaaattaatcgcaaagccgaaatgcgcgatagaggtaagcacaagaagaataaggacaaggaagatcgtaaagaaacccataaaaataaagaaaatagaagcgattcggacaagcacgtgtcaagggagaaacaaaactcgaggcaagataaaagaaaagatgacggtgacattaaagaaaaacacagaaaagatgatagggaggacagggagaggcaacggaggaacgaagaaaagagtgggaggaaaaaggactatgaatgggtgaaaagtagacacgaggataacatacatcaattaaaaacatctaaaaaagtgtttgaaaaaccatcgaagcacaggtcgaggtcgagagacaaaattagtagtaaagaaaaggacagaaagcatagaagtaaagaaaggcgaaaaagttga

SEQ ID NO: 739 - DNA, 1788 bp, Phyllotreta cruciferae
atggcgttgaaaaaccaagtcggtcaaaaaataatgaacgaggtgataaaacataaagcctccaagaagaacggacctgcagttacacagccccacaacgctagtggtgttgactggagaatcctggtggtcgatcaactggcaatgagaatggtatcggcttgctgtaaaatgcatgatatatcagctgagggtattacattggtcgaagatataatgaagaagagagaaccgcttgctacaatggaagctgtgtacttgatcacaccttctgaaaagtctgttcatgctctcatgaacgatttcgaatctccgagacctatgtacagaggagcacatgtatttttcacagaagcatgcccagacgaattatttaacaaattaagtaagagtcatgcagcaaaatatataaaaacgttaaaagaaatcaacatagcatttatacccacagagtcacaggtattttctttagattccccagacactttccaatgtagttacgatccttcctttgctgccgcacgaaatgcgaatatggaaagaatggccgaacagattgcaacattgtgcgccactttgggggaatacccgcacgtccgatataggagcgattgggaacgtaacgtagagttggcgcaattgatccagcagaaattggatgcttacaaagccgacgagccgaccatgggagaagggccggagaaggcccgatcgcaattgctgatcttagaccgaggcttcgattgcgtttcgcctttacttcacgaactgacgtttcaagctatggcctacgatttacttccaatcgaaaacgacgtgtacaaatacgaggcttccgctggggtacaaaaggaggttctcttggatgaaaacgacgagctgtgggtggagttgcgccatcaacacatcgccgtggtatcccaaagcgttactaagaatttgaaaaagttcaccgattcgaagcgcatgactcaaagcgataaacagtccatgaaggatttgtccactatgattaagaagatgccgcaatatcagaaagaattatcgaaatacgctactcacttgcatcttgccgaagactgcatgaaggcctaccaagggtatatcgacaagttgtgcaaagttgaacaggatttggcaatgggaactgacgccgaaggggagaaaattaaagatcatatgcgcaacatcgttccgattcttttagataccaaaataacgaacgaatacgataagatgcgcatcatagctttgtacgctatgaccaaaaatggaataaccgaggaaaatcttacaaagctagcaacgcacgcccaaattaaagataaacaaactattgctaaccttcagctcttgggagttaatgtcattaatgatggtggccctagaaaaaagatctacaccgtaccgcgcaaagagcgaattacagaacaaacttatcagatgtcgagatggacacctgttattaaagatatcatggaggattgcatcgaagacaaattggatcaaaaacatttcccctatctaagtggacgagcgcaaaccacaggatatcacgcagcaccgtccagcgctcgatatggacaatggcacaaagatagaggtcagcaggccgtgaagaacgtcccgcgtctgctggtcttcgtcgttggaggcataagtttctcggaaattcgctgcgcgtacgaggtaacaaacgcccagaagaattgggaagtcataatcggatcgtcgcatatccttacaccagaaggtttcctcagtgatttagcgacgttagccggctag

SEQ ID NO: 740 - DNA, 2139 bp, Phyllotreta cruciferae
atgatgcaacaatatatgaaagaattagaacaagagcctttcgatgccgaagaatttgtagaacgtttagcctggagaactttagctgaatcaaaaagcgagggagaggaaaatgaaattaatccggcacttcttcacgagtcgtttgttcaagccataaaggaccttaatttattgcacgaaaggcaacagaaaaaatgcgaaaaattagaagttgccgttagagaagacgaagcgacgttttttcaagaagtttacaatttattggaacaaaataagcaagctatggatacatttcaagaactggacggcaaaattaatcatgtagcaaccaaagttcttcacttgggtgatcaattagacagtgtcaatggtcccagatctagagttgtcgatgcattaagcttaatgactcatttaagagaatttttatcgaacgagccagtttcatccacaatatttaccaatgaagaatacattgatgaagcagctgatgtgattcaaaagttgtatttaatatcgcaagatttgccacccaagtttgaatcgataaaaagaaaaatagaaaggaagtattcggatattgaaaaaacgctaatagaagagtttgttggggccatggataatgagaatttaacaagaatgaaggagatagcattggtactgtcccaatttaaaggctactctcaatgcattgactcctatatagatcacagccaagtgggttgtttatctagtaaagatgtcttctataactttttgaatttgtgtaaatacaatgatgaaataattcgaaaagttttcaagaatccagagcaagtgatggcgaaattcgttttaaatatatatcagctaaaattagtggaatatatagatcaaaaactaaattctaaattgggtacatacagctatttacaaacattatatgaactgtattcaaagactaatcatctatcaagcgaattaaccgtttttcatatgggaaacgacaaaaactatctcactaaactaacgacaaatatttttaataagtatattaacgattacatttctatggaactcaagtgtctcaaagacagatgttcaactaacttgcaaaaatattatgattcgaaaaatcatcaaaagaaacagattcagtctgggggctttcaagatcttagaagagatttacaagcagtaataggcacaagggcaaacattaacatagcacaaatagaaaattatggcggtgagactttcttatcggaggaattggcaatcatgattcttcaagatactaaacaagcttttcaacgttgcttattgttatcaaaaggtagtgaaagagcttccaacgccactcaaattttagacaggcttattaatagtttgctgatagaacatgtagactatgcagttgagttgggtctacacgctgtacccgttgtcgaaggcgttagaaatccccctgttttgtatttttttaatatcgtgcatcagagcaataatataacccatctcgtcgagaaacagtttatggatttggtggttccattagtagaaaatacttcaaaatatagcgattgcatacagaagaaaaaatttgttttggaggatatagaaagaaaaattaatacgggattggatagatgtttgagtgcgatattaaattgggtgaagttgtatttacaatctgaacaaaagaaatcggatttcaagccagagtctgatgattttgatacagtggcctcgccagcttgcaagaacgtacttaattatgttaatagtattatcaaagaaattaaaactaatttggatggcaataatgtaacagctatccttcaggaattagggattagactgcatagagttgtttacgagcacttgctgcagtatcaatataacactgcaggtgcaatggtggcaatttgcgatttaaacgaatatagatcttgtactaaacaattaggtcctttagttgcggagcttttcgatactttacatgctttgtgcaatcttttgctggttaaaccagaaaaccttcaacaagtgtgctctgaagattctttggttaagttagacagagcgatcctccatagttttatacaactgcgaagtgattttaaagttcaaaagcagactattttgaaagtttag

SEQ ID NO: 741 - DNA, 813 bp, Phyllotreta cruciferae
atggattttcaaaacagacctggtgggaaaacgggcgggggcggcgtcgcctcctggtcggaaaccaaccgagaccgaagagagcgtctgaggcaactggccttagaaaccatcgatctgcagaaagacccctattttatgaaaaaccacctggggtcttacgaatgtaagctttgtttgacgctgcacaacaacgagggtagttacttggcccatacgcaaggcaaaaagcatcaagccaatttggccaggagggcggccaaggaagccaaagatgcccccacgttgctccaaccggagaaacctcgagtggagcccaagaaggtcgtgaaaatcggtaggcccggttatcgggtaaccaaacaaagagaccccgaaaccggtcaacagagtttactgttccaaatcgattatccagaaataagcgatttggttttgccccgacaccgcttcatgtctgcgtacgaacagaaaatcgaaccccccgaccgtaaatggcaatacttactcttcgctgccgaaccgtacgagaccattggcttcaaagtaccgagcagagaggtagaaaaaaccgatactaaattttggacacactggaacagggacaccaaacagtttttcctacaattcgccttcaagaacgagaacaaacgcaacgttaactctgtagtacaaaggcattcgattgttggtggcgttccaccgcctcccatgctgccggtaccgccgccacccaggcctcctatgtttaatcccattccaccgccaccgccgatgatgagggctgttttgccagtaccccctccgaattaa

SEQ ID NO: 742 - DNA, 402 bp, Phyllotreta cruciferae
atgtctatcggtgtacctattaaggttctccacgaagccgaaggccacattataacctgcgaaacgataaccggcgaagtttacaggggtaaacttatagaagccgaggataatatgaattgccaaatgacccaaataactgtaacttacagagatggacgagtggcgcaattagaaaacgtttacattagaggttccaagataaggttcttgatattaccggatatgttaaagaatgctccgatgtttaaaaaacaaaccaaagctggaactgctggcagagggaagtctgcaattctacgagctcaagctcggggaagaggtcgagggcaaccgcctgttcgaggaggcagaggggcttggcagaatcagcaaaacgctcctgcaggtcgagcaaaataa

SEQ ID NO: 743 - DNA, 1329 bp, Phyllotreta cruciferae
atggctacaaatctatcccgaacatcgctcctgcgaatcattaacgctaggggctacgcagcctgtccccatccactttccggggttccaaacgcagaagtaaaaagcaccatactccccaacaaaacggttgtagctgctgttgacaacaacgcctccctcaccagagtttcaatcgtattcagggctggaagtcgtaacgaagatcccgacaatttaggtgtagctcacgtgttgagaaccgctgctggtctgagtacgaagaactgttcgcaattcgctattattcgcaacattcagcaactgggggccaatttaacggccacttccgatagagaaactatctgctacactttagaaggtaccccagaagccgtggaatgtgctatacctttcttgaccgaagtagccacccaacaggaattcagaccttgggagatttccgaattgtctggtagattgcagttggatattgctacaagaccgttgcagttgagagccatcgatttgctgcacaacgctgcctttagaggacgcggcttgggtaattctctgtttattccgaaaactcaaatcggtaaaatttcgtccgaaaccctacaacactacgttgcctcgaacttcgtgagcggccgtatggctgtagtaggctcaggtatcagtcaaaaggaactgacatctttcgcaaactccttgaaaattgaaaatggcgaaggcaacaacgctccttcaccttacgtaggaggtgaactaagatcaaacaaaggtggtcaacttgcattcgttgctgtagcaggagagggtgctgctatcacgaacaccaaggaagctctggctttcgctgtgctacaaggagccttaggaggaggcccacaggttgcacacggagtttccgacaatggtgtcttcaggaaggctcttggaagcaaccccaatgtcagttcagtagccataaacgccagttactcagacaccggtctctttgggcttctactggctgtgccaacgaagtctgcaggaggtgctctagaaaccgctgttaaagtgcttaagagtggaacggtttctgatgaagatgtccgcagaggtaaaaatcaattgaaaacatcgattctctttggggctgaaagcggagctgatattgtaagaagaattggacaggaagctgttttgacacaaaaagctaccagtgttgatgcacttgtagctgatgtagattctgtttctaccagtgatgttgcaaatgctcttaagaaagcaggcaagaaattgtcattagcgtctgttggaaacttagccggagtaccatttttagatgaactaaagtaa

SEQ ID NO: 744 - DNA, 333 bp, Phyllotreta cruciferae
atgagaagagcccatgcaggtaactactacgagccattgccgcagaattcgaacgaaattgaagacgaaaatgatcggatgactaacgaactacaagagaaaatcggagccctaaaatccctcactatagatataggaaatgaggttaaataccaggacagaatgctcagggatgtcgatgatgatttagagaaaaccggagggttcctgggaaccaccatgaacaaagtcttgaggctgtcgaaagggggccacaattacatcattgtgtatttgtttttattttcgattgttgtattttttatactttactgtgttattaaatttaggtag

SEQ ID NO: 745 - DNA, 1491 bp, Phyllotreta cruciferae
atgtcttacccatcgacgttaaacgcaaaacaggccgcacaggaacacgttttagccgtgtccagagacttcgtatcccagccaaggctcacttacaaaacagtgtctggtgtcaacggaccgttggtaatcctcgaagatgtcaaatttccgaaattcaacgaaatcgtccagctcaaactggccgatggcagtctacgatccggtcaagtattggaggtgagcggctcgaaagccgtagtacaagtgttcgaaggtacttcgggaatcgacgccaaaaacaccgtgtgcgaattcaccggcgacattctcagaacgcccgtatccgaagacatgttgggcagggtgttcaacggctcaggaaaaccaatcgataaaggacctccaattttggctgaggacttcttggacatccaaggtcaaccgatcaatccttggtcgcgtatctacccggaggaaatgatccaaaccggtatctccgccatcgatgtgatgaactcgatcgctcgtggtcagaagattcccattttctcggcggctggtctgccccacaacgaaatcgccgcccaaatttgtagacaagccggtcttgtcaaggtgcccggcaagtcggctttggacgatcacgaagacaacttcgccatcgtgttcgccgctatgggagtcaacatggaaactgctcgtttcttcaaacaagatttcgaagagaacggttcgatggagaacgtttgtttgttcttgaatttggcgaacgatcctactattgagagaatcatcacgcctcgtttggctctaacagcagccgaatttttggcctatcaatgcgagaaacacgtcttggtcatattgactgatatgtcttcgtacgctgaagctttgcgtgaggtatccgccgccagggaagaagtgcccggtagacgtggtttccccggttacatgtacaccgatttggccaccatttacgaacgagccggacgtgtggagggccgcaacggctccatcacccaaatccccatcttgactatgcccaacgacgatattactcacccgattcccgatttgaccggttatattaccgaaggacagatctacgtcgaccgtcagctgcacaacaggcaaatttaccccccgattaacgtcttaccatcactgtctcgtctcatgaagtccgccatcggcgagggaatgaccaggaaagatcactctgacgtttctaaccagttgtacgcttgctacgccattggtaaggacgttcaggcgatgaaggccgtggtgggagaggaggccctgacgcccgacgatttgctctacctggagttcctgaccaagttcgagaagaacttcatctcgcagggcagctacgagaatcgtacagtgttcgaatcgctggacatcggctggcagttgttgcgtatcttccccaaggaaatgttgaaacgtatcccggccgccacgttggccgaattctacccgagggactcgcgtcattag

SEQ ID NO: 746 - DNA, 2421 bp, Phyllotreta cruciferae
atgagttacatgcagactaaccaaaatagaccaatgtctcaaggctatcatcagggtgccaacgatctcccaatgcagtcgtccaaagagcagaccctgctatggcagcagaactcctacatgggagactcaggcatccagtcaggcgctgccactcaagtgccatcgctctctggcaaagaagaggaagagatggacctcttcgatctcgaccaaccctaccaaggattcacgcaagagcaagtagacgaaatgaacaaccagctgaaccacaccagatcgcaaagagtgagggcagctatgttccctgaaaccttggacgaagggatcgagattccttcgacccagttcgatccgaaccatcaaactgctgttcaacgtttggccgagccaagccagatgctcaaacacgctgtggttaatttaatcaactatcaagacgacgctgatttggcgaccagggctataccagaattgatcaagctgctcaacgatgaagatcaagtggtggtatcgcaagccgctatgatggtgcaccagctctcgaagaaagaagcttctcgacatgccatcatgaacagcccccagatggtggccgctttggttcgagccatctccaattccaacgatttggaaaccaccaaaggtgctgttggcacgttgcacaaattatcgcaccacaggcagggtttgctggccattttcaagagcggtgggatcccagcgctcgtgaaattgttgagttctccggttgaaagtgtattattctacgctataaccacgcttcacaacttgttgctccatcaagatggttcgaaaatggcggttagattggccggaggattgcagaagatggtagctttgctccagagaaatcatgtcaagttcttggctattctcaccgactgtttgcaaatcttggcttacggcaatcaagagagtaagctcatcatactcgcctctcaagggcccatcgaattggtcagaattatgagatcatacgattacgagaagctgttgtggactacttcgagagtattaaaagtgttgtcggtgtgttccagcaataaaccggctatagtagaagctggcggtatgcaagccctcgccatgcatttgggcaaccccagcacgagattggttcaaaactgcctttggaccctcagaaatctatcagacgcagctactaaagtcgacggattggagagtttgttgcaatcattggtacaagtgctgcaatcatccgacgtaaacgtggtgacttgcgccgccggcatcctgtcgaatttgacgtgcaacaatcaacgcaacaaagtgacggtgtgccaggtgggcggcgtcgacgccctggtgcgcaccatcgtcagcgccggcgatcgcgaggagatcaccgagccggcggtgtgcgccctacgccacctcacctcccggcacgtggagtccgagatggcccagaacgccgtgcggctgaactacggcatacaagtgattgtcaagctgttgaacccgccgtcgcgttggccgctggtgaaggccgtcatcgggttgattaggaaccttgctctgtgtccggccaatcacgctccgttgagagaacacggcgccattcatcacttggtgcagttgctgatgagagctttccaagacactcaaagacaacggagtagcgtcgctagcggaggcagccaaccgcccggaacgtacgcggacggtgttcgcatggaggagattgtagagggaacggtgggagcgttgcatatattagcgagagaatcgcataatcgggccatcattagacagcaaatggtgattccgatcttcgtgcaattgctgttcaacgatatcgagaacatacagcgcgtcgccgccggtgttctttgcgaactggccgccgataaagagggggctgaaatgatcgaaaacgagggcgccactgcccctttgactgagttgttgcattcgagaaacgaaggtgttgctacatatgcagctgcggtgttgtttagaatgagcgaagacaaaccacaagattataaaaaacgactgtctatggagttgactaattctttatttagagaagaaaatctttggaatcccgatctaggcatgggtccggatttgcaggatattttaagtcccgaccaggcatacgacaacatgtatgctcagggtcccccaagtgttcatagtagccatggcggccgaccatatcaacaacaagggtatgaccagatacccatagacatgcagggtttagagatcggttctcacggaggggggaatgggtccacttacagtgcaatagacgcaatggacgttaccagcggggaacctgatctcaatttcgataccattgatcaactccctacccctcctcaagataataaccatgctgctgcttggtatgataccgatttataa

SEQ ID NO: 747 - DNA, 801 bp, Phyllotreta cruciferae
atggcccggaacgctgagaaggcaatgacaacattggccagatggagggcagcccaactgggtgaaatcgacaagcacaagaaacgccggccatatttagcatcagaatgcaaaagcctgtacgcctgcgagaaatggcgcatgcaaatcatcagggaaatagcgaaaaaagtggcccaaatacagaacgcagggctcggggaattccgcattcgcgacctaaacgacgaaatcaacaaactcctgcgcgagaaacgccattgggaggaccaaatcaaggagctaggcggccctgattaccagcgcgtcggccccaggatgctagatcacgaaggcaaagaagtccccggcaacagaggctataaatacttcggagccgctaaggaactaccaggcgtgcgagagctgttcgaacaggaaccgccgcccccgcctaggaagagccgtgcagaactgatgaaggacatcgatgccgattactacggctacatggacgacgacgacgggatactgatccctttggaaatcaaagctgaaaaaatagccgtacaaaacgcgatagccgaatgggtgaacaacaaggaaaagaacctagaccccgccaaaggaatcgaagagagtatctacgtggtggaggattcagatgaagaagatgttgttcaacagttcgatggttcgcaacagagattcgtggcacacgtaccggtgccatcgcaacaagatatcgagcaggctttgctgaggcgaaggaagcaagagttgatggagaaatacggcgtacaagatgaacaggatctatga

SEQ ID NO: 748 - DNA, 2409 bp, Phyllotreta cruciferae
atgccaagaataatgataaagggtggtgtttggagaaacacggaggatgaaattcttaaggccgccgtgatgaaatacggcaaaaatcaatggtctagaatagcatctctgcttcacaggaagtctgcgaagcaatgtaaagcccgttggttcgaatggttagaccctagcatcaaaaaaaccgaatggtccagagaagaagatgaaaagttgttgcacttagctaaactaatgcccactcaatggagaaccatcgcgcctataataggcaggaccgcagcccaatgtctagaaagatacgaatatttactggatcaagcgcaaaaaaaggaagaaggcgaagatgccgtggatgatccgaggaagctaaaacctggagaaatcgaccccaatccagaaaccaaaccagccagacccgatcctaaagacatggacgaagacgaattagaaatgctttccgaagccagagccagactggccaacacccaaggcaaaaaagccaagcgtaaagctcgtgaaaagcagttagaggaagcccggcgtttggcggctttgcagaaacggcgagaactgagagcagccggtatcgaagtcacctcgaggcgcaagaaaaaacgaggtgtagattacaatgcggaaattccgttcgaaaaacaaccagcaatcggtttctacgacacttctaacgaagccctcgacttgatggcccctgatttctctaaaatgagacaacagcatttagacggcgaactcagaagcgaaagagaagagagggaacggaagaaggataagcaaaagttgaagcaacgcaaggaaaacgacattcctcaagcgatgctgcaaaacgaggaaccagctaagaaacgatcgaaactggagcaaaagttgaagcaacgcaaggaaaacgacattccccaagcgatgctgcaaaacgaggaaccagctaagaaacgatcaaaactggtattgccggaacctcagatatccgatcaagagatgcatcaggtagttaagttaggcaaagcgagcgaaacggccagagaaatcgcaacagaaagcggtgtcgaaaccactgatactcttcttaacgattacatgttcacaccgcaagctgctgctactccaagaactcccgctccccaaactgacaggatactccaagaagctcagaatatgatggctcttacacacgtagatacgcctcttaaagggggtttgaatacgcctctgcataactcagatttcagcggggttctgccgcaatcgcaagcgattaccactcctaatacggtactcgctacgccattcagatctactagaagcgacgggggagctacaccaggaagtactgccggattcatgactcctaaaagcggagccctgactcctgttggtaaaaacgcgacgccttctatcagagataagctgaatattaacgctgaagaaagtttagatgtgggaagtactccggccgaacatagaatgtttcagatgtcgatgaaagaccagttgaaacttggattgagcagcttaccacaaccaagaaacgattacgagattgttgtgcctgaaaatgaagcacaagatgaaccagaagaagcccaagctcaattggtcgaagaccaagctgatgtcgatgctagaaaacaagaggaactgagagccaaagcggctcaagaattagcatcgcgttcgcaagttatccaaagggaattgccaaggccgcaagaggtgaatttgaccgtgctgcgaccgcccaacgaaagctactccttaaccgaccttcaacgagccgaagagttgattaaatgcgaaatggttactatgttgcaatacgacaacctgaagaaccctctgccagcgcaaagtaagcgatccaacatgtcgcaagcccagcaattggcctttctcgagcaacatccttacgattcgttcaaaaaggaagacttagacgtggctaaaacgctgttgagaagcgaaatggacgtagtgaagaacggcatgaatcacggagaattgccgttggaggtgtacaatcaagtatgggaagagtgtctgagtcaagtgctgtatttaccgaatcagacgaggtacactcgcgctcatttggcgagtaaaaaagatagattagaatccgcggagaagcggctggagcagaatcgatcgcacatggccaaggaggcgaagcgtgccgccaagatggagaagaaattgaagatattaacgggcggttatcagtccagggcgcaggtgttgattaaacagttgcaggatcagtacgagagcatcgatcaatcgacgttggagttgaacacgttcaaattcctggcagagcaggagaagaacgctttgccgatgcgaatacagtctcttactgaggacgttaataggcagatggaaagagagaag

SEQ ID NO: 749 - DNA, 456 bp, Phyllotreta cruciferae
atgatgcaatttatgttattgttcagtaggcaaggaaagttgcgattgcaaaagtggtatgtggctcatcctgataagctgaagaaaaaaattactagggaattaattactaccattcttgccagaaaaccaaaaatgtgcagttttttggaatggagagatttgaaaatcgtttataaaaggtatgccagcttgtatttttgctgcgcgatagaacaatgcgacaatgaactgctaactttggaaatcattcatcgttacgttgaacttttggataagtacttcggaagcgtatgcgaattggatataattttcaactttgaaaaagcgtattttattctggacgagctgatgcttggtggcgaggtgcaggaaaccagtaagaaaaatgttctgaaggcaattgctgcacaggatctcctacaagaggttagtcatgggaatattgaattatag

SEQ ID NO: 750 - DNA, 1371 bp, Phyllotreta cruciferae
atgtatggattacaacgatactcgttttcttatactctcaaaaatgcggtgcgttattactcgagagaacccgccaagagatcgtcgtttctcagccgcctatacgacaatttcaaagatgaaatgaacaaaaacaaagaaatgaaagaatccctaaaaaaattccgcgaagaagcccaaaaactcgagcagagcgacgctctaaaagctgcccgacagaagttcgaaaccgtagagaaagaggccagtaaaagcggcgaagtcttcaaagagagtttaggttctattaaagagagagttaaaggtgtgatagacgaggccagtaaatcggatctggccaaaaaagctggtaaattcaccgaagaagtaggaaaaactacgcacaaaatcagcgaaacggcacaagaaatcagcaaaaccggagcctttcaaagcatatcggaggccaccaaagccgttaaacaagaaatcgacaacaccagcatggaaggtcgagtgtacgtgagccctaagaagcttcgaaaacgaaccgaaaccagcgcagtagtccaacaaaagtactacgaaccgaacacagacgccaccggcgtagagctacacaaagactccaaattctacgagtcctggcagaacttcaaaaacaacaacccctacgtgcacaaagtcatggactggaaactcaaattcgacgaaagcgagaaccccatcatcagagcctccagggcgctcacggaaaaagtgggagacataatgggagggttgtttcaaaaaaccgaactctccgaaacccttacagaaatctgcaaaatcgaccccgacttcgatacgaaacgcttcctaaaacaatgcgaaaccgacatcatccccaacatcctagaagccatgaccagaggcgacttggatgttttaaaggactggtgtcacgaaggccctttcaatttattcgctgtaccgatcaaggaggcctataaaaaaggctacaaaatcgagtccaagatcctcgatgtagaccatgtggatctagtgatgggtaaagtgatggatcaaggccccgtgttgattatttcgtttacgtcgcagcaagtgatggccgtgcgggtccccaacatcctggaagccatgaccagaggcgacttggatgttttaaaggactggtgtcacgaagggcccttcaatttattcgctgtaccgatcaaggaggcctataaaaaaggctacaaaatcgagtcgaagatcctcgatgtagaccacgtggatctagtgatgggtaaagtgatggatcaaggccccgtgttgattatttcgtttacgtcgcagcaagtgatggccgtgcgggatccgtcgggggctgttgtagaaggggatccggac

SEQ ID NO: 751 - DNA, 924 bp, Phyllotreta cruciferae
cttaaatttataaaaatgagtagcagtgattcagaattaagcgatagtgacgctgagttgcaacaagcattattagatggtaagctgaaacctggtttaaataaaatcgaacaggctcctaagcaattcgtaaacaacataagtggtttaaatcagaaaatcgaagaattcaaattgaatctaccatggatcgaaaggctggattgtacgaatgcccaagcccccttagcgcccgagttagcggaggagatgttagctcacgaagaaaagagaagtaatcaactgcgaaacaacaaaaaacttccccaattccaaccgtcggaagatccagttctgaacgatttcaaacgagaactaatattccataggcaagctcaagctacaattctggacgcaattccgaaaatcaaagaattagggatatctactaaaagaccggacgattattttgctgaaatggcaaaatccgatgagcaaatgcacaaaatcagagagaacttaaagcagaagcaggagcagcagaagcggagtgaacgggtgaagcaattgaggcagcaaaggaaagagggaaaatcgctgcaggtgcagctcaagttgcaacgctctaaggagaagaaagagatgatggatcaagtgaagaaagcgagaaaaaatttcgattttctggatgagaaaaataagcccatgggaaagaataaggtggcagaaaggcgtaagatgaaggataaaaaattcggttttggtggtaagaaaaaggggatgaagaaaaatacaaaggacagtgcgggcgatattagcgagtatagaaatcctggaaaagccaagaaacagatgggaaacaaattcgtcaataaaaacaaaccgaaaaatcaaagaatgggtaaaaataggagaattaaaactaaggctaaaggaaaaaaataa

SEQ ID NO: 752 - DNA, 1752 bp, Phyllotreta cruciferae
atgaatcccagcgccccaaattatcctatggcgtctctgtacgtcggggatttgcattccgatattactgaggccatgctttttgaaaagttttcatcggctggcccagttttatccatccgcgtctgcagggatctgataacccgcagatctttgggttatgcctacgttaacttccaacaacctgctgacgctgaacgtgccctcgacactatgaatttcgacttgatcaaaggcaggcccattcgtatcatgtggtctcaacgtgacccttctctacgaaaatctggagttggtaacgttttcatcaagaacttggaccgatccatcgataacaaggccatgtacgatactttttccgcgttcggcaacattctcagctgcaaagtagctcaagacgagagcggagtcagcaagggatacggtttcgttcacttcgaaaccgaagaagccgccaataagtccattgaaaaggtaaatggcatgctgttgaacggcaaaaaggtctacgttggccgtttcatcccgcgcaaagaaagggaaaaggaattgggcgagaaagccaagctcttcacgaacgtttatgtgaaaaatttcggagaggacttgtccgaggaacagctaagaacgatgttcgagaaatacggcaagataactagctacaaaataatgagcaaggacgatgggaaatcgaaagggttcggattcgtcgcattcgagagtcccgaggcagccgaatcagctgtcgaagccctaaatggcaaagaaatattggaaggcaaacctctgtacgtcggaagagcccagaagaaggccgaacgccaacaggaattgaagcgtcgcttcgaggctctaaaaatggaaaggctcaaccgttaccaaggcgtaaatctatacgtcaaaaacttggatgataccatagacgatgaacgccttcgcaaagaattctcaccgttcggcaccatcacatccgccaaagtaatgatggaagaaggccgaagcaaaggcttcggcttcgtttgcttctcctcgccagaggaggccaccaaggcagtgaccgaaatgaacggcagaatcgtcggcacgaaaccactctacgtcgccctggcccaacgcaaggaagaccgcaaggctcacttaacatcgcaatacatgcaacgcatggccaacatgcgcatgcaccagatgggccagttcatccagccgggcggctccagcggctacttcgtgcccaccattcaagcgacggcgccccgattctacgggccggctcagatgccgattcgcacgagcccgagatggccggcgcagacgcccgtgcgccccggcgcccaagggagcaccgccacctacaccggcatgccgaacagctacagggccgccgccagaccgccgggtcagtccacgatgcgcagcaacatcagcgtgccgcgacccatcaccggacaacaaccaccaagtatgcacggtcgtccacttgttggacaagtgtggctgctgccggaaatcgtgcagccaacttcaaatacaccgccaacatgcgtaatccaccgcaagcgttgttacccggagctcaagctcaagtacagcaagcagtccatattcaagggcaggaaccccttactgctaccatgctggccgctgctcctccgcaggagcagaaacaaatgttgggagaacgattgttccctctcattcaaagaatgtattcagatttggctggtaaaatcaccggtatgttgctggaaatag

SEQ ID NO: 753 - DNA, 2568 bp, Phyllotreta cruciferae
atgaccgactcaaagtattttacaaccaccaaaaagggagaaatattcgaattaaagtcagaactcaacaatgataagaaggagaagaagaaggaagccgttaaaaaggtcattgcttccatgactgtaggcaaagatgtctcagcattatttcccgatgtcgtgaattgcatgcaaactgacaatttggagcttaaaaaattggtttacttgtatttgatgaactacgctaaatcgcagcctgatatggctattatggcagtcaataccttcgttaaagattgtgaagatcccaatccactgattagagcacttgctgttagaacaatgggctgcattcgtgtcgataaaatcactgaatatttatgtgaacctctaaggaaatgtctgaaagatgaagatccttatgtcagaaaaactgctgctgtttgtgttgctaaattgtatgatatttcgtcagggttagttgaagatcagggattcctcgaacagttaaaggaattattaagcgattctaatccgatggtagttgcaaatgctgttgctgctttgtctgaaatcaatgaaagtagtcctacaggtcaacccctcgttgaattaagcaccaacacaataaataagcttctcactgctctaaacgaatgcaccgaatggggccaagttttcatactcgattccctgtcaaactacactcctcgagacgagcgggaagcccaaagtatatgcgaaaggatcactccacgtctagcccacgctaacgctgctgtcgtactatcggccgttaaagtattgatcaaaatgatggagattttggcgggcgacactgaattctgtaacacgcttagcaaaaaattagcgccacccttagtgactctgctaagctcagaacccgaggtgcaatatgttgcattgagaaacattaacttgatcgtccagaaaaagccggacatcttgaaacatgaaatgaaggtattttttgtgaaatacaatgacccgatttacgtcaaactggagaaacttgacataatgattcgattggcttctcaagtcaatatagctcaagttctcagcgaactcaaagaatatgctactgaagtagatgttgactttgttagaaaagctgtgagagcaatcggtcgttgtgccatcaaagtggagccttctgcagaaagatgcgtcgctacgctgttagacttgattcagaccaaagttaattacgtcgtacaggaggccatcgtcgtcatcaaagacatatttagaaaatacccaaataaatacgaaagtattattagcaccttgtgcgaaaatttggatactctggacgagccagaagccagagctagtatggtctggattataggagaatacgccgagagaatcgataacgcagatgagttactggatagtttcttggaaggttttggtgacgagaacgctcaagtacaactacaattgctaacagccgttgtgaagctattcttaaaacgtccacaacatacccaaggcttagtccaacatgtactgagtttagccactcaagactccgacaatcccgatttgagagacagaggtttcatatattggagattgttgagtaccgatccggccgctgccaaggaggtggttctcgctgataaacctcttatttccgaagaaacggatctcttagagccgactcttctcgacgagctcatctgccacatatcatccctggccagcgtctatcacaaaccacccacggcgttcgtagaaggccgaagtgcaggtatcagaaagacattgccggctagacaaggctctgatgacacagccgccgctcccgaaaccactgttattccgaaccaagaaagcctcattggtgatttgctttctatggatattaacgctcctgctccagctgctgctgctcctgccgcccctcagactagtaacgttgatttactcggcggtggattggatgttttgttgggaggaggtaatgatattggggcagcacctgctagtgctgctgctcccaccactactggtcttctcggggacatattcggcatacctactgcacctaccatgtacacaccgccgaaagttatctggctgccggccgaaaaaggcaagggaatggagatctacggtactttctccagacgatctggccaaatggccatggaaatgactataaccaataaggctatgcaggctatgtcgggtttcgcgattcaattcaacaagaacagtttcgggatcacgccgagtgcgcctatgaacattcccactttgcaaccgggccaaaatctcgaatacagcctgccgttgaacactacggggcccgtacaacgcatggatccgttaatgacgctccagattgccataaaaaacaacgtcgacgtgttttactatgcttgtcaaatacccattcagatattgttcggggaggacggtactctggataagagggtgttccttaccacttggagggacattccgggagctaatgaggtcagtatgttggtaaatataaacgttgtttggtacggagtttataattttcgaggtattaaaaatgtttaa

SEQ ID NO: 754 - DNA, 498 bp, Phyllotreta cruciferae
atgccgcctaaattcgatcccactgaagtaaaatacgtttacttaagatgtgttggaggagaagtaggagctacatcatctttggctccgaaaatcggtccccttggtttgtctcccaaaaaaattggtgacgatattgccaaaggcacagccgactggaaaggtttgaaaattacggtccaattgaaaattcaaaaccgtcaagccaccatctccgtcgttccatcggctgcttccttaatcattaaggctttgaaagaacctcctcgtgacagaaagaagcagaaaaacattaaacacagtggaaacattacattcgatgatgtaatttctattgccaagcaaatgaggcatagatcaatggccaagagcctttctggaactattaaggaagtgctgggcactgctcaatctgtaggttgtacaattgacggcaaagccccccacgacgtcatagatgaagtcaatgagggtactgtagaagttccagatgagtaa

SEQ ID NO: 755 - DNA, 1095 bp, Phyllotreta cruciferae
atgagcgaagaagggaaaagagcgttaattttagtcgggggctacggcacaagactgaggcctctaactttgagccggcccaaacctctagtcgaattcgcgaacaaaccaatcctgttacatcaaatagaagccctagtagacgccggagtaacggaagtcatattggccgtgtcgtatcgagccaagcaaatggaggaagagcttacagtcgaagcggctaaactgggcatttctatagtattttcgcacgagactgagcctttgggcaccgcaggaccaatagccttagctagagaacacctttcgaaaagcacaaaaccgtttttcgtactgaattcggacataatatgcgacttcccgttcagagagctagagaagttccacgaaggccacggcaaagaaggcaccatagtcgtcacaaaggtagaagaaccctccaaatacggagttgtagtgtacgatcaaaacaactgcatcgagagtttcgtggagaaaccccaggagttcatttcgaataaaatcaacgctggtctgtacattctaaaccccagcgtgattaacagaatagaactccggccgacttccattgaaaaggaagtgttcccttacatggcctctgaccagcagctgtacgctttcgagttgaaaggattctggatggacgtcgggcaaccgaaagatttcttgactggaatgtgcttgtatctaaaccatttgcgggaaaccaacagccagaagttgtacaaaggtcctggagtggtcgggagcgtgctggtcgatcccacagccaaaattggcagtaattgccaaattggacccaatgttacaatcggaccaggtgttgtaatagaaaatggtgtttgcataaaacgctcgacgatactaaggggtgcaacggtttgctccaactcttggttagaaagttgcattgtggggtggaagtgtcacataggtaaatgggtgagaatggaaggaagtactgtacttggagaggatgttattgtgaaagatgagacgtacataaacggaggacaggttcttcctcataaaagtatcgctacgtctgttccagaaccacagattattatgtag

SEQ ID NO: 756 - DNA, 867 bp, Phyllotreta cruciferae
atggcgtcggaaggtgaagaagtgataagtgaccaagaaaaagttaaaatagtttcggatttcatcctccattcgccgccgggcgagttcaacgaagtcttcaatgatgtaaggaagcttctgaataacgatgaccttctgaaagaaggagtaaccggggcgttcgcccaatacaataaagaccaactcacccccgttaggatagaaaacgccgatcaaatggtgctgattacagaatacaacgatttaggtaacaatagattcttcgacccccgtagtaagcaaagtttcaaatatgaacatttaagaaaggaagcttctgattaccagccttatagtgttgataccgcggcggagccctggcgggccgctctagataacgagtttatacaatacacgagaaaccattataaagacggcgtttgtagcgtgttcgctcgcagccaaaacggcgccatcaccctcaccgcttgcatcgaagaccaccaattccagcccaagaacttctggaacggtcgatggagatcccagtggtctgttagtttaaccgatgaagccaccgcagaagtacggggagttctcaaagtgcaagtccattattacgaagaaggtaacgttcaactggtgagcactaaagaaatcaaggaatcgattccggtttcgaacgaagcgcaaacggctaaggaaatcatccacgtaatagaacaggctgagaatctgtatcaaacggcgatttctgagaattaccagacgatgtctgatacgacgtttaaggctctgcgaagactcctgcccgtcaccaggacaaaaatggattggaataagattgtatcttatagtatcggaaaagaactaaaaacacaatga

SEQ ID NO: 757 - DNA, 3558 bp, Phyllotreta cruciferae
atgaactttctactagttttaataatcagtgcggtggccgtgggggctcaagagggcgtcgcgccggacgccgcgggccaggataacacgggagacgtggagagcatcgacgtgggtgcgtcaggaggcgacgaaggggtcgattccaagcccattcccgtcgaagaaaacggcgggagtgttactactaacattaattacgaccccatgacatcagatacagccccccaggacacggaccaaaggggtggaggcttgccttactccattaccgaaactaggttagccgagattaggaaaaactttatgtatccgttcttcgacaaagggggcaacgtggataacgagggggactatcagaaggaaatccaatcctccacgccccaggtccacaagaatctgaacttccaattgcctttcttcggattcaggtacaattacacgagagtgtccattaatggttacttggaattcagcgatccacctcccaacttggattacccattagtttttcctgtaaaggactggcctaaggagaatgatccttcgtttattggtattttctacagtaaatgcaaaatcggtaatcttcgcgacgaagactcggacaaaaggaagccaggtgtgtacttcagaatggaaagagacctcagggacaggcaagacaggatgggagtggaaataagggaaaggttgaaatgggacataagagaaggagttatcggttcggagaccttcaatcccaaacacgccataatcgtaacgtggaagaacgtatccttcaatggaggatacgccaacgcagtttatcagaccaacacattccaaatggtcctcgccactgacgaggtattcacctacgccatgttcaactacctaaatttggactggaccagtcacaccgaagccggaggagacactagaaaaggcgaaggcggtacgccggcattcgttggattcaacgccggtaacggcaccagaagcttccagtacgctccctacagtcaagcatcggtcattcgggacttaacatccaccggctggggtaacaacaaacccggcaggcacattttccgaatcgacgagaacatcctgctgggttcttgtaacaaagatatcgatggagctaacttgcctcttcaatttgctccggagagcggcaatatgctgggaggaacggtcgtgaacatcacaggtccttgcttccaacccaacgacaggatcagatgtaaattcgacgtgtacgatgaagttgttggattcgtggtggacaggaatcgtgctatttgcatccaacctcgcctttactccgagggttgggtgaggctgcaaatcgccatcaattcggacgccttcaaatggaagggaaaatactacgtcgaatcgccggccagtgcctcgcagaagatcttcttcaaagacatgaagtaccacgagaagtcgcccagcgagattcgcatcacgtggcagaagcagaacttgaccaccaacgaaaatgccaacatcagaatttccttgtggggttacagggaaaccaccatgaggcccacgttcgtttacatcacagaaatagccgataatgtccaaaacaccggggagtacacgatcgtaccgtcgcagtacagaggcaaaatcaaccagttcctcaccgacattaagtttggattcctccaaataaatttgaccgaatcgataaaggtcaacatttactctaccaacaaccaaaacatcgacatcacaccgataatatggagcaggccgattcctctaggttggtatttccaattccaatgggagaaccaatacggcaaaaattggcccaaacaactctgcgacgattggctcagaaccgatagatatctgaaaaacttcgctcacgaattaccccaatgtccttgcacggtccaacaggctctggctgataaggggaaattcatgccagactttgattgcgacaaagattcgaatcccgtttgttattacaacaaccaagctttgcattgcgtcaaaaccggtgctcccacaatggaaggctccgagcaacaatgttgctacgacaaaaacggctacctaatgctgtcctacgatcaacaatggggttccagcccccgtcgatgccacaaccttggaaaaatgccttacaacgaagccaccaaggtccccacactatcccaatggttcaacgacatcgtacccaagtacctctgctgtctttggcaggaagagcaagccgtgggctgcgaaacgctgcgattcgaaagaaggccttcgcaggactgcgtcgcctatcaagcgccggctgtggcaggagtgtacggtgatccgcacattgtcaccttcgatgacgtagagtacacgttcaacggcaaaggagagtacgccttggtgaaatccttgaaggtggacgataatttggaaatacaggctagattcgagcaaatggacatcaatgcttatggagaggtcagagccacgcaacttacggcaatcgtagccaaaggaaacaagaccattcctattgaagtgagaagaagaccgttggaagccaggtggaggtatagattagatgttatagccgagaacaggagattgttctttgataggccttcgttgaaattccaacatttccaaggggtcactgtttatacaccaacctacattctgaatcaatctgaagtactaataatgttcgacaatggagccggcgtcgaagtgctggacaatcaagggtacatgagcgccagggtgtacttaccttggtcgtttattaacaaaacggtagggctgttcggcaattggagcttcaacaaagaagacgacttcacgctgccggacggatccaaggcggccgtggtgagcaacatcaacgacatggagagagtgtacaacgatttcggttcaaaatggatgctggacgacgtaggcgacgcgcacaaaggccagtcgctgttctacagggaattcggccgcacgtcggccacctacaacaacaagaccttcaagccgcagttcctgatgctgcccgaggacatcctgccgcccaacaggtccgagcaaatacagcgcacgtacgacgtgtgctcgaccaagatgtacgagtgctactacgactacgccatgacgctgaacagggacctggcgcacttcacgcagaactacaaggctaccatttacgagctgaagcaaaccaccagggagaagatcacgtcctgcggcgtgctggaaacgccgcggttcggcaggaagagtacgttcctgttcgtgcccggcacgaaggtgacctacgaatgcatacaagatttcgtgctcgtcggtgatcctagaagagagtgcgggggtgatggaaaatggaacataccggattatggatacacatattgtttgcgtcagcaggaatattcccaacgacaagcaggaatcacgtccgggataataatgttagtgctcataccactcatcctgctattcgtgtatttggcgtacaggttcttaaagaagaaacagaaagaacgggaggagaacaggctggagcaagaacaatacagagaacaatctagg

SEQ ID NO: 758 - DNA, 342 bp, Phyllotreta cruciferae
atgcgttacgtggctgcttacttattggccgttttgggcggaaacgcttcccccagctccgctgatgtcgaaaaaatcctcggctccgtaggagtagaagctgaagctgaaaaggtcaagaaagtcctaggcgaacttaaaggcaaatccatcgaagaactcatcactaaaggtcgtgagaaattgagttctatgccagtaggtggcgcagcccctgtagctgccgctgcagttgccgctgccccggctgccgccgaggaaaagaaagaatccaagaaggaagaaaagaaagttgaatctgaatcagaagacgatgacatgggctttggtcttttcgactaa

SEQ ID NO: 759 - DNA, 2721 bp, Phyllotreta cruciferae
atgactgaccgttttggattaaaatgggaccccaaaaatttagaaataagaaccatgtcagtggagaaaactttggagccccttgtgttgcaagtaactacccttgttaacacgaaggggcccagcaaaaagaaaaagggcaagtcaaaacgtgctaatgctcttgttagtacagtagagaaggccactgagaatttcatcgagaaaggtgagcaaattgcttacgagaatcctgatataacggatgagatgatagctgctgtcgaagaagtcaggaaaactggcaatgcaatgagcatagctgccagggaattttcagaagatccttgttcctctttgaagaggggaaatatggtacgcgcagctagaaatcttttgtctgctgtaacaagacttctgattctcgctgatatggttgatgttcatcttctattacaatcgctgcatgtagtcgaagatgatttggagaaactaaaaaatgcttcaagccaaggggaacttcttgacaatattaaggcctttggtcaaaatgcaaacgaacttatgaatcaggctgctaaaagacaacaggaactaaaagatcctcagctacgtgatgatttggctgccgctagagcagtacttaagaaacattccacaatgcttctaacagcttctaaagtttacgttcgtcatccggaattagctgcagctaaggctaacagagattatgtgctaaaacaagtttgcgaagctgttaatacaataaacgatgttgcgcagggaagaacacctcagcccgcttctggtccttacgatggtccaggagaacttgcagctgctttagatgattttgatgatcacatggtaatggagcctctggcatacaatgaggttcacacgagaccatcgttggaggaacgtttggaaagcattattagcggtgctgctttaatggctgattcgagttgcactagagatgaaagaagagaacgtattgttgctgaatgtaatgctgtcaggcaagcattgcaggatttgttatctgaatacatgacaaacatgggcaagaaggataagagcgaaaatcttaacagagctattgacaatatgggaagaaagacccgcgaccttagaaggcagctcagaaaggccgtggtcgaccacgtttcagatagcttcttggaaaccaacgtgcccctcttggtcctgatcaaagcagctcaaaacggcaacgaaaaggaagtggaagaatacgccgttgtgtttaccgaacattccaataagctcgtagaagtagccaacctcgtctgcagcatgtcgaacaacgaagacggcgtcaaaatggttcgatacgctgccgctcaaatcgacaatctatgtcctgaagtaataaacgccgctaggatcctagcggccagatctcgcagtaaagttgctcaagaaaatatggaagctttcaaacaatcatgggaaaaccaagtgcgcatcttgaccgaagccgttgacgatatcacaactatcgacgactttttggccgtgtccgaaaatcacattctggaagacgttaacaaatgcgtactagctcttcaagaaggcgatgctgatacattggatcgtactgctagcggcataaagggcagatcaaacagagtatgcaatgttgtaacagccgaaatggataattacgagccttgcatttacactaaacgcgttttggaggccgtgaaagttttgaacgatcaagtgatgcccaagtttacccaaagagtacaggtggctgtacaggctttgggcaacagtccgcctaaagaagtggacgaaaacgatttcatcgacgcatcgagattggtttacgacggtgtcagagaaataagaagagctgtactcatgaacagagccgacgaagatttggatcccgaagacgtcgaactcgatgaaaattatttgattgagaccagaagcaaatcgagtgctcatactggtgaacatggcgttgatgaatatcctgacatcagtggaattacaaccgctcgggaagctatgggtaagatgcctgaagaggataagcaaaaaatattgcagcaagtggagtttttcaagagcgagaagctcaagttcgatcgcgaagtcgccaaatgggatgataccggcaacgatatcatcgtattggctaaacacatgtgcatgattatgatggaaatgacagattttactaggggaaaaggtcctctgaaaactaccatggacgtcataaatgcagccaagaaaatttcagaagcgggcactaaattagacaagttaaccagacaaattgccgaacagtgtccggaaagttcaacgaagaaagacttactcgcctatttacagcgtatcgctctttactgccatcagatgaatatcacttctaaggttaaagcggacgtccagaatatcagcggagaattgattgtttctggtctcgacagtgctacatctttgatacaagctgccaaaaatttgatgaacgctgttgttctgacggtgaaagcttcatacgtcgcgtctactaagtatcctagacaaggaactgtagcttctccgattgttgtatggaagatgaaggctccagaaaagaaacctcttgtaagacccgagaaacctgaagaagttcgtgccaaagtgcgcaaaggctcacaaaagaaagtgcaaaatccaatacacgctttatctgaatttcaaagccccacggagtctgtgtaa

SEQ ID NO: 760 - DNA, 1221 bp, Phyllotreta cruciferae
atgtcgttcaatttcggaaatactggcactccaaaaacagccgctacaggctttacattaccgccaaatccggccactactagtgcaacaggattacagtttaattttggaggaggagacactaaaactgaagttaaaccatcatctacattatttcctgcagccacaagtacaccaccagctttcgggattaccccaaaacctgcaacacctgcgtcagctgcaccatcgtttaattttggtacacctacaacccaacagacaacagcatccgcttttggaactgcaacaccagcctcattcagtactccaacatcttctctccaatttggactaaccactactaaaccagaaacatcagcaggattatttggatcaactgcagctgcaacgcctatttcagcatcaactggacttagttttggaacagcggtttctacaacatcttcagccaccacagctgctactggaactcccctttttggagttgctccaacctcaagcactactacaatagccagtgtacctgctttaggtttatcgactacagtttctgccgctgcttcaacaactccttcgacttcattaagtactacaacagcacccccagcttactcaacatcgacacttccttctagtggttcattaacatttagtcaactagaagattctattaacaaatggaccattgatttggaagaacagggcaagtttttcattaatcaagcgaaacagcttaatgcttgggattcgttacttatttcaaatggcgagaaaattctcaatctgaatggtagtatcgagagagttaagcagcagcaacagcaattggatcaagaactcgattttgtcttggcgcagcagaaggaattagaagagttaataacacctctggaaaaggaattattggaaattcccgtaacagacatagatcgaaatcaaatgtatcaattttcggaaataatcgattcgcaattaaagcaaatgtctgatgatttgaaagaaattattgagcatattaatgaatctaataaaagcgaagaaatttcaaatcctttgacccaaattagccgcataatgaatgcccacatgaattcccttcagtggttagacagaaatacagcacaaattgtttctcatctggaacaaatcagtaaaatgcaggactccaacagaagaaattttcctctgaatcattcattcaataattcactcctttaa

SEQ ID NO: 761 - DNA, 582 bp, Phyllotreta cruciferae
atgttcatatgggattggttcacgggagtgctgggctacctaggattatggaagaagtccgggaaattgctgtttttagggctggataacgctggtaaaaccaccttattacacatgcttaaagacgatagattagcccagcacttgcccacgttacatcccacttctgaagaactgtccatcgggaacatgaggtttaccacgttcgatctaggaggccattcgcaggctcgaagagtatggaaggactacttcccagccgtagacgccattgtattccttatcgacgctaacgacagatctcgattcggagaaagcaaacgggagctcgacgcgctgttgacagacgaaaccctggccaactgccccgtgctgattctaggcaataaaatcgatttacccgacgcggcgtctgaggatgagttgagaaacgtttactcgttgtacggccaaacgaccggtaaaggtaaagtcgctcgatcggatctgccggggagaccgttggagctgtttatgtgctcgattctgaagaggcagggctacggggagggttttcgttggctggcgcagtacattgattag

SEQ ID NO: 762 - DNA, 564 bp, Phyllotreta cruciferae
atggacccgatcgccgtgctggagaagcgcatcgaagccctcgagctgcaggtgttccccctcggggactacgctcaaatctccaacaaaacgcaaaccatcaccaacctgctggtggagacgcaaaccatgatcaactcggcgctgacctgccgcgagtccatcacttccatgctgcagcacctggtggtcatcaacgactacctcaacccggccagcgaggccgacgagctggaggtggaggccaagcggcagtacctgctcgagctctaccccgaattgaaggacaccatacagacggtgagcacgctggagtcgctgttgccgttcatcgattcgatcaacatatcgaaggtggtggagttctctgggaagctggaggaggtggccgtggggaatcttaagttgtacggggagtgcagggatatcaccaagaaggtgttggtggcgttgcagcagtacaacgacatatccaattcgattaagttgttgttttcgcagctggatacggccgttacgaatttagagtacgctttgcagctgcgagacgcgaacgaggaatag

SEQ ID NO: 763 - DNA, 1752 bp, Phyllotreta cruciferae
atgaacaacgctaaattccaagaagtgtacagtgacctaacgctctacaccactccagacaaattcttcatcgagccgaaggctggcgaggaattaatggtaatagagcgaaattccgaaaatataatatgcttcaaaagcgaccacagacacctgataccagcagcgaacagccggaaggatttctgtgggttaataggtataatccaactgttagcttgtccctatctagtagtagcagttcaaagggaattggtcggttacatagcaggctgcgccgtctggcgtctcgccaaagccgaattaattccctatagaagctccgcgcacttaacgcccgaaaaacaagccgacaacgatgtctatttgtccatggtctactccgtactatccactccatttctatacttttcgtacgactacgatcttacgcattccttgcagcgcctgcacggcataagccccgatttctggaagcaatccttgttcgagcgggccgatcagcggttcgtctggaacggaaacctgttgtattcgttcaaaggattctccatacaccggttctgcttgccgctcatgcacggattcgtttcgataaacttctgcgtggtgaacggccacagtttgaactggtcgattgtcagtagaagaagcgtgcaaagagcaggcacccgattgcaccgaagagggttggataaggaaggaaacgtcgccaatttcgtggaaaccgagcagatcatcgaataccaaggggatagggcgagcttcgtgcaaatacgaggcagcattccgctgttctggcaacaagaccctgacttacgatacaaaccaccgcctactctgctcgatgtcgatccgcaggatcagcactcgatgtgcctgaagcacatgaacgatctaatgactttctacgggaagatcgtttgcgttaatctagtcgatcagaaaggagccgaagggaacatggaagtggcgttcaagaatgcgataaacaacgtatcgtcgccatcggtgaagtacgaatcgttcgatttccacgccgagtgcagcaaaatgagatgggacagactgtcgattctcatcgatcgattggcgcacgatcaagacgagatgagtttctttctgttgctgagagacggctcgttgagttcccttcaagacggcgtatttagaacgaattgcatcgattgcttggaccgcacgaacgtcgtgcaaagcatgctggcccatcggaatctggaaagcgtgctcagaaaattgcagattctccatcagaaccaaacgttggagttccagtattcgtttgaggtgttgtttaagaacgtttgggcggataatgcggatataataagtacccagtattcgggtactggtgctttgaagacggatttcacgaggactgggaaacgtacgcggtacggtttacttcaggatggtatgaattcgatgacgaggtactacaagaataatttcgctgatgggatgcgacaggacgccatcgatctgtttttaggtaacggtaaacccctttcgccattgcatatcgataaaggatggaagtacgtgacgtatccgtcgattctgctgatcgcggtggctatgtttgtggcttgtgctgtcactccttctgagtattcgacagattcattgctgtttctcttgttctggggttccatggtctatgcgactttgcacactattttgaagtacggttcggagtttgtcgataaacctagactcacccattcttag

SEQ ID NO: 764 - DNA, 783 bp, Phyllotreta cruciferae
gtattaacagaacacgatttaggcgtaagcatagacctcatcaacaaagatatatacgcaatcggagcaggcgccgccttggacccggccgacgagaaactcctagaagaagacatcctcactcctcaagactctaagagatcccgccaccatgccaaatccgtctcgtggcttcgacgaaccgaatacatctccacggaacagaccagattccagccccaaactatggacaaagtcgaagccaaagtgggctacagcatcaagaagtccctgaacaacgaaaccctttacatggacagggactcgcaaatcaaggctatcgagaaaacgttcgaagataccaaaacgatcatcgataagcattacagcaagcctaatgtagtccctgtggatgttttgccagtttatccagatttcagtttgtggaaatatccttgtgcccaggtcattttcgattcggatccggctccagttggcaaacaagtaccggctcaaatcgaggagatgtctcaagctatgattcggggtgtaatggacgaaagcggtgaacaattcgtagcctacttcctccccacggaggaaaccctccaaaaacgcagggaagacgtggccaatcaagtccaatatcaagacgaagaggagtacgaatacaaaatggccagagagtacaattggaacgttaagagcaaggctagtaaaggctacgaggaaaattactttaccggctcaaatcgaggagatgtctcaagctatgattcggggtgtaatggacgaaagcggtga

SEQ ID NO: 765 - DNA, 1170 bp, Phyllotreta cruciferae
atgccgattgaaaatttggaagatcaaggtttagaaaagaacccagacctagagctagctcactacaaatttctcctgacgctccccgaatatcgcagcgaccgcaatgtccattcgaagatcacagaagccatcaagaaggacgatatggctccatggtacgaactcctctgcaaagaagtcggctggaagttagacgctgccttgctgaaggccctcaaagccaagaactccgaaaaggtcaagcttctggacgaagccatcgaagacgcggagaagaacttgggggagatggaggtgcgggaggcttatttgcgtaaagcggagttttacagcagaatcggcgacaaagaaaacgccgtgaccactttcaggcagacttacgataaaacagtatctttgggccaccgtttggacatcattttccacttaattagaataggcttgttcttcatggaccacgaccttatcactagaaatatcgacaaagcgaagaccctaatcgaagagggaggcgattgggacaggagaaaccgattaaaagtctaccaaggtgcttattgtatgtccgtgagagacttcaaaaccgccgctaacctgtttttggacaccgtgagcaccttcacatcctacgagctcatggactacaaggctttcgtcagatacaccgtctacacttccataatcagcctgccgagaaaccaacttagagataaagtaataaaaggctctgagatactggaggtgcttcattctgaaccgttcgttaaagattacctgttttctttatataactgccagtacgcggagttcttctcgaatttggctgaggtcgagacgatcttgaggaaagattacttcctgaatccccattaccggtattacgttagggagatgaagatttcggcttacacgcaactgctggagtcctatcgatctcttacgttgcaatatatggccgaagctttcggggttactatcgagtacatcgatgaggagttgtcgactttcatcgccgctggaaggctgcattgtaaaatcgatcgggtgggaggaatcgtggcgacgaacagaccggatttgaaaaatgctcagttcaattccgtggtgaaacaaggggatttgttgcttaatcgagttcagaaactctccagagttattaatatttag

SEQ ID NO: 766 - DNA, 14307 bp, Phyllotreta cruciferae
atgctcaccactgcatctccatgtttaacttgcggctctattggagatatagcgaatttgatgttttgttcgggttgcggtgcgcattaccatggaatttgcgtgggattagctcagttgccaggtgttagatccggatggcaatgtaggaaatgccggtgttgccaagtgtgccgagtcgtcggagacgaatctaagctgatgacttgcgaacaatgcgataaaatttaccacgctagttgtcaaagacctgtagtgacttcgataccgaaatacggttggaagtgtagatgttgtagggtgtgcggggattgcggtgcaaggactcccggggctggtttatcttcaagatggcacgctcactatacagtatgcgattcttgctaccaacaaaggaataaagggttttcttgccctatttgccataaagcctaccgcgctcacgctcatagagaaatggttcagtgttcgagctgcaaaaagtttgttcatggaacctgtgatccagaagcagacgttgttacctacaatcaaaagaaagaaataagcatagactatgaatacgtttgcttgcattgcaaaaatagcacagctagacaaataacagcaaaaagagcaagtattgatgatccttccgatgtatccgcttcacacgattctctatacgatgatacgtccgaattcgatcttccttcgcccgacgagtttgccaggaacatgggtttgggtaaagggaaaccgtacagcgcgaataaaatagccaagaagcgccttagtttcacagtgaatccggtgggcaggccgaaaggtaccggaaaagtgccgcccgggaaaatggggtacatgaaacgctaccgactaactgagttcaatagaaaacgtggcccgaaagccaaaatgaggggcattttcggcgtgcccggcgtcggtctgcaaagaccgatttcggatgggaaaaccgacgaagaaccgggcgttgaaaatcgattggtattgtgttcagctaaagacaaattcaccctaactcaagatatctgcgtaatgtgcggggccttcggcaccgatcaagagggatgtttgatcagctgcgtacaatgcggacaatgttaccacccctattgcatcaacgttaaagttactaaagtgattttacagaaaggatggagatgcttagactgcacggtttgcgaaggctgcggccaacgcaacgacgaaggccgtctcatattatgcgacgattgcgacgtatcgtttcacatctactgcatggacccgccgctcgactacgtgccgcacggcaactggaagtgcaaatggtgcgccatctgccaatcctgcggcaccaccgatccgggtttcaattgcacgtggatgaacagctcgacgcaatgcggcccgtgcgcctcgcacgtgaactgccccagctgcaacgagccctacggcgagggcgatctgatcatacagtgcgtgcagtgcgagcgctggctgcacggcgcctgcgatttcatcaagtgcgaagaggacgccgagaagtgcgccgaagagggttacaattgtatactgtgcaggccgagggacgtgccgccgccgcatatggtgccggcggcggtcacgccgaagccgcccactcccacgaagagtcccgagttggggaagagtacgagctattacatggacggcgtgtgtctcagcgaattcggtagcaacttgatcaaatcgttggctctcgagtaccacgggtcgaggaagaagcggaaaaagatacccactgttcaagataaggaagccggtattatggctacgattgaatcggtggttgccggtggtaatgttattcctactaatatggaagacagcgctaaattggagctagtcgacatcaaagacgaacctcaagaattatataaggaaggcatgatgtggactaaagaagacggtccaccacccgaaggttttacgataatcacgatggagaacggtttgaacgtgctgcgaaggaagaggcaacgcaatctgcagaagctcggtattggaggattcgtggtcaggatgagaggtatcagaacaggtcaggataatgatgatgttgattcgtccattggtcaaagtgggctcaacgccaacgacattgtcccatcgcctgcggacggggacaaacctagaaggaaaactattcgtcgaaagccgaagagtaaattagcagaaacgtttccagcttatctccaggaggcttttttcgggaaagaccttatggatacggtcgattgtaaaaaggaagaagtcgattgttatagtagcgacgatgagaaaactgacaagcattttaaatccattaatttatctcaagacgaaataatagcaatcgtggcatcaggtaaaaccgagaaattggaaaacaataacaaagattcgaccaaagaagtcaaaccgactgtattgaaggaggaagaagaagataatccggaggatttgaaagatgttcttgccttgccgggcgacttactcgatactgatttggtcaatagtattatggaagatgaggaggaactgagcaaaactacagcctctcttgttgcattagattcgaatttacagcacgatacggaactgacggacactttgagtagttcaggaaattcaaaagaaaccaaagatgaattgagcgacattttaggccctcatttcaacctcgattccataccgaacataaacagcaaggatgtcgaagacatatttaagggcgtattaacagacgaatcgcaagaatcccaagagagcagtagcttttccttgcaaggaaataatatgttttcgagtaataatgcgcaacagaacgttgcccaacaccccattattaatcaagcggtgagaccgaaaactttgcctactgttaatcacaatttgaattcccctgttagttttccaccaccctcaccataccactcggaatacagcaacagtcctcagtttagtcctgcgttcaccgattcgtcctgttcgtgggtaggaggaaacgaaacgccggaaatcgatagtaccaacgtgacggtcacatcaacgtacaatcagagatcatctgataaaatgaaagctgatgagagtttgggcaaaagcgctacgatttcggccgttttgtatgcgaacatcaaccatcccgaatggaagaaggagtatccgaattggcccgataggtataagcaaataataaagaaatggagaacgttgagccaagaacagaaagcgccgtttttgcaacacgctagagataataggagtcagttgaggatgaagaaagcgcagcagtcacagaccgtcaaggaaaccgcctcaaccgccacgtcccccaatgcgaccaagcctctgcaccaagccggtccagccttagtgacaactctccaggcggtaacgcaacagccggcgggggcggccgcggcccccgcgccgcccgtttcagaggaccaagaaaagatcgccctgcaacagaaatccgccagggaagccgaacaggagagacaatggaagcaattgcaggccctcaggcagcagcaaacccaacaaacgcagaacattctacacgaacagcgcgttcaagcgatcgcacgtgtacaacgtcagatttcaactgatccagcgcagcagttcataaacgagcaacagagccctctgcaggtgaacacgcctcaggaattgagcccgtcaaccacgccggctcccagtcctaggccattcctgggcattaaatcgcccacgttccccgtaccttcgcccgttccgcaaacgggcgtcagggccaacacgccctcgcaatcgccccacgatatctcccaacccagcacgcccgacggtaacgatcactttatccactcccccacgaatcctaaacctaatttccaacctagattgcccaatgatccgttcgccgcgcaacccgccacgccgcgaccgcaattcggaatggcccggccacccttgcagaatttcggcggtacggttcgcaacgagcaacaggacatcaacatcaatcgccaattgagggagctgttgcagcggcagcaggttaaaaaactggacgaattgttgcctggaaaagcgccacctcaaaggctgtggcacgcgaatgatcagcaagaggccggcgacgcctcgatgacgtcggctgtgcagggcgccggtgcccaaggaaccgacgccaccttcaggcagcctctaccgcctggtgtagtgaaacctaggttggcgatttcgtcggtgaataggccgatattgggcacggttagagtcaaccaattggatcccaggatacaaaatttggatccgaggatgaggttgattttgcaacatcagcaacaaagactggccaccggtattcagcagcaattcatccgtttcacatcgaacgtgcgcccgacgacggtggagcagtacgagcaattgttgcaacgtcagggtaataatcagaatcaaattcacgcggaggaacaacagcagggcgttgctcgaatacccatagcccaggccagcgttatacaaaggccgcacgtggctcaagcggtggttactggcgccgccgctgtgacaaccagtaccacagaaagtaattccagcgaggagggaatccccgataatgtaactgccgaattggagaaacttgaacaggaaacaggcactatggtggagcttcaaggcgtaagcgatattttaggaggtttggacgatgacgatgagcttttggccgaaatgggcgctgattttaacatactcgaatacgcggatcccgaattggaggccctaacgggcggtaaaacgaatattttggacctggagctcgaggaggaaccggtcaaaaaagaaaaactagcctctaacgcgaacacttgcgctccttctcagaaaccgactcctaacgttgctactacagctattagcaacagtacctctgtgactacaccgaccgaagctaatgcagaacctaaaatcgagaatacaattcagcagagcattccgaaatcgacgccacaacagctacaacatcccgtttctcttccacagcagcagaacattccccagcacggagcccaagttcaagtgcaatcgcagcaatcccagccgcatccgccgcagcaaatgcccatccaatcgacgctgcatattcagcaaattcaccagcaaatggtgcatcaagttcagcaagccgcagcacaaggaaggccgatgcctccgggttcgaagatgcaaaccacagatggattcgttggtgttgtgatggcgaacaacgccgtacaattacagatacctccgaattatcaacaacggttgcttctgttgcaacaactgcaaaatcaaaaattgatgcgagtgggaagcacacagcctagagctgctttgcaagtggcccctaatcaaatgcccgtaggtatgaatccgggagctaggatgccggtatcggcgccgccgccgcctccgccgccttatcccgggccgcccccgccctatccgggcaacgcgaatcaacatcagcaggaacaaccgctgctgttggaagatctgctcgagcaggagaaacgcgaacaggagaagctgcaaaaccagccgcccaaccacgaagtcacctcgtccaccggcaacgaaacggaatcagctttgctgagcgaccaggacttcgagcgcctcaaagccgatgtgtttaacagcgccccagtgagtaacatatcttctacgaatcaagggaacgccgcccaaacgccgcaagcgtggccccagctgcagaataggcaagcggtggttccggccgccgcttcgcagcacacgatggaagtgactactagagttcaaatgtataatcctaatttgataccggcgccgccgctcccgcccgagaatatcgctacggagcaggacaagcaggcgcagctgttgtacgagcagtggctgaaccaccagaacaactcgctcgtgcagcaattgcgctattatgagaccgaagtgcagaagcttcgtaagagtaaaaagtcgctaaatagtaagcaacggcaattgaggaaagctggtaaccagttaaccgacgcagatgcgactgagcttcaaagaattactgcggaacaggctatattacagaaacatttggaatcgagcaggaaacaaaatcggcaacatggaatgttgatacaggaatatcgaaacaagcatcccgccatcaagcagagaaccgtaacggaccagatccaatcgccgttgggccatccggcctcgtcgcccatacagcaatcgagcgcctcgttgtcgcccatgctgtcgccctccgtgtcgccgatgacccagaacagctcgcctttgaacagccccgggccgatggtgccttcgtcgcccggccacagcgccgtgcagaatattttgcaaagccccaacggcgccaatgcggctcaaatgtcgcccatgcaggcgtccccgatgcaatcttcgccgagaatcggtactcctcattctcaaagtgatgaaagtcccggatcggcgcaatcgccgtcgcaggtctgcctgccgccgcctatgcctagaatgacgtcgcctcagcacagacgagtcgtcaccagtccggtgggaatgtcgcaaatgcgttttataaacaacaacatgttgcagcaacgcgttcgcatgcagtctcctatacagaatttccaacagaaacccggcacgccttcgccgttgaacagcccgacgtcgcagcaaatgaacgtcaaccagcaacatcaaatccagaaacagctacaacaacagcagcagcagcagcaacaacagacgttgttgcagcaaaatttggaaggcgatccaaacgccattcactcgcagaggaccacgcaattgttgcagcaccggaatttcatcaggcagcaggtgtcccagcagcaaatatcgcctcaaacgttaaccccgcaacagcatcagttgatgctgcaacagcaaaagcagctggcccagcaacaacaacagcagatcgcccaaatgaacgccgcgagattgcaacaacaacagcaacagcagcagcagcaacaacaacagaataacccgccgcattcgccgatgccgcccaaaagtcccatgatcaaccagcagatcatgtcgccgcattcgatgccccaatcgcccatgcagatgccgccgaagagtcccatggtgccgttcaatcccaaccaaacgaatcccaattcgcctgcggctaggagcccggctttccatcagggtatgaaccaaccgacgagtcccatcacacacggccatcaacctcccagttcaccgatgcctaggagtcccatgatcaatcaaacgcactctccgcataacgttcgaaggcctcccagcgccaacagcagcccggccatgcctgataggccgcacagcgtagagaattcatcgcctaggatgtactcgatagatcaattggtgcaggagagtttggccaatcaaaatgtaaacgcgcagtataacagttacaattcggatatgatcaacgaaagcggtggagggaattcgaataaccccataccatgtccaccggaaataccgagatttcgctattttaagctcggtttgagaggcggagcgcctatgtggagctttggaagaggcgccaaaagaatcccagcgcctccgaacgccaaaccggacgaacccaaggcgaagaaggagtcgcatttgagcaaagtttcgatactaaaaaggaaacccccgatcgcttctatcggtaaagtgggctcgttggttagttcggattacaacgatttggacgacagttcaacaacgcctcctgtaacaccaccgttggcttcgaccagcagaggaagtctgtcgaagaagaagaatctcgaactgcaagcccagaaggattcggtgatcgtcatgcacagtcccgaggataataacaaacagctcgaaataatggattacgatgacgataataacacggttctatcatcagaagtgtcgttgagttctgtagcaagaaacgacgacgacttggtggagatcgaaacgatatcgcaagacctcgccgaagggctatccagcccgttggaatccgatcaaataggcgacgaattcctgttgtttcccggcaatatggtggtggatatgtccggtgaagagcattactcggaaaaggaggaagaggaaaccgttgatgaggagtataccgatcagaatatgcacatagtgatacgcagcccgaccaccagcgacgacgagttcataatgccttgcaaagtgaagcagtacaacgaggacgagcaggaggataaccccgaatcgcccgatcaggaggaattcggcgaatcctccgatatgatggcgagttacgataacgaagacacggatataatcatttcagatcaaaccaccggcgttcccgaggactcgatctccactaaggaagacttcgaggagctcatcgacgaggggtcgcggaaaaacaacatcagcaagcaagaggtgaccgcgaaacacattcaagatttccacaggtacaccgaattgttcgattacggcaaacctgatgcccaaccggttaagaaaccagtcgccaaaaaattccaaccgaaagtctctctagttagaggagtagctttgcccagtaagcccaacaccgagaagattatcatcacgcaaaattcgaacgtgttgaatacttcacaggcttcgaaagtcaccagcatcattttaacccacaacgcaaatgttagaaggaacattataagcgtaccgaaaatagtgagtaccgtttcaccggctataactatagtgagcgccagtacctcgcaaatggcctctatattaccatctaaattcaccgtgccggttataagcgccagtgcggtacgccagctatccaacgtcaaagtcatcgacaaaccatccacttcttcgttgtcgatttctaccagagacaacgtcctgccgaagaagatattcgaggacgattcggtgtcgccggacagttcgaattgcgacgacgagaaatccaaagattcattcgacgataaagtcaagtcggagtctccgccgcgggaggtcaaacagttcgtgaaatcggatcagcaggtcatatcgctgaaatcgaagaactactccgatcaatcgaagaagatcgagcatctgcaaatagtgaatatatctgcgaaggatgtggttcaaaggcagaggataccgagtcctttgatatcgaaagcttctccggttatcattcacaatacgccagagttgaaaatgactgcgcaagttattcaagagagccaaacccgcatgaaaattactactactactgatacagaacattacgatgagtctgcggatgatacgaagtcagttgtgatttcaattccgtctcctacaccttcgcaagaacagatgcttgatagtatagctttccaggcgcttgaaaatagaaggagagaatacgattctatcgaagatgtattagatatgattgagaatatagaaaacatcaccgccgaaccgcccgagatattagaagaaaacacgttgcaaaattccgattccaacagcaacatcgaaaccaaaaccaccgaaaccaaggagttgaaattgcctaccagcgaaagcgaagcgcccgctaccaaatcatccatcgtaccgcaattatcgcctctttcccaacccacggaattgactacaaacatggccaacgcctcgcagcagctcagaactctgctatcctcgctgcaaaccacctcgacgtcgtccccgaccaacgtggagtccatagccaagggcttcggccagaaaatgagcacctcctcgtcggctaaccagcccatagtcgcctcgcgggtgatcggccaacaagccggcaggcaatcgccagttatcaccagcgtctccaccgtcatagttccgaatttcaagcaaaaaatcaccgccgcaacgaccgccgcctcccggagcagccccgtgaaggtggtcagcacctcgcagcaattaaccggatccataataacctcgactttgaattacataccgaacagaacgatcggtatacagatggtggcggatcaatcgaaactgccgccggccagcatcgtgacgacgatgcagcaaatcaactcgatcacctccagccaggagtcgaagaagccttcgttgactctcacggcgatgctgcaaaaccagcccgctgcgaatatgatgactaaatcatcagccgatactatcacggctgctagtttgctaggctcgcccatcagcctgcccaaaaccgggttcaccacgtctttggtgcaagcccaaccgagcgtggtgctgtctaacacaccgccagcgcctagccaaacttccacggcgacatcttctacgaaaaccaccgcggattcgatcacggccgctagtttattgggcagttctattaaaactagctttgcaatgcaaccgagtagcaccgtaggagtggtgacgagctgcgtcaacaagacgcctacttccactactaatctgctccacacgcagttgacgaaagtcgtgagaagcaaatccgtcgacgatgttaaagaattggccaaaatcgacgagaacaaacaaagcgttagcagcgaaattgtagatgatagtaacagcgggtgtaaatcatcaacgataactacggtagcctgtaacaaaactgaagattcgcagaatgtgttactcaagaaattgctgcagaatacagcttgcgccagcgcccaatcctccccgccggcttctactagtactgttacaaccagcgctgctaatactatatctaaagtggttaacacgcagtgtagtactagcgctagcgtggagcaaccgccggtaagcgctccttcgaacgttacagtccaaagaagcgccagcagagacgagctactatcaccgccacaagacgtccaaactatggtagtgattaaaaaagaaccgccgttagtaccgctgtcccaaccgagcccagtgctgaactcgaactccaacgctcacacgcccgaagtgaagaaagaattcatcgacgaatcgtcgcagcactccgaagtatccgatcacagcagatcggacgcccctattaaagaggaactggaaaccatggagagcgccgccgagaagatgatgctcgacaaggaggagctgaagaagcagaagcgccgcatgtaccagcagaagcgccgccagaaccagatcctcaacaaggagctggcgcagcagcagccgaagaagcggccgcgcaagaattcgaagatcgacgaggactacgacacgtacatcgacggcgtgctggcgcagctgcgccagctgccgcccatcgccgtctccgagccggtgctgaaccgcaacttcggcgtggtgccgctgttcgggtgcggcgatctggccaagatcggcgccaaggattactcgacgcacctgggggagttgacggggaactacggctacggcgagctgcccggcttcaccgatttctactcgacgaagccctacggggatatggatccgctgccggagaagccgccgtcgtcgacgcagcgcggcttctacgaccaggagttcccgctgattagattcgatgcggacgagcacaagaagtttgacgtgttttgcagggaggattcgcccgattcgatattgagcagctcgtcgccggaatgtacgcgcgaacccgaaggcaaattcgtcgggttgaagctcatcagcgacagcgaagaggacgaagaagatgatgccaaagattctgtctcgaaaggaagaatgtcaccagtggtacccgtcatcaagcctgttcctattagactgaaacccgccggcgaattgtacttcaaagagaacctcaacgagaacaaggagaacatcaacagcgactcggtgcacgtaatgacgaaatccaaattcgacaacaagcagtctccaccgtcgaacgtttccggccacgttacagtaaccttaactctaacatcatctgcggctgaagatataatgggagtgttgcgggatttggcgaatattctgcacatacccgctccgactagttaccaaatcgtggagagaacggcgtctccgcccagccagaaattgggcttgtaccgcaccaaaggcaaggacggcaaagaaggggctcccatcgacatacagagcatcctcaacggcgccaccaagttctgcaagcactgcgacgtgatcatcttgagcaacatcatcaggcggaaggtgtccgatttaccgttcctcgctaaagattcggatttgctcagcgacggggaagaattgttcttttgcagttccgcttgttacatgcagttcgctttgatgcaccggtcgccttcgatatccgaagataaggctgctgaaattataaatcacctatcgcagaaagacaatttggattcgaagcagaaattgcccgcagacgcgttagatagcaataaatcgatagcgcagaagttatcgtttaacatcaaagatgcgaaacgggaattcgagccgatggagacgaacgatgcgtttgcgtttttcgctcgtaccaccgccaataaacaagggaacaacttctacgatggggcgccattcaaatcggtccctgctagggtacacaggaacgataggtacaaactctggacgcccggttgcctccaacccacccagaaacacaaaactcccaccgacaaggagatcatggagctgctctacaggatgcagatcaccgttacacctcccgttatgcccgaagatacgaggaagtgtttgttctgccacggtattggtgatggcgtggccgacggaccggcgagactgctcaacttcgacgtggataaatgggtgcacctgaactgcggcctgtggtcggacggtgtatacgaaaccgtgaacggggctttaatgaacgtcgaaagcgccctacagtccgggttgttagccacttgcgtgcattgccaaagcatcggggccaccatcaagtgcttcaagacgagatgctcgagcatataccacttgaattgcgccgtcaaagacaattgcgtgttttacaaaaacaagacggtgttttgcaaagtccacgcgccgaagaacgaaaaagacaacgaactcaccaccctctccgtgtctcgtagagtctacatcgaacgagacgagaacaaacaagtagccgctgttatgcaccattccgattctacagatttactgagagtaggcagtttgatattcctgagcgtgggtcaactgctcccgcaccagctgcagaatttccatacaccgaaccacatctatcccatcggctacaagatcatcaggttctactggagcatgaggaacttgaacaagcgctgcaagtacatttgcaccattcgagaagtgtcgggcaaaccggagtttcgggtgatggtgcaagagccacccgaagcggacgtggagttctccgattgcactccgaaaggcgcctggcagaagattctggacaacgtcgctagcatccgtaaagagaataattgtttgcacatgttcccgaaattcgctacaggtgaagatttgtttggtttaacggaacccgctatagttagagtgttagaaagcatgccgggcatcgaaacgttgtcggattataaattcaaatacggccggaaccctttgttggagctaccgctcgctataaacccttcaggatcagccaggactgagccgagattgaggagccagttgcattggaagaaagcgcatacacagagaactactggtggtacttcgtccattcgaccaatgttcgggccgtctttaacaggatctattagtactccagctcaaggggagatcgcctgtccttatagcaagcaatttgtgcattcgaagagttcgcagtacaagaaaatgaagcaggaatggaggaataacgtttatttggcgaggtcgaaaatacaagggctgggtttgtacgctgctagggatttggagaaacacaccatggttatcgagtacataggagaaattattagatccgaactggctgagtgcagagagaagcaatacgaagcgagaaatcgaggaatatacatgtttagactggatgaagaacgcgtggttgatgctactttatgtggcggtttggctagatatatcaatcactcgtgtaatccgaattgcgtggccgagaccgtggaagttgatagggatattcgaataattatattttccaaacggagaattttacgaggagaagagttggcatacgattacaaattcgatatagaagacgatcagaacaaaatatcctgtatgtgcggagctccgaattgtcgcaagtggatgaattaa

SEQ ID NO: 767 - DNA, 4044 bp, Phyllotreta cruciferae
atgttttcaaccatgccggctaaacagaaaacagcagcgaaagttgatgatgatgaaatgctatcggaaatattaggtgaaatcgattctgatacagcaaatacatcggctatcaagaaacctaaaattagcaattactctgctctggccactaacttgtcggttaagaattacatgagaaatttgtcccaaccggttaaaaaacgggctatcgaaaaaaaagtacaacccagtgtacccaaaccagtaatcaatttaaataaaaaactacctgaaccaattcaaattcaagataccaaaaacgaaacgattgagcctcatgagcatatcgataaagaaaaggctgatgcagatacatcatattttgatgatgatttggatgaaactctactagaagaattcagcgaagatctagataaaaccgccactgaatcccaaataacggaatccgaaacgaaagtagacgatttcccagatgatttcgatacaacagaaatagaggaaatcgaagaacgaattaatgctgccagcgaacaactaatcaacgatattcaagcggaagtcgagacggaatggcagtatatcaacaatactaatgaaagcttcaaattagcaacagaagattctattcccgattctcctgctgtcaataccgctgatactccgtttgtaaaagtcgaagggaatattgtgtttaggttcttttggtgggatgcttacgtggacccactatatcaacaagggactgtttttctctttggtaaaacgtactgcgaaacttctaagaaatacgaaagttgctgcgtggctgtgaagaacatagaaagaacaatatttgtcttacctaggccgtttgaactagatgagaacgggaagcccacagataaaccggttacatttaaaacaatccacgatgaatttaacaataagattttgaagcgattgggcatcggctcttttaaatccagattgatcaaaaagaaatacgtattcggtggtagcgtgccagccgaatccgactatttagaagtcagataccctgcaacattcccacgcattcgatgcagccaagacggtgacctatacaatgacgatgaatacattgaagatgatctcggctataaaactttttcgaagatcttcggcataaaaacgaacttcttggagttgctttttctcgagcgtaaaatcaaagggccttgttggatcgatataaccgatcccgaaatggccgctaacccgatgagcttctgtaagttcgaagtaaattgcctcaagcccgccaatttacgaataactgcgttcgagaaaccgcttcctccaccacctctcgtagtggctactataaatatgagaaattgctttaatcgagcaacgtctaatcacgaaatcgttatgctatcttgtctggtgcaaaattgctacgatgtgaacaaaccgcctccggaacccgcatttcaacagcatttctgcgtattcagctgcccccgaggacaggtgctacctccaaatgtgttcgaatctttacagaattacaaaataacgaaagcgctgaaaaccgacaacgaaaaggccatgctgagttgcttcatcaacaacttcgcgccaatcgatcccgatctaatcgtagggcacaacttacaagggtatcaagccactatattggcagataggctggtgaaattgaactgcgtttattctaatagactaggcaggctcaagaagaagactactcaagccaaacaattagagaaaactttgttcttggggcgattagtttgcgatataaaaacatcagcgaaggagctgattaaatccaaatcgtacgattttgatacgctgtgtcaggtcgtgttgaaattaaaggagaaccaacgcgttgatctagagcctgaggatgtgttcaaaatgttcaaaacgtcgcaggatttgttgaaattaatttccttcactatgcaagattccgggtatattatgaaaatgatgtacaatttgaatgtagttcctctggcgttgcaaattacgaatatagcaggcaacgtcatgtctaagacgttgatgggaggaagatcagagaggaacgagtttttgctgttgcatgctttccacgagaaagggtatattttaccggataaggtttatagaaaaattgaaagcgaatcgaagaaaaagcccacatattctggaggtttggtgttggagcctaaagtaggtttctacgacaagctgatactcctgatggatttcaattccctataccccagcatcatccaggaatacaacatttgcttcaccaccctccccgtaatggattcagacgaaaatctagtactaccggacagcaatctaccggccggaatacttccaacagaaatcagaaaattagtagagagccgtcgacaggtgaaatcgttaatgaagaaaccggacctcccgaaagacttgaaattgcaatacgacattcgccagatggcgttgaaattaaccgccaactcgatgtacggttgcttgggcttcggacattccagattctacgcgagaaatctagccgctttgatcacccaaaagggccgagagattctcgtgaataccaaagatttgatcgagaagatgtgcttggacgtcgtgtacggtgatacagacagtcttatgattaacactaatattttagaatacgatcaagtgttcaaagtaggcgttaaaatcaaacaagaagtcaacaagttgtacaagcaagtcgagcttgatatcgatggcgtttttaaatatttgttgttgttaaaaaagaagaaatacgccgcagttacgctttccaaaagtccaacaggcgaattaataaccactaaagagtacaaaggattagatatagtgcgtagggattggtcgcaattgtcttcggaaactggaaaattggtcctcgagcacctcctcagcgatcaatcctccgatgaaaaagtacagaacatctacgactacttggctaaaatcaaatctgatttggttgagggtaaaataccaataccactattagcgatcacgaagcagctgaacaaggcccctcacctgtacaccgataaaaactctatgcctcacgttcaggtggccttgcgatacaacaagaagagccgcgatcacttcagaatgggcgacacagtgccctacgtaatatgcatagacaacacgagtaacaaccccatgcagcgagcctatcacgtggacgaattgaagggtaaccccgagttgaaaatcgactacgattactatctggagcagcagattcatccggtgatatcgagaatttgcgagcccatagagggcttggactcctaccagttagccgaatttctgggcgccaatctgaagcgaatgaagaggcccaaaccgaaagggggcaacgagaacattcaaggggagaacgtcgttaaagccgaggtgaagttcaagaacgccgagaaattttcgttcgtttgctacatttgcaaacaccagaatgtcgttagcgaaccattggtgaataacattccttttttggaaacgtgtcaaaactccgattgcaaatcgaagcccatcgattacttaccgagcgttcaaaatcaactctacttaactattcgttcgcatataactaaatattacaagaaggttttaacgtgtgaagacccaagttgccccagcgctccgagaagattgcccctgcaatttctgaagaaacgccccatatgcaacaagtgcggcaacgctgtaatgtacagggtttacaccgaattccacttgtataatcaactagcctactatcggtacatgttcgatttgagcaaactcaaaaacaagcctttgatggatggtgaaaccgaatcgggttacagagcgcttctagatacagttgagaaattcatgaatcaatcagagtactcgctcataaatctgagtgaggtgttcagccagctcggttgggctgcgactgttgaggaacgtgttttggaagagtctggaaatggtatccattttaacgaagaaggcagtgaggatgtctacgatgaatga

SEQ ID NO: 768 - DNA, 1467 bp, Phyllotreta cruciferae
atggcggctgccgcagcggcaaaaattgccgaagtacgcgagacaacacgcgtagaaagaatcggtgcccattctcacatcagaggcctaggattagacgacagtcttgaagctagacatgtatctcaaggtatggttgggcaagtatcagctagaagagcagttgggattgttctgcaaatggtacgcgatggtagaatcgcaggaagagctgttttattagccggacagcctggtactggaaagactgctatagcaactgctttagctcatgctttaggacaagacacgccgttcactagcatggctgggtctgagatatattcgttagagatgagtaaaactgaggcattgacgcaggctattagaaagagtattggagtaaggataaaggaagagagtgaaattatcgaaggtgaagttgtcgatctgagtattgaacgtccagctacaggagttggtactaaagtcggtaaattgattctcaaaactacagatatggagactgtatacgatttgggcggtaaaatgattgatagtattctaaaagaaaaagttcagtctggtgatgttatcactatagataaagctacaggaaaaattacgagattgggtagatcttttgctagagctagagattatgatgctactggccaacaaacgaggttcgttcaatgcccagaaggtgaactacaaaaacgtaaagaagttgtccacacagtgactttgcatgaaattgatgtaatcaatagtcgcactcacggattcttggcactattttccggtgacacgggagaaattaaatcagaagtaagagagcagattaatggcaaagtagctgaatggcgtgaagaaggcaaggctgaaattattcctggtgtactgttcattgatgaggttcatatgttggatatagaatgcttctcatttttaaacagagctttagaaaatgaaatgtctccaatcgtcataatggccaccaatagaggtataacaaaaattcgaggtaccacttacaaatctccgcacggcattcctttggatttactggatcgaacaattattgttcctactcagccatatgacgagaaggaattaaaagaaatattaaatattcggtgtgaagaagaggactgtcagatgtctgataatgctttggtggttttaactagaatctgcaaggagacttctctgcgttacggcatgcagctcatcatgacatctagtttaattgctagaaagcgtaaagcccacgaagtcgatgtagaggatataaaacgagcctatcaattattctttgatgaaggtcgctctgtgcaatttctcaaggaataccagcaagaatttatgtttaacgagattgatgaaaaggatgatatacttgatgtaagcatccgttgtgaagcttgcgtccgccctattttttctgagacgcactacaagtgtatgcaatgcgacgactttttc

SEQ ID NO: 769 - DNA, 1116 bp, Phyllotreta cruciferae
atggcgttaagaacttacggagataaaccgatcagtttccagttggaggaaaatggagagtactactgtgttggatctgaagtgggaaattatcttcgactcttcagaggatccctgtacaaaaaatatcctggaatgttcaggaggtctataaccaacgaagaaagaaggaggttgattgagctcggtttgagccagcatgttttagcgagcagtgtatcactgcttagagcagaagaagttgaagatataattgaaggaaatgatgagaagtataaagctgtatctgtacacacttcggaacctcctatgccaagagagggtaaatccaagaaaaacatgcaatgggtaccatcgttacctaattccagtcatttagatgccgttccacaagctacgcccattaataggaacagagtagctgctaaaaaggtgagaacatttccactatgttttgatgacaccgatccccaaataaacatagaaaatgcttgtcaacaagaattgctagttcctattagactggatatggaaatcgaaggacagaagctcagagatacattcacttggaataaaaatgagagtttaataacgcctgaacaatttgctgaagttctctgtgacgatcttgatttaaatcctttaacatttgtaccagcgattgctcaagcaattagacaacaactcgatgcattcccgactgaacctcctgctattatagaggaaacctgcgatcaaagagtcattattaagttaaatattcacgtgggaaatacatctttagtcgatcaagttgaatgggatatgagtgaaaaacagaataatcccgaagaatttgcgttgaaactttgtgcagaattgggtcttggtggtgagtttgtcactgcgattgcttattctattagaggtcaactctcttggcaccagaggacttatgctttcagtgaagctcctcttcctgttgtagaggtaccattcagaaatcccagtgaatcggatcagtgggctccgttcttggaaaccttgactgatgctgaaatggaaaagaaaattcgcgaccaagacagaaatactcgtagaattagaagattggctaacactacgccgggttggtag

SEQ ID NO: 770 - DNA, 624 bp, Phyllotreta cruciferae
atgttgtgttgttgttcggacaaagaggactacggcaagggtccgatggctgcaataagaaaaaaattagtgatcgtcggcgacggagcctgcggtaaaacgtgtcttttgatagtatttagtaaggatcaattcccggaagtgtacgtgcccaccgtattcgagaattatgtggccgacatcgaggtggacggcaagcaagtggaactcgccttatgggatactgcaggccaggaggactacgatcgcctgcggcccctttcatatccagacaccgacgtgatcttaatgtgcttctcggtggattcgccggactccctcgaaaacatcccggaaaagtggacgccggaggtaaaacatttttgtccgaatgtgccaattatcctggtaggcaataaaaaggatctgcgtaacgatccgactaccattaatgaacttaaaaaaatgaagcaggagcctgttaagccgcaggacggtcgttcgatggccgagaaaataaacgcctttgcgtatttagaatgttcggctaaaagtaaggagggcgtcagggaagtattcgagaatgccactcgtgctgcgctgcaggtcaaaaagaagaagaagcatcgttgcgtaatgttttga

SEQ ID NO: 771 - DNA, 4155 bp, Phyllotreta cruciferae
atgaatgcatccactttcaatccaagaatggatgccgctcaaaatccggtgcaaaaaatggaattggcgtccaggaatgtggaaaattcgttgttaatcgacaacaatgcgccgagattgatcgattttatgaatatcaatccgcaaagcggttccactgcgagcggtttcgcagaccacgattatccaactttaagtggattgtcgcatattatcaacagcatgacccaaatcaaatgcgtgagcaatgttcccataccttcggaaatcgttgaccactttgcccgtgtgcaatgccactgtatgatgggtttattttctgaaataaacagagcttggctaactgttgatagtgatatttacgtatggacctatgaggaaaataccgacttggcttatttcgatgggataagtgaaacgattgtttgtgtgggcctagtgaaacctaaaccaggagtatttcacgcctttataaaatatctcctgattttagcgacttctgtcgatattgttgtattaggggttactttcactgaacgacccggtgacaacgctgatgaaattcaactcatacctgatcctgtgttcatattgcctaccgatggttccactgttacgataatcaacagtactgatgatgggaggattttttatggcacaaaagaagggaatttatttgaaattgcatatcaagctgagagtggttggttcggcaaaagatgcaaaaaaattaatttatcgaccagcactttgtcgtttctggttccctcgtttattaatgctgcattaagtgaagaggatgggataacgcaaatttcaattgacgatagcagacatattctctacattcttacggagaaaggatccattgaagtttgcgacctaggagacaaagggaattcgttttccagaattagtaaaatatctcaaaacacgttggttaaccaagcaatgaatactgttaaaactcttgacagtcaaaatttccgaccaatagtgagcatatccgccatcgaagcgtctgaatcggttaatttaaatttagtagctgtatctcaaactggagtaagattttatatgagtgttacgagtttgtcgaaccaaaatcctaatcaaagaccatatacactaaccctggctcatgtaagacttccgtccgaatcggttaatttaaatttagtagctgtatctcaaactggagtaagattttatatgtctgttacgagtttgtcgaaccaaaatcctaatcaaagaccatatacgctaaccctggctcatgtaagacttccacctggttattcagctaacattactgtaagacccagggcggtacacgtgtcccaatatagggacagaaacttgatattgatatccactgttaacgagaaagatgtgttgtggtgtatgagctcagacttatttccattcggccgaggactgacagaagcttacacggccattaatttagacgggccagctttagctatctctgaggtgaggaatggtagtccccttcaaataaaagatttacatgaagcgccccctttagtcgtccggcaacatgccgaacctccgaaaaagtacattgttcttacttcgcacagcattcagattttcattaagttaagaccagtggatgtattgaaacaaattttgaaagacagccatgggcaagacaccgaggcattgaaagccttctttacaattcaaaaagaggaccaagcgtgcgctactgctttgatactagcttcattggaaaacgaagataacatggatatagccgagtttgcaaccagagctttcttcttattcggaggcgagccaaaattggcagctccaatgaatacattttccgggccgtccgtattttgcccgcccgtcatgtctactccaaatatacaccaatatcaacagcaacagcaatttcaagcttcaccgcaataccaacacaattttccccatgccatctcgcccggggcaaatgcatacgaattgaccagtccattcgttttctctcccaagcacaacggcctctatttatatttaagtagaatattaagacctatttggcatcgaaggacagtggataagctttgcttagatggaaaaattgttacaaatcacagtacagtgactagtgaagactgcatatttattttgaactacataacgtccctgcataatttcctaatgcgcaatactcagctttcaaccttaagcgccggtcctggtcccggtcaaaatcctcaaaccttcaataatactacaattaatatgaccagattgaaccataccattcaagatgttcaattggaggaaagggcatctctggatgctttgaaaacattcgtttgccactgttgtcaaatattaggtctatggagaattctttgcgagcatcaattccacacattaatagcttctttgcctgaaactgagcagcagattttgcaaaatacgactttcaaggatctacttttatatcgacatgatatctgttcgttgttgattgcgacattagtcgatagttacttaggtgataacgcctcagtcgattcgattagcagcaaattgagagaagtctgtccgctgttttacaagacggaagatgcagctttttcaaaagctgtcgaaatattaaagatgacccggacaattcaaaacaacgacgaaaaggaagagatgatccaatccgccttacagatttgcaaatcaataggtcccactattaatatcactgatatatgcaaggagttcgctaatttgaaagcttacaaagctgttacggaattgtgcgcgcatttcggtaagaaaatagatccggataaaatagcagaaagttactataacgccgaagacaacagtggtgaccaagaggggtacaattattaccaaagaaggttggaaatttaccgtcatatattaaacatgttggatcaactatacaacgaacaaaatcaaacgctggtcactagtagagatgcctcgtactcagttaatcagaccatattactggatggcgtggaacaatctcaagtgggatacgtgatgaagcaagtaataaaagacgttatggaaacgcccgatgagatcatgcacttcgccctttacgattggctggtgttcaaaaatatgactggagatttaataaacatccaaaacccgtctttggaaacgtatttgaaacgaacctccacccagaatcccaacaacattgaggccatgaatttgttatggaaatactacgaaagttgtaacaatcacgcagccgctgccaaaattttgaacaacctcgcctcgagaactggcataaacgttcctttgaaagagagactgtcttacctagcgagagctatcatgtgcatgcgaagcgataaaataggctatgcgccatatcttggtgtatttttgagggatcttgaagataaaatggaggtagcgaaggtgcaagagcaaattttggatgccattgtaaatttgcaaggacaaattcctaacgctcaggaagcaataagtgcacttaattctggcttgtacgaaatttcgcagttgtatgaaaatttcgctgaacccttcaaactattagaatgccaattggcaatcatagaatgcgccggatacactgatcaagttttgatcgaatccatttggcagcaaattttgactgaagaactaaggaaaacctacggaactggtacagataaagtctgtcaacttttgaacaaagtgaagcagttgtcgaagcaatacgctcaatcagcaaactgttttccattgagttacattgtttacgaattggaaatagtgaatgcaaaacttcgaggagacaaacaactcgttccttgtgccttggaaagcatgaatattcctttcgaaaatttaatcaacgtttacaatagtttaaatacgatttctataaatgatcacttttggcaattagaggagaacgaatttcatctttctgaagctactgctgcattaataaattgcttcctaagccatctggaacagtacagcagcgttgaaaagagaaaaataacttcgctctgtcaagatgcagtggttgctttactatccaacttgtatagcaagcctaacactgaggtgttagttaataagttaagaaatatacaagccaagttgtcaagaatttag

SEQ ID NO: 772 - DNA, 4143 bp, Phyllotreta cruciferae
atgagcgaattcactttgagctatagggaagtcactccggagcaaatagatttcgaaaattggaaagaaataaccctcactacaggaggaacccaaagcacccttcaagatataaaagtagccgagaaagccaatggatactgttacaaagactccactaaacactgcacgaggaatagattcatctactggagaattaatcacaatgtattggagctagtagagcacagtttagatataaatcttacaggaaatcgtatcagatacaagttcgatactccaattttagatggtgtttcgatacacgaagtactcgataatattgttattttggttcctacagtttgtagtgtacacaggctgattttcccccatccaaatgttttccacgcacaggacgatttactgggaatatatccggatttaacagccttatcgatattctcgaaagcttcgattgtagacaccagaaacccgaacagcttttacgtgttcaacaatcccagcactgccaacgatcaattaccgaacctagccaattcgtacttcgtaccggaaaccggggaagcttatttcgttttggcctttccttcgactgaactcttactaatcaggcaaagtcccgatcaagtcacttgcacagaactcaaaggggaatctttggtgcccagatttttcgccggtttagcagataaattcaggcaaaggaattcggatagcgaaaatgtggttagtttgctattttacgatttggacgaagaaacttacgtgttgtcattaacacaagatgctcatttgaaattctggtcatgcagtaaaggccaatgcgtagcagtaatagatgttcgtgaaaaaataagaactaacttgaaatatagagtacaatcagccattctaaagaaagcagaagatggcaacagttctgaaaacattctggttctattcctaagtttcggaaataaatgccagttccatattttgaaaccctcgattagagaacaagagatcactctaaatagattagccactctcgaatcgccattgaacgatttgatagatttcgcagcacaaatagactgcttatggtcagtatggcgatcagaagagggcgaaacggttgtgtacaatgcatcgttcaaatccaaccgatggacccaagtaatactggaaaccgaaccgtgcgaatttaaatattgccctataaaatacaatgatgtcaagacgctttacttacagcacattttccatccaggcagatttcctctgcacgttattaacaaaaccctttcgatatataaaatgcctacgattgcctcagacgcccatctttccgtttctgctctaaagcaaagagtgtgcttggctgtcgaaaatgatatacaaaatctctttaataatgggagcgatatcgatagcgttgaagttgatgagtatgtagagtgcgctgaatggagttggcaaaaattctacacctattgtgtccaataccacacagctagtagaaaaccgttgggtttgatgctactaccgtccgtatcaggagctatgctgttgaagaaatctgtattttcgtttctacggcctgtggattcgttggaacacatgacgttgtgtacagatttgtacagagagcagttcttcaatttttccatgttgtccgaagatttggatactgtagatgacgtaatcaacgtgtttaaagtgatcgtttacatcgaacaacaactaaaggacgttttcatgcaatcgttcgaaacagaacttctcaatctccaatcacctgacgttgtgacagaggagctgttgaaaagaatttacgttgaaatggattccgattttttctcgcatattttgcacctaatcaaagacgtcaacgatttgtacaaagccatacacaaaatcctggagctgttgagatatgaaaacaccttggccaaccccgataacgacattaacccatccgctatgtactatttcaattcactgttaggcacttcattggtggcccaaagtttccgacaacaagccgaaatcagatttcaaatttgccgcaatttgttgctattatgcaacttcttggtgatggacaggacgctagattggggcgttttggaaggcgttcgatcagtctgtatgccagacattgtcgttctaacccaagccagtttcgttgttctgtggctaagcgggttgacaatgttcgaaagcgactcgattcgtgattcttcgatgagcatcctgaacccgttaaaactaactccagtttacaatttgctaccgttcactcgttgcacgtctttgttggaagtattcatatcatcatcaggcgttcaagatgccaggaaatcgttcgcaagggtttcctgcaaggacgaggccttggtgcattggcattggtcgttgttgccttacgtaaaccacatcaggcatcttatatggcccataagcggttgtacggtgttagaagagtggctgttgtccagtggacaacacgtgtggctacaacagtacgttcgcctacttagcaattggtgcgaatggaacgcttgtacacgtaacttcttattggcctcgtcgtttctgactaccggcgaattttataaagccgaagagctgttcgaaactgcagcgaaaggggtttttaccgacgcgtttttgaagaaccgaatcaaaagtgtcgatgatagtaattttagaacgactattcattattatttaaaggttatccagctattcgagttatgtaatgcaagaaaccatgtgatttacgtagccaatacggccttatgtgttgtcaaacgagacgatcctttagctgctacgttgttttcgatcaaattcaagcaccatttggctttgaagcactaccaactggccttcgattcgttgaattcgaaccccgatggtgaaaggaggaaagataatctcagggatctagtaaaaacgttgctggacgagaaaaaactcaacgtattgttgaattttacttacggcagcatggatgagttctttgcgaacattattttaactcgagctagagctgctgatgttactaataacgtgttctacgattttttgtattcgtaccaaattaagaaaggaccaccttctttcagattagctgcctcagctatgtacgaacaagcctttcgattaagccagaaaactaccatcgaagctttagaaaagcaagtgaaatgctacttagcagctaaaaatgttctacatttgtgcccacctcaacacgcttgggttgtgagacctgcagatcccgatgaagaagacgaacaagttatattccagcctttagccggctccaacggggaaattcgtacgttcaaaatcaaaaaacaaatcgaagtagtagacatcgaaaccataggcaaagaactgacgttcgccagcgctaaattgaaactactccaattcaatcccactgtctccatgaacatgtacgatcctctggagctggtgatatcgttgaacaactccgggatgttcaaagtggctttcgagatttgttcgaccttcgatttgccttattcgttggtgtttgaggctctaacgaaacgctgcgttttgctcacagaagccgaggatcccaacgcttggaattggctggtggagaacgatctgcaagatttaccggttaatagagagtcagcagccgatgtagtttggaagttcttgcaggattgtttggagaaatacgaagagcctaacatgtcgtgtttgcataatgtggtttgcaagaaaattatcaacatgcaaatttacttgcctcattggttgaaagcttcttataagtctcgaaatccgtccgaattgctaagattactgcacgcctcggggcgtttggaggaagccgtggaattggccaaagattacattttatcagcgatgggatacggtaaagaggaattcggattcaagcagcctttggcgccaacgtcaccggccttttgtcttcctgtctacgccatacaaaggctggtagacgaattgaacatacagaattccatgaacatcgagaagccttacgtacacgagtatgatgatttgaacgtgttgttttctaagtatctcgaaacagcaattagagtttctaatcagatgtgccaggttaagtgtaaagctttttaa

SEQ ID NO: 773 - DNA, 2970 bp, Phyllotreta cruciferae
atggaagtctccgacaagaatctggaaaccctgagcagatatttgcaggaaacgctcaacccggaccccaacgtgcgcaggccagccgaaaaattcctggaaggagtcgaagtcaaccagaactatcccctattgctgctcaatctagtgcacaagcccgaggcggacatgaccatcagggtggccggctcggtggccttcaaaaactacataaaaaggaactgggtagtcgaagaggaccagaccgatcgtatacacgaatccgatcgattggccatcaaaaatctcattgtaactttaatgctgagctcaccggagtcaattcaaaagcaactcagcgatgctatcagcatcatcggaaaaactgattttcctttgaaatggccggagctcatcaccgagatggtcgagaaattttctaccggcgattttaacgtgattaacggcgtgctgagaacggcccattcgctatttaagaagtatcgatacgagttcaagtccaacgaattgtggacggagattaaatatgtactcgagaagctagcgaagcctcttactgatctgttagttgctacgataaatctatcgcaaacccacgcgaacgacgtagcagcattgaaaatcatctacagttcgctcgtgctcatctgcaaagtgttctattcgttgaatttccaagatttgccggagttcttcgaggataacatacaaatctggatgaccaatttccatacgcttctctccgttgatgttaaatcgttacaaagccaagaagacagcgaggcaggggtactagagcagctgaagtctcaagtatgcgataatgtggccttgtacgcgcagaagtacgatgaagaattccagccgtacttaccgcagtttgtaacagatgtttggagtttattagtggctactaatttacaaccgaaatacgatttgctggtttcgaacgccttgcagttcctttcgtccgtagccgaacgttcccaataccggaacctcttcgaggacgacaacgtgctgagcagcatctgcgagaaagtcatcatacccaacatggaattcagaacttccgatgaggaattgttcgaagacaatcccgaagagtacacgagaagggacatagaaggctccgacatcgacacgcgcaggcgagccgcctgcgatttggtcaacactttgagccagaacttcgagcaaaggatcgtcgagatattcggaagatatctacaagtgatgcttgcgaagtacacggagaacccgaaggagttctggcgcagcaaagacgcggccttgtacttggtaacgtcgctggtgagcagggggtctactcagaagcacggcgttacgcagactagccagttagtggacattacccagttctgtcagcagcacattttgcccgaattggaacggccggacgtgaacgatttgccggtgttgaaagccgatgctataaagtacgtgatgacgttcagatcggtacttcccagcgatttagtggtgtctacgttaccgcaattgatcaggcatatgccgagcgaaagttgtgtggttcacacgtacgccgcgtgcactttggagaagattcttatgttgaaatccaacaatcaagccatagtaaccggggatcaattggagccgttggcctccgagttattgaccaatttgttcgccgtattacaaaaaccagtgtcggaggagaacgagtacataatgaaggctttgatgagaacgttcgcaacgctacaagataggatcataccgtacttgaacgtggctttgccgaagatgaccgagaaattgcaaatggtggccaagaatccttcgaaacctctctttaaccattacctgtttgagtgcttttcgttggctataaagattatctgtaaggtgaatcccacagctgtgacttcgttcgaagacatattgtttcccatatttcaaggaattttacaacaggatatacaagagtttattccgtacgtgttccaaattttatccttgctcatggagcacaccccgcagggctccttatccgacccctacatgcagctgttgccttgcttgttggcccccatattatgggaacgaccggccaacattagcccgttggtgagattgttggctgcattcgctactcaggccgccccgcagattgtactgcaagataaagtgggtggatttttgggggtattccagaaattgctggcttcgaaatcgaacgatcacgaaggctttcgattgatgcaaagtttaatacaaaatctacctactgaagctcttacgccgtatcacaagcagatattcttcctgctattccagcgattatcgtctagcaaaaccaccaaatacgtgattaatttgatcgtgttcttttgcttgtacatggtgaagtattcgcccaacgatttggtggctttgatcgatgaaattcaaggccagatgttcggtatggtattagagaagcttctaattgctgaattgcaaaaaatagctggcgatgttgagaggaaaatcgtagcttgcgggattactaaattgctgtgcgattgtcctgcgatgtatacggggacttaccaaaaatattggccgcagttactgcaggctctattagcattcttcgagatgcctagagatgagacaaccttccccgatgaccatttcatcgaagtagatgacaccccagcctaccaagccactagcgctaaattgaatttcgcggacggtaccaaaaacgatcctctacaaggtgttagcgagccacggcagtttctggttcagagcttggccagcctgggggctacgcagcccggccggctgcctacttatataaaccaacgtaaatcagcagtcgcagacgatactgcagggttatttggccaagttcggcgttcaattggcgtaaattcgagtcgactgagttcaaatattatttatcgaaaaatgatgatctgcgaaacgatctaa

SEQ ID NO: 774 - DNA, 600 bp, Phyllotreta cruciferae
atggcaaaagtacaattatgcaatatcacagttatggacaatcctagtcctttcttgaacccatttcaatttgaaatcacgttcgaatgcatagaggaattaaaagaagacttagaatggaagatgatttacgttggttcggccgaaactgaagaacacgatcaaatcttagactctgtatttgtaggacctatcccagaaggcaaacacatgttcgtctttcaagcagatcctccgaacgtctcccgtatacctgaaaatgacgccatcggtgtaacagttgttctcctcacttgctcctacaagagccaagaatttattcgtgtaggttattttataaataatgaatacagcgatcctgaaatgagggaaaatttgcctagtccacctcagttcgataaggtaattagaaatatattggcgtccgaaccgagggtgacgaggtttaaaatcaactgggaagaatcgagtggcactcaggaaaacggaactacaattgccgaaacccccgctaaccaaacaaccgaaacttccacttccgtagaggtacctgctttcaacgagaactctaattcgtgggccaccatggagtgttcataa

SEQ ID NO: 775 - DNA, 939 bp, Phyllotreta cruciferae
atggatcaaatgctaccgagccctggttttagtatacctagcataggtacacctcttcatcaacccgaggaagaccagctaattttaccaaacgccattcaacaacaacaaagtctacctactactaactcacaagtgcctcctctagctccaatgggaggttctactccaacgcttggtctaggtttaggccatgcgatgtccatgccacatactaagtatgtaaccggattttcactgcctatcagttctatggcacctcaaacaccacaacatacaatgatgagtcctatggtaaatgttggtggaactggtaccactagttctggtgtaacgcccacgttaggtccctctacaccttcaccaatgactcctatgacaccacattcagcagatcctggaatcgttccacaattacaaaacattgtgtcaactgtaaacttgagctgtaaattagatttaaagaaaattgccttgcatgcgagaaatgccgaatataatcctaaacgttttgccgctgtgattatgaggatacgagagccaaggacgacagctttgatattttcgtcgggtaaaatggtgtgtacaggtgcgaaaagtgaagaagactcgagactagctgcaagaaagtatgctcgaattatacaaaaactgggtttccctgccaaatttttggatttcaaaatacagaatatggtgggaagttgtgatgttaaatttccaataagattagaaggattggttctaactcacagttctttcagcagttatgagcccgaattgtttcctggtcttatatatcgtatggtgaaaccaagaattgttctgttaatatttgtctccggtaaagttgttctgactggtgctaaagttagacaggaaatttacgaagcgtttgataatatttatccaattttaaagagttttaagaaacaatga

SEQ ID NO: 776 - DNA, 477 bp, Phyllotreta cruciferae
atggctgcaatgcgttccatgtctcgcctgttattctccagatcattacaaactactgtaaaaaggggttacgctgatcaaatgagcttcacttttgctgctggaaaccaggtcttctacgatgcgaaatcgataaaacaagtagatgttccttctttctccggtagcttcggtatcctaccagcccatgttcccactcttgctgttctaaagcctggagtagttactgtttacgaagacgctggtaatgtcaagaaaatcttcgtatccagcggtacagtgactgttaatgacgattcatctgttcaaatcttagctgaagaggcccatcccgtagaaaatttagacgttagtgcagccagagatcttcttaacaaagcacaaagtcaattgtcatcggccactacagatcaggccagagctgaagctgccattgccattgaagtgggagaagcacttgtaaaagctgctgaatag

SEQ ID NO: 777 - DNA, 972 bp, Phyllotreta cruciferae
atgagcggcgatggcaaccaaaacgagcacttcgacacgttattcctatcaatcgcccagcatcatccccaggggcccacgcaactcctagacacttttgtgaacttcctgagcagaaaaacggatttcttcacaggcgggaaggaaggcgaatgggaaaagttggtgttgaatacgttcaagaagtacgagaagtccagcagggagcagcacgcggcagaattgaaggagaagcaggaacaggaggcccgcaggaaggctaagaaagaggccgaatcggccaagcaagctcaaattactgaattaacagaagagcaggctgagaaattgcaagccgagctcgatgctaagaagtccccagcttcggttaccccttcgaatagctcgagtggcccttcgacctccacgacgaagatcgaagaagacgaagacgagtccgagaagggtaaattgctacccaataaaggcaacggatgtgatttagacaagtataattggacccagactcttagtgatatagagctgcgagtgccgctccagtgcaatttccgagccaagcaaaaggatctcacggtgaatttgaccaaaaaacgcctcacttgcggcctcaaaggccatccccccatcatcgatgacgatttccagcacgaaatcaaactggaagagaccaattgggtgattgaagacgggaaatcgttgctgttttccatagaaaaagtgaataaaatgaattggtggagtaaaatcgtgaagaatgatccggagatcagcactaaaaagattaatccggagccttcgaagttgagcgatttggatggggagacgaggggcatggtggagaagatgatgtacgatcagaggcagaaagagatgggattacccactagtgatgaaagaaagaaacaggacgtgttgaagaagtttatggagcaacatcccgagatggatttctccaaatgcaaattcaattga

SEQ ID NO: 778 - DNA, 477 bp, Phyllotreta cruciferae
atgcagtctcctagcggaatggtgcacggccatccaggtgcctcaatactgcaatggagccctgataaaaaatacagcgatagagaaaggtggatttgcgtttatccagcatacattaattccaaaaaaaccattgcccaaggcaggaaaataaacaaagaaaaatgcgtggagaatcccactcatcaagaaatcagagacgttttgctcgcagcaggtttgaaggttggcgtagaaaacaaattgtacagcagagaacgaagcaaagaattgctctatcgagggcgaattagagtccaattgaaaaacgacgacggtacgctgtgcaatccaaatttccctaccagagacagcttaatgctccatttgggagacatgattcccaaattgaagagcagacaaaacaagggcagtggagatccacaaccaaccaccaccagctcgaagggaaagggcaaaggcaaaggaaggcgttaa

SEQ ID NO: 779 - DNA, 2202 bp, Phyllotreta cruciferae
atggaggaaccggagcctactaaacgccagaagatgcccaaagtggccaaagtgaaaaacaaagccccagctgagatccagatcacagctgaacagctactgagagaggcgaaagaaagagacttggaaatcctcccgccgccgccgaaacagaaaatttctgatccggctgagttggcggactatcagttaaggcgcagaaaacagttcgaggataacatcagaaaaaacagggcggtcatttcgaactggatcaagtacgcccaatgggaggaatcgcaaaaggagatacaacggtccaggtcgatatgggagagagccctcgatgtggaccacaggaacattaccatttggttgaaatacaccgaaatggaaatgcggaacagacaagtaaatcatgccaggaacttatgggacagagctacagttcttctaccaagggtaaaccagttttggtacaagtacacctacatggaagaaatgctggaaaacgtagccggagcaagagcggtattcgaaagatggatggattggcaacctgacgaacaagcttggcaaacttacataaatttcgaactgagatacaaggaaattgatagagccaggcaaatatacgaaagatttgttataacgcacccggaagtgaaacattggatcaaatatgcccgtttcgaagaaaatcacggtttcattcattcagctaggcagatttatgaaagagctgtccaattttacggagacgatcatttggatgagaagctttacatagctttcgccaaattcgaagaaaaccagaaggagcacgatagagctagagttatctacaagtacgccttagaccacatccctaaggatgaaacgaaagaactgtataaggcgtacaccatccatgaaaagaaatatggagacagaagcggtatcgaggaagttataatgtctaaaagaaagctgcagtacgaacaagaaatactccaaaatcccaccaattacgatgcttggttcgattatcttcgactggtagaaggagaagcagatttggaaataactcgagaaacctacgagagagctattgcaaatatacccccatcgaaaaacaaacaatactggagaagatacatttatttgtggatcaattacgctttattcgaagaactggaagctaaggattacgaacgaaccagacaggtatataaagcctgcctggaaatcctgccgcataaaacattcacgttctccaaaatctggctgctctacgcacagttcgaagtgcgacagaagcatttaaaagcagcccgtaaagttctaggcatgtccataggaatgtgccctagagataaattgttccggggttacatagaactggagatacagctccgggagttcgatagatgtcggaaattgtacgagaaattcctggaattcggtccggaaaattgcgttacttggatgaaattcgcggaattggaaactcttttgggggataccgacagagcgagaggcatttacgaattggccataaaccaaccgagattagacatgccggagttactgtggaaagcttacatagatttcgaaatatctcaagaggaacccaacaatgccaggcaaatttacgaaagattgctagagaggacatctcacgttaaagtgtggctttcctacgccaaattcgaattgaacaatccgagtgaagaagatttcaacatccgtttagccaggaggatcttcgagagagccaacgaaaatctgaaaaacgtccccgaaaaagaatccagagtattattgcttgaaaactggagagaattcgaaaacaatcacggcgatgaggcgcacaaagaaaaagttaacgctaaaatgcccaagagaattaagaagaggcagaaggttatcgatgaggatggtgtcgaacaaggctgggaagaagtatttgattatatattccctgaagacgaagccagcaggccgaacttgaaattactggccgctgctaagaactggaagaagaacactgacgagccggaggaagatacggaaaatagaacaaccctttccagcagtagccaaaggatgaaagaaaagttattagcctccgtgaagaattggaaaaacaatgacaaagaaaatagtgattctaataacgatgaatgctctaatgaagatgtagttcaaattactgattcaaacaatgcagtagaaaattga

SEQ ID NO: 780 - DNA, 1431 bp, Phyllotreta cruciferae
atgggaattaaatttttggaagttatcaagcctttttgcagtatcctgccggaaattgcaaaaccagaacgaaagatacaatttagagagaaagtgctatggacagcgataactctattcatctttctagtatgttgccagattcccctattcgggatcatgagttcggactctgcggatcccttttactggatccgtgtaatcctcgcctccaacagaggcaccctcatggaattgggtatttctccgatcgtaacatctggattgatcatgcaactcttagccggagcgaagatcatcgaagttggcgacactccgaaagacagagctttgtttaacggagcccagaaactgtttggtatggttataacggtcggtcaagccatcgtgtatgtaatgaccggaatgtacggagacccagctgaaataggagctggagtctgcctgcttatcatcatccaactgttcgtagcaggtcttatcgtgctccttctcgatgaactgttgcagaaaggatacggtttgggttctggtatttccctgttcatcgctacgaacatctgcgagacgatcatatggaaggctttctctccggctactgtcaacactggaagaggaaccgaattcgaaggagctgtaatcgctttgttccacttgctcaccaccagacaagacaagattagaggactacgagaggcattctaccgccagaatcttcctaatttgatgaacctcctagccacagttttagtgtttgctatagtaatatacttccaaggttttagagttgatttacccataaagagcgccagataccgtggccagcactcgagctaccccatcaaacttttctacacttctaacattccgatcattttgcaatctgcgttggtgtccaatttgtacgttatatcccagatgttggcggttaaatttcaagggaacttcttcatcaatctgttgggggtttgggctgatgttgggggcggcggcccggctaggtcttaccccatcggcggtttgtgctattacttatcgccgcctgaaagcgttagccacattctggaagatcccgtccacgctgttatgtacattattttcatgctgggttcctgcgctttcttctcgaaaacgtggatcgaagtatccggcagttcggctaaggatgtcgccaaacaacttaaggaacagcagatggtcatgagaggtcacagagacaattccatgatacatgaactcaacaggtacattcccactgctgctgcatttgggggtttgtgtatcggagccctgagtgttctggctgatttcatgggagccatcggttctggtactggtattttgctcgctgttacaatcatttatcaatatttcgaaatatttgtcaaggaacaaagcgagatgggcggcatgggcgctttacttttttaa

SEQ ID NO: 781 - DNA, 921 bp, Phyllotreta cruciferae
atggctgccaccgtagggcgaatttgtggtgtagggctattaaagccgaataatttaaccaccatcggtcagatcagctcttattccaccgccaaagaatggagtagaggtaaaaaggcacttttaggaacattagggttattagccggaggcactggggccgtgctggtggccctcgaccagtcggttaaagcgtcggatctagaactgcacccgccgaagaacatctggagccacagcgggatattcagctcgctcgatcacgccagcgtccggaggggttacgaagtctacaaacaagtatgcgctgcatgccactccatgcgtttcgtggcctaccgcaatctaataggcgttacgcacaccgaggccgaagccaaagccgaagccgaagaccagatgatcgaagatggccccaacgatgagggcaacatgttcaaacgccccgggaaattatccgattacttccccagcccttaccccaacgaggaggcggccagggctgccaacaacggggcctacccgcccgatttgagctacattacgtctgctagacacggaggtgaggattacatttttgcgctgttgactggttactgcgaggccccggccggcgtgattgttagagaagggcagtactacaatccgtacttccccggtggggctatttcgatggctcaggctttgtacaatgaaacgatcgagtacgatgatggtactccggctacggctagtcaattggctaaggatgtgtcgacgtttttgaagtggacagcggagcccgagcacgacgataggaaacgaatgctgatcaaagtcatagggatattctcgttcttgttagggatcacttggtatatcaagaaggtgaagttctcctcgctgaagtcccgaaagatcgagttcaggccgaagaaatga

SEQ ID NO: 782 - DNA, 1695 bp, Phyllotreta cruciferae
atgttggcattacaacaatactcaggaagtagcgacgatgaggaagacaaagaaaagtccactattaataacgatccatcaactcctgctgaatattcgtcaaaaagcaagctcgcggtttgcgcagcaccagaagtccttcccacaggactagaggaggaccaaatgcacatcgatgtagacacaaaagagctagcgtttaaccccaagttcgatgtcctgttcgcacctgccctaggtcctgctaatccttttaaaacgcaacaacagttggttgaacgaaacatgctctcaggccacatcgagagagcccacgtcagcgaattccaattcgaaaaccaaaggaggactttcaccagttacggttacgctttggacccgtctgtaaccaatgacgggaaaatcaaagtggtaggatcttcggaagccgatgatagtagcatcaagactgtattcgaagcctctaaaacgaggcctttggataaacgaaaaaggaagaagaatgatgaccccagcgatgttgaaggtttcttaggcccttggggtggtttcgtagacgagcaaaaagtttccaaacctaccgaggaagaacaaatcgaattggatgagatatcctccaagaagaataaaaagggtaaacccaacgaagataaacccctcgaagaaaaatcagtcttgcacatcaaagacgccgtggattaccaagggcgctcattcctccatgcgccacaagatgtcggggtcaatctcagatcggacacccctccggaaaaatgtttcctgccaaaagctcatatacacacatggactggacactcgaagggcatcgctgctatccgattgttccccaggacggctcatcttctattatcggccggaatggactgtcgtattaaaatttgggaggtttacaacgaaagacggtgtgttaggacatactatggacatcgacaagccgttagggacatcaatttcaacaattccggaaagcattttctttcagccggttatgacaggtatataaaattgtgggatacggaaaccgggcaggttctgtcgcgtttcaccagcaggaagataccctattgcgttaaattcaatccggataaaaacaagcaacatttgtttgtggccggtacttcggataagaagataatttgttgggatacgaggtcaggggatatcgtgcaagagtacgacaggcatttgggtgctgttaatagtattacgtttgtggatgaaaatcgacgattcgtgacgacttcggatgataaatcgttgagagtatgggaatgggatattcctgttgatatgaagtacattgctgatcctactatgcacagtatgccttcagtaactccagcaccaaacggtaaatggttagcttgccaaagcatggacaacaaagtagtcatattctcttccatgaatagatttaagattaatcgtaagaagacattcagtggtcatatggtggccggatacgcttgctcgttggacttttcacccgacatgagttacttatcatccggagatgccgatggtaaagtttatatatgggactggaagtccactaagcttttcaagaagtggaaggctcatgataacgtttgcatcagcgtcctgtggcatccgcatgaaccgagtaaactgatatctgctggatgggacggcctaataaagtactgggattga

SEQ ID NO: 783 - DNA, 603 bp, Phyllotreta cruciferae
atggtgcagaaaaagcccaagaagaaggtgggcaagaaggtagccgcggctcctttggcagtcaaaaaagtcgagccaaagaaagaagtcaaccccttattcgaaaagcggcccaggaatttcggaataggccaagacatccaacccccgagggatctatccaggttcgtaaagtggcccaaatacatccgcatccagcggcagaaggccgtcttacagaagcgcttgaaagtgccgccgccaatcaaccaattctcccaaaccatcgacaaacaaacggccacccaattattcaaagttttggagaaataccggccggagaccgccttgcagaaaaagaaccgactgaaggccaaggccgaggccaaggtggccaaaaaggaagaggcccccgccaagagacctaatactttaagagctggtactaacactgttaccaaattagtcgagcagaagaaagcccaattggtggtcatcgcacatgatgtagaccctatcgaattggtactattccttcccgccctgtgtaggaaaatgggagtcccctactgcatagtgaagggtaaagctaggttagggctgctcgttaggcgtaaaacttgc

SEQ ID NO: 784 - DNA, 1002 bp, Phyllotreta cruciferae
atggcaacaataattaaggacataacactacaagaaaacattccacaaaacatactattcgaaaaacatatcgacttcataaaggaatacggccaaaaggaaaacaactttgaatatgcaatgaccgattatttaaggatatccggcatgtattggggcctcacagccctcgaattaatgaacgcctcaccaccacactcaatagacgagatttcagattacatcaaacagtgccaagaccccgaaagcggtggaatcagctcttgcctgaaccacgatcctcacatactccacactttaagcgccgttcaaatactttgcatgtacgataacttaaaagctatagacgtagaaggcgttgtgaagtatgtaaaaaacctacaactacccgacggtagcttcacaggagacaaatggggcgaagtagacaccaggttctcattctgcgccgtcgcgacgctctcgcttttagacagaatggacgccatcgacgtgaataaagcagtagactttgtagcttcttgtaaaaacttcgatggtggtttcggctcgaggcccctctccgagagccacgccgggttaatatactgctgcttaggattcctgtctgttaccaatcgattggatattgtggatcgagatatgctggcttggtggctctgcgaaaggcaattaccttcgggcggtttgaatgggcgtccggagaagctgcctgatgtttgctactcctggtgggtgctgtcttctttaactatattaggaaaactgcattgtatagacgccaatgcgttgaagaaattcatactagcatgccaggataccgagagcgggggcttcgctgataggcctggggacattccagatcctttccacacagtgtttggaatatcagcgctgtctttactcggaaacgacacggtccagaaagttaatcctacttattgtatgccccagcatgttatcgataggcttcagttgaaacctcaaattttagatgtttag

SEQ ID NO: 785 - DNA, 2667 bp, Phyllotreta cruciferae
atgcaccaagaaacattgcaactaatccaaatattagaaaaaacagtttcacccgacaagaatgaattggagcaagcttcgagctttttggaacaagcgtcccaaacgaatttattaggattcataaagaccctctcggatatactgcggcatggcggcaacagcccggtggcccgaatggccgccggtttacaactgaaaaaccagctcacttcgaaagacccgaccatcaaagtcggctaccaacagcgctggctgctcttcgccgaagaagtcagagactacatcaagaagaacgtggttggcgccctcgggaccgagaccaacaggccgtcgtcggccgcccaatgcgtcgcctacatagcagtgaccgaattaccgcaaggacaatggccggatctcatatcgacgctggtgagcaacatttgccaggggaactccacggaaatgcagaaggaggccacgctcgaagccatcggttacatctgccaggaaatcgaatccgatgtgttagtcttacaatctaacgatatactaacagccatcgtgcacggcatgagatcctccgagcccagcaatcacgttcgattagccgccacgcaggctttactaaactcattggaattcactaaagctaacttcgatttgaccaccgaaagaaattacattatggaggttgtttgcgaagccacgcagtcgccggtgtcgcaaatcaaagtggccgctttgcaatgtctagtgaaaataatgtcgctgtattatcaacacatggagccctacatggcgcccgctctgtttcccataacgttagaggccatgaagtccgagaacgatgccgtagccctgcagggtatagaattttggtcgaacgtaagcgacgaagaagtggatttgtccatcgaagatactgaagcaaccgaagctggtagaccgcctacaagggtgtcgaggcattatgcgaaaggagctctgcagtacatcataccgatcatcctgcagaaactcacgaaacaagaagagttggatgacgaggacgattggaatcccagtaaagctgccggggtgtgcctgatgcttctagccacttgctgcgaagacgaaatagtccctcacgtgttgccgtttatcaaagaaaacatcaaatcagacaactggcgtttccgggacgcctccctgatggccttcggttccattttaggtggcttggagccgaatactctgagaccgctcgtcgaacaggcaatgccgactttgatagaattaatgtacgatagcagcgtaattgtaagggatacggccgcttggacgtttggtaggatatgcgaaataataccggaggcggccatcaacgagaattacttgaaacctctgctagagagtcttataactgacttgaaagcggagccccgtgtggccgccaacgtgtgctgggccttctccggattggccgatgcggcctacgaagctgctgctgttaacgaggaaaccggagctccagatacttacattttgtcgccgtattatgaatttattatacagaggttattggagacaaccgacagagcggacggtgcacaagctaacttgagaccggcagcgtacgaggccctgatggagatggttaagaattcgccgaaagactgttacgttacggttcagaaaaccacgatggttattttagaaagactgcaacaggtactgcagatggagaatcacattaccagccacaacgacagatcgcaattcaacgatttgcagagtctcttgtgcgccacattgcaatcggttttgaggaaagttactcccgaagatgccccgcatatttccgatgctatcatgacggccatgttgaccatgttcaattccaattcttgcaaaaacggaggcgtacaagaagacgccctcatggctgtatcaaccctcgtagaagtcttgggagagaatttcattaaatacatggacgcttttaagccgttcttatacataggtttgaagaaccaccaggagtatcaagtgtgcggtaccgctgtaggcttgacaggcgacatcttccgcgctttgaagctcaaagccatgccctactgcgatgaaatcatgactcttttattggaaaatctcagcgatcaatcggtacaccgtagcgtcaagccccaaattctctctgtattcggcgacataggtctcagcatcggctcggagttcaagaaatacttggacgtggtgctctccacgttggcgcaggcgtcccaagcgcaagtcgaccgcaacgatttcgatatgatagattatctgaacgagttgagagagggcgtattggacgcttacaccggcattatacaggggttgaagggggacggaccgtcgcccaatccggaagtaatggtcctcgagccgcacattccgtttatcgtacagtttatcatcgtggtggcgcaggatgccgatcattccgatggcactgtggccgtggccgctggaatcgtaggggatttgtgtacggcgttcggcagttcgatggtgccgttgttggatttggcttcgatcaatgatatgttggcgcaaggcagacgcagccgcgtcagcaggaccaaaacgttagcgacgtgggcttcgaaggaactgaggaaacttaagatgccgccatccgcagcagctgctagctggtga

SEQ ID NO: 786 - DNA, 1503 bp, Phyllotreta cruciferae
atggaaacgattttggaacaacaacgtcgatatcacgaggaaaaagagcggctgatcgacgccatggtgaaagaaatgctgcacaaaaaaaacacctatagagaagcgataaattcggaccaccggcaaaagtacctcctagacagatacatgacctccaccgaaagactaatcgatttgtacgaagacaaagacggccaacgcaaggccgaggtggccgccctgacgggccccaacgaattcaacgagttctacagcagactgaaacaaatcaaagacttctacagaaggcaccccaacgagatcagcgtaccgatgtccgtggagttcgacgaattcgccaaagctagagagaaccccaacgaagatatggccaatttcgtggaattcaccgacgaagaaggctacgggaagtacctagatttgcacgagtgctacgagaagtacataaacttaaaaggcatcgagaaagtcgattatatcacatatttggcaatgttcgatcagctgtacgatataccgaaagaacgcaagaccggcgagtaccgcaaatacctgctgtacctcatcgagtacctcacgtggttcgtgcagcgcatcaggccgctgatggacctcgatggcgatttgctagagcaggccgagcaggctgcggccggatgggagaacggatcggtgcccgggtggccgaaagaaaccggctcggctttggcgaacgtgggcgctcatttggacctatcggctttctccagttgggaggaattggcttcgttgggcctcgatcgattgaaatccgctcttatggcgttgggattgaaatgcggaggaactttagaggagcgagcccagcggttgttttccacaaaaggcaaaggctccttggatccgtcgttgatgacgaaaaacaccaagaatcgcgtcactaaagagaaggaggcgctgcggcagaaggagctggctacattagaagcgcaaatctacagattggccgatctggtgtcagcccaacgagcagccaccaaagagaacgtacaaagaaaacaagcccgcacagacggcgaaagagacgacagcgagaacgaagaaagcgaagaagagagccccgatgaagccgatgatgacgtgccgtacaatcccaagaaccttccgctcggttgggacggtaaacccattccgtattggctgtacaaattgcacggcttaaacatcagctacaattgcgagatatgcggtaactacgtgtataaaggccccaaagcgtttcaaaggcacttcgctgagtggaggcacgcgcacggaatgcgctgcttgggcataccgaacacggcccatttcgctaatgttacgcagatcgaggacgctttggctctgtgggagaagctgaaggtgcagaagcagagcgagcggtggcagccggagaccgaagaagagtatgaggattcgcaaggaaatgtcgttaataggaagacttacgaggatttgaaacggcagggtttattgtga

SEQ ID NO: 787 - DNA, 639 bp, Phyllotreta cruciferae
atgacgataggaaagaataataaaatgatccaacacataaactatagagtccgaataacattgcaggactctaggacgtttatcggcacctttaaagctttcgacaaacatatgaacatgatactcggcgattgcgaagaattccgcaaaattaaacccaaaaactcaaaagtcgaacgagaagagaagcgggtattaggatttgtactgctgagaggcgagagcatagtctcactaactgtggaagggcctccaccaccagaagagggacttcccagggtacctatccccggagcagcccaagggccaggtataggaagagcagcaggtaggggaatgcctcccggtatggctggtgtaccagttggtctccaaggtcctgtgagaggagtcggaggaccgtctcagcaagtaatgactcctacgggtagaggacaggtttcagcgccgccacaaatgaaccaagcacctccaaggatgggtggccctccgcctggtatgatgggacctccgccgggaatgatgggcatgccgccgcaaatgggaatggggcgcggaggaccgcctccgatgggtatgaggggtcccccgcccggtatgatgagaggtgggccacccggaccgccaaggccttactaa

SEQ ID NO: 788 - DNA, 876 bp, Phyllotreta cruciferae
atgaactttggagacttggagtttggttttaaaatttcaaggaaaacaataccattaattgtaagagaaacttgtttggccatatggaatgttattcaacctcaagaaattccatttcctacgaaggagctgtggttagagaagtccaaggaattttatgagattacacagtttcccaattgtattggaagtatcgacgggaaacatatcaggataatttgtccccctaactctggctcagagtatttcaattacaagaaatacttctcgattgtccttttggcggttgctgacgcaaattattacttcacagctgtcgatattggatcttttggacgcgaaggagactctacgatcttcaaaaagtcaaattttggactaagactcaaaaataacgaactagacctgcctgcagataatcccctaccagtacctgacaatgtggagcaaggttccgaggtaccctatgttttgctcggggatgaggcttttgggttgtcaaagcatgtgatgcggccatacccgtccaagggattatcgcaagaaaagaggatctacaactacagacactgccgagctcggcgtgtcgtagaatgctctttcggaattctctctaacaaatggcgtgtgctacattcttctatgttaatacatcctgaatttgctgtcatcgtagtgcaggcttgttgtgttttgcatagttttgtgcgaagaggagatggctacctttttgaggatactctgacctgcccactgcaggatgtgcaagagtccgctgttgtagggggcatgtcaagagggatcgatgtaagagaagtgttctgtcaatatttcaatggttctggagcactttcttggcaaaacaaatatgtgtaa

SEQ ID NO: 789 - DNA, 14418 bp, Phyllotreta cruciferae
atgctcaccactgcatctccatgtttaacttgcggctctattggagatatagcgaatttgatgttttgttcgggttgcggtgcgcattaccatggaatttgcgtgggattagctcagttgccaggtgttagatccggatggcaatgtaggaaatgccggtgttgccaagtgtgccgagtcgtcggagacgaatctaagctgatgacttgcgaacaatgcgataaaatttaccacgctagttgtcaaagacctgtagtgacttcgataccgaaatacggttggaagtgtagatgttgtagggtgtgcggggattgcggtgcaaggactcccggggctggtttatcttcaagatggcacgctcactatacagtatgcgattcttgctaccaacaaaggaataaagggttttcttgccctatttgccataaagcctaccgcgctcacgctcatagagaaatggttcagtgttcgagctgcaaaaagtttgttcatggaacctgtgatccagaagcagacgttgttacctacaatcaaaagaaagaaataagcatagactatgaatacgtttgcttgcattgcaaaaatagcacagctagacaaataacagcaaaaagagcaagtattgatgatccttccgatgtatccgcttcacacgattctctatacgatgatacgtccgaattcgatcttccttcgcccgacgagtttgccaggaacatgggtttgggtaaagggaaaccgtacagcgcgaataaaatagccaagaagcgccttagtttcacagtgaatccggtgggcaggccgaaaggtaccggaaaagtgccgcccgggaaaatggggtacatgaaacgctaccgactaactgagttcaatagaaaacgtggcccgaaagccaaaatgaggggcattttcggcgtgcccggcgtcggtctgcaaagaccgatttcggatgggaaaaccgacgaagaaccgggcgttgaaaatcgattggtattgtgttcagctaaagacaaattcaccctaactcaagatatctgcgtaatgtgcggggccttcggcaccgatcaagagggatgtttgatcagctgcgtacaatgcggacaatgttaccacccctattgcatcaacgttaaagttactaaagtgattttacagaaaggatggagatgcttagactgcacggtttgcgaaggctgcggccaacgcaacgacgaaggccgtctcatattatgcgacgattgcgacgtatcgtttcacatctactgcatggacccgccgctcgactacgtgccgcacggcaactggaagtgcaaatggtgcgccatctgccaatcctgcggcaccaccgatccgggtttcaattgcacgtggatgaacagctcgacgcaatgcggcccgtgcgcctcgcacgtgaactgccccagctgcaacgagccctacggcgagggcgatctgatcatacagtgcgtgcagtgcgagcgctggctgcacggcgcctgcgatttcatcaagtgcgaagaggacgccgagaagtgcgccgaagagggttacaattgtatactgtgcaggccgagggacgtgccgccgccgcatatggtgccggcggcggtcacgccgaagccgcccactcccacgaagagtcccgagttggggaagagtacgagctattacatggacggcgtgtgtctcagcgaattcggtagcaacttgatcaaatcgttggctctcgagtaccacgggtcgaggaagaagcggaaaaagatacccactgttcaagataaggaagccggtattatggctacgattgaatcggtggttgccggtggtaatgttattcctactaatatggaagacagcgctaaattggagctagtcgacatcaaagacgaacctcaagaattatataaggaaggcatgatgtggactaaagaagacggtccaccacccgaaggttttacgataatcacgatggagaacggtttgaacgtgctgcgaaggaagaggcaacgcaatctgcagaagctcggtattggaggattcgtggtcaggatgagaggtatcagaacaggtcaggataatgatgatgttgattcgtccattggtcaaagtgggctcaacgccaacgacattgtcccatcgcctgcggacggggacaaacctagaaggaaaactattcgtcgaaagccgaagagtaaattagcagaaacgtttccagcttatctccaggaggcttttttcgggaaagaccttatggatacggtcgattgtaaaaaggaagaagtcgattgttatagtagcgacgatgagaaaactgacaagcattttaaatccattaatttatctcaagacgaaataatagcaatcgtggcatcaggtaaaaccgagaaattggaaaacaataacaaagattcgaccaaagaagtcaaaccgactgtattgaaggaggaagaagaagataatccggaggatttgaaagatgttcttgccttgccgggcgacttactcgatactgatttggtcaatagtattatggaagatgaggaggaactgagcaaaactacagcctctcttgttgcattagattcgaatttacagcacgatacggaactgacggacactttgagtagttcaggaaattcaaaagaaaccaaagatgaattgagcgacattttaggccctcatttcaacctcgattccataccgaacataaacagcaaggatgtcgaagacatatttaagggcgtattaacagacgaatcgcaagaatcccaagagagcagtagcttttccttgcaaggaaataatatgttttcgagtaataatgcgcaacagaacgttgcccaacaccccattattaatcaagcggtgagaccgaaaactttgcctactgttaatcacaatttgaattcccctgttagttttccaccaccctcaccataccactcggaatacagcaacagtcctcagtttagtcctgcgttcaccgattcgtcctgttcgtgggtaggaggaaacgaaacgccggaaatcgatagtaccaacgtgacggtcacatcaacgtacaatcagagatcatctgataaaatgaaagctgatgagagtttgggcaaaagcgctacgatttcggccgttttgtatgcgaacatcaaccatcccgaatggaagaaggagtatccgaattggcccgataggtataagcaaataataaagaaatggagaacgttgagccaagaacagaaagcgccgtttttgcaacacgctagagataataggagtcagttgaggatgaagaaagcgcagcagtcacagaccgtcaaggaaaccgcctcaaccgccacgtcccccaatgcgaccaagcctctgcaccaagccggtccagccttagtgacaactctccaggcggtaacgcaacagccggcgggggcggccgcggcccccgcgccgcccgtttcagaggaccaagaaaagatcgccctgcaacagaaatccgccagggaagccgaacaggagagacaatggaagcaattgcaggccctcaggcagcagcaaacccaacaaacgcagaacattctacacgaacagcgcgttcaagcgatcgcacgtgtacaacgtcagatttcaactgatccagcgcagcagttcataaacgagcaacagagccctctgcaggtgaacacgcctcaggaattgagcccgtcaaccacgccggctcccagtcctaggccattcctgggcattaaatcgcccacgttccccgtaccttcgcccgttccgcaaacgggcgtcagggccaacacgccctcgcaatcgccccacgatatctcccaacccagcacgcccgacggtaacgatcactttatccactcccccacgaatcctaaacctaatttccaacctagattgcccaatgatccgttcgccgcgcaacccgccacgccgcgaccgcaattcggaatggcccggccacccttgcagaatttcggcggtacggttcgcaacgagcaacaggacatcaacatcaatcgccaattgagggagctgttgcagcggcagcaggttaaaaaactggacgaattgttgcctggaaaagcgccacctcaaaggctgtggcacgcgaatgatcagcaagaggccggcgacgcctcgatgacgtcggctgtgcagggcgccggtgcccaaggaaccgacgccaccttcaggcagcctctaccgcctggtgtagtgaaacctaggttggcgatttcgtcggtgaataggccgatattgggcacggttagagtcaaccaattggatcccaggatacaaaatttggatccgaggatgaggttgattttgcaacatcagcaacaaagactggccaccggtattcagcagcaattcatccgtttcacatcgaacgtgcgcccgacgacggtggagcagtacgagcaattgttgcaacgtcagggtaataatcagaatcaaattcacgcggaggaacaacagcagggcgttgctcgaatacccatagcccaggccagcgttatacaaaggccgcacgtggctcaagcggtggttactggcgccgccgctgtgacaaccagtaccacagaaagtaattccagcgaggagggaatccccgataatgtaactgccgaattggagaaacttgaacaggaaacaggcactatggtggagcttcaaggcgtaagcgatattttaggaggtttggacgatgacgatgagcttttggccgaaatgggcgctgattttaacatactcgaatacgcggatcccgaattggaggccctaacgggcggtaaaacgaatattttggacctggagctcgaggaggaaccggtcaaaaaagaaaaactagcctctaacgcgaacacttgcgctccttctcagaaaccgactcctaacgttgctactacagctattagcaacagtacctctgtgactacaccgaccgaagctaatgcagaacctaaaatcgagaatacaattcagcagagcattccgaaatcgacgccacaacagctacaacatcccgtttctcttccacagcagcagaacattccccagcacggagcccaagttcaagtgcaatcgcagcaatcccagccgcatccgccgcagcaaatgcccatccaatcgacgctgcatattcagcaaattcaccagcaaatggtgcatcaagttcagcaagccgcagcacaaggaaggccgatgcctccgggttcgaagatgcaaaccacagatggattcgttggtgttgtgatggcgaacaacgccgtacaattacagatacctccgaattatcaacaacggttgcttctgttgcaacaactgcaaaatcaaaaattgatgcgagtgggaagcacacagcctagagctgctttgcaagtggcccctaatcaaatgcccgtaggtatgaatccgggagctaggatgccggtatcggcgccgccgccgcctccgccgccttatcccgggccgcccccgccctatccgggcaacgcgaatcaacatcagcagacgggattgagaatggggcctggtcttctcccaatgggacattttcatcccagtacactgcagggttttcccatgcatccacacttgcagcggagacctcttctcctggaggaacaaccgctgctgttggaagatctgctcgagcaggagaaacgcgaacaggagaagctgcaaaaccagccgcccaaccacgaagtcacctcgtccaccggcaacgaaacggaatcagctttgctgagcgaccaggacttcgagcgcctcaaagccgatgtgtttaacagcgccccagtgagtaacatatcttctacgaatcaagggaacgccgcccaaacgccgcaagcgtggccccagctgcagaataggcaagcggtggttccggccgccgcttcgcagcacacgatggaagtgactactagagttcaaatgtataatcctaatttgataccggcgccgccgctcccgcccgagaatatcgctacggagcaggacaagcaggcgcagctgttgtacgagcagtggctgaaccaccagaacaactcgctcgtgcagcaattgcgctattatgagaccgaagtgcagaagcttcgtaagagtaaaaagtcgctaaatagtaagcaacggcaattgaggaaagctggtaaccagttaaccgacgcagatgcgactgagcttcaaagaattactgcggaacaggctatattacagaaacatttggaatcgagcaggaaacaaaatcggcaacatggaatgttgatacaggaatatcgaaacaagcatcccgccatcaagcagagaaccgtaacggaccagatccaatcgccgttgggccatccggcctcgtcgcccatacagcaatcgagcgcctcgttgtcgcccatgctgtcgccctccgtgtcgccgatgacccagaacagctcgcctttgaacagccccgggccgatggtgccttcgtcgcccggccacagcgccgtgcagaatattttgcaaagccccaacggcgccaatgcggctcaaatgtcgcccatgcaggcgtccccgatgcaatcttcgccgagaatcggtactcctcattctcaaagtgatgaaagtcccggatcggcgcaatcgccgtcgcaggtctgcctgccgccgcctatgcctagaatgacgtcgcctcagcacagacgagtcgtcaccagtccggtgggaatgtcgcaaatgcgttttataaacaacaacatgttgcagcaacgcgttcgcatgcagtctcctatacagaatttccaacagaaacccggcacgccttcgccgttgaacagcccgacgtcgcagcaaatgaacgtcaaccagcaacatcaaatccagaaacagctacaacaacagcagcagcagcagcaacaacagacgttgttgcagcaaaatttggaaggcgatccaaacgccattcactcgcagaggaccacgcaattgttgcagcaccggaatttcatcaggcagcaggtgtcccagcagcaaatatcgcctcaaacgttaaccccgcaacagcatcagttgatgctgcaacagcaaaagcagctggcccagcaacaacaacagcagatcgcccaaatgaacgccgcgagattgcaacaacaacagcaacagcagcagcagcaacaacaacagaataacccgccgcattcgccgatgccgcccaaaagtcccatgatcaaccagcagatcatgtcgccgcattcgatgccccaatcgcccatgcagatgccgccgaagagtcccatggtgccgttcaatcccaaccaaacgaatcccaattcgcctgcggctaggagcccggctttccatcagggtatgaaccaaccgacgagtcccatcacacacggccatcaacctcccagttcaccgatgcctaggagtcccatgatcaatcaaacgcactctccgcataacgttcgaaggcctcccagcgccaacagcagcccggccatgcctgataggccgcacagcgtagagaattcatcgcctaggatgtactcgatagatcaattggtgcaggagagtttggccaatcaaaatgtaaacgcgcagtataacagttacaattcggatatgatcaacgaaagcggtggagggaattcgaataaccccataccatgtccaccggaaataccgagatttcgctattttaagctcggtttgagaggcggagcgcctatgtggagctttggaagaggcgccaaaagaatcccagcgcctccgaacgccaaaccggacgaacccaaggcgaagaaggagtcgcatttgagcaaagtttcgatactaaaaaggaaacccccgatcgcttctatcggtaaagtgggctcgttggttagttcggattacaacgatttggacgacagttcaacaacgcctcctgtaacaccaccgttggcttcgaccagcagaggaagtctgtcgaagaagaagaatctcgaactgcaagcccagaaggattcggtgatcgtcatgcacagtcccgaggataataacaaacagctcgaaataatggattacgatgacgataataacacggttctatcatcagaagtgtcgttgagttctgtagcaagaaacgacgacgacttggtggagatcgaaacgatatcgcaagacctcgccgaagggctatccagcccgttggaatccgatcaaataggcgacgaattcctgttgtttcccggcaatatggtggtggatatgtccggtgaagagcattactcggaaaaggaggaagaggaaaccgttgatgaggagtataccgatcagaatatgcacatagtgatacgcagcccgaccaccagcgacgacgagttcataatgccttgcaaagtgaagcagtacaacgaggacgagcaggaggataaccccgaatcgcccgatcaggaggaattcggcgaatcctccgatatgatggcgagttacgataacgaagacacggatataatcatttcagatcaaaccaccggcgttcccgaggactcgatctccactaaggaagacttcgaggagctcatcgacgaggggtcgcggaaaaacaacatcagcaagcaagaggtgaccgcgaaacacattcaagatttccacaggtacaccgaattgttcgattacggcaaacctgatgcccaaccggttaagaaaccagtcgccaaaaaattccaaccgaaagtctctctagttagaggagtagctttgcccagtaagcccaacaccgagaagattatcatcacgcaaaattcgaacgtgttgaatacttcacaggcttcgaaagtcaccagcatcattttaacccacaacgcaaatgttagaaggaacattataagcgtaccgaaaatagtgagtaccgtttcaccggctataactatagtgagcgccagtacctcgcaaatggcctctatattaccatctaaattcaccgtgccggttataagcgccagtgcggtacgccagctatccaacgtcaaagtcatcgacaaaccatccacttcttcgttgtcgatttctaccagagacaacgtcctgccgaagaagatattcgaggacgattcggtgtcgccggacagttcgaattgcgacgacgagaaatccaaagattcattcgacgataaagtcaagtcggagtctccgccgcgggaggtcaaacagttcgtgaaatcggatcagcaggtcatatcgctgaaatcgaagaactactccgatcaatcgaagaagatcgagcatctgcaaatagtgaatatatctgcgaaggatgtggttcaaaggcagaggataccgagtcctttgatatcgaaagcttctccggttatcattcacaatacgccagagttgaaaatgactgcgcaagttattcaagagagccaaacccgcatgaaaattactactactactgatacagaacattacgatgagtctgcggatgatacgaagtcagttgtgatttcaattccgtctcctacaccttcgcaagaacagatgcttgatagtatagctttccaggcgcttgaaaatagaaggagagaatacgattctatcgaagatgtattagatatgattgagaatatagaaaacatcaccgccgaaccgcccgagatattagaagaaaacacgttgcaaaattccgattccaacagcaacatcgaaaccaaaaccaccgaaaccaaggagttgaaattgcctaccagcgaaagcgaagcgcccgctaccaaatcatccatcgtaccgcaattatcgcctctttcccaacccacggaattgactacaaacatggccaacgcctcgcagcagctcagaactctgctatcctcgctgcaaaccacctcgacgtcgtccccgaccaacgtggagtccatagccaagggcttcggccagaaaatgagcacctcctcgtcggctaaccagcccatagtcgcctcgcgggtgatcggccaacaagccggcaggcaatcgccagttatcaccagcgtctccaccgtcatagttccgaatttcaagcaaaaaatcaccgccgcaacgaccgccgcgtcccggagcagccccgtgaaggtggtcagcacctcgcagcaattaaccggatccataataacctcgactttgaattacataccgaacagaacgatcggtatacagatggtggcggatcaatcgaaactgccgccggccagcatcgtgacgacgatgcagcaaatcaactcgatcacctccagccaggagtcgaagaagccttcgttgactctcacggcgatgctgcaaaaccagcccgctgcgaatatgatgactaaatcatcagccgatactatcacggctgctagtttgctaggctcgcccatcagcctgcccaaaaccgggttcaccacgtctttggtgcaagcccaaccgagcgtggtgctgtctaacacaccgccagcgcctagccaaacttccacggcgacatcttctacgaaaaccaccgcggattcgatcacggccgctagtttattgggcagttctattaaaactagctttgcaatgcaaccgagtagcaccgtaggagtggtgacgagctgcgtcaacaagacgcctacttccactactaatctgctccacacgcagttgacgaaagtcgtgagaagcaaatccgtcgacgatgttaaagaattggccaaaatcgacgagaacaaacaaagcgttagcagcgaaattgtagatgatagtaacagcgggtgtaaatcatcaacgataactacggtagcctgtaacaaaactgaagattcgcagaatgtgttactcaagaaattgctgcagaatacagcttgcgccagcgcccaatcctccccgccggcttctactagtactgttacaaccagcgctgctaatactatatctaaagtggttaacacgcagtgtagtactagcgctagcgtggagcaaccgccggtaagcgctccttcgaacgttacagtccaaagaagcgccagcagagacgagctactatcaccgccacaagacgtccaaactatggtagtgattaaaaaagaaccgccgttagtaccgctgtcccaaccgagcccagtgctgaactcgaactccaacgctcacacgcccgaagtgaagaaagaattcatcgacgaatcgtcgcagcactccgaagtatccgatcacagcagatcggacgcccctattaaagaggaactggaaaccatggagagcgccgccgagaagatgatgctcgacaaggaggagctgaagaagcagaagcgccgcatgtaccagcagaagcgccgccagaaccagatcctcaacaaggagctggcgcagcagcagccgaagaagcggccgcgcaagaattcgaagatcgacgaggactacgacacgtacatcgacggcgtgctggcgcagctgcgccagctgccgcccatcgccgtctccgagccggtgctgaaccgcaacttcggcgtggtgccgctgttcgggtgcggcgatctggccaagatcggcgccaaggattactcgacgcacctgggggagttgacggggaactacggctacggcgagctgcccggcttcaccgatttctactcgacgaagccctacggggatatggatccgctgccggagaagccgccgtcgtcgacgcagcgcggcttctacgaccaggagttcccgctgattagattcgatgcggacgagcacaagaagtttgacgtgttttgcagggaggattcgcccgattcgatattgagcagctcgtcgccggaatgtacgcgcgaacccgaaggcaaattcgtcgggttgaagctcatcagcgacagcgaagaggacgaagaagatgatgccaaagattctgtctcgaaaggaagaatgtcaccagtggtacccgtcatcaagcctgttcctattagactgaaacccgccggcgaattgtacttcaaagagaacctcaacgagaacaaggagaacatcaacagcgactcggtgcacgtaatgacgaaatccaaattcgacaacaagcagtctccaccgtcgaacgtttccggccacgttacagtaaccttaactctaacatcatctgcggctgaagatataatgggagtgttgcgggatttggcgaatattctgcacatacccgctccgactagttaccaaatcgtggagagaacggcgtctccgcccagccagaaattgggcttgtaccgcaccaaaggcaaggacggcaaagaaggggctcccatcgacatacagagcatcctcaacggcgccaccaagttctgcaagcactgcgacgtgatcatcttgagcaacatcatcaggcggaaggtgtccgatttaccgttcctcgctaaagattcggatttgctcagcgacggggaagaattgttcttttgcagttccgcttgttacatgcagttcgctttgatgcaccggtcgccttcgatatccgaagataaggctgctgaaattataaatcacctatcgcagaaagacaatttggattcgaagcagaaattgcccgcagacgcgttagatagcaataaatcgatagcgcagaagttatcgtttaacatcaaagatgcgaaacgggaattcgagccgatggagacgaacgatgcgtttgcgtttttcgctcgtaccaccgccaataaacaagggaacaacttctacgatggggcgccattcaaatcggtccctgctagggtacacaggaacgataggtacaaactctggacgcccggttgcctccaacccacccagaaacacaaaactcccaccgacaaggagatcatggagctgctctacaggatgcagatcaccgttacacctcccgttatgcccgaagatacgaggaagtgtttgttctgccacggtattggtgatggcgtggccgacggaccggcgagactgctcaacttcgacgtggataaatgggtgcacctgaactgcggcctgtggtcggacggtgtatacgaaaccgtgaacggggctttaatgaacgtcgaaagcgccctacagtccgggttgttagccacttgcgtgcattgccaaagcatcggggccaccatcaagtgcttcaagacgagatgctcgagcatataccacttgaattgcgccgtcaaagacaattgcgtgttttacaaaaacaagacggtgttttgcaaagtccacgcgccgaagaacgaaaaagacaacgaactcaccaccctctccgtgtctcgtagagtctacatcgaacgagacgagaacaaacaagtagccgctgttatgcaccattccgattctacagatttactgagagtaggcagtttgatattcctgagcgtgggtcaactgctcccgcaccagctgcagaatttccatacaccgaaccacatctatcccatcggctacaagatcatcaggttctactggagcatgaggaacttgaacaagcgctgcaagtacatttgcaccattcgagaagtgtcgggcaaaccggagtttcgggtgatggtgcaagagccacccgaagcggacgtggagttctccgattgcactccgaaaggcgcctggcagaagattctggacaacgtcgctagcatccgtaaagagaataattgtttgcacatgttcccgaaattcgctacaggtgaagatttgtttggtttaacggaacccgctatagttagagtgttagaaagcatgccgggcatcgaaacgttgtcggattataaattcaaatacggccggaaccctttgttggagctaccgctcgctataaacccttcaggatcagccaggactgagccgagattgaggagccagttgcattggaagaaagcgcatacacagagaactactggtggtacttcgtccattcgaccaatgttcgggccgtctttaacaggatctattagtactccagctcaaggggagatcgcctgtccttatagcaagcaatttgtgcattcgaagagttcgcagtacaagaaaatgaagcaggaatggaggaataacgtttatttggcgaggtcgaaaatacaagggctgggtttgtacgctgctagggatttggagaaacacaccatggttatcgagtacataggagaaattattagatccgaactggctgagtgcagagagaagcaatacgaagcgagaaatcgaggaatatacatgtttagactggatgaagaacgcgtggttgatgctactttatgtggcggtttggctagatatatcaatcactcgtgtaatccgaattgcgtggccgagaccgtggaagttgatagggatattcgaataattatattttccaaacggagaattttacgaggagaagagttggcatacgattacaaattcgatatagaagacgatcagaacaaaatatcctgtatgtgcggagctccgaattgtcgcaagtggatgaattaa

SEQ ID NO: 790 - DNA, 2055 bp, Phyllotreta striolata
atgcctagagaagatatacttgaagggcacaaacacaaaagccacaaaagtaaaaaaagccggtccagtagccgttccgagcgtactcaagaaaagcacaagcattcatcaagctcaaagaaaaagagtagtttccacgaagatgccgatcgaaagaaaaagaaaaagcgatctaagagctcctccagtgaatccgaatcgaccagcagcgaaagttcgggtaattcggtggagctattaaaaaaactagaaaacgaaagattgcgatcagccgaacaaaaaaagaaggaaaaggagcttctcaaagctgctgaaaccgccgaggagaagagattgagaagattgatgaagaaagaggcgaaggaaagaaggcgaaaagagaaaatgggctgggacaacgaatacttacattacacgaacagcgacaatccattcggagatggaaatttactgaccacattcgtttggaacaaaaaattgtccaaagaaggcatcaaaaacgtcggtcacgcagaaatcgaagcaataaaccggttaaaacaagaggagaataagagggaactcgaaaaagtcaagaaacgtaggctagagagggaattggagaggcaaaaaagagaggaagaaacccaaatgatgcaaagaagtaaagaagctgcccaattcgaggaatgggaaaggcaagaagataaattccacttggagcaggcccgactgagatctcacatcagaattcaagatggtcgagccaagccgatcgatctactagcaaagtacataagcgcagaagaagaagtcgatgccgtcgaaatgcacgagccttacacttacctcaacggcttgcaaatcaaagacctagaagacctagtcgaagacatcaaagtctacaaggaactagaaagaggaaagaacctagattactggaacgacataacagtcatagtagaagacgagcttcaaaagttgagaaaaattgaaaaacaaaacgatttcgacttgggattgaaccgaagagaagggatacatcaatctgttgccactgatgtaacatcagtgtttaaaggcaaaacggccgcacaattagcggcgttagaaaggcaaattggaagcaaaattagcagcaaagccgatggtatagacataggctattgggagtctttgctatcgcaacttaaagcccacatggcaagggccagactacgtgacagacatcaagatagcttgagaaggaagctgcaagtactaaaagcagaacaagccattacaggagtaggtcaaagccacagcgaaactcattctactgataacgaagaaaccacttcggaacccaaaccaagcacttcccaggattcgttggaaacgatggaagaaagcaatgaaaagagcgaagacgctgctcatgcgtggctgaacgaatgcttttcggcctaccaagcaggcggatacagtccaaagtttttaactccggacgataccgagcccggtacgatcgtagtctcggaggaagacgatttaaaacgattggaattcgctaggatgcaggtgacgggccaaggaaccaaaatcgaaaacgtcgttacaaaagaagagttactgctacaaaaggaagcgagaaagggaatggacggggacgaggctcaattttcagtcgagcaagccttggataatccagtgtatttatggtcggataagtaccgcccacggaagcccaggtacttcaatcgagtgcacacaggattcgaatggaacaaatataatcagacccattatgacatggacaacccgccgccaaaaatcgtacaagggtacaaattcaacatattttaccctgatttgatcgacaaaagcagcacgcccgagtattatctaacgcccagccccgagaatagggaatttgctatactacgattccatgccggaccgccttacgaggacatcgcttttaaaatcgtcaacagggaatgggaatattcatacaaaaggggatttaggtgccagtttcataacaacatattccaattatggttccatttcaagagatataggtatcgaagatga

SEQ ID NO: 791 - DNA, 1323 bp, Phyllotreta striolata
atggacaatttagaagccaacataatggacaagtccatgcgatccgtcttcgtgggaaacatcccctacgaggccaccgaagagaaactgaaggacattttcggggaagtggggcaagtgctgtcgttcaaactggtcttcgaccgtgaaacgggcaaacccaaaggctacggcttctgcgagtaccgagaccaggaaaccgccttgagcgccatgaggaacctaaacggatacgaaattggcgggcggaatttacgcgtggacaacgcctgtacggagaagtctcgaatggagatgcagaatttgctcaatcagccgcccgtcgagaatccctacggggagcccatccaggcggagaaggctccggaggcgatcagcaaagcggtggcttcgctgcctccggagcagatgttcgagctgatgagacagatgaagagtaccatacagaataacccaaccgaagcgagacagatgcttttgcaaaatccccaattggcctacgcccttctacaagcccaagtcgtcatgaaaatcatcgatcctcatacggcagccagtttactgcaccccgtcaatcaagtaccggccactttgctggcgggcgataagaacgtaggcctgcaagtacccatcgggaaccaatacagggagcccccgggacccgtgcaggcccccaggcaggagtaccaacccgtaccgcccccgactgcagtcgtacatccgggtcacgtgcaacaacagccagtttttaccggtcaagacgtcgatttgagatcaatgggaaacgtgactgatccgagaatcagaccgatgatggtcgatcaggatatgagacaaatgccgaacgtcatccagaatccactgccgcctacgatcagtgaaagcttttcgagggatccccgaagcgccaccggcggcttcccgtcggatccgaggcaagccaggatggacccgagacaaaaaaatatcgtacctcccgccatccaacaaccaccatcatcggtgaatccaaaattgaatcaagcgggccccgtcctgccgccgcccgtccgacctgcgcagaacgtcatcgcgcaatcaacgcctaccgcgtctgccatatcttcatcgttgtcgtcgggatcggcaggagtgggatcggcgggtgccaatgtgatgagtccgggtatcggaggagcgggtgctactgatcaggaaaaagccgccttgattatgcaagtcctccaattatccgatgagcaaattgcgatgttgccgcctgaacagagaaatagcattttggtgttgaaagaacaaattgcgaaaagtgcgcatgtccgttga

SEQ ID NO: 792 - DNA, 1179 bp, Phyllotreta striolata
atggcacaaatggatgcagaacgtgagaagagcctccaagagtacagaaaaaaattgttggagcacaaagaagtggaatccaggctaaaagaaatgcgagaacagctcaaagatttaactaagcagtacgataagtcagaaaatgatttgaaagccctgcagagtatggggcaaattgtaggtgaagttttgaagcaactgacagaagagaaattcatcgtaaaggcaacaaacggtcctcgttatgtagttggctgccgtcgtcagttggataaggccaaattaaaggccggcactagagtagctctcgacatgaccaccttaaccataatgcggtatttaccgagagaagtcgacccgttagtttacaacatgagccacgaagatccaggagacgtcacttactccgccataggaggactttccgagcagattagggagttgcgagaagtcattgaactgcctctcatgaaccccgaattgtttatgcgagtgggcattacacccccgaaaggttgtctgttgtacgggccgcctggtaccggtaaaactctgttagctagagctgtggcatctcaactggacgcgaactttttaaaagtcgtatcgagtgctattgtagacaaatacatcggcgaatcggccaggcttattagagaaatgttcaactacgccaaagaccatcaaccgtgcatcatcttcatggatgaaatcgacgctatcggtggtcgtaggttctccgaaggtacatcggccgatagagaaatccaaaggacgcttatggagttgctgaatcaaatggacggattcgattcgttaggacaagtaaaaatgattatggcgaccaataggcctgatactttggatcctgccttgctccggccgggtcgtttggacaggaaaatcgagattcctctgcccaacgaacaggctcgacttgaaattctgaaaattcacgcgcttcctattgctaagcacggggaaattgattatgaagctatcgttaaattgtcggacaccttcaatggggctgatttaagaaatgtgtgtactgaggcaggacttttcgccattagagcagaaagagagtacgtgattcaggaagatttcatgaaagctgtaagaaaagttgccgaaaacaagaaactggagagtaaattagactacaaacctgtgtaa

SEQ ID NO: 793 - DNA, 780 bp, Phyllotreta striolata
atggctcgccggtatgatacgagaacgacgatattctcacccgaaggtagattgtaccaagtcgagtacgccatggaggccatatcccatgccggaacgtgtttaggcatcctggctaacgacggaatccttcttgccgccgaaagacggaacaccaacaagttgctggacgaagttttcatttcggagaaaatatacaaactaaacgaggatatggtttgcagcgtggcgggaattacgtcggacgctaatgttctaactaacgaattgcgtttgatcgggcaaaggtatttgtatcagtacggagagtcgatcccatgcgagcagttggtttcgtggttgtgtgatgttaagcaagcttatactcaatacggaggtaagaggccattcggtgtatcgatcttgtacatgggctgggacaagcattacggttatcaattgtaccagtccgatccgagtggaaattattccggttggaaagcgacttgcataggaaataacagttccgctgctatttcgagtttgaagcaggaatacaaagaaggcgatatgaccttaaaagatgcgaaaggtttggctgtgaaagttctggcgaaaactttggatatggctaaattgacgtcggaaaaagtggaaatggctacactgacgcgtagaaacgataaaaccatcataaatatattaaatagcaaagaagtggaagaacttatttccgagtacgaaaaatccgaagcggccgccgaagctaccaagaaacaagaacaaaaatccgccgcttga

SEQ ID NO: 794 - DNA, 2664 bp, Phyllotreta striolata
atgagtgaatcaaaagccgaacctataaaggtggaatcaaaagcaaatgatgacaaaaataagaacgaactttcggatgaggataagcaacttcaagaggaattgaacttgtgcgtggaaaagttacaagaaaatgacagtaaactttatatgcccgcattgcaagctttgggcaaccatattcgggcctcgactacttctatgacgtccgtgcccaaaccactgaagttcatgaaacctcattacgatacgatgaaaacgatcttcgagaaaattaccgaggccccagttaaatgtctctgcgcagatattatttccgtactagctatgactatgggagaaggaagggactgcttaaagtacaggctactctccgatttggacaaaatcggtgaatggggccacgaatatgtcagacatttggctggagaaattgctggtgaatggggcgaaaccgatttcttaataaacacagaagttagagataagctcatattgttaacgaaacagatcgttccttataatatggcccataatgctgaagctgaagcttgtgatttgttgatggaaatcgaaagactagacttgctcgaacagtatgtggatgaaaacatttaccctagggtttgcttgtatcttacaagctgtgtaccttacgtagctgatccggaaaataccactcttcttcaaactgctttgatgctattcaggaaattcaagcagtaccctcaagctcttcgattggctatgcaactgaacgatcacagtctcattgaagaaatattcctaaactgtcccgatactgatgtgcagaaacagttggcattcatgttgggtaggcagcagatttacatcgaagtacccgacaccacaccggagtatgaagacctcattgaaataatggcgaattgtcatctaaacaaccactttttgaatcttgcacgcgaattggatataatggacccgaagaccccagaagatgtctacaaatcccacttggaaaacagccgtcccccattcggtggaagccaagttgattctgccagacagaacttggctgcgagttttgtaaacggtttcgtaaatgccgctttcgggcaagacaaactcttgatggaagatggaaataaatggctctacaagaacaaagagcacggtatgctgagcgctactgcctcattgggtttagtactattatgggacgttgatggaggtcttacgcctattgataaatacttatattcctctgaagatcacattaaatccggagctctgttggcttgcggtatcgtcaattgtggagtcaggaatgagtgtgatcccgcattggctctgttgagtgactatgtccttcatagcacaaatataatgaggataggtgctatcgtgggccttggtttagcttatgttggatctaacagagaagcagttttaagcttactgactcctgtcttctccgatccgaaatccaatatggaggttatcggtatgtcagcactagcttgcggaatgatcgcagtgggatctggaaatcttcaagtcaccaccacaattatgcagacgttaatggaaaaatcggaatctgaactgaaagatacatacgctagattcttgcctttgggtctcggtctttgtatgttgggcaaacaagaaggtatcgattccataattgccgcgttggaagttataccggagccttttaaatccatggcaactactatggtcgacatttgcgcttacgctggtactggcaacgtgcttaaagttcaacatttacttcacatttgctccgaacattacgatggcagtgacagcacagacaagagctctaaagataaggacaaaaaagacgccgcggagaaggagaaagacctttcctcgagacaagcagtggccgtactcggtatagctttgatcagtatgggcgaagatattggtagcgaaatggccttccgcaccttcgggcatttgttgcgctactgcgaaccagtgattagaagagcagtaccgttagctttaggacttatttcagtatcgaatcctaaattgagcatcctcgatactttgagtaaattctcgcacgacagtgacgcggaagtagcccacaatgccatatttgccatgggtttagttggagcgggtacgaataacgcaagattggccgcgatgctgaggcaattggcgcagtatcacgctaaagatccgaacaacctgtttatggttcgcattgctcagggtctaacacatttaggtaaaggaacgttgacgttgagtccttatcacagcgaccgtcaactcatgagtcctgtagcagttgcaggattaatggctacactcgttgggtttttggatgttaaaaatattattttgggaagatcgcattatctcctatacactttagcagcggctatgcaacctaggatgcttgtgacattcgatgaagatttgaatccattgccggtacctgtgagagtgggattggctgttgatgtagttggtcaagctggtaaaccaaaaactataacaggttttcaaacacataccactcccgttcttcttgcttatggtgaaagagctgaactggctactgaagaatacctagccctcactccgattatggaaggtttcgttatattgagaaaaaatcccgacttcaatgcataa

SEQ ID NO: 795 - DNA, 1410 bp, Phyllotreta striolata
tttcaaactacgaagtcaagacacatttttttgattttacctgtgccaatttggaaaatctgtaatatggactcgaaagaagagaaacaagcatcaccggaaaacgtgaaactgaaaacagaagcatccgagcctgaggctcctccagctcaagcgaccgcaaccggcgtgatccgaagaaacttcatcaccccggccggaacaatagtggaaaccaacgaagagcaaccaccagaaccaacgacagaagaagtagtcaaaacgacatcgtcaaatccaagcccggccgaacagaaaaccgaacccgcagaaatagtctatacggcggaggtcctgccgcaggagcaaagagagcaattcgctgacgctaaatcttacgccgtagaaatgcccgccgagaattttcctaatccgagctttacgcaggacattagttacgtgaacatagaaggaactgttgtgcccgttacaatatcggaaatggaacatcctggggactatgccaatctacaaactgctcaatacaacaacggctatacggatggcacacaatatttaaccaatcatcagtaccagaacatgtatatagagagaagtactgttgataattctccttctgctacagttctataccgtggcgatgatccgaatttgggagcttctagattccaagcaaattacgacatatccagtactcaatcgcaagtgaaccttcttcccgcttccggagaaacctactatacatcaacatctaactggacgccgaccagcagcggttcttacccacaacaatatccatcagggaccataaacgtccttcaagctgattcgacccaagctttcggaactccttacataaacgcgacctggtcgtcgaattcgatggaggacggacggcaatctagtcaagagactggaaatagaagaaacggcgtaacgtgtgcaaattgcaaaactaacaacacaacactttggagaagaaacaaccaaggcgagccagtttgtaacgcttgcgggctttactataaattacataatgttaacaggccgatcagtatgaaaaaggaaggtatccaaacgcgcaaaagaaggccaaaaaactcttcggtcggaagccctgcgagtgctgcaggtcaagtaagaatggggcttcccacttatcaatattcagacatggatgtacagcaagatcaataccaattaccagtgaacctttattctcaaagaccacaagtttcttatcgacattacggaaccgaaaatattggaacattaaatgcacaaccactgcagccaataattactcacgatgatgaacaggcaagcgtcattacatcgacttcacaacaggctaggtttaggacaaatgtagaagaggacgaaggaagcaatccttctatgcaatcttaa

SEQ ID NO: 796 - DNA, 2193 bp, Phyllotreta striolata
atgaatacgatggcactaccggggaatgggatattcgtcgtcaaaggcgaaatatcgaacttgatggcggccatgaagaggggccccaaatggtcgtcgcattcttatcaggacgacgacgtcgacgcgctgctgaggaacttccaagagctgcgggacattctacacaacgtaaacgatttaggatacgttgaacccaacacgtttttggccccttttttgaacgtcatccgttcggaagagactacgggtcctgttactagtttagcgctgtcagctgttaacaagttcctctcttacggtcttttggatcccgtacaaacatccattccgcagaccatccacaccatcgcagatgctgttactcacgcccggttcgtgggcaccgatcaatcctccgacggggtagtcctgatgcgcatcctgcaagtactgcgaactctcacactctcccctgagggctccacgttgacaaacgaaagtctctgcgagataatgctgtcctgctttcggatatgcttcgaaacgagactgtcggagctgcttcgtaaaactgccgaacattacctgaaggacatggtgcaattgatattcatgagactgccccaattctccgaggacccgaagctctcctacgtcaagcgattgcggatgcagcccggtgacctcgaccagacgagaacgaagaggaaaaagtactcgaagaaggagaacaaagaggccgttaaagtacaaccgcaagaaactaacgtcgaaactaccccgcaggccgacatagtagacatgcaaggtactattcttcgtaataacgaaactgctagtgttacaacgccttctagtccaaatccaaatgttgatacagacgttactatagacattccaacagacgacagtatgaagaattcagaaacttctaatttagatgatagtggggagaaagaaacggacgaaccttttcaagactatgtcaatcaaaggggtattcggtttacgcctcaattccaacaggaaaccaatctatctccttacggtttagcctgcgtacgcgaactattcagattcctaatcagtctctgtaatcctttggacaagcaaaacacggacgtcatgatacatttaggactcggtttgctcacagtagcgttcgaaattagtgcagacaacataggcaaatacagcaccctgttggctctagtcgaagacgatttatgcaggaatctattcgctttaatgaacaccgatcgtctgacgatattcgcagcgaacttgcaagtgtcgtttctgctgttcgaatcgctacgcgcccacttgaagtaccaattggaatgctacttgaagaaactcatggagatcatgcgcagcgaatcgaacaaagtgagctacgagcacaaggagatcgccttggacaatctgttgcaattgtggcgggtgcccggcttccacgccgagctctacgtgaactatgattgcgacatgtattgcgcgaatttgtacgaagagctcaccgagctactggccgaacgatcaatttccaccgtcgtgggagtgtaccaccagcatttgctgtcgctcgacgggcttctgatcataatcgatggcataggaaagagattcgacgaagcgaaagatcgcactgataccgacgagattagtagttacataggagagaatacgaggattaaaggttgtgttaaagtacccgataagaaggtgttggccgcgaagaaggcgatcaaaaagtggttacctcaaggtacggagtatttcaatcagaagccgaagaagggcgtgcagttcctgcaggagcacggcgttttgaagcaggagctcgacgtggaggagatcgcgagattcctgcgggagaatccggcgttgaacaaggcgatgatcggcgagtacatcagcaatcggggcaacctgaagatcctcgaggcttttgtgagcacgttcgatttcaccgggatccgaatcgacgaggcgctgcgagcgtttttggagacgtttcgattgccaggcgaggctcccaccatttcgttgatcctcgaacatttcgccgagcattggcacaaaagcaatggggaacccttcgccgacgtggattccgctttcaccctagcgtacgctgtgattatgctaaacgtcgaccagcacaacgaaaacgccaaaaaaacaaacaactcccatgtcgcctaa

SEQ ID NO: 797 - DNA, 618 bp, Phyllotreta striolata
atgtcgattttggcgtacaacgggggcgcgatggtagcaatgaaaggcgaaaactgcgtcgcgatagccgccgaccgccggttcggcatccaagcccaaaccgtcgccacgaacttcgagaaggtcttcgaaatgggcccccacctgttcgtcggcctgcccggcctggccaccgacacgcaaaccgtcatggagaagctccggttccgcaagaacctctacgagctgaaggagaaccggcgcatctcgcccaaggtgttcgccgccatgatatctaacatgctgtacgagaagaggttcgggccgttcttcgtggaacccgtggtggccggtctggcgcccgatacgttcgaaccttacatttgcaacatggatttgatcggttgccttaacgaacccagcgatttcgttgtagggggtaccgcttcggcgcaattgtatggaatgtgcgaatccttatgggagcctaatttagcacccgatgatctgttcgaaaccatttcgcaggctctaataaacgccttcgatagggacgctatatccggttggggagctacggtttatattgtagaaaaggataaagtaactataagaaacctaaaaactcgtatggattaa

SEQ ID NO: 798 - DNA, 2904 bp, Phyllotreta striolata
atggacggaaaaccggatttggaagtggtgaaatcagccgtatcaacattatacaacaacccggatggcggtgaaaaagaaagggcctcccgatggctattggaattacaaaaatcggttcacgcatggaccgttgccgacgaattgctgcgccgttgcacgaacgccgacgatctccaaacccgctatttcgccgctcaaacgatgcgaaccaaaatccaccaatccttccacgagctgcccagagaggtccacgagtctctcagggactcgcttctggagcacatgggggcttgcgctggcgtcgatgagggcgcaggtgccgccatagtgacgcaactatcgctagcacttgcggatttggcgctgcagatgcccgattggcgaacgcctgcgctggatttgatcggccgattcagcgcggggaataacgtgtggcccttattggaggtgttgactgtgctccctgaagaattagagagcagatcagtgagattaggagaaaatcgacgatacgaggtattagaagatatgaaattctgcgctcccaccgtgaatgaatttctgaagcattgttcgaatttgtacggaagaggaggatcggaaaggttagcggcaggcgatagaccgatcgatgtgaaaatcctcagatgtttcgcttcttggatatcagtcggagcaattggaccgagtcaattaagcgaggatcgggtggtggttgacatggcgttcgacgtgttgaaaacggacataaggccagatgaaaaagaaagcgtaacaggccaacttcacgaagccgccacggattgtatttgcaccttactgttacgtctcgaggataataacaaccacgtcgcattggaaacgcacttattcgaaaatatagtaaatttagaagtggcctatcatgcatctgtcgccctcgaagatcaagcaaagtcgacggactattgtcggctattcaccgaattggcggaatcatttttggggaagattgtagacgatggaggaggcggtggcggcggcgacggcggcggcggagccaagaggcgtaccgtgtacgccgttaaatgtctagatttggtactgatgtgcgtcggccatcatgattacgaggtggccgaaataacatttaacctttggcatatgctaagtgaggaattatatcagaaaaataataaggaattaactgaattattcaaaccatacgtggaaagattgatcacggccctatgtaggcattgccagatggagccagacatggagggtctactcgaaaaaggagatgaatttaaagattttaggatgaaagtctctgatctaataaaggacgtggtctttatagtaggtagcagcagttgcttcaggcaaatgttcatcaatttacaaacctcaggtgttacgtgggatgccagcgaagccgctctctttgtaatgcaggctgtagccaaaaacgttctacccacggaaaacgaagttgttcctaaagtcgtcgaagcaatattgaacataccaatcagcgcacacgtcgctgtgaagtacacctctgtccttctactgggcgaactggccgaatggatagaaaaacacccggacgctctggatcccgtcctgaatttcctagtttgctgccttcggagcggcgccgaagggggaggcgtcgcgacggcggcggcgtccgcgctgcagaacgtgtgcacgtgctgcggcgctcacatgggcaggcacgttcccattctgttacagttacttcaacagtcggattcgttcggcgtcggcaacgcggcggtggtgggattattgaaaggcgtcgcgtcggtggtgagttgcggcatgggaagcggcgccgaaacggcgtcggccgtacgggaattgtgttcgatgcaattgtcgccgttatgcagtttgatcgaaaacgacgttcgacctgttaaagggactctaacggatccggtgctgtggttggatcgattgagttcggttctgagatacgttaatgtcaatattgtcgaaggtgaaatccatccttgcaaaccggtaataatggaaatgtggccgatattatcccgagcattcgacgcataccacagcgacgttcggataatggaaagatgttgccgttcggtgcgtttcatgttgcgttgcgtggcccgacaacttcaagatttgctgccttcgttggtcggacagatcgtaaacatttactgtctctacggacattcgtgttgtttgtacgtcggcagcattttagtggacgaatacgccggtgacgtgacttgcgttagaggtctcctcgacatgttgaacgcttttttggagccgacgtttcgtctgttgcaagaagagaatggcttgaagaaccatccggataccgtcgatgatttctttaggttgtgcgctcggttcgtccagagggccccgaaggcgtttctaagcggaggctcccatttggcgcccattatacaatgcgctcttctcgccgccaccttagatcacaaggaagccaacgtgtctgttatgaaatttttctacgatttaataaaccagggactgagcggccgaggtgaacccgatttcgacgaaagaaaagccttggttaggagtctactgaacgaatacggtcaacaactcgtgtctaatttaattcactcttgcgtattttacttgcattcgtacatgctgagcgaagtgggcgacgtttttgtacaattgttggatttcgatagacagatcacgagtgaatggttagcgaacggtttggaattgttaccgaaacaacagaatggtggcataatggcggccaagcctaaacaattaaatgatgttcatgcttctataacgagatcaaacagttcaaaatctgtgacgcacgctctgaaagacctaactaggctatatcgttaa

SEQ ID NO: 799 - DNA, 1458 bp, Phyllotreta striolata
ccgccccctcaaaggtaccaacaaccgccgccgaatcaaggaatgaggcaatacggtcaacagacctttccacccaggccgggctacaatcctccacctccaaatatgcagtcgagcgggggcactatgattcaaagaccacccggggccccctattcgccgatgcgcggagggcccatgcctccccaaccggtgggcaagaggccttcggataacaggaatccattacaacagaagaccggcgattacagccacggtacgagcaagaaaaaaaagaaactggccgataaaattttaccccaaaaagtgagagatttggtgcccgagagccaagcctacatggacctgctagctttcgaaagaaaactcgattccaccattatgagaaagcgattagacatacaagaagctttaaagcgcccgatgaagcagaaaagaaaattgcgaattttcatctccaacaccttctacccagcgaaagagccccaacccgaaggccccgacggtcccggccaagaaggcaccgtagcctcctgggaactccgagtcgaaggcagactactagaagactctaaaaacgaccccaacaaggtaaagcgaaaattctcctcgttcttcaagtccctggtcatcgagctcgacaaagagctctacggccccgacaatcacctagtcgaatggcaccgaaccctcaccacccaagagaccgacggcttccaagtgaaacggcccggcgacaagaacgtgcgctgcaccattctgttgctcctcgactaccagccgttgcagttcaagctcgacccgaggctggcccgattgctcggcgtccacacgcaaaccagaccggtgatcatatccgccctgtggcagtacatcaagacgcaccggctgcaggacggccacgagcgcgagtacatcatctgcgacaagtatttggagcagatcttcaactgtactcgcatgaagttcgccgagatcccgcaacggttgaatcccctgctgcatccgcccgatccgatcgtcataaaccacgttatatccgtcgaaggcggcgccgagagcaagcaaacggcttgctacgatatagatgttgaggttgacgatacgctgaagactcaaatgaataatttcctgttgagtacggccagtcagcaggaaattcagggattggacgcgaagattcacgagactgttgatactataaatcagctgaagactaacagggagtttttcctgagttttgctaaggatcctcagcagtttatacacaaatggatcgtgtctcaaacgagagatcttaagtcgatgaccgatgtggtggggaatccggaggaggagaggcgatcggatttcttctaccaaccttgggctcaggaggctgtatgtcggtacttctatactaaggtgcagcagaaaagggcagagttggagcaggcccttggtattcgtaataattag

SEQ ID NO: 800 - DNA, 435 bp, Phyllotreta striolata
atgcctaaagtacgaagaagtaagaaaccaccaccagaaggttgggaacttatcgagccaacattggacgaattagaacaaaaaatgcgagaagccgagaccgaatcccacgaaggaaaacgaaaaaatgaatcattgtggcccatattcaaaattcaccatcaaaaatctcgatacatcttcgacttattttaccgaagaaaggcgattagccgagaattgtacgagtattgcttactggaaaacatcgccgacaagaatttaattgcaaagtggaagaaacagggctacgaaagcctttgttgcctgagatgcatccaagccagagacaccaatttcggaacgaattgcatttgcagggtacccaaatccaagctggaagaaggaaggattgtcgaatgtgtacattgcggttgtaggggatgttccggttaa

SEQ ID NO: 801 - DNA, 885 bp, Phyllotreta striolata
atgccagcagctactttgggtagcaatttacatcctaacaatgaagactgcggcattcgggacgtttgggctcacaatttggaagatgaattccgaactataagacaaatagtgcagaaataccaatatgtcgcaatggacactgaatttcccggcgtcgtggcccgacccataggagaatttcgaagctccgccgattatcaataccaaatgttgaggtgcaacgtagacttactgagaattatccaactaggtttaacgttcttagacgataatggcaaaacaccaggaggagtttacactacctggcagttcaattttaaattcaaccttcaagaagacatgtacgcacaagatagcatcgatttactgcaaaattccgggatacaattcaagaagcacgaagacgaaggtatcgaaccgttagaatttgccgaactactaatgtcctccgggatcgttctaatggaaaatatcaaatggctgtcgtttcattccggctacgattttggctatttaataaagttactcaccgacaacaatctaccgcaagatgaaaatgaatttttcgatctgctgaaattgtattttcccaccatatacgacgtaaagtatttaatgaaatcgtgtaaaaatttaaaaggtggccttcaagaagttgcggaacagttagaattggagaggatcgggccccaacatcaagccggatccgactcgctgttgaccggaatggcctttttcaaaatgaaagaaatgttttttgaggatactattgacgattcgaagttctcaggccatctttacgggctcggaacatctttcactgttaatggtacaactaacaattacggaaacgataacggcgacaccacaaactcctcatga

SEQ ID NO: 802 - DNA, 1212 bp, Phyllotreta striolata
atggcggaagctcagaaaaggggcgcttcggtgttcgaggacctctcgaatgtagaattcgagaccagcgagaacttagatgtaatcgaaaagttcaaagatatgaagctgaaggaggaactgcttcgcggcatcttcgcatatggtttcgagaagccttcagctattcagcaaagagctattattcccgtgatgaaaggccgagatgttatagcccaagcacagtcgggtaccggtaaaaccgctacattttccatagctattcttcaagctctggatttaacgatgagagaaacgcaagtgctgtgtttatcccctacgagagaattggctgtacaaattcagaaagttatattagctctaggtgatttcatgaatgtacaatgtcacgcttgtatcgggggtacaaatcttggagaagacatcaggaagttagattacggacagcacgttgttagtggtacacctggaagggtttacgatatgattcgtagaagagctttgagaactagatccgtgaaaatgctagtactagatgaagccgacgaaatgctaaacaaaggcttcaaagaacaaatctacgatgtgtacagatttcttcccccatccactcaagtggtgttaatatctgctacattaccacacgaaatcctggaaataacatccaaatttatgaccgatcccatcaggattttagtcaaacgtgatgaactgacgctggagggaatcaaacagtttttcgtcgccgtggagagggaagaatggaaattcgacactctatgtgacctgtacgacaccttaaccatcacgcaagccgtaattttctgcaacaccaaaagaaaggtcgattggttgaccgaaaagatgcgagaaaacaacttcaccgtgagctcaatgcacggagacatgcctcagaaagagcgcgacaacattatgaaggaattccggtcgggccaaagcagagttttgatcactaccgacgtttgggccagaggtattgacgtgcaacaagtatcgttggttatcaattacgatttgcccaacaatcgtgaattgtatattcatcgaatcggtcgatccggtcggttcggcaggaagggtgtcgctatcaatttcgttaaatccgacgacattaggattctgagagatatcgaacaatattattccacgcagatcgatgagatgcctatgaatgtagctgatttaatttaa

SEQ ID NO: 803 - DNA, 1602 bp, Phyllotreta striolata
atgaccgctcctgctgccggtggagatgcaagaggaagaactctcgcttacaaagacaaaagcaaacccgccgatgtccgaacaagtaacattaacgccgctaaggctgtctgcgatgcaattcgtactagtttggggccaagaggaatggataaaatgatacaagctggtaacggagaagtgactattaccaacgatggggcaacgattttaaaacaaatcaacgttatccaccctgcagcaaaaatgttggtagaactgtcgagagctcaagatatcgaagctggtgacggtacaacctccgttgtggtcattgccggagcccttttagacgccgcagaaaagttgctacaaaggggaatccacccaacggctatttcggagtctttccagagggctgcccatttggctgtcgagattctacaagaaatttctacaccggtagaaatcactaacagggagttgttaatcaagagtgcgtccacctctttgaattccaaagttgtatctcaacagtcgagtctcttagggcctttggcagttgatgctgttcttaaaattgtcgaaccaggacaggaacaagcgtgtaacttggtagatgtgaaagttattaagcaattgggcggtaccgtggaagataccgagttgattgagggtatcgttttctctcagagatccgccaatgtatctggtccgaagagaatcgaaaaagccaagattggttttatacaattctgcatttctcctccgaaaaccgacatggaccacaatgttatcgtatccgattacgctgcgatggatcgagtgttgaaggaggaaagagcgtacattttgaacattgttaaacagattaagaaagccggctgtaacgtacttttggttcagaaatcgattctcagagatgccgtatccgatttggcccttcactttttggataaaataaagtgcatggttattaaggatgtcgaacgagaagacgtggagtttgtgtgcaaatcgttggcttgcagaccgatcgcttctctcgatcacttcaccgctgagaatttagtaactgcagatttagtcgaagaagttggactaggcggtaaccgaatggtgaaagtcacaggtattcaaaatggcggacgcacggtgaccctactagtgagaggctcgaataaattagtattagaggaggcggaacggtctctgcatgatgctctgtgcgtcatccgttgtctcgttcgtaagaaggcgctcatcgccggcggtggagcaccggaaatcgaggtggctcttaaactggctgctatggctaataagttggagggcatcgatgctatttgcaccagagcttatgcaaccgctttggaaattataccgtttactttggcggagaatgctggattgaatcctatacagacggttactgaattgaggaatagacatgctaaaggtgaaacttcggctggtattaatgttcgtaagggcaccattacagacattttggaagaaaatgttgtacaaccgctgttagttagcacatctgctttgagcttcgccaccgaaaccgtcaggtccatattaaaaattgatgacattgtgaacacagtaacataa

SEQ ID NO: 804 - DNA, 1230 bp, Phyllotreta striolata
atggaggctatggatattgtaataccagagaaagaggaaggcagtccttccgaagcgaaacaggtcttgcaagatttagacatggaggatttgtacacgaaatacaagaaattacagcagacgttggaattcttagaagtccaagaagagtacatcaaagacgagcagaggaacttgaaaaaggagtacctgcacgcccaagaagaagtcaaacgcatccaatcagtaccgttggttatcggtcaattcttagaagccgtcgatcagaataccggcattgtcggttcaactaccggttctaattactacgttcgaattctctctaccatcgatagggaattactgaaaccgtccgctagcgtagccctacacaagcacagcaatgctttggtggacgtgctaccgcccgaagcggactcctccattagcatgctacaagccgatgagaaaccggacgtacaatacagcgatatcggaggtatggatatgcaaaagcaggagattcgagaggccgtagaacttccgttgacccactttgagctgtacaaacaaatcggtatagaccctccgagaggtgtgctgatgtacggcccgcccggttgcggtaaaaccatgctcgcaaaagccgtagctcatcacaccacagcggctttcattcgagtggtcggttcggagttcgtgcaaaaatacctgggcgaggggcccaggatggtgcgagacgtgttccgcctggccaaggagaattccccagccatcatcttcatcgacgagatcgacgccatcgcgacgaagcgtttcgacgcccaaacgggcgccgatcgcgaggtgcagaggatcctgttggagctgttgaaccagatggacgggttcgatcagaccaccaacgtgaaggtgatcatggcgacgaatcgggcggatacgttggatccggctttgctgcgacccggtcgtttggataggaagatcgaatttccgttgcccgataggaggcagaagcggttgatattcagcactatcacgtccaaaatgaatctgtctgaagaggttgatttggaggattacgttgccaggcctgatagaatatcgggggcggatattaacgccatttgccaggaagccgggatgcacgctgtgagagagaatcgttacatcgtgttgccgaaggatttcgaaaagggctacaagaataacatcaagaaggatgaaagcgaacacgaattttacaaatga

SEQ ID NO: 805 - DNA, 489 bp, Phyllotreta striolata
atgccaaatataaagctgcaatcttcggacggcgagaccttcgagatcgacgtcgaaatcgccaagtgctcggtgaccataaaaaccatgctggaggacctgggcatggacgaggaagaggaggaggtcgtgcccttgcccaacgtaaactcagctatcctacggaaggtcatccaatgggccacataccacaaagacgacccgcccccgcccgaagacgacgacaacaaggagaagagaaccgacgacatatcctcgtgggacgcggactttctcaaagtcgaccaaggcactctgttcgaactgatcctagccgcgaactatctcgatatcaaaggcctgctcgacgtcacttgcaagaccgtggccaacatgataaagggcaaagcgccggaggaaatacggaaaacgtttaacatcaagaacgatttcacgccgtccgaagaagagcaagtgcgcaaggagaacgaatggtgcgaggagaaatag

SEQ ID NO: 806 - DNA, 1038 bp, Phyllotreta striolata
atgaaggcagcaaataacactaaatccgttaaaatgacatcgcaaaaattgaataatgtcgaaagcgttgataaatcggagaaaggaaagataaaaaccgtagtaataatggacgataaggcttcatgtaaggaactagatcaatggatagaacagttaaatgactgtaagcaattaaccgaaaaccaagtgaaaactctgtgtgataaggcgaaagaaatactgtccaaagaatcaaatgtgcaggaggtaaaatgtcctgtcaccgtttgcggagatgtacacggacagtttcacgatctgatggaattatttaggataggtggtcgaagtccagatacgaattacctttttatgggtgactatgtcgatcgtgggtattattccgtcgagactgttactcttttggtggctttgaaagtcaggtataaagaaagaattacgatcctgagaggaaaccatgaatcgagacaaatcactcaagtatatggattctacgacgagtgcctgcgaaaatacgggaacgcgaacgtttggaaattcttcaccgatttgtttgattacttgccgcttacagcgctcgtcgatagccagatattctgtttgcacggagggctcagtcccagcattgatactttggaccatattagagccttggatcgtttacaagaggtacctcacgaaggtccgatgtgcgatcttctctggtcggatcccgacgatcgcggaggttggggcatttctcctcgcggtgcgggttatacctttggacaagatatatcggaaacgttcaaccacagcaacggcttgacattggtctctcgggcccatcaactcgtcatggaggggtacaattggtgccatgacagaaacgttgtaacgatcttcagtgctccaaactactgctatagatgtggtaatcaagctgccattatggaattagatgatgcgcttaaatattcattcttacaatttgatccagcaccgagacgtggcgaacctcacgttacccgcagaactccggattatttcctttaa

SEQ ID NO: 807 - DNA, 648 bp, Phyllotreta striolata
atcttcgtaaaaactctcactggaaagaccattactcttgaagttgaaccttctgacactatcgagaatgttaaagctaaaatccaggacaaggaaggtatcccaccagaccaacaacgtttgatcttcgctggaaagcaactagaagatggtcgtactctttctgattacaacatacagaaagaatccacccttcacttggtacttagacttcgtggtggtatgcaaatcttcgttaaaacattaactggaaaaactatcactcttgaagttgaaccatctgataccattgaaaatgtcaaggctaaaatccaggacaaggagggaattcccccagaccaacaaagattgatcttcgccggaaaacaactggaagatggtcgcactctttctgattacaacatccagaaagaatctactcttcacttggttttgagacttcgtggtggaatgcagatctttgtaaaaactttaactggaaagaccatcaccttggaagtcgagccatccgacaccattgagaatgtaaaagctaaaatccaggacaaggaaggtatcccaccagaccagcagagattgatcttcgcaggaaaacaactagaagatggtcgtactctttctgattacaacatccaaaaggaatctact

SEQ ID NO: 808 - DNA, 1623 bp, Phyllotreta striolata
atgatgcaaccgcagatattgctcctcaaggaaggcactgattcgtcacaaggcaagcctcagttgatatccaatataaatgcgtgccagaatatagtggacgctatacgaaccaccctggggccccgaggtatggacaaattgatcgtctccaacagaggctctgcgaccatctcaaacgacggagcgacaatattaaatttactagacgtggtgcatccagcggcgaaaactctagttgacatagcgaagtcacaagacgccgaagtaggcgatggcacgacctccgttgttttgctagcaggcgagtttttgaagcaactgaagtcctacatcgaagaaggcgtgcatccgaggatcatcatcaaagccgtgcggaaggcgacccagatttgcctggagaaaatcaacgccctcgccgttaaaatcaacaaagccaaccccgaggagtacaggtcgttgctggagaaatgcgccgcgacggcgatgagctcgaagttgatcaacaaacagaaatcgttcttctccaaaatggtggtcgatgccgtgctactgctcgacgaactcctgccgttgaacatgatcggcatcaagaaggtgcaaggcggcggtctggaggactccatgttagtcgccggagtggccttcaagaagaccttctcgtacgccgggttcgagatgcagcccaagatttacaaagactgcaagatcgccctgttgaatatagaattggaactgaaagcggagagagacaacgccgagatccgcctgagcagcgtcaaggagtaccaaaaagtcgtcgatgcggagtggaacattttgtacaacaaactccagaaaatttacgaatccggagcgaacgttgttctatcgaaattacccattggtgacgtcgccacgcaatacttcgccgacagagacatgttctgcgccggaagggtccaagaggaagacatgaagagaaccttgaaagcctgcggtggctccataatgaccacagtcaacgatttgaaagacgaagtgctaggtaactgccagctgttcgaagagaagcaaattggaggcgacagatacaacttcttcaaaggctgtcccaacgccaaaacctgcaccatcatcctaagaggaggagccgagcaatttttagaagaaaccgagaggtccctacacgatgccatcatgatcgtccgcagaacaatcaaaaacgactccgtcgtagcaggcggaggagccatcgaaatggagctatcgaagttactcagggattactctcgcaccattgccggcaaagaacaactcctgattggagctatcgcgaaagcactcgaaataatccctaggcaactatgcgacaatgccggtttcgacgccactaatatactgaacaaattgcgacagaaacacgctcagggcaactcctggtacggggtggacgtcaacatggaggatatcgccgataactacgaaacttgcgtatgggagccggctattataaaaattaacgctttgaccgccgctgcggaggccacgtgcttgatcctgtccgttgatgagacgatcaaaaaccagaaatccgaagcgcccccgcaaatgggcggacgcggaatgggtagacccatgtaa

SEQ ID NO: 809 - DNA, 13947 bp, Phyllotreta striolata
atgggggactccctagaagcctcggaaacggctcacgaaactcaaaatgtggcgttagtggattttactgcgtttacaaattttattttgaaagcggctactgtacttttgccagaagatgatagccaagcggaaccggcgaacctcatagcagcaatagatgacaaaaccaatcaggaatgtataaaaaaattcataagcgatccccaaattgtgatattgtacgtccaaaggaactcttcaaaagatgacgacaatgtccagcctccggaaggagaagaagaaaaagaaccagttacatactacattagcaacgaagtgcactattccaactcgaaaatgtccagcttggtgtgcatcaaaaggggcccggtgatagaggccgataaaagcattagggctcaggttcgtttgatgaacttcagcgagggttccccttatgaaattctgcacgattacgtcagcagaaccgtcgccccttactttaaatcctacgtaaaagagtcgggcagagctgaccgcgacggtgataaaatggcgcctgctgttgaaaaaacaatcgccgaattagaaatggggcttctgcatttacaacaaaatatcgatattccggaaattacgcttcaagtgcatccgtacgtcgccagtcttataaagcaatgcgccgatgaaggaaggaagccgaaagtcgccgatttcagtgacaaagtggacgactcgaactttctcaaccaactccaacacggagtaaatcgttggatcaaagaaattcaaaaagtaacaaaattagacagagacccctcttctggcacggcccttcaagaaattagtttttggctcaatctggaaagggcccttcaccgcatccaggaaaaacgcgaaagcatggaggtcgctctaacattggacattctcaagcacggtaaacgttttcacgccacggtgtcgttcgataccgataccggcctaaagcaagccatagctacggttaacgattacaatccgctgatgaaggatttccccattaacgatttgttagctgcaacggagctggagagaattcgcgcggcggttcaattgattttttcccatctaaggaaggtccgatcgaccaaatatcccattacgaggtgcctaagactagtcgaggccatttcgagagacttaggcatgcagctgttgaaagtactgggtacccgccgtttaatgcacattccattcgacgaattcgagaaagtcatgacccaatgtttcgaagtgttttcgatttgggatgacgaatacgagaaattgcaaggtcttctcagagatatcatgaagaagaagcgagacgaacacatgaaaatggtctggcggatttcgccgcaacataaaaaactccaaagccgtatggatcagatgcgcaaatttcgcaggcagcacgaacagctgcgcacggtcatagtgcgcgtattgagaccgagtgtcaaagagagcgcagcgcccgtcgaaggaagcgatatcgaacctcctaaaccgacgttttcccttgatgctgcagatgccaacgctattgaggaagtaaatttggcttacgagaacgtaaaagaagtcgactgtctggacattaccaaggaaggccaagacgcttgggatgccgctgtacagagatatgaagagcgaatcgatagagtcgaaacgaggatcaccgcacatctacgcgatcaattgggaacggccaaaaacgcgaacgagatgtttaggattttctcgcgttttaacgccctattcgtcagacctcacattagaggggctataagggaataccaaacgcatctgattcaaagagtgaaagacgatatcgaagccctacatgaaaaatttaaagttcaatatccgcaaagtaacagcgctaaaattagcaaagtgagagatttgccgcctgtagccggttctatagtgtgggccaagcaaatcgatcatcaactaacgacatatttaaggcgtgtcgaagatgtgctaggaaaaggatgggagaaccacatcgaaggacaaaaactcaaagccgacggggacagtttccgtttgaagctaaatacccaggaaatattcgatgattgggcgcgaaacgtgcaacaacgtaatctcggcgtgtccggcagaatatttaccatcgaagccgtgagatcgaggagcggtcgcggtaacgttctcaaattgaaagtcaactttctaccggagatcattacgctggccaaggaagtacgtaatttaaagtgcctgggattcagagtacctttggctatcgtcaataaggcacaccaagcgaatcaactttatccgttcgccatatcgcttatcgaaagcattcgaacatacgagatgactttggaaaagatcgaggacaaggccagcatcattccgctcgtcgctggcatgagaaaagaagtccaactggtcctggccgaaggaatccaactggtatgggaaagctacaaactggacctctacgtacagcgactctcagacctagtggtgggtttccaagagcgagtcgaagagctcgtattcgtcggcgagcaattagaagtagacgtcagatcgttggaaacctgcccttactcggccaacaccttcgccgacatcctgtcgaagatccaacacgccgtcgacgatctgtcgctgaagcaattctcgaacctgcacatttgggtgttgcgattggacgaggaggtcgagaagaacctcgccaggcggctgcaagccggcatcgaagcctggacggagacgctgagcggccagaagaaggaaatcgatcacagcatggacaccgacgcgccggcccagcccacccacaaacccggcggcgatccgcaaatccaaacgatgatacacgaagtgcgcataaccaatcagacaatgtacttgtttccgagcatcgaagaggccaggttcctgattatgcagcaactgttcgcttggcaggcgatcgtgacgtgccagcaacgccttcaaagcagtcgctatcaagtcggcgtggataagccggtcgtggagacttaccggaatattttgactagactaccggctggcgcgcaaccgttgatcaacgcttacagcgctatttcttctaaaattaaggaggttcaaaattatgtaaacgagtggttaacttaccaatctctgtgggatctgcaagcagataatctttacgggaaactgggtgaagatattagtaaatggatggaatgtctgaacgacataaagaaaactcgaactacattcgacacgtcggacacccgtcgcgaatttggcccaatagtcatagacttcgccaaagtccagagcaaagtttcccttaaatacgactcttggcacaaagaaaccttgagcaaattcggaagtctcttgagcaacgaaatgacctcgttccacgccaacgtatccaaatccagatccgatctggagttgcaaagcatcgaggcggccagcacatccgacgccgtcagctttataacgtacgtccagcaattgaaacggaacatgaaagcttgggagaagcaggtggacatctacaaagaaggccaaagaatcctggagcgccagcgattccagttcccgacgaactggttgcacgtggaaaacctggagggcgaatggggagcattcaacgaaatcatcaagaggaaggattcgagcatccaaactcaagtcgctagtcttcagcagaagatcgtttcggaagataaggcggtcgaaagtcgcacgaacgatttcttggtagactgggagaggagcaagccggtcgaaggccatctcagaccggacgacgccctctctcagctgcaattattcgaaagcaaattttcgcgtctcaaggaagaacgcgacaacgtcgccaaagccaaagaagctttggacttgcaagacccgggcggcataagtaccagcgaagataaaatgcaagtcgtttacgaggaattgcaagatctgagaggcgtctggtccgaactgtccagaatctggcagcaaatcgacgaaacccgagagaaaccttggctctccatccaaccgaggaagctgcggcaacaattagaccaactctcgacgcaactcagagaattaccggcccgtctgaggcaatacgcttcgtacgaatacgtcaagaagaccctacaaacctacaccaaagtcaacatgctgatagtcgaattaaaatccgacgccctcaaggaacgccactggaagcagctcatgaagcaactgcgagtcaactgggtgctctccgatctaacgctcggccaagtctgggacgtcaatctccagaaaaacgaggccatcgtcaaagacgtcatactggtagcccaaggcgaaatggcgctcgaagagttcctgaagcaagtgcgcgaatcctggcaaaactacgaactcgacctgatcaactaccaaaacaaatgcaaactgatcagaggatgggacgatctgttcaacaaagtcaaagaacacatcaattccgtcgccgccatgaagctgtcgccgtactacaaggtcttcgaagaggaagcctcgacttgggaggaaaagttgaatcgcatcaacgcgctgttcgacgtgtggatcgacgtgcaaaggcgctgggtgtatttagaagggatattctccggcagcgcggacatcaaaacgctcctgccggtggaaacgtcgcgtttccaaagcatcagctccgacttcttggggctgatgaagaaggtgagcaagagcccgatggtgatggacatcgtgaatattctaggcgtgcaacgcgtactggaacgactggccgatttattgggtaaaatccagaaagcgctcggcgaatatctggaaagagaacgtacgtctttccctcgattctacttcgtgggcgacgaagatctcctggagataatcggcaacagcaaaaacgtggcgaggttgcaaaagcatttcaagaaaatgttcgccggcgtggcttccatattactcaacgaaaacaatactatcatcaccggtatagcttcgcgagaaggcgaagaagtcgtgttcaaatcgccggtttccaccgtagagcatcccaagatcaacgagtggctgagtttggtcgaaaaggaaatgcgcgtgacgctggcctcgaatctaacgcaagccgtgcaggacatcaagcaattcaaagacgaaatcgactcgaaatcctacatggaatgggtggacaaataccaagcgcagatcgtggtgttggcggcccagattctctggagcgaggacgtcgaagcggcgctggtgaaaatgaacagcgaaccgcagaagggcgtgctggaaaaggttctgcaacaggtcgagaacaccctcaacgtgctggcggattccgttttgcaggagcaaccgcagttgagaaggaagaagctggagcacttgatcaacgagtttgtgcacaagagaacggtgaccaggagactgatcgccaacggggtttgtagtaacaaggcgttcgaatggctgtgcgaaatgaggttctacttcgatccgagacaaaccgaagtgctcaaacaattaacgattcacatggcgaacgcgaggttctattacggatttgaatacttgggcgtgcaggatagattagtgcaaactcctctaactgacagatgttacttgactatgactcaagctttggaagcccgtctcggaggatcgcctttcggacccgccggaactggtaagaccgaatcggtcaaagcgctcggaaaccagctgggtcgtttcgtgctcgtgttcaattgcgacgaaacgttcgatttccaagccatgggcaggatattcgtgggtttgtgtcaagtgggcgcttggggttgtttcgacgaattcaacagattagaagaaagaatgctgtcggccgtttcgcagcaaatacaaactatacaagaagctctgaagtcgcagaaggaagctgccgccgaaggagtcgccaccggcagtataagcgtcgaactggtgggaaaacaagtaaaagtgtcgcccgatatggccatctttattacgatgaatcccggctacgcgggtcgttcgaatttgccggataatttgaagaaattgttcagatcgttagccatgactacgcccgacagacaactgatcgctgaagtcatgttgttctctcaaggattcaggcaggccgagaaattggcatcgaaaatcgtaccgttctttagattatgcgacgaacaactgtccaatcaatcccattacgacttcggtttgagagctttgaaatccgtactgatatcggcgggaaatgtgaaaagagatagaatccaaaggataaaagaaggtatgacccaacgaggcgaaactaacatagacgaagcaaacatagccgagaatttgcccgaacaagaaatattgattcaatcggtttgcgagactatggttcccaaattggtcgctgaagatatcccattgctgttcagcttgttgaacgacgtgtttcccaacgtgcaatacaccagagccgaaatggaaggtcttaaggacgaaattagaaaagtgtgcacggaagaatacctcgtttgcggagaaggcgatgaaagaggttcggcttggatggaaaaagtattacaattataccaaatttcgaacctcaaccacggtctaatgatggtcggcccgagtggttcgggcaagagttcagcatggcgagttctgcttaaagccctcgaacgattcgaagggatagaaggcgtagcccatgtaatcgatccgaaagcgatcagcaaagagactttatacggtgtgttggatcccaataccagagaatggaccgatggtctgttcacccatattctaagaaaaattatagacaacgtgagaggtgaaattaacaaacgccaatggattatcttcgacggtgacgtcgatccagaatgggtggaaaacttgaactctgttctcgacgataacaaattgttgactcttcccaacggagaacgtctatccctaccgcctaacattagagtcatgtttgaggtacaagatctaaaatatgccacgttagctacagtgtcgcgttgtggtatggtgtggttctctgaagacgtactatccaccgaaatgatattcgaaaattacattctccgattgaagaacattccgctcgaagaaagcgaagagggcttcgggaagaaatcagacctcaaagacgacatgttgtctccgaccctccaactgcaagtcgacgtcgtgaatctactccagccgtttttgggacccgacggtctcgtcgtacgctgtttggagtacgccatggaacaggaacacataatggacttcacgcgactcagagccctcagctctctcttctccatgctgaatcaagccgtgagaaacgtcttgcagttcaatcacatgcatcccgattttcctctctccagcgaagccctcgataaatacataccgaaatgtttgatatattcgatcttgtggagcttcgccggcgatgccaagcttaaagttcgatcggaattgggcgattttatcagatccgtcaccaccgtacccctgccttccgatcgcaatttgcctattatcgattacgaagttaccatcgaaggagaatggtcgctttggtcgaacaaagtgccgcaaatcgaggtcgaaactcacaaagtcgccacgcccgacattgtggtgcccacgttggacacagtcaggcacgaatcgttgttgtacacctggttggcggaacacaaaccgatagtgttgtgtggtccacctggttccggtaaaacgatgacattattctccgcattgagagcattacctgacatggaagtcgtcgggttgaacttctcatcggctacaactccagagttgctgttaaaaacctttgatcattactgcgaatacagaaaaacaccgaatggcgtcattctatcgcccatacagttaggcaaatggctcgtcctcttctgcgacgaaatcaacttaccggacatggacaattacggcacccagcgcgtcatcatgttcttgcgtcaaatagtcgaacaaaaaggcttctatcgcgcttcggaccaaacctgggtatcgttggagcgcattcaattcgtgggcgcttgcaatcccccgacggaccccggaaggaagcccctttctcaccgtttcctcagacacgtgcccgtcgtttacgtcgactacccgggagagacgtcgctcaagcaaatttacggcaccttcaccagagcgatgctgcgactggccccgggactgaagggctacgccgagccgctaaccaactccatggtggaattctacttgtcgtcgcaggacaggttcactcaagacatgcaacctcactacgtgtattcccctcgcgagatgacgagatgggtgagaggcatatgcgaagccatcagacctctggacaatctgtccgtggaaggtttggtcaggttgtgggcgcacgaagcgcttcgactgttccaagacaggttagtggaggacgccgaaaggcgatggacgaacgaaaacatcgatgccgtcgctttgaagcacttcccgtcggcgaattgcgaaaaggccttggaacggcccatcctatacagtaactggttgtccaaggattacgtaccggtaggcagggagcagctgagagaatacgtcaaggctaggttgaaagtgttctacgaagaggaactcgacgttcctttggtgctcttcgatgaggtactggatcacgtgctcaggatcgacaggattttcaggcaaccgcaaggtcatttgctcctgataggcgtgtccggagcggggaaaactaccctgtcgaggttcgtggcttggatgaacggattgtccattttccaaattaaagttcacaacaaatacaccgccgatgatttcgacgaagacttgcgatcggttctgagaaggagcggttgcaaacacgaaaagatcgccttcattttggacgagtcgaacatgctggactcgagtttcttggaaagaatgaatactcttctagccaacggcgaagttcccggattgttcgaaggagacgaatacaccactctaatgacgcagtgcaaagaaggagctcaaagagaaggattaatgttggattcgaacgatgaactctacaagtggttcacgcaacaagtcatgcgaaatttgcacgtagtttttacgatgaatccttcgacggatggtttgaaggatagggccgctacttctcctgctttattcaacagatgcgtgttgaattggttcggagattggtccgatggagctctattccaggtgggaaaagaattcacgaatcgcttggatctcgacaaacaaagttggaaatgccccgatttcttccccgcttcttgcaaccgcatttccgcgacgcccaatcacagagaggccgtcatcaacgcctgcgtttacgtccatcagacccttcacaaagccaacggcagattgacaaagagaggaagtcgcacgatggccatcacccctagacactacttggatttcatacaccatctcgtcaaattgtacaacgaaaaacggtccgatttagaagagcaacagctccatcttaacgtcggtttgaacaagatcgcagaaaccgttgaacaggtggaagagatgcaaaagagtttggccgtaaaatcgcaagaattgcaagcgaaaaacgacgccgccaacgccaagctcaggcaaatggtgaaagatcagcaggaggccgaaaagaagaaagttcaaagtcaagaaatccaacagcagctcgcccagcaaacggtgcacatcaagcagaaaaaatccgaagtaatggccgatttggaacaagtagaaccggccgtcatcgaagctcagcaagctgtgaaatccatcaagaaacaacaattagtagaaatccgtaccatgtcgaatcctccggccctggtaaaactggcgctggaatcgatttgcttgctactaggagaaaacgccagcgattggaaatccattcgagctgtgattatgagagacaatttcatcaacagcgtggtcaatttcaacaccgaagatatcggcgacgacgtcagagaaaaaatgaaaagccgctatttgagcaaccccgactacaacatcgacaaaatctaccacgccagcaacgcctgcggtccgctggtgaagtgggcctgcgcccaagtcgagtacgccgacatgctgaagaaggtcgagccgctgcgcgaggagctcaactctctggaaactcaagccgaaacgaaccagaagcgcggcgaagacgtgaaagttctcatcggccagctggagcaaagcatcgcctcctacaaggaggaatacgcgcagctgatcgcccaagcgcaagccatcaaaaccgatttggagaacgtccaagccaaggtcgatcgatcgatagcccttctcaaatcgctcgtcatcgaaagggaacgatgggaggccagcagcgagacgttcagatcgcaaatgtccaccatcatcggggacgttctgttatcggccgcgttcatcgcgtacggaggttacttcgaccaacattaccgtcaaaatctcttcagcacttggtgtcaacatttaacgctagctaacatccaatacagggccgatatagcccgaacggagtacttgtcgaatcccgacgaacggctcagatggcaagccaacgctttgccttcggacgatctgtgcacggaaaacgccatcatgctgaagagattcaacagatacccgctcattatcgacccgtcgggccaagccaccgaattcataatgaacgaattcaaagacaagaagatcaccaagacgagcttcttggacgattcgttcaggaagaacctggaatcggcgctgcgtttcggcaatccccttctcgtccaagacgtcgagaactacgacgccatattgaaccccgtgctcaaccgggagctgcgaaggaccggcgggcgcgtgttgataacgctcggcgaccaagacatcgatttgtcgccgtcgttcgtgatattcctatccacgcgagacccgaccgtggaattcccgccggacatttgctcgagagtcacattcgtcaacttcacggtgaccaggagctcgttgcagagccaatgcttgaatcaagtgctcaaggccgagcggcccgacatcgacgccaagcgatccgatctgctgaagctgcagggcgagttccacctgcgattgaggcagctcgagaagtcgctgttgcaagccctcaacgacgccaagggtaagattctcgacgacgacagcgtcattacgacgttggaaacgctgaagcaggaggccgccgaaatcggacagaaagtcgaagagaccgataaggtcatttcggaaatcgagacggtgtcgcagcagtacttgccgttatcgcaggcgtgcagtaacacttactttactatggatagtttgaaccaagtacacttcctctaccaatactctttgaagatgtttttggacgtatttgctacggtgttgcacaataacgtgaagttagatggaatcaccgattatcaagctagattgaacgtcatcaccagtaatttgttttcggttgtttatgagcgagtagctagaggaatgcttcacaacgaccgcatgacgttcgctatactactgtgcaggattcacctgaaaggacgaccgacggaacccaatctagaccaagagttcaacttcttcctcagaggcaaagagggcgtcttcagcagcaccaattcggccatcgtcgacggtttgaacagcgatcaacaggaagccatcacgagactgtcgaccaaactaccggcgttcaagaaactaccggaacaaatcaaagacatgccggagttcggcgcgtggttgcagcagagcagccccgagcaggcggtgccgcagctgtggatcgaagagaagcagctgagcgccgtcggcaggggcatgtaccagatgctggtgatccaggcctttaggcccgatcgcgtgatcgcggcggcgcagaacttcgtcgccgccgtgctcggcgccgatttcatgtacctggccgagaaggagctggactttgcgacgtgcgtcgaaaaggagatcagatcgaacgtgccggcgctgttgtgctcggtgcccggcttcgacgcttccggtcgcgtcgacgatctggccgccgagctcaacaagcagatatccagcatcgccatcggttccgctgaaggtttcaaccaggccgatagggctattaacatggcctgcaaaactggaagatgggtgatgcttaaaaacgtccatctggcgcctcagtggctggtgcaactcgaaaagaaacttcactcgcttcagccgcacgccaatttccggctgttcctcacgatggagatcaatcccaagttgccgttcaacttgctgagagcgggaagaatattcgtgttcgaaccgccgccgggtatccgagcgaacttattgagaacattcagcactgttccggcgagcagaatgatgaaagcgcccaacgaaagagcgagattgtacttcctgttagcttggttccatgcgatcgtgcaggaaagactgcggtactgtccgttaggttgggccaaatactacgaattcagcgaatcggatttgcgcgtcgcctgcgatactttagacacgtggatcgacgcaacggcgatgggaaggaccaatttgccgccggagaaagtaccgtgggacgcgctcgtcacgcttctctctcaatcgatctacggcggtaagatcgacaacgatttcgatcagaggctgttgcattcgttcttgaacaaattgttcacgccgaagagcttcgacagcgatttcgcgttggtggcgaacatagacaatgggcccggcggcaatcgacacataaccatgccggacggtactcgaagggatcacttcttgaagtggatcgaaagtctcgccgacagacaaacgccagcttggttgggactacctaataacgcggaaaaggtacttttaaccacaagaggtaccgacctcatagcgaagctactcaaaatgcagcaattggaagacgacgacgaattggcgtattcgctcgacgacagctcgccgtccgatccggccgctcaaatcgacgggcgtccgtcgtggatgaaaactctgcacaacagcgccgccacctgggtcaatttgttgcccacgtcgttgcagacacttagaagaacggtcgataacatcaaggatcctctgtacagatatttcgagcgagaagtcaattccgcgtctaaattgctgacggacgttttgcacgatcttcacgatgtactttttatctgtcaaggagaaaagaaacaaacgaactaccatcgtacgatgttgtctgaattagttagaggaattattccgaagaactggcatcggtacacaatacccaaaggttgtacagttatgcaatggatcaccgactttagtcagcgcgttaagcaattgcagaacgtatcgcaagtggtctcgtctgcgggtgctaaagaattacagagttttccggtttggttgggaggactcctgaacccggaagcttacataacggctacgagacagtgcgtggcacaagctaacagctggcctctcgaagaactccacttagacgtgactattactgattccaatgatagaaattccattcctcacgactgcttcgctgtcgtcggaatcaaattgcaaggagcccaatgcagaaacaatcaactcctcctaacctcgagcatcatgattgaacttcccatcacactcttccgttgggtgagagtaacgggcgatgagaaattaaaggaagggaaattatctttaccgctttatttgaattcaactagaaccgagcttctgtacactatcgaacttaatattgcagcagggcaagaccctcacagcttctatgaacgtggtgtagctgttttaacttctacttctttaaactaa

SEQ ID NO: 810 - DNA, 2673 bp, Phyllotreta striolata
atgagtcgtcagggccccagcaaacgttacgaatcggattcggattccgatagcgtggacagcgcggaggaggcccgacggcgcgacttgcaggagcgagacgagttcgccaatcggctgaagaagcgcgacgaagaccgcacgcgaaacgtcgtgcagaacttcgacaagaggacctacgaggaggcggcgaagcggctgaagctcgaccacgccggcagggacaaggtgatatcggagcttcgcaagacctcgagatggaagtatttggagaagaggaaggacgataaattgcaggagttagaggcggatatcgtcgacgatgagtacttgttcgaagaggaaatattaacggagagggagaagaaggaacgccagcacaaaaaggagttgttgcaactggcccaggagcatgagaaggcgcgagaattggagcgcatccagcgctaccacatgccgagggacttgggcaaggactcgacggccgattacatcgaagtggacgagctcgaaaaagtcccccaatccgagcagaagaaatgggagaaggaccaaatggcctcggccgtcttcaaattcggcgccaaagatgtcaagaagaccgacgactacgagctgttgctcgaggatcaaatcgatttcatacaagctttacaaatgccgggcagcaacgagaagaaagtcccgaaaatgtccgatgtgcaaatgaagaaactcacaatcgaagaaacgaagaagagcctgccgatttatccgttcaaagacgatttgatcgcagccgttaaggagtaccaagtgttgattataaaaggtgaaaccggttcggggaagaccacgcaaatacctcagtacctccacgaggccggtttcactgcagacggtaagaaaatcggttgcacgcagcctcgtagagtcgccgctatgtcggtagcagccagagtagcacaagaaatggacgtaaaactaggcaacgaggtcggttacgccatcagattcgaagattgcacctccgaaagaaccgtcatcaaatacatgaccgatggtaccttgcacagggaattcctatcggaaccggacttgcaatcctacagcgtgatgattatagacgaagctcacgaacgaacgcttcacaccgatatcctcttcggattggtgaaagacatagcgaggttcaggcccgatttgaagctactgatatcgagcgccacgttggacgttaccaagttttcggagttcttcgacgacgcgccggtgtaccaaatcccgggccggaggtttcccgtggatatttactacacgaaagcccccgaagccgattacgtggacgcctgcgtcgtgtcgatactgcaaattcacgtcacccagccgttgggcgacattttggtgttcctgacgggtcaggacgaaatcgaaacctgccacgagctcctgcaggatcgcgtacgacgattgggttcgaaagtcaaagaactgattatactcccgttgtacgctaacttaccgagtgatatgcaagctaagatattcgagccgaccccgccgggagcgaggaaggtgattctagctacaaacatcgcggagacctcgctaacgatcgataatattatctacgttatcgatccgggtttcgccaagcagaaccacttcaattccagaaccggcatggagagtctgatggtcgtgcctatatctaaagcttcggctaaccagcgagctggaagggccggtagagtggcggccggtaagtgctttaggctgtacacggcctggtcctataagcacgagttagaggaatgtaccgttcccgagatacagaggatcaatttgggaaacgctgtgttgatgttgaaggcgttgggtattaacgatttggtgcatttcgattttttggatccacctccgcacgaaacgctggtgttagctttggaacagttgtacgctttaggtgctttgaatcaccacggggaattgactaaattaggaagaagaatggctgaattaccggtagatccgatgatggccaaaatggtattggcatctgagaaatacaagtgttccgaggaaatcgtcactataggcgcaatgttgtcggtgaacggggccatattttacaggccgaaagataagattatccacgcagatactgccaggaagaatttctatcacatggctggcgatcacttgagtcttctgaacgtttataatcaatggagagactctgattactcgttgcaatggtgttacgaaaatttcattcaacacagatcgatgaaacgagccagagacgtcagagaacagctagtcaatttaatgcagagagtagaaatcgaaatggtgtcaggaatcgatgaaactgacaacattcgcaaggctattacttccggatatttctatcacatagccaggttttcgaaaggaggcagttacaaaacggtgaagcacaatcaaagtgttactatacacccgaacagtgctttgttcgaaacgttgccacggtgggtgttgtaccacgaattagtgttcacgacgaaagagtttatgaggcaagtgatcgaaatcgagagtaagtggctgttggaggtggcgcctcattactacaaggccaaggaattggaagattctactaataaaaaaatgcccaaaaccgtcgggagaagtaaaatgactgattaa

SEQ ID NO: 811 - DNA, 1371 bp, Phyllotreta striolata
atgaaggtagaagaggtaaaaagcaccgtgaaaactcaaagaataagcgcccatactcacataaagggtttgggattagatgaagcgggttttgcaatcccttcggcagccggcctggtcggtcaggagcaggctagagaggctgcaggagtcgtcgtggacatgataaagagcaagaaaatggccggcagggctgtgcttctagctggccctccaggtaccggtaaaacagccattgctctagcgattgcacaagaactgggtaataaagtaccattttgcccaatggttggctcagaagtgtacagcacagaaataaagaaaactgaagtgctcatggagaatttccggcgagctattggtcttagaattagagaaacaaaggaagtctacgaaggagaagttagcgaactgacacccgtcgaaacagaaaacccagcaggaggttatggtaaaactgttagccatgttgtaatcggtttgcgaacagccaagggcagcaagcaattgaaactagatcccagcatatacgaagccctgcaaaaggagaaggtggaagtgggagatgtcatttacattgaagctacaagtggagctgttaaaagacagggaaggtccgatgcttatgccacggaattcgatttggaagccgaggaatatgtacctcttccgaagggagatgtgcacaagaagaaggaagttgtacaggacgttactttgcacgatttggatgctgctaatgcgaaaccgcagggtggtcaagacgtgttatccatgatggggcaactgttgaaaccaaagaaaactgaaattacggataaactcaggaaagaaatcaataaaatcgttgacaaatacattgatcaaggtatcgcggaattggtacctggagttttattcatcgacgaagttcatatgttggatatagaaacattcacttatctccacagagctttggaaagcgctatagcacctattgttatttttgctactaatagaggtcgttgtctcattagaggaaccgatgatgtgttttctccacacggaataccattagatctgctagatagactgctgattatacgcacaattccttacaacaaatccgaaatggaacaaattattaaattgagagctgttacagaaggtttagaaattgagcaggaagcaatctcgagtttgggggaagttgggacaaaggccaccttgagatatgcagttcagcttttgacgccgtcatttttaacggctaaaattaacggaaggagcaacattctccaaagcgacgtggaagaaattggtactctattcctcgatgcgaagtcttcagctaaaatacttaccgagcagaaagataaatttatgacgtag

SEQ ID NO: 812 - DNA, 2202 bp, Phyllotreta striolata
atgacttcgataataaaagtacaagccttatccggcgccaaagatgaatctcccccttgttacctgttacaggttgacgatgttagaattcttttagattgtggttgggatgaaaaatttgatatggaattcataaaagaactaaagaggcatgtacatacaatagatgcagtgttaatttcttacccggataacaatcatttaggagctctaccttatgccgtgggtaaattaggtttaaattgtccaatatacgctactataccagtatacaaaatgggtcagatgtttatgtacgatctctaccaatcccagtacaatatgaaagaattttgcatattttcccttgatgatgtcgatgctacgttcgaaaaggttgttcaattaaaatataaccaaacagttcccttaaaaggtaaaggatatggcataaccgttacaccattacctgccggtcacatgatcggaggaaccatttggaagataatgaaagtaggcgaagaagatattgtatactgcaacgattttaatcacaaaaaagaaaggcatttgaacggttgcgaactaaagaaacttcaaaggccatcgttactcataacagatgcattcaatgctacatatcaacaggccagacgaagggcgagagatgaaaaattaatgacaaatattctccagactttacgaaaccacgggaacgttctgatagctgtagacactgctggtagagtgctggaattggctcacatgttagatcaactgtggagaaacaaggaatcaggacttttggcttattcattggcttttttgaacaatgtcagttataatgtagtcgaatttgccaagtcacaaatagaatggatgagcgataatctaatgagaagttttgaaggagccagaaataatccattccagttcaaatatttgcagctatgccacagtttgggggaactaagcaaagtacccagtccgaaagtggtgctggccagttcgccagatttggagagtggattttcaagggaattgttcttgcagtggtgttctaatccaaataacagtattatattaactacaaggacctcacctggaactttagccagggatttaattgacaacggaggaggaagaaacatagacttgatagtagagcgaagggttaaattagaaggagcagaacttgatgattatgaaaggcgtcaacgatctaaatatgacaaattagaagatgaggaggccgattctgattcagattccgatattgaaatgtcagtcacctctaaaggcaaacatgacattgttatcaaacaagaaggcaaaatatcaacaggattttttaaagtcaccaaaaagatgtaccccatgtatcctttcaaggaagataaaataaagtccgatgaatacggcgaaattgtaaaagcagaggattacaaattagctgaaatttcagccgaaaccgaagataataaagaaaatatagtgattaaaaaagaagaagaggaaataactgaaattactgaacaaccaaccaaatgtataattcttcaacgcaccgttcaagtgagttgtcaagttcagtacatcgatttcgaaggtagatcagacggggaatcgttgatgaagattttaacgcaactgaaaccgagaagagtgattgtggtgcacggaaccgaagaaaatacgtccgttatagaaaaacattgcttggataatttggaagctagagttttcacaccatccagaggcgaaataatcgatgccactagcgaaacgcacatttatcaggtgaggctgacggacgccttggtttcacaactgagttttcagaaagctaaagaagctgaagttgcttggctgggagctcatatagtgctcagagaaagccaagctgatgctaaaaggatgaatttggacaatgaagaaatggaagtggaagaagaagatacgagaatcctaacgcttgagccattgccggaaagtattccgcacgatcctgttttcataaatgaagttaaacttgccgagttcaaacaagttttagggagaaataatataaattctgaattctccggcggcaccttgtggtgttccaatggctcaatagcagtgagaaaggttgagaacggcaaaataatgttggagggttgtatatccgaagattattataaggttaaagaattgttgtacgaacagtacgctattttatag

SEQ ID NO: 813 - DNA, 2289 bp, Phyllotreta striolata
atgcctccgttggaggtaacagcgaataccaacaacgatgaatcggcgcccataaacccagtcgtcggaataatctatcctccgccggaggttagaaatatcgtcgacaaaaccgccagtttcgtcgcgagaaatggacccgaattcgaagcacgtatcagacaaaacgagctcggcaatcccaaattcaacttcctcaatggcggtgatccctatcacgcctactaccaacacaaagtgaaggatttcagagagggaaaaggccacgaaccgactccgggcttgaaccaagccattgcgaaactatcggtgagcgcttccgcacagcaaaagcaacaggagatattgaagcaagtcgagcagcctttcgttccgaaagatccgccggccgaattcgagtttatagcggaccccccgtcgatttcagctttagatttggatatcgttaagcttacggcccaatttgtagcgagaaacggtcgagcttttctaacgcaactgatgaacagagaacagagaaacttccaattcgattttttgagaccgcaacattcgcttttccaatatttcaccaagcttttggaacagtacaccaaggtgctcattccgccgaagagcatggaacaaaggctcagagacgaggcgaaaagcgccaaagccgtactcgagcaggtcaaatacagggccgaatggttgcggtatcaagaacagcaaaaggccaaagaggaggagatactcgaaagagaaagagtggcttacgcgcaaatagactggcacgatttcgtcgttgtcgaaaccgtcgattatcaaccgttcgaaatcggcaatttcccgccgcctacgacccccgaagaggtcggcgcgcgcattctcatccaagagaggatcgaagagggcgaagacatcgaaatgcaattggaaagcgacgaagacgacgatccctccaacgcggacgacggtttgagcgccatgcaggataagacgaaacgcaagggaggcggcgacgacaaccgtctgcaggacatggaagaggacacctccgatgaagacaacgacgacgaatccggtaaaacttcgacttcatcttcgctcatccagccgccgttgccgcccgtgcccgataaagtactcgtcaaaaaatacgatcccaaacaagccgtgaaagtatcgaggccgacagtaggcgacgattatctagtatcgcccatcaccggcgagaagataccggccagtaaagtacaggagcacatgcgcatcgggctgttggacccgcgatgggtcgagcaacgcgacaaacaaatgtccgacaagatgaaccaagacatggtgtacgccgcagggagcgccatcgacgcttcgttgaagttgctggccgaaaggcgtacggatatattcggcgtgggcgacgaggagacggcgatcggtaagaaaatcggcgaggaggacgtgcgcaaggacgagaaagtgacgtgggacgggcacacgagcagcgtggaggcggcgacgagggcggcgcgcgccaacatcaccttggaggagcagatacatcagatacataaagtgaaaggtctccttcccgacgaagagaaggagaagatcggtccgaagaatatcggttcgaagaagattaacatccaaagcgttatcactacgaaaccgccgaatccctctacgcagcaatccaaacagtcgatttcgatgatgcaaacgagcgcccagccgatcatgccggttccggcgcaaccgacgatgatggcgccgcaaccgtccattatgatgatgccggcccctccgatgcccgccatacgaccgccgccgctcatgatggccggtggtgtggcgatgggcggctatccggtgggaccgatgcccggcgggccgccgggtcccggcatgaacatggcccccatgaagcatcccagcgacgggcccagcgaggacgagccgagcaacaagaaattgagaaacgaggattcgttggtgccggagaacgtgtttttgtccagaaatccgagtcaagtgtctatcaaaatttcggtgcctctgatgccggagaaatcggaatggaggctgaagggccaaatggtatcgtggacgttggcgttgacggagtcggtggtgaatctgaaggccaaaatccaggaggaaacgaacatgccgccggccaaacagaagttattcttcgacgggatgttcttcaaggattccaacacgttggcttactacaatgtgacgcaaggagcggtcattcagttgcaaatcaaagaaagaggtggaaggaagaaatga

SEQ ID NO: 814 - DNA, 975 bp, Phyllotreta striolata
atgccgagtacagaggtaacaacgactaaggtaatagtgcacccgctggtgctcctcagcgtagtggaccatttcaatcgaatggggaaaatcggcaatcaaaagcgcgttgtcggtgttctactcggttgctggagggctaaaggagtcttggatgtgtctaacagttttgcagtcccttttgatgaggacgacaaagataaatctgtatggttcttggaccacgactacttggaaaacatgtacggcatgtttaagaaagtcaacgctagagaacgcgtcgttggttggtaccacactggtcctaaattgcaccaaaatgacatcgctattaacgaattaattcgaagatactgccctaattccgtgttggtgattatcgatgcgaaacctaaagatctggggcttcctactgaagcgtaccaagcggtcgaagaagtccacgatgatggctctcccacgtccaaaacatttgaacacgttccgagcgaaataggcgcagaagaagccgaggaagtcggcgtagaacatttattaagagatatcaaagacactacagtgggcactttatctcagaggatcaccaatcagttattaggcctgaaagggttgcatttgcaattgagagacataagagactatttgatgcaagtgggcgataccaaactgcccattaatcatcagatcatctatcaattgcaagacattttcaatttgctgcccgatataaaccaagatgcattcaacaattcgttttatgttaaaaacaacgatcaaatgcttgtagtttatttagcagctctcgttcgatctatcgtcgcattgcacaatctaatcaacaacaaactcaccaacagagacgcagaagaaggcaaaaaggaagagaagaaggacaaggataaggatagcaaagacaaagataaggaaaaaactgacaaagaaaaggaggcgaagaaggacgagaagaaaaaataa

SEQ ID NO: 815 - DNA, 1653 bp, Phyllotreta striolata
atgtttggaggaggacgcgccccgattttagtgttgagccagaatacaaagcgcgagtcgggccgaaaagttcagttggagaacatcaatgccggcaagcaaatcgcagatgtcatcagaacatgtctcggcccacaagccatgttaaaaatgttgatggaccccatggggggcatcgtaatgaccaacgacggcaacgctattctgcgagagatcaccgtgcagcatcctgctgctaaaagtatgatagaaatagccagaacccaagacgaagaggtgggagatggtaccacttctgtaatagtattagctggagaaatgttggcagctgctgaacagttcctcgagcagcaaatccacccgacgatcatcatcagacaatacaggcaggccctcgaagatatggtgcagttcctagaaggacctttgagcgtacctctagatcgaagcgacaaaaacgctattgccgaagtggttaaaggttgtataggaacgaaattcttgagcaagtggtcggatttggccgtcaatatcgctttagatgcggtaaataccgttctattagaagaaaatggccgaactgaggtggatatcaagagatacgccaaagtggaaaagattcccggtggttcggtggaggaatcgaggattttgagaggagtcatgttgaacaaagacgttacccatcctaaaatgaagcgacacattaagaatccgagaatcatccttttggactgcgctttggaatacaagaagggagaatctcaaaccaacgttgaaattagtaccgaaactgattttaccaaactcctcgaattggaagaagagcacgtgaagcgccaatgcgacgagatcatcgccctcaagccggacgtcgtgttcaccgaaaagggagtatccgatatagcccagcacttcctgctgaaggccggcatcaccgccatcaggcgtgtgagaaagtccgacaacaaccgaatcgccagagcttgcggcgccgtcatcgtcaacagaaccgaggaactccaagagtccgacgtgggcaccggggctggtgtgttcgaaatcaaaaaattcggcgacgagtacttctgtttcgtcgacgaatgcaaaaatccaaaggcctgtacgatcctcctgcgaggagccagcaaggatatcctgaacgaaatcgaaaggaacctccaagacgccctgcaagtcgccaggaacatcatactgtcgccgcgtttggtgcccggcggtggggccatcgaaatggccgtggcccaacggttgatgcagaaggccacgcacggtccctacagggcgctcgctcacgctttggaaatcattccgaggacgttggcgcaaaattgcggcgctaataccatcagaacgttgacggctttgagggctaagcacgccaatcacactgacgccgacaaaccgtgcacttggggtatcgacggtgaaaccggggaattggtcgatatgaaagtcaaaggcttgtgggagccgttgtctgtgaaacttcagacctacaaaacggccgtcgagaccgctattctcctgttacgtatcgacgatattgtatcgggatcgaaaaagaagggcgacaaggaggtcccgactcccagccaaatgcaacaacaggaagcccaaggagcggattaa

SEQ ID NO: 816 - DNA, 702 bp, Phyllotreta striolata
atgatgcaaacaggaatacgtccctattatcctgactattccacaattcccgtcgaacgccagattaatccgtacgctgataatggagggagcgtagtagcaattgcaggaaaagatttcgtggttattggtgccgacacgcgtctcagttccggcttttccatttacactagaaaccagaacaagctgtttcctctttctgagacaaccgttttaggatgttcgggctgttggtgcgatactttaacgttgactcgcattttaaagtctcgcatgcaaatgtaccatcaagagcacaacaagaacatgtctacaacggcggctgctcaaatgctttccaccatgttgtactacaagcgatttttcccttattacatatcgaacattctcgttggattggataacgagggaaaaggttgcgtgtacagctacgatcctgtaggacattgcgaaaaagccacttacagagcaggcggttctgcaggggctttgcttcaacccttattggacaatcaaatcgggcagaagaatctacagaagccttcacaagaagatcttactcaggaaaaagccctttctacactgaaagatgttttcatatccgccgcagaaagggatatttacactggtgatagtgtacttattaaaatcataacaaaggatggaactaaagaggaaacttttgatttgaggagagattga

SEQ ID NO: 817 - DNA, 900 bp, Phyllotreta striolata
atgttccaattcggcttcaacatgttcccggacatcccgaggcccttcaacatgacctacaaatgttactcagtggccatgtttccggggaacgaaagacaggacgtcgaacgtggaggaaaaataatcatgccaccctctgcactggaacagctcactcgattaaacatcaactaccccatgttatttaaactagtcaataagaagacgagtcgcacgactcattgcggcgtgttggaattcgtggcggacgaaggaaaggtctaccttccgttatggatgatgcacaatttggtactaaccgaaggcgatttggttcaaatggaaagcgtctcgttgccggtgggcaccttttccaaattccaaccgttaaacccggacttcctcgacataaccaacccgaaggccgtgctggagaattgcctgcggtcctttgcttgtctgacgaccggcgacgtgatagccgtgcgatacaatcaaaaggcgtacgaattgtgcgtgctggaaacgaaacccggcaacgccatcagtataatcgaatgcgatatgaacgtggaattcgccgctcccgtgggctacaaggaacccgagcatgcgaagaaagaagaggaaatgtcggtggatcccgccgacttgatgccggaaccgtcgggattcgtggcttttagaggggccggtaaccgattggacgggaaaaaacgcaaagattcttcgtctaacgacgctccttcggttaaaccggcttacgtccggggaattcccgattacgattatcaaatcggcacgctggacttcatcaggcgtacggtgatgaagccgaaggagaaggatagtagcgatgatggggatgatttcaaggctttcagcggtactgggttcagtttgagaaataggaattag

SEQ ID NO: 818 - DNA, 1623 bp, Phyllotreta striolata
atgtcggccttaccaggagccatcgctttcgacgaatatgggagaccatttattattttaagagaccaagacaagcaaaaacgattgaccggaatcgatgccctgaagtcgcacattttagccgcgagtcaaattgctcacactgttcgcacctctttggggcccaaaggcctagacaagatgatggtctcctctgatggagaagttactgtaactaatgacggagctactattttgaagatgatggatgttgaacatgaagtagctaaattgttagttcaactatctcaatcacaggatgatgaaataggggatggaactactggagtagtagtactagcaggggctctgctggaacaagccggcgccctcttggaccgtggaatccatccgataagaatagccgatggcttcgaattggcatgccaaacggctgtggatcatctggagaaaatcgctgaactgtttccagtttccgctgaaaacaccgagccccttgtgaaagttgcgatgaccactttaggctcgaaaataattaacaagtgtcacaggcaaatggccgaaatcgccgtcaatggcgtattagctgtggcggatcttgaacaaaaggatgtcaactttgaactcattaaagtagaaggaaaggttggtggtaaattggaagacacgacattagtgaaaggtgtcgttatagataaaacaatgtctcatcctcaaatgccgaaggaacttaagaatgttaaattggcaatcctcacctgcccgtttgaacctcccaaacccaagaccaagcataagttggatgtcaccagcgtagaagactacaaagaactaagattgtacgaacaagaaaaattcaaggaaattgttggcttagtcaaaaaagctggagctaccttggccatttgccaatggggattcgacgatgaagctaaccatttgctgttgcagcaggagttgcctgctatacgatgggttggtggtccagaaatagagctgatagccatcgcaaccggaggaagaatagttccacgattcgaggaacttagccctgaaaaactcggctctgccggtttggtgcgcgagatatcgtttggaactaccaaagataagatgatggtgattgaagaatgctcgaattcccgtgccgttaccattcttgtcagaggcggtaatcaaatgttggttgatgaagctaagaggagtttacacgatgctttgtgcgttgtgaggagtctcattcaggaaccaagagtcgtgtacggaggaggtgcagctgaaatagcttgcagtttagctgtggcagctcaagctgatcagttggcttctttggaacaatacgcttatcgggcatttgctgaagcgttggaaagcattccgctggctctagctgagaattccggtttctccgccatccatactttgggagaaatcaaggcaaagcaagctgcatcgggagatccggcacttggcgtcgattgcatgaatattggcaacataaacatgagagaacagcatgttacagaatctctgcgatctaagaggcaacaattgttgttggctacgcaattagtgaaaatgattctgaagattgacgatgtacgtcaacccggctctggctaa

SEQ ID NO: 819 - DNA, 342 bp, Phyllotreta striolata
atggccactgctatggacgtcgattccgaagaaattgaattaccaacttcaagcagttcgaaaggcgagaaaaaacgttttgaagtaaaaaagtggaatgctgtagctctttgggcttgggatattgttgttgataactgcgctatatgtcgaaaccacataatggacttgtgcattgagtgccaggcaaatcaggcctctgcaactagtgaggaatgcactgtagcttggggagtatgcaaccacgcatttcactttcactgtatttcaagatggttaaaaactaggcaagtatgccctttggacaatagagaatgggaattccaaaaatatggtcactaa

SEQ ID NO: 820 - DNA, 1605 bp, Phyllotreta striolata
atggtgtcattaaacccggtgaggattctcaaacaggaggccgaggaggaacgggcggaactagcgcgtttgagcagcttcgtcggcgccattgccatcggagatttggttaggagtaccttggggcccaaaggtatggataaaattctagtgtcgagcggcagaaacagcggaatggtagaagtcaccaacgacggagctactatattaaaatccgtgggcgtcgataaccctgctgcgaaaatcctcgtcaacatgtcaaaggtacaagatgacgaagtaggcgatggtaccacatcagtaactgtattagcttcggaattgttaaaagaagccgaacgcctaattgagcaaaagattcacccgcagactattatagcgggttggagaaaatccgtggatatcgcgagaaaggcgcttttggacgcatcgaaagacaacagcgccaacttagaaacgttcagagaagatctgatgaacatcgcccgaaccacattgagctcgaaaattctatctcaacacaaagagcactttgcgaagctcgcagtcgacgccgtgctgagattgaagggatccggcgatttgcaagccattcaactgatcaaaaaaaccggcggtacgttgcaggattcgttcctcgacgaaggattcctgctggacaagaaacccggcgtgcaccagcccaagcgagtcgagaacgctaaaatcctgatcgccaacaccccgatggacacagataaaatcaaagtgtttggctcgcacatcaaagtcgactcgatggccaaaatcgccgaattggagtccgccgagaaggataaaatgaaagacaaagtcaacaagatcctcaagcacaacgccaacgtgttcatcaaccggcaactcatctacaactacccggaacagttgttcgccgatgccggcgtgatggccattgaacacgccgatttcgatggcatcgaaagactggcgctggtcaccggaggagaaatagtctcgacgttcgatcacccggagctcgtcaaactgggaacttgcgacgtgattgaacaaatgatgataggagaagatacgctgctgcgtttcagcggagtagctttgggggaggcttgcacgatagtcattcgaggggccacccagcagatcatcgacgaagcggatcgctccctgcacgacgctctttgcgtactagccgcaacggtgaaagaaagcagaatcgtattcggaggcggttgcagcgaaacccttatggctacggccgtggccaaagcggccgttaataccgctggaaaggaagcactcgccatggacgccttcgctagagctttgttacagctaccaaccatcatcgctgataatgccggttatgattccgctcaattaatcagcgaactcaaggcagcccacaacagcggcctcaacactatgggtttgaacatggagaagggcgagttgggcgatatgcgagcgctgggcatcaccgaatcattcgttgtcaaacgacaggtgttgatatcggccggcgaagctgctgaaatgattcttcgggtcgataatatcatcagggctgcgccgagaaagcgtaccgaagacaggggaatgtgttag

SEQ ID NO: 821 - DNA, 858 bp, Phyllotreta striolata
accatgtttcgcaaccaatacgacagcgacgtgaccgtctggagcccccaagggcgcctccaccaagtcgagtacgccatggaggccgtcaatctcggctcggccaccgtcgggctgaaaagcgccagtcacgccgttataatagcgttgaaaagggcctcgtccgaactgtccgcctatcagaagaagatcatccagatcgacgatcacatcggcatcaccatctccggtttgacggcggacgcgagaatactgagcagatatatgaggaacgaatgtttgaattacaagtactcgatggattcgtacatgcctttgaacaggctgatcaacatcttaggcataaaaatgcaacattgcacccaacgctacgaccgtagaccgttcggcgtcggtctactcgtcgccggctacgacgacgacaccggcgcccacgtctaccagacctgtccctcggcgaatttctacgattgcaaggccatgtcgatcggcgcgcgatcgcaaagcgcccgaacctacttggagaaaaagctcgacgagctgccctccatggctttggaggatctcatcaagcacggcttgagagctttgagagatactctcccacccgaagtggatttgaccacgaaaaacgtttcgatcggttacgtgggaaaagggacgagcttcaagatattggaggaggaggagacggcgccgtttttggcgttgatcgaaggggaggaacgtagagggggtagcggtggtggtgggggtgctgtggagggggcggctgatcctttgagggaatcgggggacgaggggggaccccccaacagggatcctgtcccacaggtagcgatggatacaacggagtag

SEQ ID NO: 822 - DNA, 2547 bp, Phyllotreta striolata
atggttttaaagccaggaaataaccaagaacctatggaaataaccttcaatgacgatgatctgccttatgaggaagaaattttacggaatccctactcggtgaagcactggcttcgatatatagaccacaaaaaagcggctcccaataacgaaatgaacataatcttcgaaagggcgctcaaggagttaccgggttcgtacaaattgtggtacaattacctgcggaccaggaggaatcaaattaaaagcaaatgcatcaccgatccgggtttcgaagaggtaaacaacgccttcgagcgttcgttggtgttcatgcacaagatgccccgaatttggatggattattgcaccttcctcaccgaccagtgtaaaataacgagaacccgaaaggtcttcgacagggcccttcgagccttacccgttacgcagcacaacagaatatggcctttgtatttgaagttcgtacagaaacacgatatatccgaaactgccgttcgagttttcagaaggtacatgaaattgtgtccggaaaacgccgaagagtacatcgattacttagcgtcggtggaacgattagacgaagccgctataatcacggctaaaatagtaaacgacgataacttcgtgtcgcaacagggcaaatcgaagcaccaactttggaacgagctctgcgagttgatctccaaaaatccggaaaaagtccgctcgctaaacgtcgacgccatcatcagaggcggcctgcgccggtacaccgaccaattgggccacctgtggaactccttggccaattactacgttcgcagcggtttattcgagcgggctagggacatctacgaagaggccattcaaaccgttacgaccgtcagagatttcacacaagtgttcgatgcttatgcgcaattcgaagagttaagtctgagcaaacggatggaagaagtggccggaaaacaaaaccccagcgaggacgacgatacggaattagagctgcgtttggcgcgattcgagtacctcatggaacgccgattgttgctcttaaactctgtattgctccgccagaatccgcacaacgtgcaagagtggcacaagcgcgtacagctctacgaaggcaaaccgcacgagatcatcaacacgtacaccgaagccgtgcaaacggtggatcccaaactggccgtgggcaagctgcacacgctgtgggtggaattcgccaagttctacgagggcaacgatcaaatcgaagaggcccggctgatattcgagaaggcctcgcaggtgccctacgtgaaagtcgacgatctcgcgaccgtgtggtgcgaatggaccgaaatggaaatccgcaacgaaaactacgacgaagctttgaagctcatgcaaagggcgacggtgatgccgagccggaaagtggcctatcacgacgacacggaaaccgtccaaagcaggctgtacaagtccctcaaagtgtggtcgatgtacgccgatttggaggagagcttcggcagcttcaaatcctgcaaggccatctacgatcgaatcgtcgagctgaagatcgccacgccgcagataatcatcaactacggcgtgttcctcgaggagaacaattacttcgaggaggcgttcagggcgtacgagaagggcatatcgctgttcaagtggcccaacgtctacgacatatggaacacctatttgaccaagtttttgaaacgctacggcggcggtaaattggagagggcgcgcgatctgttcgagcaatgcctcgacggttgtccgccgcaattcgccaaacacctctatttgttgtacgccaaattggaagaggagcacggaatggcccggcacgccatggctgtatacgaaagatccacgaaggctgtaccggagaacgagatgttcgacattttcaacatatacatcaaacgagccgccgagatatacgggataccgaaaacgaggcagatctacgagaaagccatcgaggtgcttccggaggataaaacgagggagatgtgcctgagattcgccgatatggaaacgaaattaggcgagatcgatcgagcgagggcgatatacgcgcactgcagccaaatctgcgatccgcgcgtcaccgccgaattctggcaaatctggaaggagttcgaggtgcggcacggcaacgaggacaccatgagggagatgttgcggatcaagcgcagcgtccaggcggtctacaacacacaggtgaacatgatgtcggcgcagatgctgagctcggcgggcagctcgagcggcaccgtggccgatttggcgccgggcgtgaaggacgggatgcggctgttggaggcgaaggcggccgagatggcgggctcggcggctcaaaagggcaatatcatgttcgtcagaggggagacccaaggggataataaggataaggtggtgaatcctgatgaaatcgatataggaagcgatgatgaggaggaagaggacgaggaggagataccgttggagaaacagaacgtgccgtctgaggtgtttgggagtctcaagaaaaaagggaacgatgaagatgaggattaa

SEQ ID NO: 823 - DNA, 1116 bp, Phyllotreta striolata
atggcgaacggaccgatagctgaaagaaatagagacgctacgatatacgtcggtggtttagacgataaagtatcagaatccttactatgggaactcttcgtacaagcggggccattagtgaacgtacatatgcccaaagatcgcgtcaccatgatgcaccagggctacggtttcgtcgaattcatgggcgaagaggacgccgactacgctataaaaataatgaacatgataaaattgtacgggaaacccataagagtcaacaaggcttccgctcaccaaaagaacttggacgtcggcgcgaacattttcatagggaacttggatccagaagtcgatgagaaactcttgtacgatacgttttcggccttcggtgtaatattacaaacgcccaagataatgagagatccggagactggaaattccaaaggtttcgcgttcataaacttcgccagtttcgaagcctccgatgcctccatcgaggcgatgaacggccagtacctttgcaatcgaccgatatccgtctcttacgcgttcaagaaggattccaagggcgagagacacggctcggcggccgagcgattattggccgcccagaatccattatcgcaggccgacaggccccatcagttgttcgcagacgccccaccgataggaatgatgccgatgagcatggcgccgccacctccgcctctaatcaccggcatgatgcctcccccaccgcctacgccgggcggaatgccgccgcctcctccgccggttccgccgccgagttccttccccgcgggcatcccgccgccgccgttaccgccctctcaaccgccgctgccgccgggcgcgccgcccgcgatggcgccggtgccgggcggcgccgccagaccgccgccgccgcctccgtgggccggtgcggcggccaacgtgccgatgccgccgggaccgcctgcggcgaacgcgggcggcggcttcgggggaatgctgccgcctccgccgccgcccggcgggaggcctttaccgcctaattggagaccgccgcctccgccgccgccgaatttcggcggtgccaggccgcctttcccgccgcgggggccgcctcctccgccgccgacgttcgaagggtaa

SEQ ID NO: 824 - DNA, 774 bp, Phyllotreta striolata
atgggtcgtgttattcgagcgcaacgtaaaggtgcgggatccgtattcaaatcccacactaagaggaggaaaggggcacccaagctccgttacttagatttctccgaaaggcatgggtacatcaagggtgtcgtgaaagacatcatccacgaccccggtcgtggcgcccccttggctctggtgcacttcagggacccctacaagttccaaactaggaaggaaatattcattgctcccgagggaatgtacacagggcaatttttgtactgtggaaagaaagctaacctccaaattggaaatgtgttgcctgtaggaactatgcccgaaggtacaatcgtctgtaatttggaagaaaaaactggtgaccgtggccgattggctcgagcttccggtaactacgccaccgtgattgcccacaatcacgacacaaagaaaactagggttaaattgccatcgggagccaagaaagttatcccgagcaacaacagagctatggtcggtatcgttgccggaggtggtcgtatcgacaagcccatcctgaaggccggtcgcgcctaccacaagtacaaggtgaagcgtaactgctggccgaaggtgcgtggtgttgccatgaaccccgtcgagcatcctcacggaggtggtaaccatcaacacattggtaaggcctccaccgttaagagaggaacgtccgctggtcgtaaggtcggtcttattgctgcgcgtaggaccggtcgtatcagaggaggtaaggtcgaaaataagaaggaagattaa

SEQ ID NO: 825 - DNA, 411 bp, Phyllotreta striolata
atggctcgtacgaagcagacagcgcgtaaatcgacgggaggtaaagcgccccgtaaacaactggccaccaaagccgcgaggaaatccgccccatcgaccggaggtgtgaaaaaaccccatcgttaccgtcccggtacagtcgccctgagagaaatcaggagataccagaaatccaccgaattgctcatcagaaaactgcctttccaacgattagtcagagaaatcgcccaggacttcaagacagatctccgtttccagtctgcggctatcggtgctctacaagaagcgagcgaagcatacttggtgggtctgttcgaagacacgaacttgtgcgccattcacgccaagagagtcacaatcatgcctaaagacatccagttagctcgccggatcagaggagagcgagcttag

SEQ ID NO: 826 - DNA, 1593 bp, Phyllotreta striolata
atggcaataagtttattgaatccgaaagccgaagtggcgagagccgctcaagcgttggccgttaacataacagccgccaaaggtatttccgaagtgatgaaaacgaatttgggaccgaagggtacaatgaaaatgttggtctccggcgccggcgacattaaaataacgaaagacggcaacgtccttttgcacgaaatgcaaatccaacaccctacggcctcgttgatagcaagagcctcgacagcccaagacgatatgaccggagacggaaccacatcgacagtcctagtaatcggggagctcctcaaacaagccgacatttacatcgccgaaggtctgcaccccagaaccctcaccgaaggcttcgacaaagccagagccaaagccctcgaagtactggagaagctgaaaatacccatcgaaatcaacaaggaatcgttaaccgacgtttgtcgaacgagcttaagaacgaaactgcaccaaaatttggctgacttactgaccgacgtgtgcgtcgaggccatcctcgccatcaagcaatcggacaagccggtcgatttgcacatggtggagctgatggagatgcagcacaagaccgaaaccgatacgcaactggtcaaagggctggtgctcgaccacggcgcccgccatcccgacatgcccaagagcctgcggaactgctacattctcacctgcaacgtcagcatggagtacgagaagagcgaagtcaattcgggcttcttctacaaaaccgccgaggaaagggagaagctcgtgctggccgagcgcgatttcatcgagcagcgcgtcaagaaggtgatcgaattgaagaagaccctttgcaagggcaacgacaagtcgtttgtcgtgataaaccagaagggtatcgatcccatgagcttggacatgctggccaaagagggcatcgtggccctgcgaagggccaagaggcgtaacatggaacgattggctctggcctgcggtggaatagccgtgaacagtttcgatgatttacaagaatctcatctcggttacgccgggcacgtgtacgagcacgtattgggcgagaacaaatacacgttcgtcgaggactgcaaagtgccccaatcggtgacgattctaatgaagggccccaacaagcacactctgttgcagatcaaagacgccgtcagagacggtttaagggctatcaataacgccatcgacgacaaggctcttgttccgggcggcggggctttggaagtggccgtaaacaagtcgctgctggcgtacaaggacgagatcaagggcaaagcccgattgggcgtcgccgcctacgccgaagccatgctggtgattcccaaaacgctggccgttaattccggtttcgatgcgcaggataccatcgtgaagctgcaggaggaggctcggctcagttcggaaccgatcgggctcgatttgacgtcgggcgaaccgatcaatcctaaagacgcgggaatctacgacaactacgtggtgaagaagcagattatcaattcgtgttcgataatcgccagcaacttgttgctcgtagacgagattatgagggccggtatgagcagcttgaagggctaa

SEQ ID NO: 827 - DNA, 3126 bp, Phyllotreta striolata
atgtctagtgctggaatcgcagacagccccatcgatcctccagcaaaaaagcgtaagcttgactcgaaaatctgcagcctcgacatggcgaataacgaagcttcgggatcctcgaacgccggcgaaatcgacgagggactctactcgagacagctgtacgtgttgggacacgatgccatgcgacgcatggccaccagtgatgtgctcgtctccggtctgggcggtttgggtgtcgaaatagctaaaaatgtgatcttaggcggcgtcaaatcagtgactctccacgacgatgctctgtgcaccgtgcgggatttgtcatcgcagttctacctcaccgacgccgacgtggggaaaaatcgcgcggaggcctgctgcaagcacctctccgagctcaacacctacgtcccgacgaagccctacacgggccccctcgacgagaagatcatcctcaagtaccgggtggtggtgttgactaatagcactcgtgccgagcagctccgtatcagcgagataactcacaacaacgatatcgctttgataatcgccgataccaaaggtctgttcgctcaagtcttctgcgacttcggcaaggccttctccgtggtggacgtcaacggggaaccccccgtctccaccatgatagccgatatatcgaacgatacagagagcgtggtaacttgcatcgacgacaccaggcatggaatggaggaaggcgactacgtcaccttctccgagatcttaggcatgaccgaattgaacaactgcaagcccatcaaaatcaaagtgttgggcccgtacacgttcagcatcggcgacaccaccaaattctccaagtacgtccgaggcggtatcgtaacgcaagtgaagatgcccaaggaggtgcacttcaagccgctgaaggagtcgctgcagaatcccgaattcgtggtgaccgatttcgccaagttcgatcaccccatccaattgcacctcgccttctccacgctgcacaagttcgtggagaagaccggccggttgccgaagccctggaacaaggacgacgccgccgagtttatcgccttggcgaaatccttggcggtgaacggttccaccgacaacgaggtcaacaccgatatactcaacgttttctccaagtgttgctcgggcgatttgaatcccatcaacgccacgatcggaggcatcgtggcgcaggaggtcatgaaagcctgctcggggaagttctatcccatctaccaatggttgtatttcgatgccatcgaatgcctgccccaagacaaggacgagatcacagaggaactggccgctcccgttgatagtcgatacgacggacagatcgctgtgttcggtaaagatttccagaagcgattaggtgaattgaaatatttcattgtgggcgccggagcgatcggttgcgaattattgaagaacttcgccatgatgggattgggaacgcaaggcggtcaaatcaccgtaaccgatatggatttgatcgaaaagtcgaatttaaacaggcaatttttattcagaccccacaacgttcaacaacccaaatccgctaccgctgctaaggtaattaagaagatgaatcccgacgttaacatagtggcccacgagaaccgagtgggccccgaaacggaaaacgtctacaacgacgagttcttcgaggtcctcgacggcgtggccaacgccctggacaacgtcgacgcgcgaatatacatggacagacggtgcgtctactatcgcaagcctctcctcgaatcgggcactttgggcaccaaaggcaacacccaagtagtggtaccgttcctgtcggagtcgtacagctcgtcgcaggacccgcccgagaagagcataccgatttgcacgctgaagaacttccccaacgccatcgagcacacgttgcaatgggcccgggacaacttcgagggtttgttcaggcagaacgccgagaacgcgtcgcagtacctccgagatccggatttcatcgagcgcaccgtcaaactgccgggcgtccagccgctggaggtgctggaatcggtgaaggcggcgttgatcgacgaaagaccgaaggattacgacgattgcctggcgtgggcgcgcctgcattgggaggaccaatacgccaatcagatcaagcagctgttgttcaatttcccgcccgatcaactcaccagcaccggccagttgttctggtcggggccgaagaggtgtccggatccgctcgtgttcgacatcaacgaggatttgcacgtggattacgtcatagccgcggctaatttgaaagctcaagtttacggtatacccaccaataggaatagatgttatgccaaacaagtcgtcaccggcatcgaggtgccggcgtttgtgcccaaatcgggcgtgaaaatcgccgtgaccgactcgcagatggccatgaacggtaacaacgtcgacttggatcggatcaatcaaatcaagcaggaattgccttcgatggaggagctgagcgatctgaagctgacgccgttggaattcgaaaaggacgacgatgccaatttccacatggacttcatcgtggcggcctcgaatttgcgagcggccaactacaagattcctctggccgatcgacacaaatctaagttaatcgctggtaaaatcatcccggcgatagctactactacttcggtggtggccggtttggtttgtttggaattgtacaaactggcgaggagtatcaagagtttgacgccgtttaagaacggcttcgtgaatttagcgttgccgtttttcggattctccgagcccatcgcggcgcctaaaatggagtactgcggtaaccagtggaccttgtgggatagattcgaggtgcaaggagagatgacgctcgccgagtttctggagtatttcaaggagaagcacggtttggagattacgatgctgtcccaaggggtgtgcatgctgtactcgttcttcatgcctaaagccaaagctcaagaaaggttaggactgacgatgtctgaggtggtgaggagagtgtcgaagaagaagattgagcctcacgttagagcgttggtttttgagttgtgctgcaacgacgccgacggcgaggacgtggaggttccttacgttaaatacaacttgtattga

SEQ ID NO: 828 - DNA, 1029 bp, Phyllotreta striolata
ctttgccaagcgaaaagtggtatgggtaaaacggcggtgtttgtgctagccaccctacagcaactagaacccaccgaaaacgtcgtttacgttctcgtcatgtgccatacgcgagaattggccttccaaatcagcaaagaatacgaacgtttcagcaagtacatgtccaacatcaaggtcggcgtgttcttcgggggcctgcccatccaaaaagacgaagaagtattaaaaaacagctgtccgcacatcgtcgtcggaacgcccggccgcatcttggccctcgtcagatcgaagaaactcaatctcaagcacatcaaacactttattctcgacgaatgcgataaaatgttggagctactagacatgagacgcgacgttcaagaaatatacagaaatacaccgcacgaaaaacaagtaatgatgttcagtgcgacgctcagcaaagaaattcggccagtttgcaagaaattcatgcaagatcccatggaagtgtatgttgacgatgaggcgaaattgacgttacacggtctacaacaacattatgttaagcttaaagagaacgaaaagaataaaaaattatttgagttacttgatgtgttggagtttaatcaggtggtgatatttgtaaaatccgtgcagagatgtgtagcgttggcgcaacttttgacggaacaaaatttcccagcaattggaatacaccgaggaatggagcaaaaagaacgattatccagatacgaacaattcaaagattttcaaaagagaatattggtagccactaatcttttcggtcgtggtatggatatcgagagagtgaatattgttttcaactatgatatgccggaagattcggacacttaccttcaccgagtggctcgagcaggtcgtttcggtacaaagggtttggccattaccttcgtttccgaagaaggagatgccaagatattgaacgaagtacaagacagattcgatgttaacattaccgaattacctgatgaaattgatttgagttcatacattgagggacgatag

SEQ ID NO: 829 - DNA, 1572 bp, Phyllotreta striolata
cccgcaggtatggaagccggagtgaatgtcatttgtcatcattacacagcgaaaaacaatttttcaacaaccaattcttgttttccaaatattcgaatgaaaatgggcgtagaaaccgacgttgaaatgaaaaatgcagacagtcccgcaggtatggaagccggagacagcaaacgggacatcgacttgcaaagcgtcctggaaattcgcgaacatgccaggcagatcgagaaggcagtgagcagcaaagaaaaccgcttcatattgagagttttacgctgcttacctaacaccagaaggaaactaaacggaacagtcctcagaagccttatcaatcaaatgtaccccgtcgccgaaagggacgtgctgttcggcctcagcgaggaatctaccagtgacgtagacgctacacagtcgagggccagatcagccactaaaacgcctcttcccgaagtagatgcttacattcacttactacttttagttcgactgatcgataccaataaactagctgaagccgagcggtgttcgaacataatcatgaacaaaatcaccagccagaaccgacgaaccatcgaccacatagcagctaaatgttacttctaccattcgagagtggccgagctcaccgacaagctcgattctatccggagtttcctccactcccgtctacgaacagccaccctgcgaaacgacttcgaaggccaagccgtgctgattaactgcttgctgaggaattacctgcactactcgctgtacgatcaagccgataaattggtgaacaaatgcgtctatcccgaaacggccagtaacaacgaatgggcgaggtatttgtactacttgggccggatcaaagccgcccggttggagtacagcgttgcgcacaaacacctaattcaagcgatgagaaaagcgcctcaaaacgctgcgatgggttttcgtcaaacggtgcagaaactgaccatcgttgtggagttactgctgggggatataccagaaaggcaggtcttcaggcaggccaatatgaggcactcattggctccttacttccaattaacccaggcggttagaatggggaacttgcaccggttcggagaagtgttggagaactttgggccccagtttagacaggatcatacgttcactttaatactaaggcttcgtcataacgttataaaaacagctataagatcaatcgggttgtcttattcgaggatatccccgcaagatatagccaagaaactcggcctggattcggcggaagatgcggaatttatcgttgctaaagctattcgggatggcgtaatcgaggctatcttggaccctcaaggggggtacatgcgaagcaaggagagcaccgatatttattgcactaaggaaccgcaactcgccttccatcagaggatatcgttttgcttggacctgcacaatcaaagcgtgaaggccatgaggtatcctccgaaagcgtacgggaaagaattggaatctgccgaagagagaagagaaagggagcagcaagatttggagctggcgaaagaaatggccgaagaagatgacgatggttttccttaa

SEQ ID NO: 830 - DNA, 1689 bp, Phyllotreta striolata
atggcttccagccatcaagcccttccagtatcggccatcctgaaatccaaaagcgaagtcgaggatgagcccaagaagaagtccagggaggattggcgtaaggccaaagagctagaggaggctcgaaaagccggtacagctccggcggcggtagacgaggaaggtaaagacatcaatccgcacattccgcagtacatatctacagctccctggtactacggaacgtccggccccacgttgaagcatcagagaccccaggatgagaaacataaggagtattcggatttgaacgattggtacaagcgaggcgtggatacttcgaagatcgtaacaaagtatcgaaaaggcgcttgcgaaaactgcggagccctgactcacgtaaggagggattgcatggacagaccccgtaaagtcggagctaaatattccggcgcgaatatagcgcctgatgagtatatccaaaaaaatttatcactgagtttcgacggtaaaagggatagatggagtggttacgatccctctgagcacaagacggttatcgaggaattccagaaagtggaggaagccaaacggcaactgaaatcggataaattgaatgcgaacgaggagtccgacgacgaagaaaaagacgaggacaaatacgtggatgaagtggacatgcccggaacgaaagtagacagcaaacaaagaataacggtcaggaatttgcgtatacgagaagatacggctaaatacctgagaaatttggatcctaactcggcgtactacgaccccaaaaccagatcgatgagggaagatccgaatcccggaaacgacgccacataccacggggagaattttgttcggttttccggagacactacgaaccacgcgagagctcagctgtttgcatgggaagcgcacggtaaaggagtagacgttcatttgctcgcagaacccacgaaattggaattgttgaagaaagaatacgagaaaaagaaagacgaggttaagtcgaacattcagggaacggttttagagaaatatggaggtgaggagtacctcgaagcgcctccgaagagtttactgttggctcaaaccgaaaactacgttgaatattcgagatcgggtaaagttattaaaggcgctgaaaaagaagttattagatcgaaatacgaagaagatgtgtatattaataatcatacgtctgtatggggttcttattggcgcggaggacaatggggttatcgatgttgctattcgtttattaagaattcttattgtttgggagaagcaggaaaatcagttaacgctcaacctatggcagatataaaaactaatgatgagcctaaagaggaacaacatcatgaagatgaagttaaagaaaagaacgaagcagtggataaagaaagcgaagaatcagattctagtagttcgtcagaagaggaaaaatctaaagcgaaatcgaagaaaaaattaaaaaagaagatgaagaagcagaagaagaagcaaaagaaaaaggacaaggaaaaggaaaaggaggttaaaatgtcggcgtcgattaaagatatagacgaagacgtgattatagacgatagaaagcggccttacaacagcatgttcgaggcgaagaaacccacagaagaacaaatggaggagtactacaagaagaggcgaagggacgaagatccgatgagccaattcatgtga

SEQ ID NO: 831 - DNA, 627 bp, Phyllotreta striolata
atgggtattagccgagatcattggcataaacgaagggccaccggaggcaagaggaagcctcttcgtaagaagaggaagttcgaattaggtcgcccggcggctaacaccaaactaggaaccagaaggatccactatgttcgtacaaggggtggcaacttgaagtaccgcgccctaagattagacaccggaaacttctcttggggaagcgaaggaactgcccgtcaaacgcgtattatcgatgtcgtttacaacgctagtaataacgaattggtccgtaccaagacattggtaaagaatgctattgttgtcgttgacgctaccccgttcaggcaatggtacgaaaaccactacatcttaccattgggacgcaagaagggtgccaaaatgacgcccgaagaggaggagatattcaataagaaacgtagcaaaaaagtacagaagaagtacgaaactaggcaaaaaaccgctaaagtagagcctgcgattgaagaacagttccacactggaagattgttggcatgcctagcatctagacctggacaatgcggcagggccgacggttatgtcctcgaaggaaaggaacttgaattctacatgcgtaaaattaagtctaagaaagctaaataa

SEQ ID NO: 832 - DNA, 936 bp, Phyllotreta striolata
atggatagattgcttcgtcttggaggcggtatgccgggtttaacccaagcaccgccgccttccgacgccccggtggtggacacagccgagcaggtctacatttcctccctagccctactaaaaatgctgaaacacggcagggccggcgtacccatggaagtcatggggcttatgttaggtgagttcgtggatgattacactgtgagagtcatagacgtgttcgctatgccccagacgggtaccggagtgagcgtagaagctgtggatcccgtattccaagcgaaaatgttagatatgctacgacagaccgggcgaccagaaatggttgtcggttggtaccattcccatccgggtttcggctgttggttgtcgggcgtcgacataaacacccaacagagcttcgaggcgctctccgagagggcggtagccgtagtcgtagatccgattcaatccgttaaaggaaaggtcgtcatcgatgcctttaggttaatcaatcccaatatgatggtattgggacaggaaccccgtcagacgacctcgaatttggggcatttgcagaaaccgtccgtgcaggcgctgattcacggtttaaatcgccactactactccataagcatcaattacaggaagaacgagctggagcagaagatgctgctcaatttgcacaagaaatcgtggatggacggtttgactctggcggattattcggagaattgcagcgtgaacgagaagaccgtggccgatatgctggaactggccaagaattacaacaaggccttggaggaagaggagaaaatgactccggaacaactcgctatcaagaacgtgggtaaacaagatcccaagaggcatttagaggagaaagtcgatatattgatgaccaacaatatcgtacaatgtttgggcgccatgttagatactattgtgtttaaataa

SEQ ID NO: 833 - DNA, 1158 bp, Phyllotreta striolata
atgactgtaattaataagatggaggtcgatggacctctcaagggtgaagggttcaggtcctactacattaccaaaatagaagaattgcaactaatcgttgctgaaaaaagccagaaccttagaagattacaagcccaaaggaacgaactcaatgccaaagttcgcatgcttagagaggaactaatgctccttcaagaacaaggaagctacgtaggagaagtagtcaagcccatggacaagaagaaagtgctcgtgaaagtccacccggagggaaaattcgtggtcgacatcgacaaaaacatcgacatcaacgacgtcacgccgaattgtcgagtcgcccttcgaaatgaatcctacactttgcacaagatcctacccaacaaggtggatcctttggtgtcccttatgatggtcgaaaaagtaccggattccacttacgaaatggtcggcggtctggataagcaaatcaaagagatcaaagaggtgattgaattgcccgtgaagcatcccgagctgttcgatgccttgggcatcgcccagcccaagggcgtgttgttgtacgggccgccgggaaccggtaaaactcttctggccagagccgtggctcaccacacggaatgtacctttatcagagtatcgggttcggagttggtgcaaaaattcatcggtgaaggttctcgaatggtcagagaactgttcgtgatggccagagagcacgccccgtcgatcattttcatggatgaaatcgattctatcggatcctcgcgaatcgaatcaggttccggtggcgactcggaggttcaaaggactatgttggagttgctgaaccagctcgacgggttcgaggccacgaagaacattaaggtgataatggcaacgaacagaatcgacattttggatccggctttgctgaggcccggcagaatcgacaggaaaatcgagttcccgccaccgaacgaggaagctcgattggacatcctgaagattcactcgaggaaaatgaatttgaccagagggattaatttgaggaagatcgcggaattgatgccgggcgctagcggtgcagaagtgaagggagtgtgtactgaggctggtatgtacgccctaagggagagaagggtgcatgtaacacaagaggatttcgaaatggctgttgcc

SEQ ID NO: 834 - DNA, 600 bp, Phyllotreta striolata
atggtaaaattatattgcatcagtattctctacaaagatactacatacgctacgtggttgaagtccgctttcgatttacaaagtttcagttttttccaaagagggtctgtacaggagtttatgtcattcttttgtaagactattgtggaaaggaccataccatcatcgagacaatccgtcaaagaaggagaatacatgtgtcatgtttatgtaagacatgataacttagctggtgttgtaatatcagaccacgaatatccctccagggtatcgcatacgctgattacgaaaattttggacgaattcgctgctaaaatacccgctgtgaattggcctaccttgcaggagagagatgtcacgtttccacagctaaacacttaccttaccaaataccagaaccccaaggaagccgatgcaatgactaaaatacaggaggaccttgacgaaaccaagattattctgcataacacgattcaagcagtcctggaaagaggcgagaaactggacgacttggtaaataaatcagagggcttaagtatacagtccaaagctttttataagactgcaagaaaaacaaacagttgctgcagtttcacttaa

SEQ ID NO: 835 - DNA, 729 bp, Phyllotreta striolata
atgtttctaacgcgaagcgaatacgacagaggtgttaacacattttcgcccgaaggcagattatttcaagtggaatatgccatcgaagccatcaaattgggatccacagctatcggaatatgcacgagcgaaggggtcgtgctagcagtcgaaaagcgtattacttctcctttaatggagcctacaacgattgaaaagatcgtagaagtagacaaacacatcggctgtgctgtttcggggctcatggcagattcacgcacgatgatcgatagggcaagagtagaatgccaaaatcattggttcgtttacaatgaaaacatcaccatcgaatcgtgcgctcagggagtatcgaacctagctattcaattcggagattccgatgatgatggtgctgctatgtcgaggccattcggtgtggcaatcttgtttgctggcatcgacgaaaaagggcctcaactttaccacatggatccttcaggtacatttgttcagttcgatgcgaaagctataggatccggttcagagggggcgcagcagagcttgcaggaagtgtaccatcgtagcatgactctagaggaggctaccacagcggcattgaccattctcaagcaggtcatggaggagaaattgaactcttccaatgtagaagtcatgacaatgacgccaaaggatttgttccacatgttcactaaggaacaagtggaggaggtaattactaaattatcttaa

SEQ ID NO: 836 - DNA, 1158 bp, Phyllotreta striolata
atgtcagaatactggttgatttccgccccaggtgacaagacttgtcaacaaacatgggatactatgaataatatgactagtaaacagaacaatttgtctgcaaattacaagttccaaatacccgatttgaaggttggaacactcgaccaattggttgggctatccgatgatttgggaaagctggatggattcgtggagcaggttacccggaaggtggcccagtacctcggagaggttctcgaggaccagagggacaagttgcaggagaatttgcaggcgaacaacaccgatttgccaagttatttaaccagattccaatgggacatcgccaaataccccatcaagcaatcgctgcgcaacatcgccgatataatcagcaagcaagttggtcaaatcgatgccgatcttaagaccaagtcctcggcctacaataatttaaaaggcagtcttcaaaacttggagaaaaaacaaacagggagtttgctaacccgtaacttggcagatctggtcaagaaggaacactttattttagattccgagtacttgcaaacgctgctcgtcatcgttcccaaggctcagttcaacgagtggaacgccacttacgagaaaatcacggacatgatcgtccctcgatcgtcggagctgatcatccaagacggcgactacggcctgttcaccgtgtcgctcttcaagaaggtcgtcgaggagttcaagctgcacgccagagagaagaagttcatcgtgcgagatttcacgtacaacgaggaggaattggcggccggcaaaaacgaaatcaccaagctcgttaccgacaagaagaagcaatacggtccgttagtgagatggttgaaagttaacttcagcgaatgcttttgtgcttggatacacgttaaagcgttgagagtcttcgtcgagtccgtgttgagatacgggttaccagtcaatttccaggctattctgatccatccaaataagaaacaagccaaacgtttaagggatgttttgaatcaactatacggccatctagacagtagtgcagctctttccggacctaatgttgatagcgtagacattccaggattaggtttcggccaatcagaatattacccatacgtgtactacaaaataaatgtggatatgatagaatcgaaggtctaa

SEQ ID NO: 837 - DNA, 1674 bp, Phyllotreta striolata
atgtcgatattagcaagtcctctatccgtagcgggttccagaaccaccggcgcctcagttcgcactcaaaacgtgatggccgcctccaccatagccaacgtggtgaagagctccctgggccccgtcggcctcgacaagatgctcgtagacgacatcggcgacgtcacggtgaccaacgacggcgccaccattttgcggctgctcgaagtcgaacatcccgccgccagggtgctggtcgaactggcccaattgcaggacgaggaagtcggcgacggcaccacctccgtcgtcatcattgccgcggaactactcaaaaacgccgatgaactagtaaaacaaaaaatccaccctacgtcgattataagcggatacaggttggcttgtaaggaagcttgccgatacatacaagaccacttgactatacccgtggaggaattgggcaaggaatccatcgtgaacgtcgccaagacatcgatgagctccaaaatcataggagctgacgcggatttcttctcgcaaatggttgtcgacgcggcgaccgccgtcaaagtgacggacgccaaaggcaactcgatgtaccccattaaggcggtgaacgtgttaaaagcgcacggcaaaagcgcccgcgagagcttcctggtggccggatacgccttgaactgcaccgtcgccagccaggccatgcccaagaggatcgtcaacgccaaaatcgcctgtctggatttctcgctgcaaaaggccaaaatgaagatgggcgtgcaagtgctgatcaccgatccgggtcaattggagggcgtgcgcgcccgcgagctcgacatcaccaaggagcgcatccagaagatcctcgccaccggcgtcaacgtggtgctgctctccggcggcatcgacgacgtctgtctgaagtacttcgtcgaacgcggcgccatggccgtgcgtcgcgtcaagaaggccgatctgaagcgcatcgccaaggcgacgggggcgtcgttcgtgacgtcgttgagcaacatggagggcgacgagacgttcgacgccaatatggtgggcgaggcggcggaggtggtgcaggagaggatatccgacgatgagttgatcgttatcaaaggtccgaaagcccgaacggccgcctcgataatcctgcgcggcccgaacgatttctactgcgacgagatggagcgctccgtccacgacgccctctcggtggtgaagcgcgtgctcgaatcgaagagcgtcgtggcgggcggcggcagcgtcgaggccgccctctcgatctacctcgagaacttcgcgacgacgttgagctcgcgcgagcaactcgccatcgccgaattcgcccgcagcctgctggtcataccgaagacgttggccgtgaacgccgcccaggacgccaccgatttggtggcgaagctgagggcttaccagaattccagccagaccaagaaggatcacgcgcatttgaagtacgtcggattggatctgctcgaaggtactgtgagagataataggaaggcgggcgtgctggagccgactatgtctaaggtgaaatcgttgaaattcgcgacggaggcggcgataactatactcagaatcgacgatatgatcaaattggacgcggagcagaagggcggaaagagctaccacgatgctatggatagcggtgaattgtacgattag

SEQ ID NO: 838 - DNA, 765 bp, Phyllotreta striolata
atgtttaattctacccattcggcgcctccaccgttttggagtaacggtccggcccccggggctttctataacttcccaggaacagtagcacctgtaactaatccaataactcatactcagtctccagtaacgacttcaacttcaattgtgtctataacctacgataagggggtactaattgccggagacttgctggcctcctacgggtcattagccagatataaaaattgccctagggtgatcgaaattaacccgaacatcatcatgggtgctggaggagattacgctgattttcaatacgtaaaaagcttcattgagcagaaaataatcgatgaggactgcttagatgatggtttgaaaatgaaaccaaaatctctttattgctggctgactagaattatgtaccaacgaaggagtaaactcgaccccttctggaacaacctagtagtaggagggatacaggatggtgtacctttcctgggaacagtcgataaactcggcactgcttacacagataaagtaatctgtactgggtatggtgctcatattgcccttcccgtcttgagagatgccctcgacaagaaaccgaacttgaatctaaacgaagctaagcaactcattaaaaagtgcatggaagttttgttctacagagacgcgagaagttacccgaaatatcagttgggaatgatagatgtggatgaaggtgttaagatcgagggaccaatttcagtcgaggaaaattggaacattgcttatatgacataa

SEQ ID NO: 839 - DNA, 2106 bp, Phyllotreta striolata
atggaattttcaaaagaacccaactttgaattgctaacagctgaagatttttcgccggaaaaatatgtaaaaaaattgtcccagaattatgtgggtggatcagaattgcaaagtcttcgaagaaaaatacaggggctctccgaagaaaccagctctaatttaaagaaaaatgtttacgaaaactacattcaatttatcgaaactgctaaagaaatttcacatcttgaaagtgagatgtaccagctttcccacttactttcagagcaaaaggcattacttaattgtttatcggccacctcgatattggaagatgtacagccagtcaatattgatagggataataaagtaaacgagaaggatctcgaggaagaaaataaacaaaaaatagctgctattttagaaaaagtagaaggttgtcaggaattgttaaaagtaccaggaagaatttttttgtacgaaggagatttattagaaattgaacccaccgaaaacaccgccttaaaaatagttcacgtttatttatttacagatagttttatgataactacaagaaattcaaacagtcgaggtctcatgaaatacatctatgaaagtatatatgacctaagcagcctagcagttgtaaacgtaagagatttgggaaacgtcaaacacgcctttaagcttctcattttccccgataccagagtgttccaatgctcttcaaactccaataaaaaagagtggctagacaagttcgatcaagccaagaagaccaggctggctcaagaacagcaaaaaagagaatccatatcggaaaaatctcccacccgtgtatccttcgagtcacctagctacaatcctttcgatgaagtggaagaagaaacgagcgccttgcatccggaatggttcctggagattcccgaagagctggacgtttgtgtagcccaaaggcatttcgaggaggctctgtctctattgcaaaaagccaaagaatacttgaatcaagcatcatccgcgtccggtgacaagcgggacaccgttttcacggatattcaaaggaaagtagagcaaagacagaacaatttaactgaggtgttaatgaaggaattggaagtaaacccggacaaatcgttgcaggggggattgagagcggctcgcagggctgtgagactgctgaatcaattaggaagagaaacacagtcttgtacgttgtttctgaagctgtgcagcagtatgctaaggacgcagtgcaaacgagttaaaagagaaggctctactaccacatatataaagcatctttcgagcgtggttttcaccaatatgtgtcacatgtctgatgagtttctaagagctttccccgactctccggcatgtgcttcagcgtatgtagtttgggcgagcaatgaactgctgcagtttactacccattttattaaacaggtttttatgccacagacttctttgtcaacggtgaccgagtgcatagttttagttagacatcagtgtgaaaggctgtatgtttatggtttagacctttgttatcaattagacggtgctttgagatcttcgctgatgaaagcgttaaaagacgctagagataaattaatcgattcgataaaattgcgagttttagatgataaatggataccgattaacttgcattccaaatcggctttaagtcgttgcgtgcaagagtattctcaaatggggctcactaacgtagggagttacgtttctggtgatacttggttgcaattaactgctagtactttatcgttcacgaaaatgtttctgaacttgttaaacgattgcatgaaattgaaaactacggaattaatgtatacgatcgatgagactttgtataacgtgttcgaagctcaagtcaggcacaacgagaacgctctgaggagcgaattgaatcaagatcaaaggaacttcctcacgaaaaatgcagagtttttgttggttagtttgatgcaggtggtacagaaaaagtacgaggaaaaggtcggttacgaatgtcctacgctagcgaaattgcaaaaggaatacgtagcactgcagaaaggcgtttccccagcgtcgagaagtacaaaagccaaatatgcatcagagtttatttaa

SEQ ID NO: 840 - DNA, 3243 bp, Phyllotreta striolata
tcgaaagatagacgaagatctagaagcagatcgaaagatagacgaagatctagaagcagatcgaaagatagacgaagatctaggagcaggtctagggacagaaggcgatctagatctaaagatagatattctcgaagggaaaaaaggcatagaagtaggtcgaatgaagactacaagaggagaagaggagacgacagttactcgagagatagaagggaaagaggtaggtccaaagaatcggaaagaagagacaggaatagatcgagagatgatagaaaaagggaacgaagcagatcgagaacgagaaggcgagaaaggagctacgagaaaaaattcaaaagcgaaaaggataatcctgaattcgaagatgatcctactccaggaaagatttataatggaaaagtatcgaatgtcgttccgtttggttgttttgtacaattagaaagtctaaaaagaagatgggagggtttagtgcacatttctcagctaagagcagaaggtagagttaccaacgtttccgacgttgtctccagaggaagcaaagttaaagtaaaggtattaacgataaccggccagaaagtatccctttcgatgaaagatgtctgccaaacgacgggaaaagatttgaatcctctgtcccatgccactgcggaacgagaagataaagaccgtaaccccgacaggcccacgaacaacagcacgtcagtgttgaggctaccggtcagtatcgatgaaggtgaagaaaattccaggaaaagagtaacccggatttccagtccggaaagatgggaaattaagcaaatgatttcctccggttgcatagacaaaagcgaattgccggaatttgacgacgaaactggtttactgcccaaagacgaagacggtgaagctgatatagaaatcgaactggtcgaagatgagccgccatttttacaaggtcacggtagagctgttcacgacctaagtcctgtaaggatagttaaaaatccagatggttcgctagcacaggcggccatgatgcaatcggccttagccaaagaaaggcgcgaacaaaaaatgctgcaaagagaacaagaagtggactctcagccgtctggaaagaacaaaaactggatagatcctctcccagaggacgaatctaaatcgatggcgagaggaataggccttcagagtcaagatttgccggaatggaaaaagcacgttattggtggtaaaaagtcgtctttcggcaaaaaaactaacttgacgatcatcgaacaaaggcagtcgcttcccatttacaagcttaaagaggaattacggaaagccgtaacagagaatcaaatattgatcgtcatcggtgaaacgggctccggaaaaaccacacaaatcacccagtatctagccgaagctggcttcacggccagagggaaaatcggttgcacgcagcccagaagagtagccgccatgtcagttgccaaaagagtagccgaggagtttggatgcagattaggccaggaagttggatacaccattagattcgaagattgcaccagccccgaaacgatgatcaaatacatgacagacggtatgttgctacgcgaatgcctcatggatttggatcttaagcaatactctgtaataatgttggacgaagcccacgaacgtacaattcacaccgacgtactatttggactattgaagcaagctgttatgaaacgcgacgagttgaagttaatcgtaacttccgcgacgttagacgccgttaagttttcgcagtatttcttcaaagctccgatattcacgatacccggtaggacgtttccagtcgaagttttatacaccaaggaaccggagaccgattatttagacgctagtttaataacggtgatgcaaatacatctcagagaaccacccggcgatattttactgtttctgacgggccaagaagaaatcgatacagcttgcgaaatattgtacgaaagaatgaaaagtttaggtcccgatgtacccgaactgatcattctacccgtatactccgctctgccgtcggagatgcaaactagaatattcgaaccggcgcctcctggcagcaggaaagttgtaattgccacgaacatcgcagagacttcgttaacaatcgatgggatttattacgtggtcgatccgggattcgtcaagcaaaaagtttacaattccaagaccggaatggattcattagtggttacgccaatttcgcaggcgcaagcgaaacaacgagcaggccgagcgggcaggaccggtcctggtaaatgttacagactttacacagagagagcgtacagggacgaaatgcttccgacgccggtgcccgaaatccagcgaactaatttggcaacgacagtacttcaactgaaaactatgggtataaatgatttgctgcatttcgattttatggacgcccctccggtggaatcgctcataatggcactcgagcagttgcattctctatcagctttagatgatgaaggtttattaaccagactaggaagaagaatggctgaattcccgctggagccgaatttgtgcaagatgttgatcatgtcggtagccctccaatgctccgacgaaatattgactatagtgagcatgttgtctgttcaaaacgtgttttaccgtccgaaagacaagcaagcgctggctgaccagaaaaaggccaagtttaatcaacccgaaggcgatcacttgacgctattggcggtctacaacagttggaagaacaacaaattttcgaacgcatggtgttacgaaaatttcgtacagatcaggactttgaaaagggcgcaagacgtgaggaaacagttgttgggtattatggacaggcacaaattggacgtggtatcagcggaaaggaacacggtgagagtgcaaaaggccatttgttccgggtttttccggaatgcggggaaaaaggacccgcaggaaggctacaggactttggttgatagtcaggttgtgtacattcacccttcgagcgctttgttcaatcgacaaccggaatgggttatctatcacgaattggtgcaaactacaaaggaatacatgagagaagtgacgacgattgatccaaaatggctggtggaatttgcgcctgctttcttcaagttttctgatcctacgaagttgagcaaattcaagaaaaatcaaagattggaaccgttgtataacaaatatgaagaacccaatgcgtggagaatttctagagttaggagaagacgaaattaa

SEQ ID NO: 841 - DNA, 1248 bp, Phyllotreta striolata
atggcctcaaaaaggaaaaacaaaaaaaacatactggcaaaagtgaattttcctctgtacaccgtccagatgctaacgtcacggcacgttatcgtaggaggcggcggtggaacttccaagactggggttgaaaacggtttcgaaatatacgaaatctttcatgacggtcacaaattctcagccaaagaagttacgagacacgaaaccggaggaaatgtagtcatgaattgttgtgcgtttagtgataggaaaaattcgtttttagtagccggtcaagaaaactactcgcaactttacaaagtcaatacaaaattaatcgagcatgaacaagtagaaacagttggtgacaccgcaagcgttcggcatagaaataccaagcccaaagaacacgtagataataataaaaacattaaaaaggagctggcttttgacctgaatcctttagattgtatacaaactgattttaaaggaaccgaacctctatgtagagtagttagaattaatcactcaggaaaaattttagctactgggggaactgatggggatgtaagactttggaaatttcccacaatgcagccaatgtcgattctaaagggacatacaaaggaaatagacgatatagatttcagtaaattcgataacctcatcataactttagctaaagacggtttggctattttgtgggacgcccaaacgggaaagcagaaatcgaaactgacatggaaaactccagagggatcaaaatatttgtacaagagatgcagatttggcgttattgaagatcaaaaaaacaagtgcatgctatacatgatagcgaatgcgactaattcgaagcaagcatcgtttcttcaacaatggatacccgaggagaatactttaaaaaagttctcggaatttaatgaaaccctgtctgcacttgcagtgagagacgatgggcgatttgtagctgtcgggacaatgttcagcggttccgtttccattcacatagcctttagtttacagaaattattagtagttgtcggtgctcactcgatgtttgtaactggtctggaattcctatctcacgaaaatactaatcattccataagtagtgttgctgagactgctgtgttgtctatttcggtggataatcagctttgtatacattcagtgccatacagacgaagtatacctttatggattggaattatggtgttagttttagtattatttattacatttatgttatgtgcatacatgggtttgtga

SEQ ID NO: 842 - DNA, 1242 bp, Phyllotreta striolata
atggctggtgcaatgttattcgaaagagctcagtccgttccttctcaacatgacaagttgttaaaattaaatccggcagacgaagatgacgaggagaatattgttaataaagagcaggacatcctcaacttgggcgagaagtacaaaaaggagggcaaggctaaagaactagccgagctgataaaggctaccagaccatttctgagtcttattagcaaagcaaaagcagcaaaattagttagatcactggttgattactttttggacttggaggcaggtatcggcattgaggtacaactgtgtaaagaatgtatagaatgggcgaaagaggagagaagaacgtttttgcgccaatcgctggaagcgcgcctgatcgccctgtatttcgataccggaatgtacaccgatgccctacaactggaatccaccctgttaaaagagctgaagaaactggacgacaaaaatctgctggtcgaagtgcaactgctcgaaagcaaaacatatcacgctctcagcaatttacccaaagctcgagccgctctaacgtccgctagaacgaccgctaacgctatttattgccctccgaagatgcaggccgccctcgatctgcaatcgggcgtgctgcacgcagccgacgaaaaggatttcaagacagcttactcctatttttacgaagccttcgaagggttcgatagcgtcgaatcccccaaagctctgactgctcttaagtacatgcttctgtccaaaattatgattaatagtcccgaagacgtacagcaaattgtgagtggaaaattagccataaagtatgcaggtaaagatatcgaggccatgaaagcagtcgcacaagcagcccataaaagatctcttgcagattttcaacttgccgtaaaacaattcaaacatgagctggaagatgacgttatcgtacgagcacatttaggaaccctctacgacaatatgttagaacaaaatttgtgcagaatcattgaaccttactcgcgtgtccaagtagaatatatagcaaaaacgattaagcttcctgttttacaagtagagaagaaactatcgcagatgattttagatgccaagtttcatggaattttagaccagggtgatggtgtcctgatagtgtttgaagaaactccggtagacaaaacctatgaaatggctctcgaaaccatccagagtatgagtaaagtcgtagacactctctatcaaaaagcgaaaaagttgtcatag

SEQ ID NO: 843 - DNA, 1737 bp, Phyllotreta striolata
atggcttcgcgctcgaaaaaaagctcgacgccgtcggcccagcagcggccggctagcccgctcagcccgacgaggcattccaggttgcaggagaaagcggaactccaaggtctgaacgaccgcctggccggttacatagacaaagtgagattcctggaagcggaaaacaacaaactatccagagaaatccagacgacccaggaaactgttacacgcgaagtgaccaacatcaagtctatgtacgatcacgaactatcggacgctagaaaactgctggacgacacgcatcgcgagaaagcccgcctggaaatcgacgtgaaacgcctcatagaagagaacgaggagctcaaagccgagctggccaagaagagcaaggacttagttgtcgccgagaaccatgccaggatatacgaagcccggtgtaacgagtaccagctcaaatccaaccaagctgccgccgatgcaaagaaggccatcgccgacgctaaggagttggagaaggaaagggacaagctcaagaaactcctcgatgcagctcgtaaacaactggaagaggaatccctggccagagtagaggtcgagaatcacaatcagagtcttagggaagagctaaccttcaaagatcagattcaccagcaagagctcaccgagacccgtacgcgccgacaggtcgagatcagcgaaatcgacggccgcctggcgcagaagtacgaggccaagctgcaggaggcgctccaggacctgcgcgaccagtacgaatcgcagatggccaacaatcgacaggagatcgagctgttgtacgagcagaaaatcaaaaacctgcaggcggccgccgacaggcaccaatcgaccgcctccggcgctctcgacgagctgagacaggtccggacgaggatcgacaccttcacgtcgcgcatccaagacctggagaaccagaacaacggcctgtcggctaggactagggatttggagaagttgctcgagaacgagcgcattcgtcatgccgaagatctggcgatggtcgagagggaattgcacaggatgcgagaggaaatggccacgcaactacaggaataccaagacctgatggatatcaaagtatcgctcgatttggaaatcgccgcctacaggaaacttctcgaagctgaagaagctcgattgaacatcacaccaacaggcgttgagcacgaggtgcaccagaggagttcctctcaacgtcggacgccggtgagggtgggagcgaagaggaaacgggccctgctcgaggagacgcaggagtcgagcatgtcggattacagcgtgaacagttcttcgaaaggggacatcgaagtggccgcagtcgatccggagggtcagtttgtgagattgcacaacaagagtaaccaagaggtgccgctcagcggatggcaagtcatcaggcgggcgggcgatgaggagactttctacaaattccacagaactgttaaagtagagggaaatggtacagtaaccatttggagttcggatttaaataaagatcacgaacctcctagcaacctggttatgaaaggtcaaaaatgggttaccggagacaacatgattacggtagtattgaacaacaatggagaagaagtagcgtcatctgaaagggtgaaaaggcagatttcaacgtcgcatttaagacacagggagttgggggatgaagaactttaccaccaacagggggacttgcaaggtgaaaagtgcggactgatgtga

SEQ ID NO: 844 - DNA, 2412 bp, Phyllotreta striolata
atggctgatagcaaaagcccagacgatctagcgactgcgatcctccgcaaaaaggaccgtccgaacaggcttttagtcgaagaagccgttaacgatgataattccgttgtggccctgtcccaggcgaaaatggatgaactgcagctcttcagaggcgacaccgttctacttaagggcaagcgtcgaaaagaaactgtctgcatagtcctctccgacgatagttgtagtgacgaaaagatccgcatgaacagaaacgttcggaataacttaagagtcaggctgtctgacgtcgtttctattcagccctgccccgatgttaagtacggcaaaagaatccacgttcttcccatagatgacacagtagaaggacttacaggaaatctgtttgaagtgtatctgaagccgtatttcctggaggcctatcgtcccattcataaggacgacgtttttatcgtaaggggcggcatgagagccgttgaatttaaggtagtggaaaccgatccggccccttactgcatagtcgcgcccgatacggtcatccattgcgacggggatccgatcaagcgcgaagaagaagaggaggccctcaacgctgtcggctacgatgacatcggaggttgcagaaaacagctggcccagatcaaagagatggtcgagttgccgttgagacatcccagtctgtttaaggctattggtgttaagccgcctcgaggtatcctcttgtacggtccaccgggtactggaaaaactctgatagccagagccgtcgctaacgaaaccggagctttcttctttttgattaacggtccggaaatcatgagcaagcttgcaggagaatcggagagtaacctgcgcaaagctttcgaagaggccgacaagaactccccggccatcatcttcatcgatgaattggatgccatcgcaccgaagagagagaaaacgcacggagaggtggagcgtcgcatcgtttcgcaattgcttactctaatggacggcatgaagaagagctcgcacgtcatcgttatggccgccacgaacaggccgaactccatcgatcccgcgctacgtcgtttcggaaggttcgacagggaaatcgacatcggcattccggacgcaaccggtagattagaagtgctgagaatccacaccaagaacatgaagttggccgacgacgtcgatttggagcaaatcgcggccgagactcacggtcacgtgggcgccgatttggcttcgctctgttcggaagcggcgcttcaacagatcagagaaaagatggacctaatcgatctcgaagacgatcaaatagacgcggaggtgctcaattcgttggccgtgaccatggagaacttccgttacgctatgacgaagagcagcccgagcgccctgcgcgaaaccgtggtcgaggtgccgaacgtcacatgggaagatatcggcggtttggcgaacgtcaagaaggaattgcaggagctggtgcaatatccggtggagcatcccgataagttcctcaagttcggcatgcagccgtctaggggtgtgctgttttacgggccgcccggttgcggtaaaaccctattggccaaggccatcgctaacgaatgtcaggcaaacttcatttccgtcaaaggaccggaattgttaacgatgtggttcggtgaatctgaagctaatgttagagacattttcgataaggccaggtcagcagctccttgtgtacttttcttcgatgagttagattcgatcgccaagtcaagaggtggaaatgtgggagatgccggcggtgccgccgatagggtgattaatcaaattttaaccgaaatggatggtatgggagcgaaaaagaacgttttcataatcggtgctacaaatagaccagatatcattgatcccgctatattacgtcccggccgtttggatcagttgatctacatcccgttaccggacgaaaagtccagagaagcaatctttaaagcaaacttaaggaaatcacctgtagctaaagacgtcgatcttacgtatattgccaaagttacacacggtttttcgggtgccgatttaacagaaatatgtcaaagagcttgcaaactcgctataagacaaagcatcgaaactgagattagacgagaacgtgagagagcattgaatcccaacgtagcaatggacctggatgacgacgatccggttccggaaataaccagggcccactttgaggaggcgatgcgtttcgccagacgctcggtttccgataacgacatcagaaaatacgaaatgtttgcacaaacgctacaacaatctcgagggttcgggacgaacttccgtttcccgacggcccagggcgggccgcaagccccgggaggcaccggcggggatcaggccaacttccaagatgatcccgaagacgatctatatagctaa

SEQ ID NO: 845 - DNA, 825 bp, Phyllotreta striolata
atgagtgaccaatttgactgtgcactcgatttaatgaggcgcctgcctccgcaacaaatcgaaaaaaatttgagcgatttaattgatttagtgccaagtctttgtgaggatcttctttcgtctgtcgatcaacctttaaaaatcgctaaagacaaggattcgggcaaggattttcttttatgtgattacaatagagacggggattcttacaggtcaccatggtcgaatacctattaccctccgttagaagacggttcgatgccctccgagaggctaaggaaattagaattagacgccaatttagcgttcgatcaatatagagaaatgtatttcgaaggtggcgtgtcttctgtttatttttgggacttagatcacggttttgcaggagtaattttaattaaaaaaaccggcgatggtagtagaaaaattaaaggttgttgggattccctgcacgtagtggaggtacaagaaaagggttcaggaaggaattcccactacaaaatgacctccaccgcaatgctgtggctgcaaaccaataaacaaggctcgggtaccatgaatttgggcggtagtttaacccgacagatcgagctggatgcggccgtaaacgacatcaacccccacatcgccaacatcggtcgaatggtggaagacatggaaaacaaaattcggaacacgttaaacgaaatctactttagcaaaaccaaggacatagtcaatagcttgagatcggtgcaaccgttaacggaaagccgtcaacagcaagcgcttaaacaagacttggccgccgcccttcagcgtagacaaaacaaatccgagaactga

SEQ ID NO: 846 - DNA, 2652 bp, Phyllotreta striolata
atggaacgtccaccccgcaatgagccgcccgtggagcctgtcaacggtgtggtgcaaccgctggtgcatccgccgcccgacagtcccggtcgcgtaacgaaccaactgcaattcctgcagaaaaccgtactgaaggccgtatggaaggacaaattcgcttggccttttcaacaacccgtcgacgccaagaaactcaacctgcccgactaccatagaataatcaaacaaccgatggacctgggaacgataaagaagcgtttagagaacaactactattggtcgggtaaagagtgcatacaagatttcaacacgatgttcacgaattgctacgtctacaaccagcccggcgaagacgtggtcgtcatggcccaaacattagaaaaagtatttttaaccaaagtggccgacatgcccaaacaagaatttgtcgttgatatgccgatgaaaggcgccaaaggcaagaaagggcgagttagcgtcggcggtggaagcaccccatcgtcgagcggaccggtaccgggggcggcggctataccaggagctgtcagaggcagaccgcccgcgaccgtttcttctaccagtaccacgccaattgccaccactactggttcgtcgggcctgccgttgggtacccaagcgccggccacgctgccgggcagtaccgccacgacgacgatagcgccggccaacaacaacaacagctctctgacgccgcaacagctcgtcggcacgcccgtcggttcgatgcacggcacgcccggaggagcgccactgtccaattccctcgatcccggcggcgtgatgcccggcaacgtcatgccgccggcgcaaccggccaaggtaaaaaaaggcgtgaagagaaaggccgacacgacgacgccggcgacggcctacgactatccgacggtgttggaatcgaaatcggcgaagatttcgacgcgccgagaatcgggcaggcagatcaagaaaccggcgcggcgggaaatcgaccttcatgtacctcaaccggcgatccacaaacccaacgagaagttgtcggaatcgctgaaggcttgcaatgaaatcctcatggaattgttctccaagaaacattcgaattacgcatggccgttctatcaaccggtcgatgcggaattattgggcctgcacgactaccacgacatcatcaagagacccatggactttggtactgtcaaagagaaaatggacaacagggagtaccgcacgccgcaggatttcgccgccgacgttagactgatttttagtaattgttacaagtacaatccctctgaccacgatgtggtcgccatggcgcggaagctgcaggacgtgttcgaagtcaaattcgcaaagatccccgacgaacccgtcaaccggataggaggcggtgtaaataatttacccattaaatcggaatcgagcagttccggttcgagttccgattcgtccagcgaatccgaggattcggaggaggagcgacgtaataaacaattaaaagtactggaaaaagagttgacggcgttgcaagagaagatgcgcaagctggtcgaggagagttcgcgccggaaaaaggagaaaaagaaaaacaaaatgaaaaagaaaccgagcggcggcggcggcggcggtgggtcgtctgccgccgcggcgggcgctctgccgaacagcagcagcggcggcggcggcggtctcggtttgcgcgccaacaaaccggccgccgcttcgaacgccgccgccaagcgggtgaaggccaataacaagaccggcgccggcaggaagaagaacgccgcccaaccgccccccatgccgttcgattccgaggacgaagacaacgccaagccgatgtcctacgacgagaagcggcaactttcgttagatattaacaaattacccggcgacaaattgggtcgagttgtacatataatccaatcgagggagccgtcgttgagggattcgaatcccgatgagatcgagatcgatttcgagacgttgaaaccgtcgacgttgagagaattggagagttacgtcgcgtcgtgtctgcgtaaaaagccacgtaagccttactataaaaaagtcgccggcaaatctaaagacgaacaaatggcggagaagaagcaggagctagaaaaaagactaatcgatgtgaacgataaaatcggcaattccaaaaaagcacctaaaaaagatgaagcgaacaaggtggacccgacgggcgcgggcggtccctccggtcgcctgtcgtcgagctcgagcagctcggattcggacagcagcagcagcagcctgtcgtcgagttcgagcgattccagcgacagcgaagcaggtggtacgaccaacagatcgactaaaaagaaagtgaacaaaaagagccccaacccttcggtcgataatactgcaataacgaaaccacagcaaccaacaacagcaccaccaatgtcacaaacacccgccaacgttaacgctaacgtaaacgtaaccgtatcggctaatgcgaacgcaccgccacaatcagtacctgcgacgacgttaacgacgaccgccgccgttaacagcaatttcccggcgccgccgccgccgccgccgcaacaacaacaggcgatggctcccaacaagcagcaacacaacgtcaacgtaaatgcgaacgcaccgccacaa

SEQ ID NO: 847 - DNA, 1224 bp, Phyllotreta striolata
atgtctttatccactgctcgccctttagtgagcgtttacaatgagaagtcagaagaagtaaaaggcagcggtgtcgctctgcccgctgtcttcaaggccccaatcagaccagatgtcgtcaatttcgttcatcagcaggtctccatgaaccatcgccagccctacagcgtcagcgacaaagctggtcaccaaacctccgccgagtcttggggaaccggtcgcgccgtggcccgtatacctcgtgtacgaggcggcggtacccaccgatcgggccagggagccttcggtaacatgtgtcgcggcggtcgcatgttcgccccgaccaagccgtggcgccgctggcatcgacgcgtcaacatcaaccagcgtcgctacgccctggcgtcggccgtcgccgccagcggcgtgcccgctttggtcatgagcaaggggcacgtggtcgatcagatacccgagttgccgttggtcgtcagcgacaaggtgcaggagatgcacaagaccaaggaggcggtgcaattcctgaggaggatcaaggcctgggccgacatccagaaggtctacaagagccaacggttccgtgccggtaaaggaaaaatgcgtaacaggagacgtatccaacgtaaagggccacttatcgtttactacaaagatcaaggtcttcgtcaagctttccgtaacatcccgggcatcgatctcatcagtgtccaaaagttgaacttgttgaagttggctcctggaggtcacgtgggtcgatttgtcatctggaccgaatcggcgttccaacgtttagacaaattattcggtacatggaagaacccatcgaccgagaagaagggttacaatttacctcaacccaagatgtccaataccgatttgtctagattgttgaaagccgacgagattaaagccgtgcttaagactcctcagaagaaggtggtacgccgtgttcgtcgtcttaatcctttgaccaacactaaagctatgcttaaattgaacccgtatgctgctgtactcaagagggaagctatcttgaagaaccaaaaaaggcagttgcaaagggacgaggctttggctaaaaaacgcggaatcaccctgacccctgacaacgctgtaatcaggaccaggaaattgcaggaaagaagaagagctcaaattttgaaagataagaaatcaaaacccaagaaggcggctaaggcgccggccaagcctgctggaaagaaataa

SEQ ID NO: 848 - DNA, 4497 bp, Phyllotreta striolata
atgcaacttcgtgacgttcccattacgcccgtaacggacgattccaccgagctggaagatgaagcagagtggatttacagacaagcgttttgtaacaaagcgatatcgaatgtagatgcgcacctttcggccgaagcgagagagaaaatgaagaaaggctcccaaaccgttgggaaaataaagaaagcgctggatttcatgaggaatcaacagctcgaggtgcccttcatcgccttttacagaaaggagtacgttcaacctgaactcaacattaacgatttgtggaaagtttacaaatacgatgctaagtggtgtcaactgaagtctcggaaggaaaacctccttaaactgttcgacaaaatgaggcattatcaattggatcaactcataaaaaatccggatgctcctattccggacaacgtgcgagtgatgaaagattcggacatcgaacgactaaaaaacgtccaaactgctgaagaactcaatgatgttcacaatcatttcatattgtattattccggggatttaccggctatgcacgccgcttggagaatcaaggaaaaagaacagaggagatacgagaagcgacaaaaaagactcaaacaaatagctgaagcggaagacggtgctgagatacccgatgaacctgaggatgacgatgacgatgaaccagagaccgaaactttgaagtacgccaatcgttcgggcagttacgctttatgctctaaagctggattagatcctttggcgaagaagtttggtttatccccggagcaatttgctgagaatttgagagataattatcaaagacacgaagtcgatcaagagcccgtcgaaccctctgaagttgccagagagtttatttctcctaaattttcaacggtcgatgaagtattacaagcgtctaaatatatggttgccttgcaaatagctagagaaccattagtaagaaaatgcgttagagaagtatatttcgaaagagccagaattaatgtatatccgactaagaaaggacaaaaagtcatcgatgaatctcacaattgttacagcatgaaatatttaaaaaacaaaccggtgagggatttgaacggagatcagtttttaaaattgtgcttagctgaagaagaaaacctccttactatcacaattaatgataatatcgaagggaatacatcaaactcttacatagaggaagtcaaacagctctacatcaaggacgaatttagtaaaaatgtgcaagattggaacgcgctgagaatggagtgcgtggaaagggcgctaacgaaaagcgttttgcccgatttgagaacggaattgaagaggacattgttatcagaagccaaagaattcgtccttaaggcgtgttgcaggaaactctacaacagcattaaaattgccccatactcaattacatttcccgatgaagacgaagacgaatgggacacatcgaaaggcgttagagttatgggtttagcttatgttccagaatacacagtttcagcattcgcttgcatagcagctcccgatggggatatcactgattatttgcgtttacctcacatattaaaaagaaaaaacagtttcagaacagaagaaaagttaatgaaggaaggcgatttgcaagttctaaagaacttcatcttctcgaaaaaacctcacgtgatagcgatcggcggggaatccagggaggcgctgatgatagcggacgatttgaaagcgctgattaacgaattggtcgagtccgatcaatttcccgaaatcaaagtcgaaattatcgacaacgaattggccaaaatttacgcaaactccaacaagggccagtcggactttagagactatcccgagctgctgaggcaggccatttccttggccaggaaaatgcaagatcccctcatcgagtactcgcagttgtgcaacggagacgaggaaatattaagtttgaggttccacccgttacaagaacaaataggcaaagaggaactcatcgaagccctgtgcctcgaattcgtcaacagaaccaacgaagtcggtgttgatattaatttggctgtacaacaggcgcacaaaagcagtctcgtgcaattcgtttgcgggctcggccctcgcaaagggcaagctctgctaaaagtcctcaagcagaccaaccaaaggctagaaaatcgaacgcagttggtaacagcatgtcacatgggccccaaagtgttcattaattgttccggtttcatcaaaatcgatactaacagtttgggagatagtactgaagcgtacgtggaaatattggatggttctcgtgttcatccggagacgtacgaatgggctagaaagatggctgtagacgctttggagtacgatgacgacgaaggggctaatccagcgggtgctttggaagagattctggaaactcccgagagattgaaagatctggatttggatgctttcgccgaagaattggaaagacaaggattcggcaacaagagcataacattgtacgacataagagccgaattgaactgtagatacaaagatttgagacaaccttttcattcggcgaatcctgaagagatgtttgatatgttaacgaaagaaacgccggaaacgttctatataggaaaattggttactgcttcagttataggtattgcgaggaagaaacctaaacctgaccaactcgatcaggccaatcctgttagaaatgacgaaacgggcctttggcaatgtccgttttgtttgaaaaacgattttcccgaattatccgatgtgtggaatcattttgatgcaggtgcatgtcccggtcaagcaacgggtgtcaaacttagattagacaatggaataatgggttatatttatataaaaaatattagtgataaaccggtatcgaatccggaggaaagagtaggggtcggtcaattaattagttgtcgtataataaaaatcgatgttgagagattcagcgtcgattgtacgtcgaaatctagcgatttgttggataaaaatcacgaatggaggccaccgagagatcctcattacgacacggaacgcgaagaaaaagacaacagaaccgaggcggaaaagaagaaagaaaaacaacgtttgacctacataaagagagttatagttcacccggcattccacaacatttcttatgcggaagctgaaaaatgcatggtcaacatggatcaaggcgaagtcatcatcagaccgtccagcaaaggagccgatcatttgaccattacgtggaaagtcgccgataaaatctatcaacacatcgatattagggaagaagggaaaactaatgcgttttcattgggtaaatcgttgttgataggcaacgaggaattcgaagatttggacgaaataatagcgagacatgtcactccgatggcagcgcacgctcgcgatttgctctacttcagatactacaaagacttcgagggcggtcacaaagacaaggccgacgagtacctaaaagacgagaaaaagaagaacgcctcgaagatacattacgtcgttagtgccgcaaagcacatacctggtaaattcctactgtcttatctaccaagaaacaaagtaagacacgagtacataacggtgactcctgaaggatttagattcagacagcaaatgttcgattcgataacgtcgctattcaagtggtttaaggagcattttagagaaccaccgccgggcggaatgacacctggtaccccaagaatgtccactggaagaacgccatacgatatgagtaccgaagctattcaaagagtcgcgcaaaatctccccagcgacatggtccaagccctatcagctgcaaccaatcaaactcctcactacccgcacacccctggcggttacggtggtaattacatcaacacaccgtatacacctagcggtcaaacgccctacatgactccattccaaacgcctcacgctcaacagacgccgcggtacggccaacagacgccttcgcagccgtctctgagcaatccgttcctccatccgggcgccgtgacgccgtcgcaacggacgcccagctacaggaacctgccgacgcagagtccgatgataccgcagagcccggtgccgagcccgggatcgcagagctcgtacagcagccacatgagccaccatacgcgagcgagttacggggattcgttgaggttccagccgccggagtcgccgaggaattacccgagcagcaggggatcctaccccgatgggaggtacggtggtagcgagtcgatggattggcagaaggcagctgaagcttgggcttctaggtccaaatcgacaccacgaagcgaaggtcgcgggactcccagatcgtctggtcacagaactccacgtaattatgataatatgtccgaaagtgaccggtcgaggatgaagcatatgagcagcaaaagcccgaaatcggtacgatcgactcctcgtacgaattcttcgcctagatcaatgtccttgggcgatgctactcctttatacgacgaaaatatttaa

SEQ ID NO: 849 - DNA, 2193 bp, Phyllotreta striolata
atgccagaagtggacaacagcgaaacgcgctcccctcgtcgcaagcgccgcaggtccaaatccggcgagcgcaaggaagagaaatcgtccaaaaggaaatcatcgaggaaacgttcatcggacgacgattacaatgagcgagattatccgcgctattacggcgaagatcggccgaacagcgacagctactggaacaagtaccccagaagagacaacatgaaagtggggcgtaggtattacgatcacccagatcacgagaagaatagggatagggatgcttcgaacgagaagagcagagatagagatagggaaagcaccagagggaaggagtattccaggaaagaggagaacgaggataaatccgtaattaaacccagagaacgtaaagtcgtcgatatgctgacttccagaacaggaggagcttacataccaccagcgaagctccgtctgatgcaagagagcataacagacaaatcatcagctgcttaccaacgtatcgcctgggaggccctcaagaaatctgtacacggttacatcaacaaaatcaacacgtccaacatcggaataatcgccagagaaatcctgcacgaaaacatagtaaggggcagaggtttgctttgcaaatccataatccaagcccaagccgcctctcctactttcaccaacgtatacgccgccttagtggctgtaatcaattcaaaatttcccaatattggggagttattattgaaaagactggtgcttcagttcaaaaggggctacaagcagaacaacaagtctatttgcatttcggctaccacgttcgtagctcacttggtgaatcaacgggtggctcacgagattcttgcccttgaaattctgacattgcttgtcgagactcctactgatgattccgtagaggtggcgatttcttttctgaaagagtgcggacagaagctcacagaagtctcgagtaaaggaataactgccatattcgagatgttgcgtaacatcctgcacgagggccagctcgagaaaagaatacagtacatgatcgaggtgatgttccaaattagaaaggacggttttaaagaccacgctgctgtaacagaggaattggatttggtagaagaagaggatcaattcacccatctaatcatgctcgatgatgttaaggaggttaatgctgaagatattctaaatgtgttcaagttcgatgaacattatgaagaaaacgaagggaaatacaaaactctgagcaaagaaatcttggggagcgacagcgagtcagattcgggatcggagggatctggagaggaatccgaaggcgaagacgaggaagaagaggtcaaagatgccggaaaaatcatcgacaatactgaaacaaatctaatagctctcagaaggacaatatatttgactatacaatccagtttggatttcgaggaatgcgctcacaagcttttgaaaatggagttgaaacccggccaagagatcgaattatgccacatgtttttagattgctgtgctgagcaaagaacatacgaaaaattctatggactgttggctcaaaggttttgccaaataaacaaaatatacatcgagcctttccagcagatattccaagacacctactctaccacccatcggttggacaccaacagattgaggaacgttagcaaattcttcgctcacttgctcttcaccgacgccataggctgggaggtgttcgagatcatgaagctcaacgaagaagacaccaacagctcgagtaggattttcattaaaattttgttccaagaattggccgagtatatgggcttgggaaagttgaacgctagattgaaagatgaaacgcttcagcaacattttgcagggttatttcctagagacaatccgaaaaataccaggttttccattaatttcttcacgtccatcggtttgggcggtctaacagacgaacttagagagcatttaaagaacgtccctaaaattatggaaactaaaacggccgctgtgaaggaagaaagcgatagtagcagtagtagcagcagcagcagcagtagtagcagcagtagttcgagcgaagaagaaagcagcgatgatagctctggagattcgagttctgaggatgagaaacaaaaatccaaaaagaagaaaaagaaacgcgactcggaaactaaaccttcaaaatcggatgctaaaagtaatcgt

SEQ ID NO: 850 - DNA, 1788 bp, Phyllotreta striolata
atggcgttgaaaaaccaagtcgggcaaaaaataatgaacgaggtgataaaacataaaccctcgaagaagaacggacctgctgttacgcagccacataatgcggccggtgttgactggagaatcctggtggtcgatcaactggcaatgagaatggtatcggcttgctgtaaaatgcacgacatatctgccgagggtattacattggttgaagatataatgaagaagagggagcctctcgctacgatggaagctgtgtacttgatcacaccttccgaaaagtctgttcatgctctcatgaacgactttgagtctccgaggcctatgtatagaggagcacacgtatttttcacagaagcatgcccagacgaattatttaacaaattaagtaagagtcatgcagcaaaatatataaaaacgttaaaagaaatcaacatagcatttattccgacagagtcacaggtattttctttagattcccctgacactttccaatgtagttacgatccttcctttgctgccgcacgaaacgcgaatatggaaagaatggccgaacagattgcaacgttgtgcgccactttgggggaatacccgcacgtccgatataggagcgattgggaacgtaacgtagagttggcgcaattgattcagcagaaattggacgcttacaaagccgacgagccgaccatgggcgaagggccggagaaagccagatcgcaattgctgatcttagatcgaggcttcgattgcgtttcaccgctactgcacgaactgacgtttcaagcgatggcctacgacttgcttccgatcgaaaacgacgtgtacaaatacgaagcttccgccggggtgcagaaggaggtgctcttggacgaaaacgacgagctgtgggtggaattgcgccatcaacacatcgccgtcgtgtctcaaagcgtcaccaagaatttgaaaaagttcaccgattccaaacgtatgacccaaagtgataaacaatccatgaaggatttgtccactatgatcaaaaagatgccgcaataccagaaggaattatcgaaatacgccactcacttacatctcgccgaagactgcatgaaggcctaccaagggtatatcgataagttgtgcaaagttgaacaggatttggcaatgggaactgatgcagaaggggagaaaattaaggatcacatgcgcaacatcgttccgattcttctagacaccaaaataacgaacgaatacgataagatgcgcatcatagctttatacgctatgaccaaaaacggtataaccgaggaaaatcttacgaagctagctacacacgcgcagattaaagacaaacaaactatcgctaacctgcagctcttgggagttaacgtcattaacgatggtggtcctagaaaaaagctgtacaccgtaccgcgcaaagagcgaattacagaacaaacttaccagatgtcgagatggacaccggttattaaagacatcatggaggattgcatcgaggacaaattggatcagaagcatttcccctatctaagcggacgggcgcaaaccaccggataccatgcggcaccctccagtgctcgatatggccaatggcacaaagatagaggccagcaggccgtgaagaacgtcccgcgtctgctggtcttcgtcgtcggagggataagtttctcggaaattcgctgcgcgtacgaggtgacaaacgcccagaagaattgggaggtcataatcggatcgtcgcatatccttacaccagaaggtttcctcagcgatttagcgacgttagccggctag

SEQ ID NO: 851 - DNA, 2139 bp, Phyllotreta striolata
atgatgcaacaatatatgaaagaattggaacaagagccttttgatgccgaagaattcgtagaacgtttggcctggagaactttagctgaatcgaaaagcgaaggagaggaaaatgaaattaatccggtacttcttcacgaatccttcgttcaagccataaaggaccttaatttattgcacgaaaggcaacagaaaaaatgcgaaaaattagaagtagccgttagagaagacgaagcgacgttttttcaagaagtttataatttattggaacaaaataagcaagcaatggaaacatttcaagaactggatggcaaaattaatcatgtagctactaaagttcttcacttgggagatcagctagacagtgtcaatggtcctcgatctagagttgttgatgccttaagcttaatgactcatttgagagaatttctatcgaacgaaccagtttcatccacaatatttaccaatcaagaatacattgatgaagcagctgatgtgattcaaaagctgtatttaatatcgcaagaattgccaccaaagtttgaatcgataaaaaggaaaatagaacggaaatattccgatatcgagaaagcgctaatagaagagtttgttggggctatggataatgagaatttaacaagaatgaaggagatagctttggtcttgtctcagtttaagggctactctcaatgcgttgatgcgtatatagatcacagccaagtgggttgtttatctagtaaagatgtcttctataactttttgaaattgtgtaaatacaacgacgaaattattcgaaaagttttcaagaatccagagcaagtgatggcgaaattcgttttaaacatatatcagttgaaattagtggaatacatagatcaaaaactaaattccaaattgggtacatacagttatttacaaacattatatgagttgtattcaaaaactaataatctatcaagcgaattaaccgtttttcatatgggaaacgacaagaactatctcactaaattaacaacgaacatttttaataaatatatcaatgattatatttctatggagctaaagtgtctcaaagacagatgttcgactagcttgcaaaaatattatgattcgaagagccatcaaaagaaacagattcaatccgggggctttcaagatcttaggagagatttacaagcagtaataggtacgagggcaaatattaacatagcacaaattgaaaattacggaggtgaaactttcgtatcggaggaattggctatcatgattcttcaggatactaaacaagcttttcaacgttgcttattgttgtcgaaaggcagtgaaagagcctctaacgccactcaaattttagacagacttattaatagtttgctaatagagcatgtagactatgcagttgaattgggtctacaagccgtaccagttgtcgaaggcgttagaaatccccctgttttgtatttttttaatgtcgtgcatcaaagcaataatataacccatctcgtcgagaaacagtttatggatttggtggttcccttagtagaaaatactccaaaatatagcgattgtgttcagaagaaaaaatttgttttggaggatatagaaagaaaaattaatacgggattagataggtgcttgagtgcgatattaaattgggtgaagttgtatttgcaatctgagcaaaagaaatccgattttaagccggagtctgatgattttgatacagtggcatcacctgcatgcaagaacgtacttaactatgttaatagcattatcaaagaaattaaaacaaatttggatggcaataatgtaacggctatccttcaagaattaggaattagactgcatagagttgtttacgagcacatgttgcagtatcaatataacactgcaggtgcaatggtggcaatttgcgatttaaacgaatatagatcttgtactaaacaattaggtcctttggttgcggagcttttcgatactttacatgctttatgcaatcttttactggtcaaaccagaaaaccttcaacaagtttgctctgaagattccttggcaaagttagacggagcaattctccatagttttatacaattacgaagtgactttaaagttcaaaagcaaacaattttaaaagtttag

SEQ ID NO: 852 - DNA, 741 bp, Phyllotreta striolata
gaccgaagagaacgactgaggcaactggccttagaaaccatcgatctgcagaaggacccgtattttatgaaaaatcacctggggtcttacgaatgtaagctttgcttgaccctacacaacaacgaggggagctacttggcgcatacacaaggtaaaaagcaccaggccaatttggccaggagggcagccaaggaagccaaagatgctcccacgtcgctgcaaccggagaagccccgagtggagcccaagaagttcgtgaaaatcggtagacccggttatcgggtgactaaacagagagatccagaaaccggtcaacagagtttactgttccaaatcgattatccagaaataagcgatctggttttgccccgacaccgcttcatgtctgcgtacgagcaaaaaatcgagcccccagaccgtaaatggcagtacttactgtttgctgcggaaccgtatgaaaccattgcttttaaagtaccgagcagagaagtcgagaaaacggataataagttctggacacactggaacagggacaccaaacaatttttcctgcaattcgctttcaagaacgagaacaaacgctccgttaactctgtaattcaaaggcattcgattgttggcggagttccaccgcctcccatgctgccggtaccgccgccgcccaggcctcctatgtttaatcctattccaccgccaccgccgatgatgagggccgttttgccagtaccgcctccgaattaa

SEQ ID NO: 853 - DNA, 402 bp, Phyllotreta striolata
atgtctatcggcgtacctattaaggttctccacgaagccgaaggccatataataacctgcgaaactataaccggcgaagtttacaggggtaaacttatagaagccgaggataacatgaattgccaaatgactcaaataacggtaacgtacagagatgggcgggtggcgcaattagaaaacgtttacattagaggttccaaaataaggtttttgatattaccggatatgttaaagaacgctccgatgtttaaaaaacaaaccaaagccgggactgctggtagagggaagtctgctattctacgagctcaagcacggggaagaggccgagggcaacctcctgtacgaggaggcagaggtgcttggcagaatcagcagaatgcccctgcaggtcgagcaaaataa

SEQ ID NO: 854 - DNA, 1329 bp, Phyllotreta striolata
atggctacaaatttatctcgaacatcgctcctaagaatcatcaacgcaaggggctatgcagcccttccgcatccactttctggctttccgaacgcagaagtaaaaagtgcagttctccccaacaaaactgttatcgctgctgttgataacaatgcgtccctcactagagtttcaattgtattcagggctggaagtcgtaacgaagatcccgagaatttaggcgtagctcacgttttgaggacggccgctggtctgagtacgaaaaactgttcgcaattcgccattatccgcaacatccagcaagtcggagccaatttaacggccacatccgatagagaaactatctgctacacgctggaaggtacccctgaggctgtggaatgcgctttaccattcttaaccgaagtagccacccagcaagaatttagaccttgggaagtttccgatttgtccagtagattgcagttggatattgctacaagaccattgcagttgagagctatcgatttactgcacaatgctgcttttagaggacgcggtttgggtaattctctgtttattccgaaaactcaaattggtaaaatttcgtctgaaactctgcaacattacgtttgctcgaacttcaaaagcggacgtatggcggtcgtaggttcaggaatcagtcaaaaggagttgacgtcttttgctaactctttgaaaatagaaaatggtgatggcgataacaccccatctccttacaaaggaggcgaactaagatcgaacaaaggtggtcaactagcatttattgctgtagcaggagaaggtgctgctctcaaaaacagcaaggaagctctcgcttttgctgtactacaaggagcccttggaggaggtccccaggttaaacacggaattacagacagcggtgtcttcaggaaggctcttggaaatagccctgacgttagttccgtagccataaatgcgagttactctgacacaggtctctttgggcttctactggccgttccgacgaagtcggcaagaagtgctctagaaaccgctgttaaagtactcaagagtggaaccgtctccgatgaagatgtcaccagaggtaaaaatcaattgaaagcatcgatcctcttcagtgctgaaagtggggcagatattgtaagaactattggacaagaagctattttgacgcaaaaagttacaagtactagtgcacttttggctcaagtagattctgtttctaccagtgatgtcacaaatgctcttaagaaagcaggccagaaactatcattagcatcggttggaaacttagctggagtaccctttttagatgaactaaagtaa

SEQ ID NO: 855 - DNA, 333 bp, Phyllotreta striolata
atgagaagggcccatgcaggtaactactacgagccattgccgcagaattcgaacgaaattgaagacgaaaatgatcggatgactaacgaattgcaagagaaaattggagcgctgaagtccctaactattgatatcggaaatgaagttaaatatcaggatagaatgctcagggatgttgacgacgatttagaaaaaactggagggtttctaggaacaaccatgaacaaagtactgaggctgtcgaaagggggccacaactacatcattgtgtatttgtttttattttctatcgttgtattttttatactttactttgttattaaatttaggtag

SEQ ID NO: 856 - DNA, 1491 bp, Phyllotreta striolata
atgtcttacccatcgactttgaacgcaaaacaggccgcacaggaacacgttttagccgtgtccagagacttcgtgtcccagccaaggctcacctacaaaacggtgtccggtgtaaatggaccgttggttatcctcgaagatgtcaaatttccgaaattcaacgaaatcgtccagctcaaactggccgatggcagtctacgatccggtcaagtactggaagtaagcggctcgaaagccgtagtacaagtgttcgaaggtacttcgggaatcgatgccaaaaacaccatgtgcgaattcaccggcgacatcctccgaacgcccgtatccgaagacatgttgggcagagtgttcaacggctctggaaaaccgatcgataaaggtcccccaattttggccgaggacttcttggacatccaaggtcaaccgatcaatccgtggtcgcgtatctacccggaggagatgatccaaaccggtatctccgccatcgatgtgatgaactcgatcgctcgtggtcagaagattcccattttctcggcggccggtctgccccacaacgaaatcgccgcccagatttgtaggcaagccggtctcgtcaaggtgcccggcaagtcggcgttggacgatcacgaggacaacttcgccatcgtgttcgccgctatgggtgtcaacatggaaaccgctcgtttcttcaaacaagatttcgaagagaacggttcgatggagaacgtatgtttgttcttgaatttggccaacgatcctaccatcgagagaatcatcacgcctcgtttggctctaacagcggccgaattcttggcctatcaatgcgagaaacacgtgttggtcatattgactgatatgtcttcgtacgctgaagccttgcgtgaggtatccgccgccagggaagaagtacccggtagacgtggtttccccggttacatgtacaccgatttggccaccatttacgaacgagccggacgtgtggagggccgcaacggctccatcacccaaattcccatcttgactatgcccaacgacgatattactcacccgattcccgatttgaccggttacattaccgaaggacagatctacgtcgatcgtcagctgcacaacaggcaaatttacccgcccattaacgtcttaccgtcgctgtcgcgtctcatgaagtccgccattggcgagggcatgaccaggaaagatcactctgacgtttctaaccaattgtacgcttgctacgccatcggtaaggacgtccaggcgatgaaggccgtggtgggagaggaggccctgacgcccgacgatctgctctacttggagttcctgaccaagttcgagaagaacttcatcacgcagggcagctacgagaaccgtacggtgttcgaatcgctggacatcggctggcagttgttgcgtatcttccccaaggaaatgttgaaacgtatcccggccgccacgttggccgaattctacccgagggactcgcgtcactag

SEQ ID NO: 857 - DNA, 357 bp, Phyllotreta striolata
gggattgcccctggagtcgaaaatttggcgagccaaaacggttttgatacccatcgtttcgggatcgtacatatcctggtcgtagatcaacgcggtgcctctgctttctttaaatttagtgaagtattcctgcgcgtacgatactacgtcttcgggctgttcgagcaagtagctgcaagtgaattcgagcaacatggctcgcaattcgtcagggactctgattcctgccctttcgcgttcgcgtatttcgttcattttcgattgtttaataacttttactgttcaatgtacttagaatttgacttaagtgattgcgataagcttcacttctccataatcaaacgggaaacttgctaa

SEQ ID NO: 858 - DNA, 2421 bp, Phyllotreta striolata
atgagttacatgcagactaaccaaaatagaccaatgtctcaaggttatcatcagggtggcaacgatctgccaatgcagtcgtccaaagagcagaccctgctatggcagcagaactcctatttaggagactctggcatccagtcgggggctgccactcaagtcccatcgctatcgggcaaagaagaggaagagatggacctcttcgatctcgaccagccctaccaagggttcacgcaagagcaagtggatgaaatgaataaccagctgaaccacaccagatcccaaagagtgagggctgctatgttccctgaaacattggatgaaggtatcgagattccttctacgcagttcgatccgaaccatcaaacggctgttcaacgtttggctgagcccagccagatgctcaaacacgccgtggttaatttaatcaattaccaagacgacgccgatttggcgaccagggctataccagaattgatcaagctgctcaacgacgaagaccaagtggtggtatcgcaagccgccatgatggtgcaccagctctcgaagaaagaagcttctcgacacgccatcatgaacagcccccaaatggtggccgctttggttcgggccatttccaattccaacgatttggaaaccaccaaaggtgctgttggtactttgcacaaattatcgcaccacaggcagggtttgctggccattttcaagagcggtgggataccggcgctcgtgaaattactgagttcgccggtcgaaagcgtgttgttctacgccataaccacccttcacaacttgttgctgcatcaagacggttcgaaaatggcggtcagattggccggaggattgcagaagatggtagcgttgctccagagaaaccacgtcaagttcttggccattctcaccgactgtttgcaaatcttggcctatggcaaccaagagagcaagctcatcatactcgcctcccaagggcccatcgaattggtcagaataatgagatcgtacgactacgagaagctcttgtggactacttcgagagtattgaaagtgttgtcggtgtgttccagcaataaaccggctatcgtcgaggctggcggtatgcaagccctcgccatgcatttgggcaaccccagcacccggttggttcaaaactgcctttggaccctcagaaatttatcggacgcggctactaaagtcgacgggttggagagtttgttgcaatctttggtgcaagtgctccaatcgtccgacgtaaacgtggtgacttgcgccgccggcatcctgtcgaatttgacgtgcaacaatcaacgcaacaaggtgacggtgtgccaggtgggcggcgtcgacgcgctggtgcgcaccatcgtgagcgccggcgatcgcgaggagatcaccgagccggcggtgtgcgccctacgccacctgacgtccaggcacgtggagtccgagatggcgcagaacgcggtgcggctgaactacggcatacaagtgatcgtcaagctgttgaatccgccgtcgcgttggccgctggtgaaggcggtcatcggtctgatcaggaacctggcactgtgtccggccaatcacgctccgttgagagagcacggcgccattcatcatttggtgcagttgctgatgagggccttccaagacactcaaagacaacggggtagcgtggctagcggaggcagccaaccgccgggaacgtacgcggacggggtgcgcatggaggagattgtcgagggtacggtgggagcgttgcatatattggcgagagaatcgcacaatcgggccatcattagacagcaaatggtgattccgatcttcgtgcaattgctgttcaacgatatcgagaacatacaacgcgtcgccgccggcgttctttgcgaattggcggccgacaaagagggggcggaaatgattgaaaacgagggcgccacggccccattgactgagttgttgcattcgagaaacgaaggtgttgctacgtacgcagctgcggttttgtttagaatgagcgaagacaaaccacaagattataaaaaacggctgtcgatggagttgactaattctttgtttagagaagaaaatctttggaatcccgatctaggcatgggtccggatttgcaggatattttaagtcccgaccaagcatatgacaacatgtatgctcagggtccccccagtgttcatagtagtcatggcggccgaccatatcaacaacaagggtatgaccagatacccatagacatgcagggtttagagatcggttctcacggaggggggaatgggtccacttacagtgcaatagacgcaatggacgttaccagcggtgaacctgatctcaatttcgataccattgatcaactccctacccctcctcaagataataaccatgctgctgcttggtatgataccgatttataa

SEQ ID NO: 859 - DNA, 801 bp, Phyllotreta striolata
atggcccgaaacgcggaaaaggcaatgacaacattggccagatggagggcggcccaattgggggaaatcgacaagcacaagaagcgccgtccgtatttggcctccgaatgcaagagcctgtacgcctgcgagaaatggcgcatgcagataatcagagaaatagcgaaaaaagtcgctcaaatccagaacgccggactgggcgagttccgcatacgcgatctaaacgacgaaattaacaaactgctgcgcgagaagcgccattgggaggaccagatcaaggaattgggggggcccgattaccagcgcgtcgggccccggatgctcgaccacgagggcaaagaggtgcccggcaacaggggctacaaatacttcggagccgccaaggaattgccaggcgtccgagagctgttcgaacaggaacccccgcctccgcctcgaaagagccgagccgaattgatgaaggacatcgatgccgattactacggttacatggacgacgacgacgggattttgataccgttggagatcaaagctgaaaaaatcgccgtccaaaacgccatcaccgaatgggtgaacaacaaagagaagaacctcgactcgagcaaaaccatcgaagagagcatctacgcggtggaggattccgacgaggaggagaccgtcgaacgattcgacggttcccaacagcggttcgtcgcccacgtaccggtaccctctcaacaggacatcgaacaggccctgttgaggcgcaggaagcaggaattgatggagaaatacggcgtacaagacgaacaagatgtctaa

SEQ ID NO: 860 - DNA, 645 bp, Phyllotreta striolata
atggcagcgaaagacatgcccacattcaaatgcgtcctagtcggcgacggtggtaccggcaaaacgaccttcgtcaagcgccacatgaccggcgaattcgagaaaaagtacgtcgccacattgggcgtcgaagtgcaccctttagtgttcacaacgaacagaggtaaaatctgtttcaacgtgtgggatacggcgggccaggagaaattcggcggtctcagagacggttattacattcagggacaatgtgccattattatgttcgacgtcacgtccagggttacctacaaaaacgtccccaattggcacagggacattgtcagggtgtgcgaaaacataccgatcgtactgtgcggaaacaaggtcgacatcaaggataggaaggttaaggctaaaagtatcgtgttccatagaaagaagaatcttcagtattacgacatatctgcaaaatcgaactacaacttcgagaagcccttcttgtggctggcgaggaaactgatcggcgatcccaatttagatttcgtggcggaatcggccctgttgcctccggaagtgcaaatggacccgcagtggcaacaacagttggagaaggatttgaaagaggcttcggaaacggccctgcccgatgacgatgaggatttgtaa

SEQ ID NO: 861 - DNA, 480 bp, Phyllotreta striolata
atgacaagtatagagacagtgggtaccatcgtgcttaaaatattgaagttggtaataaatttgatatgcataatactatacaggaccggttaccagggctacttcttaggagtaggaggaacatggaacttaaacgaagaaaaaaatcctgattcggaaattgtggcatctggaatctttgtcggctacatgatctacactatcgtatctcttataagcctgtgtttcgccagcggtgatcacaaaacatctttcaccgatattttaatgaatatagtcggtgtattcatgtgggtggccgttggagcaacagcacttcactactggctcggttatttgtcagaatataaatactcgagcgttgattccgagcgacaggtgggcttggcgttaggagccttgtgcgttataaacggtgcagtctatctagtggacagtgtgttgtctgtcgtatttataattaaatcgaagatgcaataa

SEQ ID NO: 862 - DNA, 2505 bp, Phyllotreta striolata
atgcctagaataatgataaagggtggtgtttggagaaacacagaggatgaaattcttaaggccgccgtgatgaaatacggcaaaaaccaatggtctagaattgcctctctccttcacagaaaatctgcgaagcaatgtaaagcccgttggttcgaatggttagaccccagcatcaaaaaaaccgaatggtccagagaagaggatgaaaagttgttgcacttagctaaactaatgcccacacaatggagaaccatcgcacctattataggcaggaccgcagcccaatgtctagaaagatacgaatatttactggatcaagctcaaaaaaaggaagaaggcgaggacgccgtcgacgatccgaggaagctaaaacccggagaaatcgatcccaatccggaaaccaaaccggcccgacccgatcctaaagatatggacgaagacgagttagagatgctttctgaagccagagctagactggccaacacccaaggcaaaaaagccaagcgtaaagctcgcgaaaagcaattagaggaagcccggcgtttggcggctttgcagaagcgccgagaactgagagcagccggcatcgaggtcacttcgaggcgcaagaagaaacgaggcgtagattacaattcggaaattccattcgaaaaacaaccagccatcggtttctacgacacttctaacgaagccctcgacttgatggctccagatttctctaaaatgagacaacaacatttagacggtgaactcagaagtgaaagagaagagagagaacgcaagaaggataagcaaaagttgaagcaacgcaaagagaacgatatccctcaagcgatgctgcaaaacgaggaaccggctaagaaacgatcgaaactggtgttgcccgaaccgcagatatccgatcaagagatgcaccaagtggtcaagttgggcaaagcgagcgaaacggcccgagaaatcgcgacggaaagcggcgtcgaaaccaccgatactcttctcaacgattacatgttcacaccgcaggccgccgctactcctagaactccagcaccgcaaaccgacaggatacttcaagaggcccagaacatgatggcccttacgcacgtcgatacgcctctcaaaggcggtttgaatacgcccctgcacaattcggacttcagcggggttctgccgcaatcgcaagcgatcaccacacctaatacagtgctcgccacgccgttcagatcgacgcgaagcgatggcggggcgactcccggaagcacggcaggattcatgacacccaaaagcggagccctgactcctgtcggcaaaaacgcgacgccttccatcagagataagctgaatattaacgctgaagaaactttagacgtgggaagtactccggccgaacaccgaatgtatcaaatgtcgatgaaagaccaattgaaactaggactgagcagcttgccgcagcccaggaacgattacgagatcgtcgtgcccgaaaacgaggcgcaggatgaacccgaagaagcccaatcgcaattggtcgaagaccaagcggacgtcgatgccagaaaacaagaggaactgagagccaaggcggctcaagaattagcgtcgcgttcgcaagtcatccaaagggaattgccgaggccgcaagacgtgaatctcacggtgctccggccgcccaacgagagctactccttgacggaccttcagcgcgccgaggaattgatcaaatgcgaaatggttacgatgttgcaatacgacaatctgaagaaccctctgccggcgcaaagtaagcgatcgaacatgtcgcaggctcagcaattggcctttctcgagcaacatccgtacgattcgttcaaaacggaggatttggacgtggctaaatcgctgttgaggagcgaaatggatgtggtaaaaagcggcatgaatcacggagaattgccgttggacgtgtacaatcaggtatgggaagagtgcctgggccaagtgttgtatcttccgaatcagacgaggtacacccgcgcgcatttggcgagcaaaaaagatagattagaatcggcggaaaagcggctggaacagaaccgatcgcacatggccaaggaggccaaacgcgccgccaagatggagaagaaattgaagatattaacgggcggttaccaatccagggcgcaggtgctgattaaacagttacaggatcaatacgagagcatcgatcaatcgacgttggagttgaacacgttcaaattcctggccgagcaggagaagaacgctttgccgatgcgaatacagtctcttactgaggacgtgaataggcagatggaaagagagaaggtacttcaaatgaaatacgctgattaccagaatcagattaaagagttacaagaggagtatttaggtcaaatgcaaaatgttccaaatgaagaatcaaataaatatgacgaggtcacttcgaccaccaatgaagagaatggtatggacacgtcggaaaatgaaacagttactgctgaaaattaa

SEQ ID NO: 863 - DNA, 474 bp, Phyllotreta striolata
atgatgcaatttatgttactgttcagtaggcaaggaaagttgcgattgcaaaagtggtatgtggctcatcctgataagctgaagaaaaaaattactagggaattaattaccactattcttgccagaaaaccaaaaatgtgcagtttcttagaatggagagatttgaaaatcgtttataaaaggtatgctagcttgtatttttgctgcgcgatagaacaatgcgacaatgaactgttaacattggaaatcattcatcgttacgttgaactattggataagtacttcggaagtgtatgcgagttggatataattttcaactttgagaaggcctatttcattctggacgagctaatgcttggtggagaggtgcaggaaaccagtaagaagaatgttctgaaggcaatcgctgcacaggatctcctacaagaggaggaaacaccgcaaggattcttcgacgatcacggactgggctaa

SEQ ID NO: 864 - DNA, 1251 bp, Phyllotreta striolata
atgtatggattacaacgatattcgtttggttataccctcaaaaatgcggtgcgttattactcgagagaaccagccaagagatcgtcgtttctcagccgattgtacgacaatttcaaggacgaaatgaacaaaaacaaagaaatgaaagagtcgctgaagaaattccgcgaagaagcgcaaaaattagagcaaagcgacgctttgaaagctgcccggcagaagttcgaaaccgtagagaaagaggccagcaaaggcggcgaagtgttcaaagagagtttaggttctatcaaagatcgagtcaaaggcgtcatagacgaggccagtaaatcggatttagccaagaaggccggtaagtttaccgaagaagtaggaaaaactacgcacaaaatcagcgaaaccgcacaagaaatcagcaaaaccggagcgtttcagagcatatcggaagccaccaaagccgtcaaacaagaaatcgacaacaccagcatggaaggtcgagtgtatgtcagtcctaaaaagctacgaaaacgaaccgaaaccagcgccgtagtccaacagaaatactacgaacccaacacggacgccacaggcgtggaactccacaaagactccaaattctacgaatcctggcagaacttcaaaaacaacaacccctacgtacacaaagtcatggactggaaactcaaattcgacgaaagcgagaaccccatcatccgagcctccagggcgctcacggaaaaagtcggagacatcatgggcggcttattccaaaaaaccgaactctccgaaaccctaacggaaatctgtaaaatcgacccggacttcgatacaaaacgcttcctgaaacaatgcgaaaccgacatcatccctaacgtactcgaagctatgacgcgaggagacctcgaggttctgaaggactggtgtcacgaaggacccttcaatctattcgccatacccatcaaggaggcctacaagaaaggctataaaatcgaatcgaaaatcctggatgtagaccacgtggatttgatgatgggcaaagtgatggatcaagggcctgtgttgattatttcttttacatcgcaacaggtgatggccgtgcgggacgcgtcgggggcggtcgtcgaaggcgacccagacaaagttatgagggtgaattatgtgtgggtgttgtgcagggacgtggtggagccggatccgagggcggcttggagactgctcgatctgtctgcgagcagcaacgagcaattagtataa

SEQ ID NO: 865 - DNA, 906 bp, Phyllotreta striolata
atgaatagcagcgattcagaattaagcgatagtgatgctgagttgcaacaagcgttgttagatggtaaactgaaacccggattaaataaaatcgaagaagctcccaagcaattcgtaaacaacataagtggcctaaaccagaaaatagaagaattcaaattgaaactgccatggatcgagaggttggactgtacaaacgcccaagcccccctggcgcccgaattggctgcggaaatgttagttcacgaagaaaagaggagtaatcaactgagaaacaacaaaaaacttccccaattccaaccatccgaagacccggttctgaacgatttcaaacgagagctaatattccacaggcaagcacaagctacaattctagaagccatcccgaaaatcaaagaattagggatatccactaaaagaccagaagattattttgctgaaatggccaaatccgatgagcaaatgcacaaaatcagggagaacctgaagcagaagcaggagcaacagaagcggattgaacgggtgaagcaattgaggcagcaaaggaaagaaggaaaatcgctgcaggtgcagctgaaactgcaacgctctaaggagaagaaagaaatgatggatcaagtaaagaaagcgaagaaaaatttcgattttctcgacgataaaaataagcccatgggtaagagggcggcggagaagcgtaagatgaaggataagaaattcggtttcggcggtaagaagaaagggatgaagaagaatacaaaggacagtgcaggcgatataagcgagtatagaaatcctgggaagccggctaagaagcaggcagggaaaaaatttgtcaataaaaacaaaccaaagcaacgattgggcaaaactagacgcattaaaactaaggctaagggaaaaaaataa

SEQ ID NO: 866 - DNA, 663 bp, Phyllotreta striolata
gaattttgtatgcttttagctttatcaattttaaatattaaaataaaatcatatataaaattcaacaagatgaacgaattagagaagctagaatacctttctttggtctcaaaaatttgcacagaattggacaatcatcttggaatgaacgataaggatttagctgaatttattatacatctctccgagaaaaacaacacattggagtctttcaagaaggtgctctcagaaaatggcgccgaattctcggattcatttgtttctaacttgctgcgaattatccagcacatgaagccgaagaaatcctccaataaggaagagttcgataaagtggaaaaagagggactagcttttaaatttcccggtctagcaatacctaatgagaaacaaaaacctttacaattagaagaatttgataatgaaaatgaaaatgatgaaatagacgttgtagctgatatgatgaaacagctcgaggccgatgcaccttctcaaaaacaaaccaaagaaaggtccagaagccccagcatcgaaaagaaaccgagagtaagatctggaagtagatcgaaggaacgaagaagatccagaagcagatcgaaagatagacgaagatctagaagcagatcgaaagatagacgaagatctagaagcagatcgaaagataga

SEQ ID NO: 867 - DNA, 1869 bp, Phyllotreta striolata
atgaatccaggcgccccaaattaccctatggcgtctctgtatgtcggtgatttgcattccgatatcaccgaggccatgctctttgaaaagttttcatcggctggccccgttctatccatccgcgtctgcagggatttgataacccgcagatctttgggttatgcttacgttaatttccaacaacctgctgacgctgaacgtgccctagacactatgaatttcgacttgatcaaaggcaggcccattcgtattatgtggtcccaacgtgacccgtccctgcgaaaatccggcgttggtaatgttttcatcaagaacttggaccgatccatcgataacaaggctatgtacgacactttctccgccttcggtaacattctcagctgcaaagtggcccaagacgagagcggagtcagcaagggctacggtttcgtccacttcgaaaccgaagaagccgccaataaatccattgaaaaggtaaacggtatgctgttgaacggcaaaaaggtctacgttggtcgtttcatcccgcgcaaagagagggaaaaggaattgggcgagaaagccaagctcttcacgaacgtttatgtgaaaaatttcggagaggacttgtccgaggaacagctgagaaccatgttcgagaagtacggcaagatcaccagctacaaaataatgagcaaggacgatgggaaatctaaagggttcggtttcgtcgctttcgagagtcccgaggctgccgaatcagctgtcgaagccttaaatggcaaggaaatattggaaggcaagcctctgtacgtgggaagggcccagaagaaggccgagcgccaacaggaattgaagcgtcgcttcgaggccctgaaaatggaaaggctgaaccgctaccaaggcgtgaatctatacgtgaaaaacttggatgataccatagacgacgagcgcctccgcaaggaattctcgccgttcggcaccatcacgtccgccaaagtaatgatggaagaaggcaggagcaagggcttcggcttcgtgtgcttctcctcgccggaggaggccaccaaggccgtaaccgaaatgaacggcagaatcgtcggcacgaaaccgctgtacgtcgccctggcccaacgcaaggaggaccgcaaggcccatctgacgtcccaatacatgcaacgcatggcgaacatgcgcatgcaccagatgggccagttcatccagccgggcggctcgagcggctacttcgtgcccaccatccaggcgacggcgccgcgtttctacgggccggcccagatgccgattcgcacgagcccgagatggccggcgcaaacgcccgtgcggcccggcgcccaagggagcaccgccacctacaccggtatgcagaacagctacagggccgccgcccgaccgccgggccaatccacgatgcgcagcaacatcagcgttccgcgacctatcaccggacaacaaccaccaagtatgcacggtcgtccacttgttggacaaggtgtggctgctgctggaaatcgtgccaacttcaaatacaccgccaacatgcgtaatccaccacaagcaatgttgtccggagctcaagctcaagtacaacaagcagtccacattcaagggcaggaaccccttactgctaccatgttggccgccgctcctccgcaggagcagaagcagatgttgggagagagattgttccctctcatccaaaggatgtactccgatttggctggtaaaatcaccggtatgttgttggagatcgacaacacggagttgttacacatgttggaacatcaagaatcgcttaagaacaaagttgaagaagccgtggctgtactccaagcccatcaagctaaacaagctgctataaaaaaagattaa

SEQ ID NO: 868 - DNA, 2781 bp, Phyllotreta striolata
atgaccgactcgaagtattttacaaccaccaaaaagggagaaatattcgaattgaagtcagaactcaacaatgataagaaggagaaaaagaaggaagccgttaaaaaggtcattgcttctatgactgtaggcaaagatgtctcagcattattccccgatgtcgtgaattgcatgcaaactgacaatttggaacttaaaaaattggtttacttgtatttgatgaactacgccaaatcacagcccgatatggctattatggcagtcaataccttcgttaaagattgcgaagatcccaatcctctgattagagcgctagctgttagaacaatgggttgcattcgagtcgataaaatcactgaatatttatgcgaacctctaaggaaatgtctcaaagacgaagatccttatgttagaaaaactgccgccgtttgtgtcgctaaactgtacgatatttcatcaggattagtcgaagaccagggattcctcgaacagctaaaagagttattaagcgattctaatccgatggtagtcgccaacgccgttgccgctttgtcagaaatcaacgaaagcagccctacaggacaacccctcgttgaattgagcaccaacacgatcaacaagctcctaaccgctctgaacgaatgcaccgaatggggccaagtgttcatactcgattccctatcgaactacacgcctcgtgatgaacgagaagcccaaagcatctgcgaaaggatcactcctcgtttggcccacgccaacgcggctgttgtattatcggccgttaaagtattgatcaaaatgatggagattttggcgggtgacaccgaattttgcaacacgctcagcaagaaactggcgccccctttggttaccctgctgagctccgagcccgaggtgcaatacgttgccttaaggaacatcaatttgatcgtgcagaagaagcccgacatattgaagcacgaaatgaaggtgttttttgtgaaatacaacgacccgatttacgtgaaactggagaaattggacataatgattcgattggcatcgcaagtgaacatcgctcaggttctgagcgagctgaaggaatacgcgacggaggtggatgtggatttcgtgaggaaagccgtgagagcgatcggtcgatgcgccatcaaagtggaaccgtcggcggaaaggtgcgtcgcgacgctgttggatttgatccagaccaaagttaattacgtcgtacaggaggcgatcgtcgttatcaaagatattttcagaaaatatcccaacaaatacgaaagcatcattagcacgttgtgcgaaaatttggacaccctggacgaaccggaagcccgagccagcatggtctggatcatcggagaatacgccgagcgaatcgacaacgccgacgaattgctggacagtttcttggaaggtttcggcgacgagaacgcccaagtccaactgcaactgctcacggccgtcgtgaagctgttcctgaagcggccccaacacacgcagggcctcgtccagcacgtgctcagcctggccacgcaggactccgacaatcccgatttgagagacaggggattcatttactggaggttgttgagcaccgatccggccgccgccaaggaggtggtgctcgccgataagccgctcatttccgaagaaacggacctcttggagccgactcttctcgacgagctcatctgccatatttcatcgctcgctagcgtttatcacaaaccgcctactgcgttcgtagaaggccgaagtgccggtatcagaaaaacgttgccggccaggcaaggttccgatgaaggcgtcggtgccggcgccgccgccgccgaaacgacggtcatcccgaaccaagagagcctcatcggagatttgctttctatggatatcaacgcgcccgctccctcggccgccgccgctcccgccgccccattggctagcaacgtcgatttgctcggcggtggattggacgttttgctcggaggcggtagtgatatcggcggtggtggcgccgttagcgccgccgctcccaccaccaccggtcttctgggggatatattcggaataccttccgctcctaccatgtacacacctccgaaggttatctggttgcccgccgaaaagggcaagggtatggaaatctacggtactttctccagacggtccgggcagatggccatggaaatgactattaccaataaggctatgcaggccatgtccggtttcgccattcaattcaacaagaacagcttcgggatcacgccgtgcgcgcccatgaacgtgccggccctgcagccgggccaaaatctcgaatacagtttaccgttgaacacgacggggcctgttcaacggatggatccattgatgacgctccagatcgccattaaaaacaacgttgacgtgttttactacgcctgccagatacctatccagatattgttcggcgaggacggtactctggataagagggtgttccttaccacttggagggacattccgggagctaatgaggtccagtacacgttgaacgacatcaaaggcaacaccgacaccgtttcgaacaaaatgacgttgaacaacatcttcaccatagcgaagaggaacgtcgaagggcaggatatgttgtaccaatcgctgaaattgacgaacaacatttgggtgttgttggaattgaaattgcagccgggcgtcccgacggcgacgctcagcttgaaatcgagatcggtcgaggtggcgccctacgttttccaagcgtacgaatccattttgaagagttaa

SEQ ID NO: 869 - DNA, 498 bp, Phyllotreta striolata
atgccgcctaaattcgatcccaccgaagtaaagtacgtttacttgagatgtgtaggaggagaagtaggagctacatcatctttggctccgaaaatcggtccccttggtctgtctcccaaaaaagttggtgacgatattgccaagggtactgctgactggaaaggtttaaaaattacggtacaattgaaaattcaaaaccgtcaagccaccatctccgttgtaccatcggctgcttccttaattatcaaggcattgaaagaacctcctcgtgacagaaagaagcagaaaaacattaaacacagtggaaacattacattcgatgaagtgcttgccattgcgaagcaaatgaggcctagatcaatggccaagagcctttctggaactgttaaggaagtgctaggtacagctcaatctgtaggttgtacaattgacgggaaagcccctcacgacgtcatagatgaagtcaatgagggtactgtagaagttccagatgagtaa

SEQ ID NO: 870 - DNA, 1095 bp, Phyllotreta striolata
atgagcgaagaagggaaaagagcgttaattttagtaggaggctatggcacaagactgaggcctctaactttgagccggccgaaacctctcgtggagttcgcaaacaaaccgatcctattgcatcaaatagaagcgttagtagacgcaggagtaacggaagtcatattggccgtgtcgtaccgtgccaagcaaatggaggaggaacttacagttgaagcggccaaactgggcattactatagtattttcgcatgagactgagcctatgggcaccgcaggaccaatagcattagcgagagaacacctctcgaaaagcaccaagccgtttttcgtattgaactccgacataatatgcgacttcccgttcagggagctggccaagttccacgaaggccacggaaaagaaggcacgatagtcgtcacgaaggtcgaggaaccctccaaatacggcgtggtggtgtacgatcaaaacaactgcatcgagagcttcgtcgagaaaccccaggagttcatttcgaataaaatcaacgccggtttgtacattctgaatccgagcgtgatcgatcggatagagctccggccgacttccatcgaaaaggaagtgttcccttacatggcgaccgacaagcagctctacgccttcgagttgcaagggttctggatggacgtcgggcaacccaaggacttcctcaccgggatgtgcttgtatttgaaccatttgcgggaaactaacagccagaagctgtacaaaggtcccggtgttgtggggaatgtactggtcgatcctacagccaaaattggcagtaattgccagattgggcctaacgttacgatcgggccgggcgttgtaatagaaaacggtgtttgtataaagcggtcgacgatactgagaggtgcggttgtttgctcgaattcttggttggagagctgcatcgtgggatggaagtgtcacgttggtaaatgggttagaatggaaggcagcaccgtactcggagaggatgttattgttaaagatgagacgtatataaatggagggcaggttcttcctcataaaagcatcgctacgtcggttccagaaccccagattatcatgtag

SEQ ID NO: 871 - DNA, 867 bp, Phyllotreta striolata
atggcgtcggacggtgaagaagtgataagtgatcaagaaaaagtaaaaatagtttcggatttcatcctccattcgccgcccggtgaattcaacgaagtcttcaatgatgtaaggaagcttttaaataacgatgaccttctaaaagaaggagtaactggggcgttcgcccaatacaataaagaccaactcacccccgttaggatagaaaacgccgatcaaatggtgctgattacagaatacaacgatttaggtaacaatagattcttcgacccccgtagtaagcaaagtttcaaatatgaacatttaagaaaggaagcttctgattaccagccttatagtcttgatacgacggcggagccttggcgggccgccctagataacgagtttatacaatacacaagaaaccattataaagacggcgtttgtagcgtattcggtcgcagtcaaaacggtgcgatcacccttacagcttgcatcgaagaccaccaatttcaacccaagaacttttggaacggtcgatggagatcccaatggtctgttagtttaaccgatgattcaaccgcagaagtacggggcgtcctcaaagtgcaagtgcattattatgaagaaggaaatgttcaactggtgagtactaaagagatcaaggaatccattctggtttctaacgaagctcaaacggctaaggaaatcatccatgtaatagagaacgctgagaatctgtatcaaacggctatttcggaaaattatcagacgatgtcggacacgacatttaaggctctgcgaagactcctgcccgtcaccaggacaaaaatggattggaataagatcgtatcttatagtattggaaaagaactaaaaacacaatga

SEQ ID NO: 872 - DNA, 3774 bp, Phyllotreta striolata
atgcatgtgaaaatgaactttctgctagtgttaataatcagtgcggtggccgtcggggctcaagaggatgccgccggggctcaagaggatgccgtagcgcccgatgcagcgggccaggataatacggaagacgtggaaagcatcgacgtcggtgcagcaagaggcgacgtcggcgacgtcgatcccaagcccgttcccgtcgaggaaaacaacggcggggcggttacgaataacctcaattacgacgctcccgtagaacaacgctcccgtaaattaacaaataccgatagcgaaataattgatactaacagttccaaacccaattggactttccagaaaaaaactaaatctggaaaatacgttacttattatggggccaattatgaccccatgacatcagccaccgcccctccggacaccgatcaaagaggtggaggcatcccttacctcattaccgaaaccaggttagcggacattaggaaacactttatgtatccgttcttcgataaagggggcaacgtggacaacgagggggattatcagaaggaaatccaatcctccacgccccaagtccacaagaatatgaacttccaattgccgttcttcggattcaggtataattacacgagagtctccatcaacggttatttggaattcagcgatccacctccgaattacgattacccattagtttttccggttaaagactggcctaagcgaaacgatccagcttttattggtattttcttcagtaaatgcaaaatcggtaaccttcgcgacgaagacgtcgacaaacgtaaacccggtgtatacttccgaatggaaagagacctcagggacagacaagacagaatgggagtggaaataagggaaagattgaaatgggacatcagagagggcgtgatcggttcggaaaccttcaatcccaaacacgccataatcgtcacatggaaaaacgtatcgttcaatggaggattcggccccgcagtttttcaaaccaatacattccaaatggtcctcgctactgacgaagtattcacgtacgcaatattcaactacctaaacttggaatggaccagtcacacggaagccggtggagacaccagaaacggggaaggcggtgtaccggcattcgttggattcaacgccggtaacggtacaagaagctaccagtacatgccctacagtcaagcatccgtcattcgagatttgacagcgaccggttggggtaacggcaaaccgggaagacacattttccgaatcgacgagaacatcctgctaggttcttgtaacaaagatatcgatggggctaatttaccccttcaatttgcgccggagagcggtaatatgttgggaggaaccgtcgtcaacatcacaggtccctgtttcaatcccaacgataggatcaggtgtaaattcgacgtgttcgatgaagttgtcggatacgtcgtcgacaggaacagagccatttgcattcaacctcctctttacacagaaggttgggtcagactgcaaatcgccgtcaattcggaagcgttcaaatggaagggaaaatactacgtcgaatcgcccgccaccgcctcccagaagatcttcttcaaagacatgaagtaccacgagaagtcgcccagcgagtttcgcatcacgtggcagaagcagaatttgaccaccaacgaaaatgctaacatcagaatctccttgtggggctacagggaaactaccatgagacctacgttcgtttacataactgaaatagccagtacccagaacgccggggagttcctgatctcgccgtcgcagtacaggggcaaagtcaaccaattcttaagtgacatcaagtttggattcttgcaaataaatttgactgaatcggtaaaggtcaacatttactcgacgaccaatcaaaacgtcgagattacaccggttatttggagccggccgattccgcttgcttggtatttccaattccaatgggagagtcaatacgggaagaactggcccaaacacctctgcgacgattggctcagaacggacagatatctgaagaatttcgcacacgaattaccccaatgcccttgcacagtccaacaggctttggcggacaagggaaaattcatgcccgactttgattgcgacaaagattcgaatcctgtttgttactacaataatcaagctttgcattgcgtcaaaactggtgcacccacaatggaaggttccgagcaacaatgttgctacgacaaaaacggttacctgatgctatcctacgatcaacaatggggttcgagtcctcgtcgatgccacaacttgggaaaaatgccttacaatgaagccaccaaagtccccacgctgtctcaatggttcaacgacatagtgcccaaatacctctgctgtctctggcaggaagagcaagccgtgggctgcgaaaccctgcgattcgaacgaaggccttcgcaggattgcgtcgcctatcaagcaccaggtgtagcaggagtgtacggtgacccgcacatagtcaccttcgacgatgtcgaatacacattcaacggtaaaggggagtactccttagtgaaatcggtcaaggtggacgataatttagaaatacaggcgagattcgagcaaatgagccccaatgcttatggagaggtgagagcgacgcaactaacggcgatcgtggctaaaggaaacaagactattcccattgaagttagaagtagaccgatagaatccagatggaggtatagattagatgttatagccgagaacaggaggttgtactttgatagaccttcgttgaaattccaacatttccaaggcgtgactgtttatacaccaacctacattctaaatcaatctgaagtactgataatgttcgacaacggcgccggtgttgaagtactggacaatcaagggtacatgagcgccagagtatacttaccttggtcgtttataaataaaacggttggattgttcggaaattggagtttcaacaaagaagacgacttcaccctgccggacggttccaaggcggccgtcgtgtcaaacatcaacgacatggagagagtgtacaacgacttcggttcgaaatggatgctcgacgacgtcggcgacgagcgcaaaggccagtccttgttctacagggaattcggccgcacctcggccacctacaacaacaagaccttcaggccgcagttcctgatgctgcccgaagacatcctaccgccgaacagatcggagcaaatacagcgcacctacgaggtgtgctccacgaagatgtacgaatgttactacgactacgccatgacgctcaacagagatttagcgcactacacgcaaaactacaaggcgaccatttacgaactgaagcaaaccaccagggagaagatcacgtcctgcggcgtgctggaaacgcccaggttcggcaggaagagcactttcttattcgtacccggcacgaaggtgacttacgaatgtatacaagatttcgtgctagtcggtgatcctagaagagagtgcggggctgatggaaaatggaatattccagaatatggatacacgtattgtttacgtcagcaggaatattcccaacgacaagcaggaatcacgtccgggataataatgttagtgctcataccgctcatcctgctgttcgtgtatttggcgtacaggttcttgaagaagaaacagaaagaacgggatgagagcaggatgcagcaggaccaatacagagagcaatctaggaaagctcaagaggcagcgacgaggaaattaaccgag

SEQ ID NO: 873 - DNA, 303 bp, Phyllotreta striolata
atgtcatcgtcttcggattctgattcaactttcttttcttccttcttggattctttcttttcttctgcggcagcaggagcagcggcaactgcagcagcagctacgggtgctgcaccacctactggcatggaactcaacttctcgcgacctttagtaatgagctcttcgatggatttgccgttgagttcacccaagaccttcttgaccttttcggcttcagcttctactccaacggagccgaggattttttcaacatcggcagcgcttggggaagcgtttccgcccaaagcggctaataagtaa

SEQ ID NO: 874 - DNA, 2457 bp, Phyllotreta striolata
atgactgaccgttttggattaaaatgggaccccaaaaatttagaaattagaaccatgtcagtggagaaaaccctcgagccccttgtgctgcaggtaacaaccctcgtcaacacgaaggggcccagtaaaaagaaaaagggcaagtcaaaacgtgccaatgctctcgtcagcacagtggaaaaggccactgagaatttcatcgagaaaggcgagcaaatcgcctacgaaaatcccgatataaccgatgagatgatagctgctgttgaagaagtcagaaaaactggcaacgcaatgagcatagctgcaagggaattctcagaggatccttgctcgtctttgaaaaggggcaatatggtacgcgcagccagaaatcttctatcagcagtcacgagacttctcatcctcgctgatatggtcgatgttcatcttctactacaatcgctccacgtagtcgaagacgatttggaaaaactaaaaaacgcctcgagccacggcgaactcctcgacaatatcaagaacttcggtcacaacgcaaacgaacttatgaatcaggctgctaaaagacaacaggaactaaaagacccgcagcttcgcgacgatttggccgccgcccgagcggtactcaagaaacattccacgatgcttctaacggcttccaaagtctacgtccgtcaccccgaactagccgccgccaaagccaacagagactacgtcttgaagcaagtctgcgaagccgttaatacgatcaacgacgtcgcgcagggccggacgccccagcccgcttcgggcccctacgacggacctggcgaactggcggccgctttggacgatttcgatgatcacatggtgatggagcctctggcttacaacgaggtccacacgagaccatcgctcgaggagcgtttggagagcatcatcagcggtgccgctctaatggctgattccagttgcaccagggacgagagaagggaacgtatcgttgccgaatgcaacgctgtaaggcaggcgttgcaggatttgttgtccgagtacatgacgaatatgggtaagaaggataagagcgacaacctcaacagggccatcgacaacatgggcaggaagacccgcgacctcagaaggcagctcagaaaggccgtcgtcgatcacgtttcagacagcttcttggagaccaacgtacccctgctggtgctcataaaagcggctcaaaacggcaacgaaaaagaggtggaggaatacgccgtcgtattcaccgaacattccaacaaactggtcgaagtagccaatctcgtctgcagcatgtcgaacaacgaagacggcgtgaagatggttcgatacgccgccgctcaaatcgacaatctctgccctgaagtaataaacgcagctagaatattagcggcgagatctcgcagcaaagtcgcccaagaaaacatggaggctttcaagcaatcgtgggagaaccaagtccgcattttgaccgaagcagtcgacgatatcactacaatcgacgacttcttggcagtctccgaaaaccacatactggaagacgtcaacaaatgcgtactagcactccaagaaggcgatgctgatacattggaccgcacagccagcggcatcaaaggccgatcgaacagggtgtgcaacgtggtgacggccgaaatggacaactacgagccgtgcatctacaccaagcgcgtgctggaggcggtgaaggtgctcaacgatcaggtgatgccgaagttcacccaaagagtgcaggtggccgtgcaggcgttgggcaacagcccgcccaaggaggtcgacgagaacgatttcatcgacgcctcgcgattggtctacgacggcgtgagggagatcagaagggcggtgctcatgaatagggccgatgaggatttggatcccgaagacgtggaactcgacgagaattacctcatcgagactaggagtaaatcgagcgctcataccggtgaacacggcgtcgatgagtatcccgatatcagcggaatcaccactgctagggaagctatgggtaagatgcccgaagaggataagcagaagatattgcagcaagtggagttcttcaagagcgagaagctgaagttcgatcgcgaggtggccaaatgggacgataccggcaacgatatcatcgtattggccaaacacatgtgcatgattatgatggaaatgaccgattttaccaggggaaagggtcctctgaaaaccaccatggacgtcataaacgccgccaagaaaatatccgaagcgggcacgaaattggacaagttgaccaggcaaatagccgatcagtgtccggaaagttcaacgaagaaagatttactcgcctatttacagcgcattgccctttactgccatcagatgaacattacttctaaagtcaaagcggacgtccagaacatcagcggggaattgatcgtgtctggtgtacgttatacactctaa

SEQ ID NO: 875 - DNA, 1224 bp, Phyllotreta striolata
atgtctttcaacttcggaaatactagcactccaaaaacagctgctaccggctttacattaccgtcaaatccggcaactactagtgctactggattacagtttaatttcggaggaggagacaccaaaaccgaagttaaaccatcatctacattattttctacggccacaagtggcgcaccagctttcgggattgccccacaaccggcatcatccgcgtctgctgcaccatcgtttaattttggtacgcctacaacccaacagccgacagcatccgctttcggtacagcagccctagcctcattgagtactccaacatcttcttcccaatttggactaacctccagggcccctaaggacacatcagggttatatggatcaaccacagctgcagcgcctactccagcatcaaccggacttggttttggaccagcagtttcaacaacgtcttcagcagccccagctactacaggaactacccccctttttggagtcgcatctaccccgagcaccactacattagccagtgcccctgctttaggtttatcgaccacaatttcttccgctgcttcaacaactccatcgacttcattaagtactacaacagcacccccggcttactcaacatcgacacttacttctactggttcgttaactttcagtcaactggaagattctattaacaaatggaccattgatttggaagagcaaggaaaatttttcattaatcaagcgaagcagcttaatgcttgggattcgttgcttatttcaaatggtgaaaagattctcaacctgaacggtagtatcgagagagtcaagcagcagcaacagcaattggatcaagaactcgattttgtcttagcacagcagaaggaattggaagagttgataacaccgctggaaaaggaattattggaaattcccgtgacggacatagatcgaaatcaaatgtatcaattttcggaaataatcgattcgcaattgaagcaaatgtccgatgatttgaaagaaattatcgagcacattaacgaatccaataaaagcgaagaagtttcgaatccattgacgcaaattagccgcataatgaacgcccacatgaattcactccagtggttagacagaaatacggcgcaaattgtttctcatctcgaacaaatcaataaaatgcaggactctaaccgaaggaattttcctctcaatcattcttttaataattcactactttaa

SEQ ID NO: 876 - DNA, 582 bp, Phyllotreta striolata
atgttcatatgggattggttcacgggagtgttggggtacttaggactatggaagaagtccggaaaattgctgtttttaggactggataatgctggtaaaacgaccttattgcacatgcttaaagatgatagactggcccagcacttgcctacattgcatccgacttcagaggaattatccatcggtaacatgagattcaccacgttcgatctcggagggcattcgcaggctagaagagtgtggaaggattacttcccagctgtagacgccattgtattcctcattgatgctaacgacagatcgagattcgtagagagcaaacaggaattggatgctttactaacagacgaaaccctagcgaattgccccgtgctgattctaggcaataaaatcgatctaccggacgccgcctctgaggatgagttgcgaaacgtttactcgttgtatggccaaacgaccggtaaaggtaaagtcgctcgatcggatttgcccggaaggcctttcgagctgtttatgtgctccatattgaagaggcagggatacggggaagggtttcgttggttggcgcagtacattgattag

SEQ ID NO: 877 - DNA, 564 bp, Phyllotreta striolata
atggacccgatcgccgtactagaaaaacgcatcgaagccctcgagctgcaggtgttccctttgggcgactacaagcaaatatccaacaaaacgcaaaccataacgaatttgctggtggaaacgcaaaccatgatcaattcggcgttgacctgtcgcgaatcgatcacgtcgatgctgcaacacctggtcgtcatcaacgactacctgaatcccacgagcgaggcggacgagctcgaggtggaagcgaaacgccagtatttactcgaattgtatcccgaattgaaggatacgatacagacggtgagcacgttggagtccctgttgccattcatcgattccattaacatatccaaagtggtggagttctcggggaagttggaagaggtggccgtgggcaatctcaaattgtacggggaatgcagggacatcaccaagaaagtgctggtcgcgttacagcaatacaacgacatatccaattccattaagttattgttctcgcaattggatatggccgtcacgaatttagaatacgccttgcagcttcgagacgccaacgaggaatga

SEQ ID NO: 878 - DNA, 1752 bp, Phyllotreta striolata
atgaacaacgccaaattccaagaagtgtacagtgacctaacgctctacaccactccagataaattcttcatcgagccgaaagctggcgaggaattgatggtaatagagcgaaattccgaaaatataatatgtttcaaaagcgaccacagacacctgatacctgcagcgaacagccggaaggatttctgcgggttaataggtataatccaactgttagcttgtccctacttagtagtagcagttcaaagggaattggtcggttacatagcaggttgcgctgtctggcgtctcgccaaagccgaactaattccatacaggagctgcgcgcacttatcgcctgaaaaacaagcagacaacgatgtctatttgtccatggtgtattctgtactatccactccatttctatacttttcgtacgactacgatctaacgcattccttgcaacgcttgcacggtataagccctgatttttggaaacaatccttgttcgagcgagccgatcaaaggtttgtctggaacggaaacctgttatactcgttcaaaggattttcgatacacagattttgcttgcctctcatgcacggattcgtttcgataaatttctgcgtggtgaacgggcatagtttaaactggtcgattgttagtagaagaagcattcaacgagcgggaaccagattgcaccgaagagggttagataaagaaggaaacgtggctaatttcgttgaaaccgagcaaatagtcgaataccaaggcgaccgggcgagtttcgtgcaaatacgagggagcattcccctgttttggcaacaagatcccgacttgagatacaaaccgccgcctactctactcgatgtcgatccgcaagatcagcactcgatgtgtctgaagcacatgaacgatttgatgactttctacggaaagatcgtctgcgtgaatctagtggatcaaaaaggagctgaaggaaacatggaagtcgcatttaagaacgccattaccaacgtatcgtctccatcggtgaagtacgaatcgttcgatttccacgccgagtgcagcaaaatgcgatgggacagactgtcgattctcatcgatcgattggcgcacgatcaagacgaaatgagtttcttcttattgctaagagacggctcgttgagttcgttgcaggacggtgtattcagaacgaactgcatcgattgcttggaccgcacaaacgtcgtgcaaagcatgctggcccatcggaatctcgaaagcgtgctcagaaaattgcagatcctccatcagaatcaaacgttggagttccagtattcgttcgaggtgttgttcaagaacgtttgggcggacaatgcggatataatcagtacccaatattcgggtaccggcgctttgaagacggatttcacgaggaccgggaaacgtacgcgctacggattgcttcaggacggtatgaattccctgacgaggtactacaagaataatttcgcggacgggctccggcaggacggcatcgatctgtttttaggcaacggtaaacccgtttcgcctttgcatattgataagggatggaaatacgtgacttatccgtcgattctattgatagctgtggctatgttcgtagcttgtgctgtaactccctccgagtactcgacggattccttgctgtttctcttgttctggggttccatggtctatgcaactttgcacactattttgaagtacggttcggagtttgtagataaacctaggctcactcattcttaa

SEQ ID NO: 879 - DNA, 1506 bp, Phyllotreta striolata
atgcctcctacgatccaacagaataatcagaacgcagcaaatggggtggaaaaaagacaagttaagactgtcgagaaaaggtccgatttattatgtaaagtaaaatattgcaacacactgcccgatataccgttcgatttgaagtttataacgtaccctttcgaatctattagattcatccagtataatcccacatccttggagcgtaattacaaatacgaagtattaactgaacacgacttaggcgtaagcatagaccttattaacaaagatatatacgcaatcggagcgggcgcctccttggatccggccgatgagaaactcctagaagaagacatcctcaccccgcaagactccaagaggtcccgtcaccatgccaagtccgtctcgtggcttcgacgaaccgaatacatctccacggaacagaccagattccagccccaaaccatggacaaagtcgaagctaaagtgggctacagcatcaagaaatccctgaacaacgagaccctttacatggacagagattcgcagatcaaggccatcgagaaaacgttcgaagacaccaagacgatcatcgataagcattacagcaagcccaacgtggtccccgtggacgtcctgccggtttatccagatttcagtttgtggaaatatccttgtgcgcaggttatcttcgattcagatccggctccagtgggcaaacaagtacccgcccaaatcgaggagatgtctcaagctatgatcagaggtgtaatggacgaaagcggtgagcaattcgtggcctacttccttcccaccgaggaaacactccagaaacgcagggaagacgtcgcgaaccaagtccaatatcaagacgaagaggaatacgaatacaaaatggccagagagtacaattggaacgttaaaagcaaggcgagcaaaggctacgaggagaattatttctttgttgtacgatcgagtggtatttattacaacgaattagaaacccgggttaggttgagcaagcgaaggcagaaagtaggccaacccccgagcaatacgaggcttatcgttaaacataggcctatggatgcgaacgaattcagaatgcaaaggtacagagaaaagcaactggagcctacaggcgaggatgacgaagagatggaaatggacgagcctcaagacgaggaaaacgtgcttgagccggataacgaaagtcgcgacaaagaaaccgagagcgacaacgagaagaaacgatccagagcttcctcagtgtcttcccaaaggagatcgagatccaggtcgcattcgtcggctaaatcaaattccaggtcgagttcaaggtcgttgtcgaagtccaggtctcgttcgagatcgaagtcgtcgtcgagatctcggtccaggacgccgtcgaagtctcccactaggtctaggtccgcgtcaaagtccccttctaggtctagatcgccgtcgagcgccagatccaagtcggcttccagttctggctcgaattccgaaagcgagtga

SEQ ID NO: 880 - DNA, 1170 bp, Phyllotreta striolata
atgccgattgaaaatttggaagatcaaggtttagaaaagaacccagacctagagctgcctcactacaagtttctcctaacgctcccggaataccgcagcgaccggaatgtccattcgaagatcacagaggccatcaagaaggatgatatggccccatggtatgagctcctttgcaaagaagtaggctggaagttagacgcggccttgctgaagaccctcaaagccaagaacgccgaaaaggtcaagcttctggacgaggccatcgaagatgcggagaagaacttgggagagatggaggtgcgggaggcttatttgcgtaaagcggagttttacagcagaatcggcgacaaagagaacgccgtgagcactttcaggcagacctacgataaaacagtgtctttgggccaccgtttggacatcattttccacttaatcagaataggcttgttcttcatggaccacgaccttatcacgaggaacatcgacaaagcgaagacccttatcgaagaaggaggcgattgggaccggaggaaccgattaaaagtctaccaaggtgcttactgcatgtcggtgagagacttcaaaactgccgctaacctatttttggacaccgtgagcaccttcacctcctacgagctcatggactacaaggcttttgtcagatacgccgtctacacctccataatcagcctgccgcggaaccaacttagagataaagtaataaagggctcggagatactggaggtccttcattccgagccgttcgttaaagactacctgttctcgttgtacaactgccagtacgccgagttcttctcgaatttggcagaggtcgagacgatcctgaggaaggactacttcatgaatccccattaccggtattacgtcagggaaatgaagatttcggcctacacgcagctgctggagtcctatcgatcgctcacgttgcaatacatggcggaagctttcggggttaccatcgagtacatcgataaggagttgtcgactttcatcgccgctggaaggctgcattgcaaaatcgatcgggttggaggcatcgtggagactaacaggccggatttgaagaatgcccagttcaattccgtcgtgaaacaaggggatttgttgcttaatcgagttcagaaactctccagagttattaatatttag

SEQ ID NO: 881 - DNA, 5958 bp, Phyllotreta striolata
atggaggaattaacctcgggtttggatcccgacgatttgatggatctggacgagcccgaaggctccgatttggacgaggacgacgacgatctcatcgacgatcacgtctcgtcgcctttcatctcgtcctcggccccggagtccacagccaactccgtcgcctcttcaccgatccatgaagacttccctccgcccttcaatttcaccgggaaacctctgcacgttaaacgcggaagaggcaggccccgaagagaaggaggaaagccttcggcgccgagaacgactagaggcggtggaactggagtatcgagagtacgtaggccgaggcctccgggtttttcgagaagaggatcgctagggggaagtaggagcgttagacaagtggatagatcggattacgagatgtcacttttcgccggctcgccggtggacgacggtttgttggatcccgaaaccggatcgatgatctttcccgagaagtttgtgcccgcgatcgaggagcctccgtactttccggaacattggccggggaaagtttgtgccttgtgtaatttaggcgaaaggagccagttagggcaaggtgaaatgctgagattgaattgtcccgaagggttctccccggagaaagttattagcgaacaaatattagaaagggctttgcaggctccggataaggaatgcggggataagagtccgaaagggcctgtgacgtgtagaaggcaaaagagtttcaacaaatgcagacatccttcgataaccagtgaatacgttgatgagttaactataatcggatataatgaagtacctgatgtatctagtttgttcgaaccaaacggacagttttacgtgcaccgcaattgcgcgttgtggtctaacggtgtaacgaaagcagaaaattcggctttgttgaacgtcgggccggtagtttcgcaaagttcttccaaaaaatgttccttctgtaaccattacggtgccagcctgacctgtgacgtcgacaaatgtaccaaaacgtatcactttccttgcgctactgctgccggtgcctttcaggatgtttcgtcgttaacgactttgtgcaacgaccattacgggcaagtggccatgctcactgacgcatctccgtgtttgacttgcgcgtcgatgggagatattgcgaatttgatgttttgttcgggttgcggcgcgcattatcacgggatttgcgtgggattagctcagttgccgggcgtaagatccggttggcagtgtaggaaatgccgttgttgccaagtctgtcgagtagtcggagacgagtctaagctgatgacttgcgaacaatgcgataagatttaccacgctagttgtcaaagacctatagtgacttcgataccgaaatacggttggaagtgtagatgttgtagagtgtgcggcgattgcggggctcgaacgcccggagccggtttgtcttcgagatggcacgctcactatacggtgtgcgattcgtgctaccaacaaaggaacaaagggttttcttgtcctgtatgccataaggcttaccgcgctcacgctcacagagaaatggtgcagtgttcgagttgcaagaagttcgttcacggaacgtgcgatcccgaggcggacgttgttacctacagccaaaagaaggaaataagcgtggagtacgaatacgtttgcttgcattgcaaaaatagcacggctagacaaataacagcgaaacgagcgagtatcgatgatccttccgacgtatcagcttcacacgattccctatacgacgatacatcggaattcgatcttccatcgcccgacgagttcgccagaaacatgggtttgggcaaagggaaaccgtacagcgcgaataaaatagccaagaaacgcctcagtttcaccgtaaatcccgtcggcaggccgaaaggcaccggaaaagtcccgcccggcaaaatgggctacatgaagaggtaccgactaacggagttcaacagaaagcgcggccccaaagccaaaatgcgaggcatcttcggcgtgcccggcgtcggcctgcaacggcccatttccgacggtaaaaccgacgaagagccgggcgtcgaaaaccgattggtcttgtgctcggccaaagacaaattcactttgacccaagacatctgcgtcatgtgcggagcgttcggaaccgatcaagagggatgtctgatcagttgcgtacaatgcggacaatgttaccatccctattgcattaacgttaaagtcactaaagtgattttacagaaaggatggagatgcctggactgtacggtgtgcgaaggttgcggccaacgcaacgacgagggccgcctgatcctctgcgacgactgcgacgtgtcctttcacatctactgcatggacccgccgctcgactacgtgccgcacggcaactggaagtgcaaatggtgcgccgtctgccattcgtgcggcgccaccgatcccggcttcaattgcacgtggatgaacagctcgacgcagtgcggcccgtgcgcgtcgcacgtcaactgcgccggctgcaacgagccgtacgccgagggcgatctgatcatccagtgcgtccagtgcgaccggtggttgcacggcgcctgcgattcgatcaagtgcgaagaggacgccgagaagtgcgccgaggacggttacaattgcgtgttgtgccggcccagggacgtgccgccgccgcatttggcgccggcggcggcggcgccgaagccgccgacgccgacgaagagtcccgagttggggaagagcaccagctactacatggacggcgtctgtctgagcgagttcggtagcaatttgatcaaatcgttggcgctcgagtaccacgggtcgcggaagaaacggaagaagatacccaccgtgcaggataaggaagccggtattatggctacgatcgaatcggtcgttgccggcggtaacgttattcctactaatatggaagacagcgcgaaattggagctggtcgacatcaaagacgaaccacaagagttgtacaaggaaggcatgatgtggacgaaagaggacgggccgcctcccgaaggtttcacgatcatcacgatggagaacggtttgaacgtgctgcgaaggaagaggcagcggaacctgcagaagctcggcatcggcgggttcgtcgtcaggatgagaggtatcaggacgggtcaggataacgacgatgtggattcgactgtaggtcaaagcgggctcaatcctaatgatatcgtcccgtctccagcggacggggataaacccagaaggaaagccatccggaggaagccgaagagtaaattggccgaaacgtttccggcctatctccaggaggctttcttcggaaaggaccttatggatacggtcgattgtaagaaggaagaagtcgattgttatagcagcgatgacgagaaaactgacaagcattataaatccattaatttgtctcaagatgaaattatagcgattgtggcatcgggtaaaaccgaaaagttggaaaacgataacaaagattcgaccaaagaattcggttcgaaccaaccgaagaatcccttcaaaccaacggtattgaaggaagaggaagaagataatccggaggatttgaaagacgttctcgccttaccaggagatttgctcgataccgatttggttaacagtattatggaggacgaggaggaactgagcaaaactacggcttctctcgtcgctctagattcgaatttacaacacgacgcggagctgacggatacgttgagcagttcggggaattcgaaagaaaccaaagacgaattgagcgatattttagggccgcatttcaacctcgattccatatcgaacataaacagcaaagacgtcgaagatatatttaagggcgtactaacggacgagtctcaggaatcccaagaaagtagtaacttcaccttacaaggaaatagtatgttctcgaataacaactcccagcaaaacgtagcacaacatcccattatcaatcaaccggttagaccgaaaacgttgcctacggtcaatcacaatttgaactcgcctgtcgggtttccaccaccatcgccttatcactcggaatacagcaacagtcctcaattcagtccggctttcgccgaatcgtcgtgttcgtgggtgagcggaagcgacgcgccggaaatcgacagtaccaacgtgacggtgacgtcgacgtacaaccagcgatcgtccgataagatgaaggcggacgagagtttgggcaagagcgcgacgatttcggccgttttgtacgcgaacatcaaccatcccgaatggaagaaggagtacccgaattggcccgataggtacaagcaaataataaaaaaatggagaacgttgagccaagagcaaaaagcgccgtttttgcagcacgcgagagataacaggagccaattgaggatgaagaaagctcagcagtcacagaccgtcaaggaaacagccacctctaccggcacgtcccccaacgcgagcaagcctcttcaccaagccggtccagccttagcgacaaccctccaggcggcggcgcaacagccggctgcggtggtacccgcggcggcggcggcggcggcgccaccggcggcagcggccgccgcggcgcccctttcagaggaccaagagaaaatcgcgctgcagcaaaaatccgccagggaggccgaacaggagcgacaatggaagcaactgcaggccctcaggcagcagcagacccaacaaacgcagaacatcctgcacgaacagcgcgtccaagccatcgcccgcgtacaacgccagatatccgccgatccggcgcagcagttcatcaacgagcaacagggcgccatgcaggcgaacgcgccgcaggaatcgagcccgtcgacgacgccggcgcccggcccgcggcaattcctcggcatcaaatcccccacgttccccgtcccgccggccggcgtcagggccaacgcgccctcgcaatcgccccatgacgtcgcccaaccgcccacgcccgatggtaacgatcactttatccactctcccacgaatcctaaacctaatttcccgcctagattgcccaacgatccgttcgccgcgcaacccgccgcgccgcgacccccgttcggaatggcccggccgcccttgcagaatttcggtggtaccgttcgcaacgagcagcaggacatcaacatcaatcgccagctgagggagctgttgcagcggcagcaggtcaagaagctggacgagttgttgccgggcaaagcgccgccgccgccgccgcagaggttgtggcacgcgaacgatcagcaggagggcggcggcgacgcctcgatgacttcgggcggcgcccagggcgccgacgccacctttcggcaacctctgccgccgggcgtggtcaaacctaggttggccatcgcggccgttaacaggccgatattgaacgccgttagagtgaatcaattggatcccaggattcagaatttggatccgaggatgaggttgattttgcaacatcagcaacaaagactagcgacgggcattcaacagcaattcatccgtttcacgtcgaacgtgcgaccgacgacggtggagcagtacgagcaactgttgcagcgtcagggcaacaatcagaatcaaatgcacgccgaggaccagcagcagggcgtcgcgcgaatgcccgtagcccaatcgggcgtcgtgcaaagaccgcacgtcgcccaggcgtcggtgacgggcgccgtcgcgacggcttctacggagagcaatcccagcgaggaaggtatccccgataacgtgactgcggaattggaaaaactggaacaggaaaccggcactatggtggagcttcaaggcgtcagcgacattttgggcggtttggacgacgacgacgagcttctggccgaaatgggcgccgatttcaacatactcgaatacgccgatcccgaattggaggccctgacgggcggcaaaacgaac

SEQ ID NO: 882 - DNA, 4452 bp, Phyllotreta striolata
atggaagattctcctctggaaggaaggagtagcaagagaagtaagacattcaaagctaaggcttcggaaaagttcaagcagttcaagagaggcgtgaaaaataagtatgaggtgggcgaagtggaaaatgtgtacgaagttgtcgaggaaaagcagtatattaaagaagttatgtctagatgtgatgatgattggattgttggtgattccagtgggtatatcgaagacggtagagatatatttgatgatgacttggacgtggaatccatagctcaagcttcgactaaaggcaaaggtgttaaaagaaaacacaagaacgtatcggaaaatgctggtaagggaaaattgcagcaaatgttctcaaccatgccagctaaacagaaaacggcagctaaagtcgatgatgacgaaatgctatcggaaatcttgggcgaaatcggtactggcacagcaaataagcctactgtcgagaaacctaaaatagaccagtactctacactagcgattaacatatcagctaagaattacatgaaaaatttatcgcaacccgttaaaaaacgagctgttgagaaaaaggtacagaaaatacaacccagtgtacccaaacgatttgaaaatttaaaagaaaaactacccgaaccagttaaaattcaagctaaagaaaatgagaagattaatcctgataaagtcatcgaaaaggaaacaatggatcttgataaaaacaccgaagaagaaaagctagatcttgatacatcacactttgatgatggtttagatgaaacattacttgaagaattcaacgaagatctaaataacaccgccagtgaatcccaaataacagaatcggaaatgatcggagacgatttcgcaggcgatttcgatacaacacaaatagacgaaatcgaagaacaaattaaccttgctagcgaacaactaatcaacgatattcaagcggaagtcgagactgaatggcaatatttcaacaacgccaacgaaagcttcaaaatagcgacgggttccgaagacgctgaatcttcttcagcaattccggttgatactccgtttgtgaaagtcgacgggaaaaatgtgtttaggttcttctggtgggacgcctacgtggatccgcaacaccaacaaggaaccgtcttcctcttcggcaaaacctactgcgaaacctccaagaaatacgaaagttgctgcgtagccgtaaagaacatagaaagaacgctatttgttttacccaggccttttgaactagatgagaacggtaaacccaccgataaaccggttacattcaaaacagtccacgatgaattcaacaatcgtatattaaagcgaacaggcattacatctttcaaatcgagattgatcacgaaaaaatacgccttcgacgcgaacataccggccgaatcggaatatttagaagtcagataccccgcgtcatttccgcggatcctttgcaacgaagaccgccaacacgacgacgacgaatccaccgacaacgacgatctcggctacagcactttctcgaagatattcggcatcaaaacgaacttcttggagtcccttttcctcgaacgtaagatcaaagggccctgttggatcgacgtgtccgatcccgaaacggccgccaatccgatgagtttctgcaagttcgaagtgaactgcctgaagcccaacaacctgaaaatcaccccgttcgagaaaccagttccaccgccacccctcgtagtcgccaccataaacatgaggaactgcatcaatcgagcatcttccaaccacgaaatcgtcatgttatcttgcttggtgcaaaatcggtacgctgtaaacaaaccgcctccggaacccgcttttcaacaccacttttgcgtatttagctgcccgggaggacaagtcttgcccctcaacttgtacgatactctacaaaactacaagataacgaaagtgctgaaaaccgacaacgaaaaggccatgctgaattgcttcatcaacaacatcgtgcaaatcgacccggatctaatagtaggccacaacctgcaaggataccaaaccgccatcttagcagacagattgctgaaattgaactgccgcgctttcaacaggctgggcaggctgaagaaaagggcgacgcaagccaagcaattggagagaactttgttcttgggtcggttggtttgcgacataaaaatatcggcgaaagagctgatcaaatccagatcgtacgatttggacacgctctgtcaggtcgtgttgaagttgaaggagaaccagcgggtcgatctggagcccgaggatgtgttcaagatgttcaaaacgtcgcaggatttgatcaagttgatatcgttcaccatgcaagattcgggctatattatgaaaatgatgtacaatctgaacatcgtaccgctggctttgcaaattacgaatatagcgggtaacgtgatgtccaggactttgatgggaggaagatcggagaggaacgagttcctgctgttgcacgctttccacgagaaagggtatattctacctgataaagtttataggagtaatgaaaacgaatcgaaagggagttctaagaagaaacctacttactccggaggtttggtattggagccgaaagtaggcttctacgacaagctgatactcctgatggatttcaattctttataccccagcataatccaagaatacaacatttgcttcaccacgctccccgtaatggactccgacgaaaatttagtactgcccgacagtaatctaccggccggtatactccccacggaaattcgaaaactggtcgaaagccgtcgccaggtgaaatccctaatgaaaaaaccggacatctccaaagaactgaaattgcaatacgacatccgccagatggcgttgaaattaaccgctaactcgatgtacggttgcttgggcttcggacattccagattctacgcgagaaatctagccgccttgatcacccaaaagggccgagagatcctcgtcaataccaaagatttgatcgaaaagatgtgcctggacgtcgtctacggcgatactgacagtcttatgatcaacactaacgttttagattacgatcaagtatttaaagtaggagttaaaatcaaacaagaagtgaacaaattgtacaagcaagtcgagctcgacatcgacggcgtcttcaagtacctgttgctgttgaaaaagaagaaatacgccgcggttacgctcaccaaaagtttatccggcgaattggtagccaccaaagagtacaagggattggacatagtgcgcagggactggtcgcaattgtcctcggaaaccggcaaattggtcctcgaacacctcctcagcgaccagtcttcggacgaaaaaatcaaaaacatctacgatcacttggctacgatcaaatcggacctgatcgaagggaagataccgatacctttgttggtgatcacgaagcagctgaacaaggcgcctcacatgtacaccgacaagaactccatgccgcacgtccaggtggcgctgcgctacaaccagaagagccgcgatcacttcagaatgggcgatacagtaccatatgtaatctgcaccgataacaccggcaacggccccatgcagcgcgcctatcacttggacgaattgaagggcaatccggacctgaaaatcgactacgactattacctggagcagcagattcatccggtgatcgcgaggatttgcgaacctatcgagggtttggatgcttaccagttggcggaatgtttgggggcgaatttgaagcgagtgaagaggcctaagcctcaagggggtaacgagaacattcaaggagagaacgtcgttaaagccgaagtgaaattcaagaacgctgagaaatttacgtttgtttgttacatttgtaaacaccagaatgtcatcagcgagccattgatgaacaacatccctttcctggagacttgtcaaaaccccgaatgccaatcgaagccgatcgattacctaccgagcgttcaaaatcaactctaccggtcgatccgttcgcacataactaaatactacaagaaagtgttgacgtgcgaagacccgagttgcccgaacgcccccagacggctgccgttgaagttcctgaagaaacgtcccgtgtgcaacatgtgctgcaacgctgtaatgtacaaggtttacactgaattccacttgtacaaccagctggcctactatcggtacatgttcgatttgagcaaactcaaacataagcctctgatggatggtgagaccgagtcgggttatcggacgcttcaagatactgtggataagttcatgaatcaatcggagtactcgcttattaatctgagtgaggtgttcggccagctcggttggtccggggcgagtgaaaaggttactgtagaacagccgagtaatggtgtacattttaacgaagaaggcatcgaggacgcctatgatgaatga

SEQ ID NO: 883 - DNA, 1398 bp, Phyllotreta striolata
atggcggctgctgcagcggcaaaaattgccgaagtacgcgagacaacccgcgtagaaagaattggagcccattctcacattcgaggcctaggattagacgacagccttgaagctagacatgtgtctcaaggtatggtcgggcaagtctcagctagaagagcagttggcatagttctgcaaatggtacgcgatggtagaatcgcaggaagagctgttttattagccggacagcctggtactggaaagactgctatagcaactgctttagctcatgctttaggacaagatacgccattcactagtatggctggatcagagatatattcattagagatgagtaaaactgaagcattgacgcaagctattagaaagagtattggagtcaggataaaggaagagagtgaaattattgaaggtgaagttgtcgatctgagcattgaacgtccagcaacaggagttggtactaaagtgggtaaattgattctcaaaactacagatatggagactgtgtatgatttgggcgggaaaatgatcgatagtattctgaaagagaaagttcagtctggtgatgttataaccatagataaagctacaggaaaaattacgagattgggtcgatctttcgctagagctagagattatgatgctactggtcaacaaacgaggttcgttcaatgtcccgaaggtgaactgcaaaagcgcaaagaagttgtccacaccgtgactttgcatgaaattgatgtaattaacagtcgcacccatggattcttggcactgttttcaggtgatacgggagaaattaaaccagaagtaagagagcagattaatggcaaagtagctgaatggcgtgaagaaggaaaggctgaaattattcctggtgtactgtttattgatgaggttcacatgttggatatagaatgcttctcctttttaaacagagccttagaaaatgaaatgtctccaattgtcataatggccaccaatagaggaatcacaaaaattcgaggtactacttacaaatctccacacggcataccattggacttgctggatcgaacaattatcgttcctactcagccatacgacgaaaaggaattgaaagagatattgaatattcggtgtgaagaagaggactgtcagatgtctgataatgctttggtggttctaacgagaatctgtaaggagacttccctgcgttacggcatgcagctcattatgacatcgagtttaatcgctagaaagcgtaaagcccacgaagtcgatgtagaggacataaaacgagcctatcaattattctttgatgaaggtcgctctgtgcaatttctcaaggaataccaacaagaatttatgtttaacgaaattgatgagaaagatgatatggaaatggaaacgatttaa

SEQ ID NO: 884 - DNA, 1116 bp, Phyllotreta striolata
atgacgttgagaacttacggagataaaccgatcagtttccagttggaagaaaatggagagtactactgtgttggatctgaggtgggaaattatcttcgcctctttagaggatccctgtacaaaaaatatcctggaatgttcaggaggtccataaccaatgaagaaagacgaaggttgattgaactcggtttgagccagcatgttctagccagtagcgtatcattgcttagagcagaagaagttgaagatataattgaaggaaatgatgaaaagtataaagctgtatctgtacacacttccgaacctcctatgccaagagagggaaaatccaagaaaaacatgcagtgggtaccttcgttacccaattccagtcacttagatgccgttccacaagctacatctattaatagaaacagagtagctgctaaaaaggtgagaacatttccactatgttttgatgacaccgatccccaaataaacatagaaaatgcttgtcaacaagaactgctagttcctattagactcgacatggaaatcgaaggacagaagctcagagatacatttacttggaataaaaacgagagtttaataacgccggaacaatttgctgaagtcctctgcgacgatcttgatttaaatcctttaacatttgtaccagcgattgctcaagcgattagacagcaactcgatgcattccccacggaacctcctagtattatagaggaaacctgcgatcaaagagtcattattaagttaaacattcacgtgggaaatacatctttagtcgatcaagtcgaatgggatatgagcgaaaagcaaaataatcccgaagaatttgcgttgaaactttgcgcagaattgggtcttggtggtgaatttgtcactgcgattgcttattctattagaggtcagctctcttggcaccagaggacttatgctttcagtgaagcacctcttccgactgtagaggtaccattcagaaatcccagtgaatcggatcagtgggctccgtttttggaaaccttgactgacgcggaaatggagaagaaaattcgcgaccaagacaggaatactcgtagaattagaagattggctaacactacgccgggttggtag

SEQ ID NO: 885 - DNA, 579 bp, Phyllotreta striolata
atggctgcaataagaaaaaaattagtgatcgtcggcgacggagcctgcggtaaaacgtgtcttctaatagtatttagtaaagatcaattcccggaagtgtacgtgcccaccgtattcgaaaattatgtggcggacatcgaggtggatggtaagcaagtggaactcgccttatgggataccgcaggccaagaagactacgatcgcctgcgtcccctttcatatccagacaccgacgtgattttaatgtgtttctcggtcgattcgccggattccttagaaaacatcccggaaaagtggacgccggaggtaaaacatttttgtccgaatgtgccaattatcctggtaggcaataaaaaggatctgcgtaacgatccgactaccattaatgaacttaaaaaaatgaagcaagagcctgtcaagccgcaagacggtcgatctatggctgaaaaaataaacgcctttgcgtatttagaatgttcggctaaaagtaaggagggcgtcagagaagtattcgagaatgccacccgtgctgcactgcaagtcaaaaagaagaagaagcatcgttgcgtaatgttttga

SEQ ID NO: 886 - DNA, 4014 bp, Phyllotreta striolata
atgaatacatccacttttaatccgagaatggatgccgctcaaaatccggcgcaaaaaatggaattggcgtccaggaacgtggaaaattcgttgctaatcgacaacaatgctccgagattgatcgattttatgaatattaatccgcaaagcggctccaccgccagcggctttgcagaccatgattatccaactttaagtggattatctcacattatcaacagtatgacccaaatcaagtgcgttagcaacgttcctataccttcggaaattgtcgaccacttcgcccgtgtgcaatgccactgtatgatgggtttattttccgaaataaacagagcttggttaactgtcgatagtgatatttacgtttggacttacgaggaaaataccgacttggcttatttcgatgggataagcgaaacgatcgtttgtgtgggcttagtgaaacctaaagcaggagtttttcacgcttttataaaatacctcctgattttagcgacatccgttgatattgttgtattaggggttactttcactgaacgacccggagacaacgctgatgaaattcaactcatacctgatcctgtattcattttacctaccgatggttccaccgtcacgataatcaacagtaccgatgatggtaggattttttacggcacaaaagaagggaatttattcgaaattgcatatcaagctgaaagtggttggttcggcaagagatgcaaaaaaattaatttatccaccagcactttgtcatttctggttccctcgtttattaatgcagcgttgagcgaagaggatgggataacgcaaatttcaattgacgatagcagacatattctctatattctcactgaaaaaggatccatagaagtttgcgatctaggagagaaagggaattcgttttccagaattagtaaaatgtctcaaagcacgttggttaaccaagcgatgaatactgttaaaaccctcgacagtaaaaattttcgaccgatcgtgagcatatccgccatcgaaacatcagaatcggttaatttgaatttggtagccgtatctcaaacgggagtacgattttatatgactgttacgagtttatcaaaccaaaatcctaatcaaagaccgtatacgctaaccctagctcacgtaagacttccacccggttattcagctaacattaccgtaagacccagggcggtacatgtgtcacagtatagggacagaaacttggttttaatatctactgttaacgaaaaagatgtgttatggtgcatgagctcagacttatttcctttcgggcaaggactgacagaagcttacacggctattaatttagatggacccgctctagctatttctgaggcaaggagcgctagtcctcttcaaataaaggatgtacatgaagcgccccctttagtcgtacggcaacacgctgaaccgcccaaaaagtacattgtgctcacatcgcatagcattcagatcttcattaagttaagaccagtagatgtgttgaagcaaattttgaaagacagccacgggcaagacaccgaagctttgaaagccttctttactattcaaaaggaggatcaagcgtgcgctaccgctttgatattggcttcattggagaacgaagataacatggaaatagccgagtttgcgaccagagctttcttcttgttcggaggcgaaccgaaattagctgctcctatgaatactttttcggggccgtcagtgttttgcccacccgtcatgtctactccgaatatacaccaatatcaacagcagcagcaatatcaaacttcaccgcaataccagcccaactttccgcatggcatctcgcctgctgcgaatgcatacgaattgaccagccccttcgttttttcacctaagcacaacgggctctatttgtatttaagcagaatattgcgacctatttggcatcgaaggacagtggataaactttgcttagatggaaaaattgtcacaaatcacagtacggtgaccagcgaagactgcatatttatcttgaactacgtgacgtccctgcataatttcctgatgcgtaatactcagctttcgtcgttgagcgccgctcccggtcacaatactcaaaacttcaataataccacgatgaacgtgactagattgaaccataccattcaagacgtccagttggaggaaagagcgtctctggatgctttgaaaacgtttgtttgccactgttgtcaaatattaggtttatggagaattctttgtgaacatcaattccacacgttaatagcatctttacctgaaactgagcagcagatattgcaaaatacgaccttcaaagatctacttttatacagacacgatatctgtacgttgttaatagctacattagtggatagttatttaggcgataacgcctcggtggattcgattagcagcaaattgagagaagtctgtccgctgttttataaaaccgaagatgcggcattttcaaaagccgtggaaatattaaagatgacgcgggcgattcaaaacaacgacgaaaaggaggagatgatccaatcggccctgcagatttgcaaatcaatcgggcccactatcaatatcaccgatatatgcaaggaattcgctaatctcaaagcgtacaaagctgttacggaattgtgcgcgcatttcggtaagaaaatagatcccgataaaatagcggagagttactataacgccgaagataacagcggtgaccaagaggggtacaattattatcaaagacggttggaaatttaccgtcacatattgaacatgttggatcaattatacaacgaacaaaatcaaacgcaagtcattagtagagattccgcgtactcggttaatcagaccatattgctcgatggtgtcgaacaatcccaagtaggatacgtgatgaagcaagtaataaaagacgtcatggaaacgcccgacgaaatcatgcatttcgcactttacgattggctggtgttcaaaaatatgactggagatttgataaacatccaaaatccctcgctggaaacatatttgaagcgaacgtccacccagaatcccaacaacatcgagaccatgaatttgctgtggaaatactacgaaagttgcaacaatcacgcggctgctgcgaaaatattgaacaacctcgcctcgagaactggtacaaacgttccgttgaaagagagactgtcttacctagcgagggctatcatgtgcatgcgaagcgataaaatcggttacgcgccctatctgggtgtatttttgagagatcttgaagataaaatggaggtagcgaaggtgcaggagcaaattttggatgctatcgtaaatttgcaaggacaaatacctaacgctcaggaagcaataagtgcacttaattccggattgttcgaaatttctcagttgtatgaaaatttcgctgagcctttcaaactgttagaatgccaattggcaatcatagaatgcgccggatacaccgatcaagtattgatcgagtccatttggcagcaaattttgactgaagaactgaggaagacctacggaacagggacagataaagtctgtcagcttttgaacaaagtgaagcagctctcgaagcaatacgctcaatctgcaaactgttttcccttgagttacattgtttatgaattggaaatcgtgaacgcaaaacttcgaggagacaaacaactcgttccttgtgccttggaaagtatgaatattcctttcgaaaatttaatcaacgtttacaatagtttaaatacgatttccataaacgatcacttttggcaattagaggagaacgaatttcatctttctgaagctactgctgcgttaataaattgcttcctgggccatcttgaacagtacagcagtgttgagaaacgaaaaataacttcgctctgtcaagacgcagtggttgctttattatccaacttgtatagcaagcccaacaccgaggtattggttaataagttgagaaatatacaagccaagttgtcgagaatttag

SEQ ID NO: 887 - DNA, 4143 bp, Phyllotreta striolata
atgagcgaattcactttgggctacagagaagtgactccggaacaaatagattatgaaaattggaaagaaataacccttactacaggaggaacgcaaagtactcttcaagatataaaagtagccgagagagccaatggatactgttacaaagactccactaaacactgcacgaggaatagatttatctactggaggatcaatcacaacgtattagaattagtcgagcatagtttagatataaatcttacaggaaatcggatcagatacaagtttgatactccgattttagacggtgtttcgatacacgagatactcgataatgttgttattttagtccctacagtctgcagtgtacacagactgatatttccccatccaaatatattccacgcacaggacgacttactggggatatatccggatttaacagctgtatcgatattttcgaaagcatcgatcgtcgataccagaaacccgaacagcttttacgttttcaacaatcccagcactgccaatgatcaattaccgaacctagccaattcgtactttgtaccggaaaccggtgaagcctacttcgttttggcctttccttcgactgaacttttactgatcaggcaaagtcccgatcaagtcacttgtgtggaactcaaaggggaatccctggttcccagatttttcgccggtatagcagacaaattcaggcaaaggaattcggatagcgaaaatattgttagtttgctattttacgatttggacgaagaaacctacgtgttatccctaacgcaagatgcccatctgaaatgttggtcctgcagtaaaggccaatgcgtagcagtaatagatgttcgcgaaaaaatatcaaccaacttgaaatacagagttcaatcagcaattctaaagaaagccgaagatggaaacagctcggataatattctggttctattcctgagtttcggaaataaatgccagttccatattttaaaaccctccattcgagaacaagaaatctctctgcatagattggctgctctcgaatcgccattgaacgatttgatagacttcgcagcgcaattagactgcttgtggtcagtatggcgatcggacgtgggcgaaacactggtgtacaaggcatcgttcaaatccaaccaatggactcaagtcatactggaacccgaaccgtgcgaaaaacagttccctatcaaattcaacgatgtcaagaccatgtacttacagcacattttccacccgggcaggttccccctgcacgttatcaacaaaaccctttcgatttataaaatgcctacgatcgcctcggactcgcatctttccatctcggcgctaaaacaaagagtatgcatggccgtggaaaacgacatacaaaatctgttcaacagagacgggactgatattaacagcgttgaagtcgatgaatacatagaatgcgccgagtggtgctggcagaaattcgactcccgctgcgtacaataccagatagccagcaggaaaccgctgggtttgatgctcctgccgtccgtctcgggcgccatgctgttgaagaaatcggcgttttcgttcctgcggcccgtcgattcgctcgaacacatgacgttgtgcaccgatttgtacagggagcagttcttcaatttttccatgttggccgacgatttggacgctgtggatgatgtcataaacgtgttcaaagtgatcgtgtacatcgaacaacaattgaaagacgatttcatgcaatcgttcgaaaccgaactgctcaatctccaatcgcccgatgtagtgatagaagatctgttgaagaaaatctacgtcgaaatggattccgattttttttcgcatatattgcatctaatcaaagacgtgaacgatttgtacaaagccatacacaaaatcctcgaattgttgagatacgaaaacactttagctaatcccgacaacgacatcaacccggccgctatgtactatttcaattcgctcttaggcacttcgttggtggcccaaagtttccgacaacaagcagaaatcagatttcaaatttgccgcaatctgttgctcctctgcaacttcctggtgatggacaggacgttaaattggggcgtcttggaaggcgttcgatccgtttgtatgccggacattgttgttttgacccaagccagtttcgtcgtgctgtggttgagcggcctgacaatgttcgaaagcgactcgattcgcgattcctcgatgagcacactgaacccgttaaaactgacgcccgtttacaatctgctgccgtttacccgttgcacgtccttgttggaagtgtttatatcgtcgtcgggcgtgcaggacgccaggaaatcgttcgcgagagtttcctgcaaggacgaggccttggtgcgctggcattggtctctgttgccctacgtgaatcacatcagacatctcatatggcccataagcggttgcacggtgttcgaggaatggctgttatcgagcggacaacacgtgtggttgcagcaatatgttcgattgctcagcaattggtgcgaatggaatgcttgtacacgaaacttcctcttggcctcgtcgtttctgaccaccggagaattttacaaagccgaagagctcttcgaaaccgctgcgaagggcgttttcactgacgcgtttttgaaaaaccgaatcaaaagcgtagacgaaagtaattccagaaccaccattcattattatttaaaggtgatccaactgttcgagttgtgtaacgctcgaagtcacgtgattaatgtggccaatacggccctgtgcgtcgtcaaacgggacgatcctttagcggcgacgttgttttcgatcaaattcaagcaccacttggccttgaagcactaccggctggccttcgactcgttgaattcgaaccccgacggcgaacggcggaaggacaatctcagggatttggtgaagacgttgctcgacgagaagaaactcaacgttttgttgaatttcacgtacgacagcatggacgagttcttcgcgaacatcgttctgaccagagctcgagcggccgacgttacagataacgcgttctacgattttctctactcgtaccaaatcaagaaaggtccaccttcgttccgattagccgcttcggctatgtacgagcaagcgttccgattgagccagaagaccaccgtcgaagcgttggagaagcaagtgaaatgctatttggcggccaaaaacgtcctgcacttgtgcccctcgcagcacgcttgggtcgtcaggccggcggatcccgacgaggaagacgaacaagtcattttccaacctctggccggctctaacggagaaatccgtacgttcaaaatcaagaaacaaatcgaagtggtggacatcgaaaccatcggaaaagaactgacgttcgccagcgccaaattgaaattgctgcaattcaacccggcggtttccattagcgtttgcgatccgttggagctggtgatttcgctgaacaactcgggcatgttcaaagcggccttcgagatttgctcgaccttcgatttgccctattccttggtgttcgaggccctcacgaagcgctgcgtgatgctcaccgaagccgaggatcccaacgcttggaactggttggtggagaacgatctgcaagatttaccggtgaatagagagtcggctgccgatgtggtttggaagttcctgcaggattgtttggagaaatacgaagagcctaggatgtcgtgtttgcataacgtcgtttgcaagaaaatcatcaacatgcagatttacttgcctcattggttgaaggcttcgtataaggctcgaaatccgtccgagttgttgaggttattgcacgcctccgggcggttggaggaagccgtggaattggctaaagactacattttatcggcaatgggatacggtaaagaagaattcggattctcgcagcctttggctccgacatcgccggccttttgtcttcccgtttacgccattcaaaggctcgtcgacgaattggacgtacaaaattcaatgaacgtagaaaagccttacactcacgagtacgatgatttgaaggtgttgttttccaagtatctcgaaacggcgattagagtttccaatcagatgtgccaggttaagggtagagctttttaa

SEQ ID NO: 888 - DNA, 2349 bp, Phyllotreta striolata
gatcttctagttgcgaccataaatctatctcaaacccacgcaaacgacgtggccgctttgaaaataatctacagttcactagtgctcatttgcaaagtattctactcgttgaacttccaagatttgccggaattctttgaagataacatccaagtgtggatgaccaatttccacacgttgctctcagtcgatgtgaagtcattgcaaagccaagaagacagcgaagccggtgttttagaacaactaaaatcccaagtgtgcgataatgtggctctgtacgctcaaaagtacgacgaggagttccaaccctacctgccacaattcgtaacagatgtttggagtctattagtcgctacgaatctacaaccaaaatacgatttgttggtttccaacgccctgcaattcctctcgtcggtggccgaacgttcgcagtataggaacctcttcgaggacgataatgtactaagcagcatttgcgaaaaggttattatacccaacatggaattcagaacttccgatgaggaattgttcgaagacaatcccgaagagtacacgagaagggacatcgaaggttccgatatcgacacccgtcgacgggccgcctgcgatttggtcaacacactcagccagaacttcgagcagaggatcgtggagatattcggacggtatttacaagtgatgctggcgaagtattcggaaaatccgaaggagttttggcgcagcaaagacgccgccttgtacttggtgacctctctagtgagcaggggttcgactcagaagcatggggtcactcaaaccagccaattggtggacattactcagttctgtcagcagcatgttttgcccgaattggaacgacccgacgttaacgatttgccggtgttgaaagcggacgctataaaatatgtaatgacattcagatcggtacttccaagcgatctggtcgtatcgactttaccacaattgatcaggcacatgccgagcgaaagttgtgtggtacacacgtacgcagcctgcacgttggagaagatcctcatgttgaaatccaacaatcaaaccatagtaacgggagcccagctggagcctctggcctcagaattgttgacgaatctgttcgctgtactccaaaaaccggtctccgaggagaacgagtacatcatgaaggctctgatgaggacgttcgcgaccttacaggaccggatcataccctatttgaacgtggccttgcccaagatgacggaaaagctgcagatggtcgccaagaatccatcgaagccgctcttcaatcattacctgtttgagtgcttttcgttggctataaagattatttgcaaggtgaatcccacggcggtgacttcgttcgaggacatattgtttccgatatttcaaggaattttgcagcaagatatacaagagtttattccgtacgtgttccaaattttgtcgttgttgatggaacacacgccgcagggcgctctatccgatccttacatgcaactgttgccctgtttattggctccgatattgtgggaacgtccggcgaatatcagcccgttggtgagattgttggccgcgttcgctacgcaggcagcccctcaaatcgtgctacaggacaaagtgggcggatttttgggggtgttccagaagttgttggcatcgaaatcgaacgatcacgaaggtttccggctgatgcaaagcctcattcagaatctacctaccgaagctctcacgccctatcacaaacagatattcttcctgttgttccaacgattgtcgtccagtaaaacgaccaaatacgttattaatttgatcgtgttcttttgcttgtatatggtgaagtattcgcccaacgatttggtggctttgatcgatgaaatccaagctcagatgtttggtatggttctggagaagcttctaatcgcggaattgcagaaaatcgccggcgatgtcgagaggaaaatcgtcgcttgtggcgttactaaattactgtgcgaatgcccggggatgtatacggggtcttaccaaaaatattggccgcaattgttgcaggcgttattggcgttcttcgagatgcccagagacgagacgacgttccccgatgatcatttcatcgaagtggacgatacgccggcctatcaagcgaccagcgctaaattgaatttcgccgatggtaccaaaaacgatcccctgcaaggtgtcagcgagccacggcagtttctggttcaaagtttggccactttgggcgcttcgcagcccggtcgcctgccgacctacataaacaacatgaacgcccaatcgcagacgatactgcagggctatttggccaagttcggagttcaattggtgtaa

SEQ ID NO: 889 - DNA, 600 bp, Phyllotreta striolata
atggcaaaagtacaattatgcaatatcacagttatggacaatcctagtcctttcttgaacccatttcaattcgaaatcacgttcgagtgcatagaggaattaaaagaagatttagaatggaagatgatttacgttggctccgctgaaactgaagaacacgatcaaattttagactccgtattcgtcggacccattccagaaggtaaacacatgttcgtcttccaggcagatcctccgaacgtctcccgcatacctgaaaacgatgccatcggtgtcacagtcgttctactcacttgctcctataaaagccaagagtttattcgtgtaggttattttataaacaacgaatacagcgatccggagatgagagaaaacttgcccagtccacctcagttcgataaggtaattagaaatatattggcgtccgaaccgagggtgacgaggtttaaaatcaactgggaagaatcgagtggtacgcaggaaaacggtactacaatcgcagaagcacccgccaaccaaacatccgagactgccgcttccgtagaagtacctgctttcaacgagaattccaattcgtgggccaccatggagtgttcataa

SEQ ID NO: 890 - DNA, 939 bp, Phyllotreta striolata
atggatcaaatgctaccgagccctggttttagtatacctagtataggtacacctcttcatcaacccgaggaagaccagctaattttaccgaacgccatacaacaacaacaaagtctacctactactaactcacaagtgcctcctctagctccaatgggaggttctactccaacgcttggtctaggtttaggccatgctatgtctatgccacatacaaagtatgtaactggattttcactgcctatcagttctatggctcctcaaacaccacaacatacaatgatgagtcctatggtaaacgttggtggaactggtaccactagttctggtgtaacccctacattgggtccctctacaccttcaccaatgactcctatgacaccgcattcagcagatcccggaatcgttccacaattacaaaacatcgtctcaactgtaaacttgagctgtaaattagatttaaagaaaattgccttgcacgcgagaaatgccgaatacaatcctaagcgatttgctgccgtgattatgaggataagagaaccgaggacgacggctttgatattttcgtcggggaaaatggtgtgtacaggtgcgaaaagtgaagaagactcgagactagcggcgagaaagtacgctcgaattatacaaaagttggggttccctgcgaagtttttagattttaaaatacagaatatggtgggaagttgtgatgttaaatttccgatacgattggaaggtttggttttaactcacagttctttcagtagttacgagccggaattgtttcctggtcttatatatcgtatggtgaaaccaagaattgttctgttaatatttgtttccggcaaggttgttctgactggtgctaaagttagacaggaaatttacgaagcatttgataatatttatccaattttaaaaagttttaagaagcaatga

SEQ ID NO: 891 - DNA, 603 bp, Phyllotreta striolata
gttccatgtctcgcctgttattccccagggtcagtgctgtcatttttgtcagttttggggttattgaagatttttgaagaatcttttatattttatccaacaaaatcccctttcaaagctcagaaaatggctgcaatgcgttccatgtctcgcctgttattctccagatcatttcaaactactgtaaaaaggggttatgctgatcaaatgagcttcacttttgcttctggaaaccaggtcttctacgatgcgaaatcaataaaacaagtagacgttccttctttctctggtagcttcggtatcctaccagcccacgttcccactcttgctgtcctcaaacctggagtagttactgtttatgaagacggcggttcagtccagaaaatttttgtatccagtggtacagtcactgttaatgacgattcatctgttcaaatcttagctgaagaggcccatccagtagaaaatttagatattagtgcagccagggatcttcttaccaaagcacaaagtcaattgtcatcggccactacagatcaggctagagctgaagctgccattgccattgaagtgggagaagcacttgtaaaagctgccgaatag

SEQ ID NO: 892 - DNA, 969 bp, Phyllotreta striolata
atgagcggcgatggcaatcaaaacgagcatttcgacacgttatttctatcaatcgcccagcatcatccacagggacccacgcaacttctggacactttcgtcaacttcctcagcagaaaaacggacttcttcacgggcggcaaagaaggagaatgggaaaagctagtgttgaacacattcaagaaatacgagaagtccagcagggagcagcacgcggccgaattgaaggagaaactcgaacaagaagcgcgccggaaggcgaaaaaagaggccgaacgggcccgaataaccgagctaacggacgagcaagcggagaaactccaagccgagctcgacgccaagaaggccccttcgagcgcccccgacgccccttcgagcacctccggcgccccttcgacttccaccgctaagatcgaagaggacgaggacgagtccgagaagggtaaattgttaccgaacaaaggcaacgggtgcgatttggacaagtacagttggactcaaacccttagtgatatagagctgcgcgtgccgctcgaatgcgatttccgagccaagcaaaaggatctcacggtgaacatcaccaaaaagcggctcgtttgcggcctcaaaaaccaccggcccatcatcgacgacgatttccagcacgagatcaagctggaggagaccaattgggtgatcgaggacgggaaatcgttgctattctccatcgaaaaagtgaacaagatgaattggtggagcaaattggtgaaatccgatccggagatcagcaccaagaagatcaatccggagccgtcgaagctgagcgatctggacggcgagacccgaggcatggtcgagaagatgatgtacgatcagcgacagaaagagatgggtttgcccaccagcgacgagcgcaagaaacaggacgtcctcaagaaattcatggaacaacatcccgagatggatttctccaaatgtaagttcaactga

SEQ ID NO: 893 - DNA, 477 bp, Phyllotreta striolata
atgcagtctcccagtggaatggcgcacggttatcctggcgcctcaatcctacaatggagccctgataaaaagtacagcgatagagagaggtggatttgcgtttatccagcgtacattaactgcaaaaaaaccatagcccaaggcaggaaattaaacaaggaaaaatgcgtggagaatcccactcatcaagagatcagagacgtattagtcgcagcaggtttgaaggtcggcgtggaaaacaaattatacagcagggaacgaagcaaagaattgttgtatcgaggacgaattagagttcaattgaaaaacgacgacggtacgctgtgcaatccaagttttcccactagagacagcttaatgctccatctgggagacatgattcctaaattgaagagcaggcaaaataagggcagcggagaccctcaaccgcagaccaccagctcgaaaggaaagggaaaaggcaaaggaaggcgctaa

SEQ ID NO: 894 - DNA, 2196 bp, Phyllotreta striolata
atggaagaaccggagcctactaaacgccagaagatgcccaaagtggctaaagtgaaaaacaaagccccagctgaaatccagatcacagccgaacagctattgagagaggcgaaagaaagagacttggaaatcctcccgccgccgccgaagcagaaaatttctgatccggcggagttggccgactaccaattgaggcgcagaaaacagttcgaagataacatcagaaaaaataggacggtcatttcgaactggatcaaatatgcccaatgggaggaatcgcagaaggaaatacaaaggtgcaggtcgatatgggaaagagctctcgatgtggaccacagaaacattaccatttggttgaaatacacggaaatggaaatgcggaacagacaagtaaatcacgccagaaacttatgggacagagccacagttcttttacccagagtaaatcagttttggtacaagtacacctatatggaggaaatgctggaaaatgtagccggagcaagagcagtattcgaaagatggatggattggcaacccgatgagcaagcttggcaaacttacattaattttgaactgagatacaaagaaattgacagagccaggcaaatatacgaaagatttgttataacgcatccggaagtgaaacattggattaaatacgcccggtttgaagaaaatcacggttttatccattccgctaggcagatttatgaaagagctgtccagttttatggagacgatcacttggatgagaagctttacatagcttttgccagattcgaagaaaaccaaaaggaacacgatagagctagagttatctacaaatacgctttagatcacattcctaaggatgaaacgaaggaactctataaagcatataccatccacgagaagaaatatggagacagaagcggtatcgaggaagttataatgtctaaaagaaaactgcagtacgaacaagaaatactccaaaatcccaccaattatgatgcttggttcgattacctgagactcgtagaaggagaggctgatttggaaataacccgagaaacctacgagagagccattgcaaatatacctccatcgaaaaacaaacaatactggagaagatacatttatttgtggatcaattacgctttatttgaagaactggaagcgaaggattacgaacgaaccagacaggtgtataaagcctgcctggaaatcctgccgcataaaacgtttacgttttcgaaaatctggctgctctatgcgcagttcgaagtgcgccagaaatgtttaaaagcggcccggaaaattctaggcatgtccattggaatgtgccctcgggataaattgttccggggttacatagagctggagatacagctccgggagttcgatagatgtcgaaagctgtacgagaaattcctggagttcggtccggaaaattgcgtcacttggatgaaattcgcggaacttgagaccctattgggcgataccgacagagcgagaggcatctatgaattggctataaaccaaccgagattagacatgccggaattactctggaaagcttacatagacttcgagatatctcaagaggagcccaataacgccaggcaaatctacgaaagattgttagagagaacttcccacgtcaaagtgtggctttcgtacgctaaattcgaattgaataatcctagcgaggaagatttcaacgtacgattggccagaaggattttcgagagagccaacgagaatttgaaaaacgtccccgaaaaggaagccagagtgttactgttggaaaactggaaggaattcgaaaacaatcacggcgacgacgagcacaaagaaaaggtcaacgctaagatgcccaagagaatcaaaaagaggcagaaggttatcgatgaggatggcgtggagcaaggctgggaagaggtgtttgattatatattccccgaagatgaagccagcagacctaacttgaagctactagcagctgctaaaaactggaagaagaatactgacgaaccggatgaggattcagaaaatcgaccgagcctttccagcagtagccaaaggatgaaagaaaagttattagcctccgttaaaaattggaagaataacgacaaagaaaacagcgattctaataaagatgacggctcaaatgaagaggaagttcaaatcgataacaatgaagtagaaaattaa

SEQ ID NO: 895 - DNA, 1431 bp, Phyllotreta striolata
atgggaattaaatttttggaagttatcaagcctttttgcagtatcctgccagaaattgcaaaaccagagcgaaagatacaattcagggagaaagtgctatggacagcgataacgctatttatctttctagtatgttgccagattcctctattcgggatcatgagctcggattccgcggatcccttttactggatccgtgtcatcctcgcctccaacagaggcaccctcatggaactcggtatttccccgatcgtaacgtctggcttgatcatgcaactcttagccggagcgaagatcatcgaagttggcgacacccccaaggacagggctctgtttaacggcgcccagaaactgtttggtatggttataacggtgggtcaagccatcgtgtacgtaatgaccggaatgtatggagatccagctgaaataggagccggagtctgccttctgatcatcatccaactgttcgtggcgggtctcatcgtgctcctgctcgatgaattgttgcagaaaggatacggtttgggttcgggtatttctcttttcatcgctacaaacatctgcgagacgatcatctggaaggctttctcgccggctactgtcaacactggaagaggaacggagttcgaaggagccgtcatcgccttgttccacttgctcaccaccagacaggacaagattcgaggattgcgcgaggctttctaccgccagaaccttcctaatttgatgaatctactagctacagttctagtgtttgctatagtaatatacttccaaggtttcagagtcgatttgcccataaagagcgccagataccgtggccagcattcgagctatcccattaaacttttctacacttccaacattccgatcattttgcaatccgctttggtgtcgaatttgtacgttatatcccagatgttggccgttaaattccaaggcaacttcttcattaatctcttgggggtttgggccgatgttggaggcggcggcccggctaggtcttacccgatcggcggtttgtgctattacttatcgccgcccgagagcgtgagccacatcttggaagatcccgtccacgccgttatgtacattatattcatgttgggttcctgcgctttcttctcgaaaacgtggatcgaagtgtccggcagttcggctaaagatgtcgcgaaacagcttaaagagcaacagatggtcatgagaggtcacagggaccattccatgatacacgaactcaaccggtacattcccaccgctgccgctttcggcggtttgtgtatcggagccctgtccgttctcgccgatttcatgggagctatcggttccggaaccggtattttgctcgctgttacaatcatctatcaatatttcgaaatatttgtcaaggaacaaagcgaaatgggcggcatgggcgctttacttttttaa

SEQ ID NO: 896 - DNA, 486 bp, Phyllotreta striolata
atgtcgacggtttcatcttcggctgttgaattaagttcatacagggaccagcatttcaagggtagtcgagcagagcaggacaagttattacggctttctacgacgttgtacgtaggaaacctatcattttacactacagaagaacaaatttacgaattattttcgaaatgcggcgacattaggcgaatcgtgatgggtctggacaagtataagaaaacaccgtgtggattttgtttcatcgagtattacaaccgcgaagatgcagaaaattgcttaaggtatatcaatgggacaagattggacgatagaatagtaagaacagactgggatgcgggttttatagaaggcagacaatacggaagggggaaaaccggtggacaggttagggatgagtatagaactgattatgattccggtcgaggaggatacggtaaaatagttcaacaaaaagtaggcggaatagattcacaaggatttattcgttag

SEQ ID NO: 897 - DNA, 957 bp, Phyllotreta striolata
tcaaatatggttttaattttaagcaggagttttggtgttaaactcttcaaatataagacgaatttcacgcaaactcgtcttaactcgaccggaaaattatggttcggaagtaaaaaagtgttttacagaaccttaggtttattagccacaggtacgggcatcgttatttatactttagaccaagcagtgaaggcaggagaaatggaacttcatcctcccagatttccttgggcctacaaaggcataattacagcactagaccatgcgagtttacgacgtggttacgaagtctaccggcaagtttgcgcctcctgccattcgcttaaacacgtaacctttcgagaactggttggagttacgcacactgaagcagaggcgaaagccgaagctgagcagcaaatggtcgaagacgggcccaatgaagaaggcaatatgttccagcgtcctgggaaattatccgataaatttccgcctccatatcccaacgaagaagctgctcgtttcgccaacggtggatcctacccactcgacttaacttacataatattagccagagaaggtggcgataattatattttctcgctattgactggctactgtgaaccacctgcaggtgtaacattaaaagaaggattgtactataatccttattttcttggaggttctatagctatggccccaccgctattttcagaatctgctacatattctgatggtactcaagctcatgccagtcaactggccaaggatgtcgttacttttctcaaatgggctggagagccggaatttgacgataggaaagtgatgatggtcaaatgcttaggttggtttatagtcggttcagtaatatcgtggtattggtacaaaatgaggtttatgtctaacaaaacgcgtaaatttgtttatacggggaaatcaagcaccaagaagccagagtgttctgataagtgcgagtaa

SEQ ID NO: 898 - DNA, 1698 bp, Phyllotreta striolata
atgttggcattacaacaatactcaggtagcagcgacgaagaagaagacaaacaaacatcctccgttaatcaagagccttcgaatccttcggagtattcgttaaaaacccagctcgcaatttgcgcagcaccagaagtcctccccactgggctagaggaggaccaaatgcacatagacgtagacacaaaagagctagcgttcaatcccaagtacgatgtactgttcgcaccggccctgggccccgctaatccctttaaaacccagcaacagttggtggaacgcaacatgctctcgggccacatcgaaagggcccacgtcagcgaattccaattcgaaaaccaaaggcgcaccttcgccagttacggctacgccctggacccttccgtaaccaatgacgggcagatcaaagtggtcgggtcttcggaggacgccgacgagagcagcattaaaactgtgttcgaagcctccaaaacgagacctttggataaacggaaaaggaagaaaaacgacgatcccagcgacgtggaggggttcctaggcccctggggtggtttcgtggacgagcaaaaaatatccaaacccaccgaggaagaacaaatcgaactcgacgagatatcctccaaaaagaataaaaaaggtaaacccagcgaagataaaccgctcgaagaaaagtcggtcttgcacatcaaagacgccgtggattaccaaggtcgttcgttcctccacgcgccccaagacgtgggggtcaatctcaaatcggacactccaccggacaaatgtttcctgcccaaggcccacattcacacttggacgggccactcgaagggcatcgccgccatacggttgttccccaggacggcgcatcttctgctatcggccggaatggactgtcgcattaaaatttgggaggtctacaacgaaaggcgctgcgtgagaacctattatggacaccgacaggccgttagagatatcaatttcaacaattccggaaagcatttcttatctgcgggttacgacaggtatataaaattgtgggatacggaaacgggtcaggttttgtcgcgtttcaccagcaggaaaataccctactgcgttaaattcaatccggataggaacaaacagcatttgttcgtggccggtacatcggataagaagatcatctgttgggatacgagatcgggggatatcgtgcaagagtacgacaggcatttgggcgctgtgaatagtattacattcgtcgacgaaaaccgacggttcgtgacgacttcggacgataaatcgttgagagtgtgggaatgggacattccggtcgatatgaaatacattgcagatcccacgatgcacagcatgccttcggtaacaccggcaccgaacggtaaatggttggcttgccaaagcatggacaacaaagtcgtcatattctcttccatgaatcggtttaagattaatcgtaagaagacgttcagcggtcacatggtggccggttacgcctgctccttggacttttctcctgacatgagctacctgacgtcaggggatgccgatggtaaagtgtatatttgggactggaagtccactaagctgttcaagaagtggaaggcgcacgataacgtgtgcatcagcgtcctctggcatccgcacgagccgagcaaactgatttctgccggatgggatggcctgataaagtactgggattga

SEQ ID NO: 899 - DNA, 807 bp, Phyllotreta striolata
atggtgcagaaaaagcccaagaagaaggtaggaaagaaggtagcagccgctcctttggcagtgaaaaaggtcgagcagaaaaaagaagtgaatcccctattcgaaaagcgacccaggaacttcggaataggccaagacatccaaatcccccgggatctatcgaggttcgtgaaatggcccaaatacatccgcatccaaaggcagaaggccgtcttgcagaagcgcctgaaagtcccgccgcccatcaaccaattctcccagaccatcgacaaacaaacagccacccaattgttcaaagtattggagaaataccggccggaaaccgctctccagaaaaggaaccgattgaaggccaaagctgaagctaaagtggccaagaaggaagagaccccttcgaaaagacccaatactttaagggctggtactaacaccgtcaccaaattggttgaacagaaaaaggcccaattggtggtgatcgcccacgatgtagaccctattgagcttgtactattcctccccgcgctctgcaggaaaatgggagtcccttactgcatagtaaagggcaaagcaaggttagggctgctcgttaggcgtaaaacttgcgcggctgtcgcccttacgcaagtcgattcaggtgacaggtctaacttcaacaagcttttggaggttatcaagacgaacttcaacgatcgcgccgatgagatcaggaggcactggggaggcggtatcctcggatcgaaatccgctgcccgtattgctaaattggaaagggccaaggccagggaactcgcccagaaacagggttaa

SEQ ID NO: 900 - DNA, 1002 bp, Phyllotreta striolata
atggcaacaataattaaggatataacattacaagaaaacattccccaaaatatacttttcgaaaaacatatcgacttcataaaggaatacggccagaaggaaaacaactttgaatatgcaatgaccgattatttgaggatatccggcatgtattggggccttacggccctcgaattgatgaacgcctcgcccccgcacacgatagaagagatttcagattacattaaacattgtcaagaccccgaaagcggcggaataagctcgtgcctcaatcacgaccctcacatactgcacacactgagcgccgtgcagatactctgcatgtacgacaatttaaaagccatcgatgtggagggcgtcgtgaagtacgtgaaaaacctacagttacccaacggtagcttcacgggggacaaatggggcgaagtggacacgaggttctccttctgcgccgtcgccacgttgtctcttttaaacagaatggacgctattgacgtgaataaagcagtcgactttgtagcttcgtgtaaaaacttcgatggcgggttcggctcgaggcctctttccgaaagccacgccggtttaatatactgctgcttaggatttttatctgttaccaataggttggatatagtggatcgagacaagctcgcttggtggctgtgcgaacgacaactaccttcggggggtttgaacggacgcccggagaagctgcccgacgtgtgctactcctggtgggtgctgtcctctttaacgatactaggcaagttgcattgcatcgatgccaacgctttgaagaaattcatattggcctgccaggacacggagagcggaggcttcgccgatagacccggagacattccagaccctttccacaccgtgttcggaatatcggcgctttccttactgggaaacgacacggtccagaaagttaatcccacttactgcatgccccagcatgtcatcgacaggctccaattgaagcctcaaattttagataattag

SEQ ID NO: 901 - DNA, 2664 bp, Phyllotreta striolata
atgcaccaagaaacattgcaactaatccaaatattagaaaaaacagtttcacccgacaagaatgaattggagcaagcgtcgagctttttggaacaagcgtcccaaacgaatttattaggattcataaagaccctctcggatatactgcggcatggcgggaacagcccggtggcccgaatggccgccggtttgcaactgaaaaaccaactcacttcgaaagacacaaccatcaaggccacctaccaacagcgctggctgctattctccgaagaagtccgggactacatcaagaagaacgtggtcggtgcccttgggaccgagaccaacaggccgtcgtcggccgcccaatgtgtcgcttacatagccgtaaccgaattaccgcaaggacaatggccggatctcatatcgacgctcgtaagcaacatttgccaagggaattccaccgaaatgcaaaaggaggccacgctggaggccatcggttacatctgccaagaaatcgagtccgacgtgttggtgtcccaatcgaacgatatattgacggccatcgtgcacggcatgagatcctccgaaccgagcaatcacgtacgattagccgccacgcaggctttactgaactcattggaattcaccaaggctaacttcgatctcaccaccgaaagaaactacattatggaggtggtttgcgaagccacgcagtcgccggtgtcgcaaatcaaggtggccgctttgcaatgtctagtgaagataatgtcgctgtattaccaacacatggagccctacatggcgcccgcgctgtttcccatcacgttggaggccatgaaatccgagaacgacgccgtcgccctgcagggtatagaattttggtcgaacgtcagcgacgaagaagtcgatttggccatcgaggatacggaagcggccgaagcgggacggcctcctacaagagtatcgaggcattatgcaaaaggagctctgcagtatataataccaatcattcttcaaaaactcacgaaacaagaggagttagatgatgaggacgattggaatccgagtaaagcggccggcgtttgtctcatgctactagccacttgttgcgaagacgaaatcgtgccgcacgttctaccgtttatcaaagaaaacatcaaatcagacaactggcgtttccgcgacgcttctctgatggccttcggctccattctaggcggtttggaacccaacactcttcgacctctcgtcgaacaagcgatgccgactctgatcgaattgatgtacgataacagcgtaatcgtgagggacacggcggcctggacgttcggcaggatatgcgaaatcatcccggaggccgccatcaacgagaactacctgaagccgctgctggagagtctgataaccgatttgaaagcggagccccgcgtggcagccaacgtgtgttgggcgttctccggattggccgaagcggcctacgaacatgccgccgtcaacgaggagaccggtacaccggacacgtacattctgtcgccgtactacgaatttatcatacagaggttactcgagacgaccgatagagcggacggggctcaggcgaacttgagacccgcggcgtacgaggccttgatggagatggttaaaaattcgccgaaggactgttacgttacggtacagaaaactacgatggttattttggaaagactgcaacaggtactgcagatggaaactcacattaccagccataacgacagatcgcaattcaacgatttgcaaagccttttgtgcgccacattgcaatcggttttgaggaaagtcacgccggaggatgccccgcatatttccgatgccataatgacggccatgttgaccatgtttaattccaattcttgtaaaagcggaggcgtacaggaggacgctctcatggccgtttcgacgctcgtagaggtactaggagaaaatttcatcaaatacatggacgctttcaaacccttcctgtacatcggcttgaaaaaccaccaggagtaccaagtgtgcggcaccgccgtcggcctcaccggcgacattttccgcgctttgaagctcaaagctctcccgtactgcgacgaaatcatgaccctactcttggaaaatctccgcgatcaatccgttcaccgtagcgtcaagccgcaaatactctccgtcttcggcgacatcggtctcagcatcggttcggaattcaagaaatacctggacgtcgttttgtcgacgctggcgcaggcgtcccaagcgcaagtcgaccgcagcgacttcgacatgatggagtacctcaacgagctaagagagggcgtgctggacgcctacacgggcatcatacagggcttgaagggcgacgggctgacgcccaatccggacgttatggtcctcgaaccgcacattccgtttatcgtacagtttatcaccgtcgtggcgcaggacgacgagcattccgacgggacggtggccgtcgccgccggcatcgtcggcgatttgtgcaccgccttcggcagtccgatggtgcaattgttggatttggcttcgatcaacgagatgctggcccaaggtagacgcagccgcgtcggcaggaccaagacgttggcgacgtgggcttcgaaggagttgaggaaacttaagatgccggctcccgcggcagccgctagctga

SEQ ID NO: 902 - DNA, 1497 bp, Phyllotreta striolata
atggaaacgattttagaacaacaacgtcgatatcacgaagaaaaagagcggctaatcgacggcatggtgaaagagatgcttcataaaaaaaacacctacagagaagcgataaactcggaccaccgacagaagtaccttctagacaggtacatgacttccacggaaagactgatcgaattgtacgaggacaaagacgggcaacgaaaggccgaggttgccgccctgacgggccccaatgaattcaacgagttctacagcagattgaagcaaatcaaagatttctacagaaggcacccgaacgagataagcgtaccgatgtccgtagagttcgatgaattcgccaaggcgagggaaaaccccaacgaagacatggctaatttcgtcgagttcaccgacgaagaaggctacggcaaatacttggatttgcacgagtgctacgagaagtacatcaatctaaaaggcatcgagaaagtcgattacatcacctacttggccatgttcgaccaactctacgacataccgaaagaacgaaagaccggcgaatacaggaaatacctgctctacctcatcgaatacctcacgtggttcgtgcaacgcatcagaccgctgatggacctcgacagcgatctccaggaccaggtcgaacaggtgttggccaattgggataacgggatggtgcccgggtggccgaaagaaaccggttcggctttggccaacgtcggcgcccatttggacctgtcggccttctccagctgggaggaattggcctcgttgggtctggatcgtttgaaatccgccctcatggcgttgggattgaaatgcggaggaacgttggaggaacgagcccagagattgttctcgacgaaaggaaaaggctctttagatccctctctcatgacgaaaaacagcaagaaccgcgtgacgaaggagaaggaggcgctcaggcaacgggaactggccacgttagaggcccaaatttacagattggccgatctggtgtcagcccaacgggcggcgaccaaagagaacgtgcaaaggaaacaggcccgtactgacggcgaacgggacgacagcgagaacgaagagagcgaggaggagagccccgacgaggccgacgacgatgtaccctacaatcccaaaaacctaccgctcggttgggacggaaaacccattccgtattggctgtacaaattgcacggcttgaacatcagctacaattgcgagatatgcggtaactacgtgtacaagggccccaaggcgtttcaaaggcatttcgccgagtggaggcatgcgcacgggatgcgttgtttgggcataccgaatacggcccatttcgctaatgtcacgcagatcgaggacgctttggctctgtgggaaaagctgaaggtgcagaagcaaagcgagaggtggcagccggagactgaggaggaatacgaggattcaccacgttcccttgcgaatcttcgtattcctcttcagtctccggctgccacctct

SEQ ID NO: 903 - DNA, 639 bp, Phyllotreta striolata
atgacgataggaaagaataataaaatgatccaacacataaactatagggtccgaataacactgcaggactctaggacgtttatcggcacctttaaagctttcgacaagcatatgaacatgatactcggcgactgcgaagaattccgtaaaattaaacccaaaaactcgaaagtcgaacgagaagagaaacgggtattaggatttgtactgctgagaggcgagagcatagtctcactaactgtagaagggcctccaccaccagaagagggacttcctcgggtgcctattcccggagcagcccaaggaccaggtatcggaagagcagcaggtaggggaatgccaccgggtatggctggagtcccagtaggtctgcaaggtcccgtgagaggagtcggaggaccatcccagcaagtaatgacgcctacgggtagaggacaggtttcggcgccgccacaaatgaaccaagcgcctccgaggatgggtggccctccgcctggtatgatggggcctccgcccggaatgatgggcatgccgccgcaaatgggcatggggcgcggtggaccgcctccgatgggtatgaggggtcccccgcccggtatgatgagaggtggcccgcccggaccgccaaggccttattaa

SEQ ID NO: 904 - DNA, 1200 bp, Phyllotreta striolata
atgcaaacgtttcgtaaaatggacgtgaatagtttaataattttatattggtatcgccgtcgttttcgccggaataaaactagaagatactgggtgcatccacttgttaaacaacgttctcatgtaggagcctttcgcttgctaatgagccagttacgacaagacgaatcaaaattttttaattattttcggatgtccatctctacttttcacgatcttctacaaagactgcaagataaattgagaaaacaggatacaaacatgagaaaagccgtcagccctgaagagaaattagcgatatgtataaggtatttggcctcaggatgttccttcagagacatacattatagttaccgaataggtatatcgaccatcagcaacataatagaagaagtgacagaatgcatttggaataatttacaccatgaatttatgcctataatcgataaagtgtccgaatgggaaaaaatatcggatgcatttgatgaaaaagccaattttccccactgtcttggcgcagttgacggaaagcatatcaggcttaaaaagccatcaaatagtggttcaatgtatatgaactataaagactttttttcgatagtattattagcagtggtagatgccgattatcgttttatttacgttagtgtaggctcctatggaaaagagtgcgattcgtcgatatttaaggaatccaatttttggaaaaaattaacggaaggcagcttaaatattcctcaaccaagacctctaaccaccgactcaacaactgcggttccttatgtaataataggcgatgagggatttggattacatgacaatttattgagaccttttggtggaacacacttagataaagaaaaaagaatatttaactacaggttaaccagagcccgacggtatgtagagtgtgcttttgggatttttgcaaataagtggaggatttttcatcgacccttggacgtaaaaaaagaaactgcggtatcgatagtgaaagcgtgtacagtcaaccacaatttcatcagagaaaaagaggggttaaatattgaacgaaaccaagaagaagaatataatcttgaaaacgtgaacaacgaacaacaaacacgaggtggtaggactgctaattcagtgcgatctgaattcgtgaaatattttatttctgaagaaggatcagtaccctggcaagaagattctatctaa

SEQ ID NO: 905 - DNA, 7263 bp, Phyllotreta striolata
cagcaacagcagcagatcgcccagatgaacgccgcgagattacagcaacagcagcagcagcagcagcaacaacagcagaacaatccgccgcactcgccgatgccgcccaaaagtccgatgatcaaccagcagatcatgtcgccgcattcgatgccccaatcgcccatgcagatgccgccgaagagcccgatggtgccgttcaactcgaaccagccgaatccgaattcgcccgccgccagaagcccggcgttccatcagggtatcaaccaaccgcccagtcccgtcacgcacggccaccaaccgcccagttcgcccatgcccaggagcccgatgatcaatcagacgcactctccgcacaacgttcgacgaccgcccagcgccaacagcagcccggcgatgcccgaccggccgcacagcgtcgaaaattcctcgcccagaatgtactcgatcgatcaacttgtgcaggagagtttggccaatcaaaacgtcaacgcgcagtacaactaccaatcggacatgatcaacgaaagcggcggcgggaattcgaacaacccgataccctgtccgccggaagtgcccagattccggtactttaaattgggtttgagaggcggcgcgcccatgtggagcttcggcagaggcgccaaaaggataccggcgccgcctaacgtcaaaccggacgaacccaaagccaagaaggagtcgcatttgagcaaagtgtcgatactgaagaggaaaacctcgatcgcttccatcggtaaagtgggctcgttggtcagttcggattacaacgatttagacgacagttctaccacgccacccgtaacaccgcctctagcttctaccagcagaggtatcgtatcgaagaagaagaacctcgaactgcacgcccaaaaggattccgtcatcgtcatgcacagccccgacgatgacaacaaacagctggaactgatggattacgacgacgataataacaccgttctatcgtcggaggtgtcgttgagttcggcggcgcgcaacgacgacgatttggtggagatcgagacgatatcgcaggacctcgccgaaggcctgtccagtccgctggaacccgaccagatcggcgacgagttcctgctgttccccggcaacatggtggtggacatgtccggcgaggagcactactcggagaaggaggaagagggcgagtacgccgatcagaacatgcacatcgtgatacgcagcccgacgaccagcgacgacgagttcatcgtgccgtgcaaggtgaagcaatacgacgaggacgagccggacgagaatccggagtcgcctgatcaggaggagttcggcgaatcgtccggttacgataacgaggaggcggatataattatttcggatcagactagcggcgtggccgaagactcgatttcgactaaagaggacttcgaggagctcatcgatgagggatcgaggaagaacaacgtagggaaacaggaggtgaccgcaaagcacatacaggacttccaccggtacaccgaactgttcgattacggtaaacccgatgttaagaaaccggccgctaaaaaattccaaccgaaggtatcactcgttagaggagtgactttgcccagcaaacccaacgccgagaagattattatcacgcaaaattcgaacacttcgcaagcttccaaagttaccagcatcattctcacgcacaacgctaacgtgaggaggaacattataggcgtaccgaagatagtcagtaccgtttcgccggctataactatagtgagcgctagtacctcgcaaatggcctcgatattaccctctaaattcacggtgcctgtcataagcgcgagcgccgttcgccagctatccaacgtaaaagtcatcgataaaccgtcgtcatcgtcgctatcgatttcgacgagagacaacgtcctgcccaagaagatattcgaggacgattcggtgtctcccgacagcagttcgaattgcgacgacgagaaatcgaaggattcgttcgacgacaaggcgaaatgcgagtcgccgccgcgcgatctcaaacagcccaactcgcagatcgtctcgttgaaatcgaaaacctacgcggagcaatcgaagaagatcgaacacctccaaatcgtgaacgtatcgtcgaaggacgtcgttcaaaggcagcgaatgccgagtcctttgatcgcgaaagcctcgcccgtcatcatacacaacacgcccgagttgaagatgaccgcgcaagtcatccaggagagccagactcgcatgaacatcacgactactacggataccgagcactacgacgagtctaacgacgatacgaagtccgtggtgatttcgattccttcacctacgccatcgcaagaacagatgttggacaatatagccttccaggcgctggagaataggaggcgagagtacgattcgatcgaagacgtgttggatatgatcgagaatatcgagaacatcacggccgaaccgcccgagatattagaggaaaacacgttgcaaagttcggaatccggtagtaacatcgaaacgaaaaacgccgatacgaaagaatcgcaattgcccgtcagcgaaagcgattcctccgcgactaaatcatctaccgtaccgcaattatcgcctctctcccagcccactgaattgactacaaacatggcgaacgcctcgcagcaactcagaactctgctgtcgtcgctgcaaaccacctcgacgtcgtctcccaccaacgtggagtcggtagcgaagggcttgggccagaaaatcgtcacttcctcgtcggccaatcagcccatagtcgcttcgagggtgatgggccaacagcaacaggccggcaggcaatcgccggtcatcgccggcgtctccacggtgatcgtgccgaatttcaagcaaaaaatcgccgcgacggccaccagcacgtccagaagtagccccgtaaaggtggtgaccacctcgcaacaactcgccggatccatcataacgtccgctttgaattatttaccgaacagaacgatcggtatacaactagcgcccgagcaatcgaaacttgcgcccgctagtgtcgctgcgatgcaacaaatcaactcgattacgtcgagccaggaagcgaagaagccttcgttgacgctcaccgcgatgctgcagaaccaaccggcggcgaatacgatttcgaaatcttcagctgatactattacagcggctagtttgctgggttcgcctatcagtctaccgaaaaccgggttcaccacgtctttggtgcaagcgcaaccgagcgtggtgctctctagcacgcctccagcgcccggccaagcttcctcttcgaccaaaaccaccgccgattcgatcacagccgctagtttattgagtagcatcgctaagagtacgttcgcgagcacgagtagcgccaacaagacgcctacttctacaacgaatttgctccacacgcaactgacgaaagtggcgagaagcaaatccgtcgatgacgttaaagatttggctaaaatcgacgagattaaacagagtatcagtagcgaaaacgttgatgacggtagtaacggcgggtgtaaattatcgacgatcgctacgagcgtttgtaacaaaactgaagattcgcagaacgtgttgctgaagaaattgctgcaaaacacggcttgcgctagcgcccaatcctccccgccagcttccaccagcaccgtcaccacgagcgccgctagcgctatagctaaagcggccaattcgcaggctagtattagcgctagcgtggatcccccgccggtggtgagcgctccaccgaacgttgctatccaaaggagcgccagcagagacgaattactgtcgccgccgcaagacctccaatcgatggtggtgatcaagaaagaaccgccgctcgtgccgctctcccaaccgagccctctaaccaactcgaactccaacgccgccacgcccgaggtgaagaaggaattcatcgacgaatcctcgcagcactcggaggtctccgaccacagccgctccgacgcgcccatcaaagaggaactcgaaacgatggagacggccgccgagaagacgatgctcgacaaggaggagctgaagaagcagaagcgccgcatgtaccagcagaagcgccgccagaaccagatactcaacaaggagctggcgcagcagcagcagccgaagaagcgcgcccgcaagaattcgaagctcgacgaggactacgacacgtacatcgacggcgtgctggcccagctgcggcagctgccgccgatcgccgtctccgagccggtgttgggccgcaacttcggcgccgtgccgctgttcgggtgcggcgatctcgccaagatcggcgccaaggattactcgacgcacttgggcgagttgacggggagctacgggtacgcggaggcgcccggtttcacggatttctactcgacgaaaccctacggggatttggatccgttgccggagaaaccgccggcgtcgacgcaacgcggtttctacgatcaggagtttccgctgattcggttcgacgtcgacgagcagcggaagttcgacgtgttctgcagggaggattcgcccgattcgatattgagcagctcgtcgcccgaatgtacgcgtcgatcggagagcaaattcgtcgggttgaggctcatcagcgacagcgaagacgacgaagaagacgatgccaaagatgccgtttcgaacggaagaatgtcgccggttgtgcccgttatcaaacccgtacctattagactaaaacccgctggggagttgtactttaaagaaaacctgaacgagaacaaggagaacatcaacagcgattcgttgcacgtaatgacgaaatccaaattcgacaataaacagtctccgcctgcgaacgtctccggccacgtcaccgtgactctgactctcacctcgtcggcggccgaagacataatgggagtgctgcgggatttggccaatattctgcacataccggcgcctaccagttaccaaatcgtcgagcggacggcgtcgccgccgagccagaaattgggcgtgtaccgcaccaaaggcaaggacggcaaagagggagcgccgatcgacatacagagcatcctcaacggcgccaccaagttctgcaagcattgcgacgtgatcattttgagcaacatgatcagaaggaaggcgtccgatttgccgttcttggccaaagattcggatttgctcggcgacggggaggaattgttcttttgcggttccgcctgttacatgcaattcgccctcatgcaccggtcgccttcgatatccgaagacaaggccgccgagatcataaaccacctatcgcagaaagacaatttggacgcgaatcaaaaattaccggcggccgattcgttagacaacaccaaatccatagcgcagaaattatcgttcaacgtgaaagattcgaaacgggaattcgagccgatggagacgaacgacgcgttcgcgttcttcgcccgtacggcctccgccaaacaaggaaacaacttctacgacggcgctccgttcaaacaggctcccgccagggtgcacaggaacgacaggtacaaactttggacgcccggttgtctgcaacccacccaaaaacacaaaacgcccaccgacaaggagatcatggagctgctctacaggatgcagatcaccgtcacgccgcccgtcatgcccgaagataccagaaagtgtttgttctgtcacggtatcggcgacggcgtggccgacggaccggcgagactgctcaacttcgacgtcgacaaatgggtccacttgaactgcggcctgtggtccgatggagtatacgaaacggtaaacggggccctaatgaacgtagaaaacgccctacaaaccggactatcggccacttgcgtgcattgccaaagcgtcggagccacgatcaagtgcttcaaaacgcgatgctcgagcatctaccacctgaactgcgccgtcaaggacaactgcgtgttctacaagaacaaaacggtgttttgcaaggcgcacgcgccgaaaagcgagaaagacaacgaactcaccacgctgtccgtctcgcgacgggtctacatcgaacgcgacgaaaacaaacaagtggccgctgtcatgcatcactccgactcggccgatctgctgcgcgtcggcagcctgatattcctgaacgtgggccagctgttgccgcaccaattgcagaacttccacacgcccaaccacatctacccgatcggctacaagatcatccggttctactggagcatgcgcaacttgaacaagcgctgcaagtacatttgcgcgattcgcgacgcgtccggcaagccggagtttcgcgtgacgatccaggagccgcccgaagcggacgtcgaatacgccgacgccacccccaaaggcgcctggcagaagatcctcgacaacgtggccggcatacggaaggcgaacaattgcctgcacatgttcccgaaattcgcgaccggcgaggatctgttcggactaaccgaacccgctatagttcgagtgttggaaagcatgccgggcatcgaaacgctgtcggactacaagttcaaatacggacggaatccgctgttggagctgccgctcgccatcaacccgtcgggggcggcgcggacggagccgaggctgcgcagccagttgcattggaagaaggcggcgcacacgcagaggaccaccggcggcgcgtcgtcgattcgaccgatgttcggaccgtcgttggccggttctatcggcgcgccggcccaaggcgagctcgcctgtccttacagcaagcagttcgtgcactcgaagagttcgcagtacaagaaaatgaagcaggaatggaggaataacgtttatttggcgagatcgaaaattcaagggctcggtttgtacgccgctagggatttggagaaacacacgatggttatcgaatatatcggggaaattatcagatccgaactggccgagtgtagagaaaaacaatacgaagctagaaatcgagggatatacatgttcagattggacgaggaacgcgtggtggatgccactttgtgcggcggtttggccaggtacatcaatcattcgtgcaatccgaattgcgtggccgaaaccgtcgaagtcgatcgagacgttcggataattatattttccaaacggaggattttgcgaggagaagagttggcgtacgattacaagttcgatatcgaagatgatcaaaacaaaatatcctgcatgtgcggggcaccgaattgtcgcaaatggatgaattaa

SEQ ID NO: 906 - DNA, 2100 bp, Phyllotreta atra
atgccgaccgaaagaaaaagaaaaagctttataactacaatgccgagggaagatgtacttgaaagatacaaacacaaaagtcacaaaagaaaaaaaagccggtccactagccgttccgaacgtaatcaagacgaacgcaaacattcatctagctctagctcaaagaaaaagagtagttttcgcgaagatgccgaccgaaagaaaaagaaaaagcgatctaagagctcttccagcgattccgaatcgaccagcagcgaaagttcgggtaattcggtgaagttactaaaaaaactcgagaccgaaaggctgcgattagctgaacagaagatgaaggaaaaggagcttctcaaagctacggaaacagccgaggagaagagattgagaagattgatgaagaaagaggcgaaggaaagaaggcgaaaagagaaaatgggctgggataacgaatacttacattacacgaacagcgacaatccattcggagacggcaatttactgaccacgttcgtttggaataaaaaattgtccaaagaaggcatcaaaaacgtcggccatgaagaaatagaagcgataaacagattaaaacaagaagagaataaaagggaactcgaaaaagtgaagaaacgaagattagagagggaattggagaggcaaaagagagaggaagaaacgcaaatgatgcaacgaactaaagaagcagcccaattcgaggaatgggagaggcaagaagataaattccacttggaacaagctcgattgagatctcacataagaatacaagacggacgagccaagccgattgatctgctagcgaagtacataagcgccgaagaagaagtcgatgccgtcgaaatgcacgagccttacacttacctgaatggcttgcaaatcaaagacctagaagacttagtcgaagacatcaaagtctacaaagaactagaaagaggaaaaaacctagattactggaacgatataacagtcatagtcgaagacgagcttcaaaagttgcgaaaaatagaaaaacaaaacgatttcgacttgggattgaaccgaagggaaggaatacatcaatctgtcgccaccgatgtgacatcagtatttaaaggcaaaacagccgcacaattagcagctttagaaaaacaaatcggaagtaaaatcagcagcaaagccgatggaatagacataggctattgggaatctttgctatcgcaacttaaggcccacatggcgagggcgagactacgcgacagacaccaagatagcttaagaaggaagctgcaagtactaaaagcagaacaagccatcacaggagtaggtcaaagtcacagcgaaacccattctactgataacgaagagaccacttcggaacccaaaccaagcacctcccaggatgctttggaaacgatggaagaaagcaacgaaaggaccgaagacgctgctcatgcatggctcaacgaatgcttttcggcctaccaagcaggcggatacagtcccaagtttttaactccagatgataccgagcctggtacgattgtagtctcggaggaagacgacgtaaatagattggaattcgctaggatgcacgttcttggtcaaggaaccaaaatcgagaacgtcattacgaaggaagaattgctgctgcaaaaggaggcgagaaaaggcatggacggggacgaggctcaattttcggtcgagcaagccttggataatccagtgtatctttggtcggataagtaccgaccaagaaaacccaggtacttcaacagagtgcacacaggattcgagtggaacaaatacaatcagacccattatgacatggacaatccaccgccgaaaattgtgcaagggtataaattcaacatattttacccggatttgatcgacaaaagcagcacgcccgagtactatttaacgcctagccccgagaacaaggaatttgctatactgcgattccatgccggaccgccttatgaggatatcgcttttaaaattgtcaacagggaatgggaatattcatacaaaaggggatttagatgccagtttcataacaacatatttcagttgtggttccatttcaaaagatataggtatcgaagatga

SEQ ID NO: 907 - DNA, 1299 bp, Phyllotreta atra
atggataatctagaagcgaacataatggacaagtcgatgagatcggtcttcgtgggaaacatcccctacgaagccaccgaagaaaagctaaaggacatattcggtgaagttggccaagtgttgtcgttcaagctggtcttcgaccgagagaccggcaagcccaaaggctacgggttctgcgaatacagagaccaggagaccgccttgagcgccatgaggaacttaaacggctacgaaatcggcggcaggaacttgcgagtagacaacgcttgtacggaaaaatcccgcatggaaatgcaaaacctgctcaaccaaccgcccatcgagaacccctacggcgagcccatccaagccgaaaaggccccggaggccatcagcaaggccgtggcctccctgccgcccgaacagatgttcgagctcatgaagcaaatgaagactaccatacaaaataaccccacagaagcgagacaaatgctattgcagaatccccaattggcgtacgctttactacaagcccaagtggttatgaagattatcgatccccatacggccgccagcctactgcacccggttaaccaagtaccagccactttgctgccgggggacaagaacgtggcagtacaagtaccgatcaacaaccagtaccgggaaccccctgcgcccgtacaaccgcccaggcaggagtaccaacccgtaccgccgcccctggtacatcccaatcacgttcaacagcccgtttttaccggtcaagatgtggacttgcgatcgatggggaatgtgaccgatccgagaatcaggcccatgattgtggatcaggatatgagacaaatgccggccgttatccagaatcccctaccgcctactattagcgaaagtcttgccaaagcgggagattcgaaaccggataacttttcgagggatccccgaagcggcaccggtttcccgtcggacccaaggcaagctaggatggacccgcgacaaaaaaatatagtacctccgacgagccaacaagtaccgccaacggtgaatcccaagataatgccgcctcaagccggccctgtcgtcagaccggctcaaaacgtcatcgctcagtcagctgcagctgcttcagtttcagctgcaacagccaacgtcagcccgggaattggaggggcaggagctactgatcaagaaaaagccgccctgatcatgcaagtgctgcaattgtccgacgagcagattgcgatgttgccgcccgagcagaggaacagcattttggtgttgaaggagcaaatcgcgaagagtgcgcacgtgcgttga

SEQ ID NO: 908 - DNA, 783 bp, Phyllotreta atra
atggatgcggaacgtgagaagagcctccaagagtacaggaaaaaattgttggagcacaaagaagtggaatccagactgaaagaaatgcgagaacaactcaaagatttaaccaagcagtacgataaatcagaaaacgatttgaaagccctccaaagtatgggccaaatcgtaggtgaagttctgaagcaactgacagaagagaaattcattgtaaaggcaacaaacggtccccgttacgtagtaggctgccgtcgtcagctggataaagccaagttaaaggccggcacaagagtagccctcgacatgaccaccttaaccataatgcggtacttgccgagagaagtcgatccgttagtttacaacatgagccacgaagatccaggagacgtcacttactcagccattggaggactttccgaacagattagggaattgagagaagtcatcgaattgcctctcatgaatcccgagttgtttatgcgagtgggcattacaccaccaaaaggttgtctattgtacggaccgcctggaactggtaaaactctgttagccagagctgtggcatcccaactggacgcgaatttcttgaaggtcgtatccagtgctatcgtagataaatacatcggcgaatctgccaggcttattagagaaatgtttaactacgccaagaccaccaaccgtgcatcatcttcatggatgaaatcgacgctattggtggccgaaggttctccgaaggtacatcggccgatagagaaatccaaaggacgcttatggagttgctga

SEQ ID NO: 909 - DNA, 780 bp, Phyllotreta atra
atggctcgccggtacgataccagaacgaccatattctcgcccgaaggacggttgtaccaagtcgagtacgccatggaagccatatctcacgcgggcacatgtctgggcatcctggcgaacgatggaatccttctcgctgcagaaagacgcaacaccaacaagctactagatgaggttttcgtctcggagaaaatctacaaactcaacgacgatatggtgtgcagcgtagctggaattacgtctgacgctaacgtattgacaaacgaattgcgtttgattggacaaagatatttataccagtatggggaatcgatcccttgcgaacagctggtttcgtggctgtgcgatgttaaacaagcgtatactcaatacggaggtaagaggccgtttggcgtatccatcttgtacatgggctgggacaagcattacggttaccaattgtaccaatcggatccgagcgggaattattccggttggaaggcgacttgcataggaaataacagttccgccgccatttcgagtttgaaacaggaatataaagaaggcgatatggctttgaaggatgccaaaggtttggccgtgaaggttttggctaaaacgttagatatggctaaattgacttcagaaaaagtggaaatggctactcttacacgtagaaacgacaagaccatgataaatatattaaatagcaaagaagtggaagaacttatttccgagtatgagaaatccgaggcggccgccgaggctaccaagaaacaagaacaaaaatcagctgcttaa

SEQ ID NO: 910 - DNA, 2667 bp, Phyllotreta atra
atgagtgaatcaacaaaagccgaacctataaaggtggaatcaaaaacaactgacgacaaaaataagaacgaactgtccgatgaagataaacaactccaagaggaattgaacttgtgcgttgaaaaattacaagaaaatgacagtaaactttacatgccagctttgcaagctttgggcaaccacattcgggcctcgaccacttcaatgacttccgttcccaaaccgctgaagttcatgaaacctcattatgatacgatgaaacagatcttcgagaaaataactgagccttcggttaagagtctgtgcgcagacatcatctccgtgttagccatgactatgggagaaggaagggattgcttgaagtacaggctggtgtccgatttggacaaaatcggcgaatggggccacgaatacgtcagacatttggctggagaaatagctggcgaatgggccgaaactgatttcttagtaaacactgaaattagagataaactcatattattaacaaaacagatcgttccttataatatggcccataatgccgaagcggaagcttgcgatttgttgatggaaatcgaacgactagatttgctagaacaatacgtggatgaaaacatttaccctagagtttgcttatatcttacaagctgtgtaccttacgtagctgatcccgaaaacaccacacttcttcaaaccgctttaatgctgttcaggaaattcaagcagtacccccaagcacttcggttggctatgcaactgaacgatcacagtctcatcgaggaaatattcctaaattgccccgatactgatgtacaaaaacagttggcgttcatgttgggcaggcagcagatttacatcgaagtccccgacagcacgccggagtacgaagacctcatcgaaataatggcgaactgtcacctgaataaccactttttgaatcttgcgcgcgaattggacattatggatccaaaaaccccggaagatgtttacaaatcccacttggaaaacagccgtcctccattcggtggcagccaagttgattcggccaggcagaacttggctgcaagttttgtcaacggtttcgtaaacgctgccttcggccaagataagctcttaatggaagatggaaacaagtggctgtataagaacaaagaacacggcatgctgagcgccactgcctcattgggtttagtattattatgggacgtcgatggaggtcttacgcctatcgataaatacttgtactcttctgaagatcacattaaatccggagctctattagcctgtggtattgtcaattgcggagtcagaaatgagtgtgatcctgccttggctctattgagcgactatgtcctacataacacgaatataatgaggataggcgctatcgtgggcctcggtttagcttacgttggatccaacagagaagcagttttaagtttactgactcccgtcttttccgatccgaaatccaacatggaagtgatcggtatgtcggcgctagcttgcggaatgatcgcagtgggatctggaaatctccaagttaccaccacaatcatgcagacgctaatggaaaaatcagaaaccgaactgaaagatacgtacgctagatttttgcctctaggtctcggcttgtgcatgttaggcaaacaagaaggcatcgattccataatagccgcattggaagtcataccggagccttttaaatccatggcaactacgatggtcgacatttgcgcttacgctggtaccggcaacgtacttaaagtccaacatttactgcacatttgctccgagcattacgacggcagcgacagctcagacaagagttccaaagataaggacaagaaagatgctacggagaaggagaaggacctttcctcgagacaagcagtggctgtactcggtatagctttgatcagcatgggtgaagacattggcagtgaaatggccttccgtaccttcgggcatttgttgcgctactgcgaaccggtaattagaagagcagtacctttagctctgggactcatctcggtatcgaatcctaaattgagcattctggatactttgagtaaattctcgcacgacagcgatgcggaagtagcccataacgccatatttgccatgggtttggtcggagcgggcacgaataatgcgaggttggccgcgatgctgagacaattggcgcagtatcacgctaaagatccgaacaatctgtttatggttcgcattgctcagggtctgacgcatttaggtaaaggaacgttgacgttgagtccttatcacagcgaccgtcagctcatgagccccgtggcagtggctggattaatggctacccttgttggatttttggatgttaaaaatattattttgggaagatcgcattatctcctgtacactttagcagcggctatgcaaccgaggatgcttgtgacgttcgatgaggatttgaatccattaccagtacctgtgagagtgggtttggctgtagatgtagttggtcaagctggtaaaccaaaaactataaccggttttcaaacgcataccactcccgttcttcttgcgtatggtgaaagagctgagctggctactgaagaatacttagcccttactccaattatggaaggttttgttatattgaggaaaaatcctgacttcaatgcataa

SEQ ID NO: 911 - DNA, 1518 bp, Phyllotreta atra
atgaccgatagtaacatggattcgaaagaagagaaacaagcctcaccggacaacgcccacttgaaaccagaagcaaccgagcccgaggctcccccagctcaagcctcccccgccgccggcgtcatccgaaggaatttcatcacccccgccggaaccatagtcgaaaccaacgaggaacaaccgccggaaccaacgacagaagaggtcgtcaaaacgacatcgtccaacccgagtccagccgaacagaaacccgaacccgagatagtcacctacgcagcggaggtcctgccgcaggagcaaagagaacaattcgccgaagccaaatcctacgcagtggaaatgccagctgagaattttcctaacaacaacttcacccaggacattagctacgtgaatatagaaggaactgttgttccagtcacaatatcggagatggaacatcctggagactacgccaatctacaaactgctcaatacaataacggctatacggacggtacgcagtatttaaccaaccatcagtaccagaacatgtacatagagagaactacagttgataattctccttctgctactgttttgtatcgggacgatcccaatttgggagcttctagattccaaggaaattacgacatatccagttcccaatcgcaagtgaaccttcttccagctgcgtcaggagaaacctactatacatcgacccctaactggacgccgacgagcagcggtacttaccaacaacaatacccatccgggaccataaacgtccttcaggcggattcgactcaagccttcgggagtccatacataaacgcgacatggtcgtcgaattcgatggaggacggacggccgtctagtcaagaggtactagtgaaagagtgcgttaattgtggtgctagcgtcacaccactttggcgtagagacggtacggggcattatctatgtaacgcgtgtggtttataccacaaaattaatggggtgcacagaccgccgacaaagccaaccaaaaaaccacaggcgactggaaatagaagaaacggcgtaacgtgcgcaaattgcaaaactaacaacacaactctttggagaagaaacaaccaaggcgagccagtttgtaacgcttgtggactctactacaaattacataatgttaacaggcctatcagtatgaaaaaggaaggtatccagactcgcaaaagaaggcccaaaaactcctctgtgggaaaccccgccagtgctgcaggtcaagtaagacttgggattccctcctatccatattcagaaatagatgtacagcaagatcaataccaattaccaatgaacgtttattctcaaaggccacaagtgtcttatcgacagtacggaacagaaaatattggaactttaaatgcacaaccattgcagccaataattactcacgaggacgaacaggcaagcgtcattacatcgacttcacaacaggctaggtttaggacgaaggtggaggaggacgagggtagcaatccttcaatgcaatcctga

SEQ ID NO: 912 - DNA, 4869 bp, Phyllotreta atra
atgatcacgatggcactaccggggaatgggatcttcgtcgtcaaaggcgaaatatcgaacttgatggccgccatgaagaggggccccaaatggtcgtcacactcttatcaggacgacgacgtcgacgcgctgctgaggaacttccaagagctgcgggatattctacacaatgtaaacgatttaggatacgttgaacccaatacgtttttggccccttttttgaacgtaatccgttcagaggagaccacaggccctgttactagtttagcgctgtcagctgttaacaagttcctctcctacggtctcttagatcccgtacaaacatccataccacaaaccatccacaccatcgcagacgctgttactcacgctcggtttgtgggcaccgatcaatcctccgatggggtagtcctaatgcgcatcctgcaagtactgcgaactctcactctatcccccgaaggcgccacattgaccaacgaaagcctctgcgagataatgctgtcgtgctttcggatatgcttcgaaacgaggctatcggagctgcttcgcaaaactgccgaacattacctgaaggacatggtgcaattgatattcatgagactgccccaattctccgaagatcccaagctctcctacgtcaaacgattgaggatgcagcccggcgatctcgagcagacgcgaacgaagaggaaaaagtactcgaagaaggagaacaaagaggttgctaaagtaccgccacaagaaattaacgttgaaagtatcccgcagactgatatagtagatatgcaaggtactattcttcgtaataacgaagttactacgccttctagtccaaatccaaatgttgatacagatgttgctatagacattcctacagatgacagtatgaagaattcggaaacttcgacatctaatttagacgatagtgctgagaaggaaaccgatgaaccgtttcaagactacgtcaatcaaagaggtattcggttcacgcctcagttccaacaggaaaccaacctatctccttacggattagcctgtgttcgcgaactattcagattcctgattagcctgtgcaatcctttagataagcagaacacagacgtcatgatacatttaggactcagtttgctcacagtagcattcgaaattagcgcagacaacataggcaaatacagcacattgttgactctagtggaagacgatttgtgcaggaatctgttcgctttgatgaacaccgatcgtttgacgatattcgctgcgaatttgcaagtgtcgtttctgctgttcgaatcgttaagggcccacttgaagtaccaattggaatgttatttgaagaaacttatggagatcttacgtagcgaatcgaataaagtgagctacgagcacaaagaaatcgcgttggataatttgctgcaattgtggagggtgcctggtttccatgcggagctgtacgtgaactacgattgtgatatgtattgtactaatttgtacgaagagctgacagaactactggccgaacggtccatttccaccattgtaggagtgtaccatgcgcatttactgtcgctcgatggacttctaatcataatcgatggtatagggaagagattcgacgaagcgaaagatcgtactgataccgatgagattagtagttatataggagagaatacgagaattaaaggttgtgttaaagttcccgataagaaggtgttggctgcgaagaaagggatcaaaaagtggttaccgcaaggtacagagtatttcaatcagaagccgaagaaaggtatacagttcctgcaggaacacggcgttttgaagcaggagctcgacgtggaagagatcgctagattcttgcgggagaatcccgcattgaacaaagcgatgattggtgagtacatcagcaatcgggggaatttgaagatcctcgaggctttcgtgagcacgttcgatttcactgggatccgaatcgacgaagcgcttagagcgtttttggagacgtttcgattaccaggcgaggctcctacgatttcgttgattctcgaacatttcgccgagcattggcacaaaagcaacggagaaccattcgctgatgtggactcggcttttacattagcctatgctgttattatgctaaacgtcgaccagcacaacgaaaacgccaaaaaacaaacaattccgatgtcacctaacgcgtttaagaagaatctgaaaggcgtaaatggaggcgacgacttcgaggaggacatgctcgacgaaatatacacttcaatcaaaagcgaggagatcgtgatgcccgccgagcggacgggcgtcgtgcgcgacaactacctgtggaaggtgctgctgcgcaaagggcgctcgcccgagggcggcgtttacatgcgcgacgacggcggcgcctacgacgccgaattgttccgcatagcgtacgggccgctggcggcggcgttgaactccgtctacgagcgagcggaccacgaaggcgtccagaagaaagtcatgcgaggtttcgagcgatgcgcctccatagcgtccaatctcggcatgacttcgaatctcgacatgttgttggtcagtttgtcgaaatttacggttttccacaaccatcagaagcagaccgccgttgtggtgcaattcggctcgaacggcaaggctcaattggctctgaagacgctcttcatgctgatccaccagcacggtaactccaccagggaaggttggaagcacctcttcgatctcctgctcgctttgtacagcaacgatttgctcagcaagagctttgtggaagtagaagattttgtagagccatccggtaaattgtgtttggtgtacaaagatgctccgagcgcggccaaacaggataccggattgttaagctctttgtattcctatatgatatctgtagagaatttatccaaaataccatcgccagaagaacagagtttaatagataaagcaagagagtgcatcaaagagtgcaatttagagcaaatgatcacagattcgaaattcctccaccaacaagcccttttccaactggtcgatactctaatcgaattatccagaggtccagatgtacaagatggctcatcgtatgactacaacgaaaacgtaacggtctttttccttgaattactggtgaaaatcgtcatccaaaacagggacagggtgatgaccatatgggaccgcgtcagagaccacgtctacaccctggtcatgaactcctcgctgatggactaccagttcctgttggagagatccgttgtgggtttgttgaggatagccgtgcgattgatgcgcaacgaggagatgagccacgtggtgttgcagtcgctgcgcatgctgctgttgctgttgaagggcggcgtgctggcgaggatatccaggcaaatggcgttcggtttgtacgagatgttgaagacgtctgcgcaaaatattcacacgacggccgattggacggtggtgttcgcgttgttggaatgcgtgggagcgggggcgaagcctcccagacccgttttgaccgtcgaagaaaacgacgcaaaacccaaacccgacgaagaaaatcctccgacgaaagaccacaaaaaagacgaggaaggcgcctgcgcgttttccgacccgaaaacgaacgaaaccgccaaacacccgacccaaagaccccaaagtccggtaacagccctcacgtctcccgtcggcacgccgaacaccggcggatggatcatcgtcagcgacgaggacgacctccaaccccaccgaggcccccagcaaaccctacccgtccactaccacctgcgcctcgacgccgatctctcgccccacgacccgctcagcatgctgaaatgctgcgagagcttggccttcctagtccgcgacgtcgctcacatcaccccgtataacttcgacgtctgcgtacgttgcgtccggacgttcgtcgaggcggccctgaaaccgcctaccaacaaccacccgaacaccagaagatccaacgtaaagaaaagcaggaagaaaagccccgctggaagccaagaggaagacagcagcggcggcgatgaggacgaagacctccccagcggctaccaccaagtccccatacaattactggatttgatgcatacgttgcacactcgcaccgcgcagatattcaaatggtgggctgaggaaggtggtgaaatttccggggaaacttccttgtgggcgcaaggatggtgtcctttactacaaggcatcgcgagatcctgctgcgatatccgcaggacggtcagaaccagcgctatagcctacctccaaagagctctactagtgcacgatctccaaacgctaacccccaaggaatgggagcagtgcttccgaagagtactattcccattaatgaactacctactgcaatccaccagtcctagagacgccgtttccaccgaagaaaccaggataagagccgccggggtgctatcgaaggtgttccttcaccatctagcgcctctttcgtcgctggcgggcttcgcggatctgtggtcgacggtgctggagctgatggacgggtacatgcacgccgacggcagcgagttgctgctggaggccgtgcccgagagcctgaagaacatgctgctggtgatggaggcggctggagtgttcgacgggcccgatgggaagaagaacgccttgtgggcggcgacgtgggagcgcatcgggaagttcctgccggggttgaaggacgagttgtttagggagatggggtcgaggaggaaggttgtggaagaagtgaaagacgtggaggtcggggagaaggagacggagtgttgggagaagaacgttggggagcgggagcaggatgtggatggtagggagaaggaggagctggttgcgtgttga

SEQ ID NO: 913 - DNA, 618 bp, Phyllotreta atra
atgtcgattttggcgtacaacgggggcgcaatggtagcaatgaaaggggacaactgcgtagccatagcggccgaccgcaggttcggcatacaagcccaaacggtggccacgaatttcgagaaagtcttcgaaatgggcccccacctgttcgtggggctccccggcctcgccaccgacacgcaaacggtcatggagaagctcagattccgcaagaacttgtacgaattgaaagaaaacaggcgaatctcccccaaagtgttcgcggcgatgatatcgaacatgttgtacgagaagaggttcggaccgttcttcgtcgaaccggtcgtggccggtttagctcccgatacattcgagccttacatatgcaacatggatttgatcggttgcatcaacgaacctagtgattttgtcgtagggggcacagcctctgcgcaattgtatggaatgtgcgaatctttatgggaacctaatctagcccccgatgatttattcgaaaccatatcgcaggctttgattaatgctttcgatagagacgctatatccggttggggtgctacggtttatattgtagaaaaggataaggtaaccgtaagaaatctaaagactcgcatggattaa

SEQ ID NO: 914 - DNA, 2907 bp, Phyllotreta atra
atggaaggaaaaccggaattagaagtggtgaaatcggccgtatcaactttatacaacaaccccgatggtggtgaaaaagaaagagcctcccgatggctactggaactacagaaatcggttcacgcttggacagtggcggacgaattgctgcgtcgttgcacgaacgccgacgatctccaaacccgctactttgcggctcaaacgatgcgcaccaaaatccaccaatccttccacgagctaccccgcgaagtgcacgagtctctcagggactcccttctggagcacatgggagcttgcgccggcgtcgacgagggcgcgggggccgccatagtgacgcaactatccctagccctggcggatttggctctgcagatgcccgattggcgaacgcccgcgttggatttgatcggcaggttcagtgcggggaacaacgtgtggcccttgctcgaagtgctgacggtgctccccgaggaattggagagcagatcagtgagattaggagaaaatcgtcgatacgaggtgttggaagatatgaaattctgcgctcccaccgtcaatgaatttctcaagcattgttcgaacttgtacgggcgaggcggcgccgagaggctagcggcgggcgatagacaaatcgacgtgaaaatcctgagatgtttcgcttcgtggatatcggtcggggcgatcgggccgagccaattgagcgaggatcgcgtggtggtcgacatggctttcgacgtgttgaaagcggccgtacggggagacgaaaaagaaaccctaacaggtcaacttcacgaagccgccacggattgcatttgcacactgctgctacgtctcgaggacaacaacaaccacgtggcgttggagacccacttatttgaaaatatagtaaatctggaagtggcctatcatgcgtctgtcgccctcgaagatcaagcaaagtcgacggattattgtcggctgttcaccgagttggccgaatcgtttttgggaaagattgtggacgacgggggaggcggcggcggcggcgacggcgggggagctaagaggcgtaccgtgtacgccgttaaatgtctagatttagtactgatgtgcgtcggccatcatgattatgaggtggccgagataacgtttaacctttggcatatgctaagcgaggaattatatcagaaaaataacaaggaattaacggaattgttcaaaccgtatgtggaaagattgatcacggccttatgtaggcattgccagatggagccggacatggagggtctactcgaaaaaggagacgaatttaaagattttaggatgaaagtttcggatctaataaaggacgtcgtctttatagtaggtagcagcagttgcttcaggcaaatgttcatcaatttacaaaccactggtgtaacgtgggacgccagcgaagccgctctctttgtaatgcaggccgtagccaaaaacgttcttccaactgaaaacgaagtcgttcccaaagtggtcgaagccatactgaacatacccaacagcgcgcacgtggcggtgaagtacacctccgtccttctactgggcgaattggccgaatggatagaaaaacacccggacgctctcgatcccgtcctgaatttcctagtgtgctgtctacgcggcggcagcggcgccgaagggggaggcgtcgcgacggcggcatccgcggcgctgcagaacgtgtgcacgtgctgcggcgcccacatgggcaggcacgtgcccattctgttacagttacttcaacagtcggatacgttcggcatcggcaacacggcggtggtgggattgctgaagggcgtcgcgtcggtggtgagttgcggcatgggcggcggcgccgagacggcctccgccgtccgggaattgtgttcgatgcaattgtcgccgctgtgcagtttgatggagaacgacgttcggccggtgaaagggaccctgacggatccggtgctgtggttggatcgattgagttcggttttgcgatacgttaacgtcaatatagtcgaaggcgaaatccatccttgcaagccggtaatattggagatatggccgatactgtcccgagcattcgacacctaccacagcgacgtgcgaataatggaaaggtgctgtcgttcggtgcgtttcatgttgcgctgcgtggcccgccagctgcaggatttgctgccctctttggtcgggcaaatcgtgcacatttactgtcgctacgggcattcgtgttgcttgtacgtgggcagcatcttggtggacgagtacgccggcgacgcgacttgcgtgcaaggtctgctcgacatgttgaacgcctttttggagccgacgtttcgcttgttgcaagaggagaacggcttgaagaaccatccggataccgtggacgatttctttaggttatgcgctcgattcgtacagagggcgcctaaggcgtttctaagcggcggggcccatctggcgcccattatgcaatgtgctcttctcgccgccaccttagatcacaaggaggccaacgtgtcggttatgaagtttttctacgatttgataaaccagggattgagcggtagaggtgagcccgacttcgacgagagaaaagccttagttagaagcctactaaacgaatacggtcaacaactggtgtctaatttaattcactcgtgcgtattttacttgcattcgtacatgttgagcgaagtgggtgacgtttttgtacaattgttggatttcgatagacagatcacgagtgaatggttagcgaacggtttggaattattgcccaaacaacaaaatggtggaataatggcggctaagcctaagcaattaaatgatgttcatgcttctataacgagatcaaacagttcgaaatctgtgacgcacgccctcaaagacctaactaggctatatcgttaa

SEQ ID NO: 915 - DNA, 1509 bp, Phyllotreta atra
atggcgcaacgttttcccggcccggtgtcgaatcaagtcccagggggaccgccgccgcctcaaaggtaccaacaacagccgcctaatcaaggaatgaggcaatacggccaacagagtttccctcctaggcccggctacaaccctccacccccaaatatgcagtctagcggaggcactatgatacaaagacctcctggggcaccgtattcgccgatgcgtggggggcccatgccaccgcagccagtgggtaagaggccttcggataacaggaacccgttacaacagaagaacagcgactatagtcatggcactagtaagaaaaaaaagaaactcgccgataaaattctaccccaaaaagtaagagatttggtgccagaaagccaagcctacatggacctgttagctttcgaacgtaaactggattccaccattatgcgaaagcgattagacatccaagaagccctaaagcgccccatgaagcaaaaaagaaaactgcgaatcttcatttctaacaccttctacccagcgaaagaaccccaacccgaaggccccgacggcccttgccaagaaggcacagtagcctcatgggaactgagagtcgaaggcagacttctggaagattccaagaacgatccgaacaaagtaaaacgcaaattctcctcgttcttcaagtctttggtcatcgagctcgacaaagaactatacggacccgacaaccacttggtcgagtggcacagaaccttaaccacccaagaaaccgatgggttccaggtgaagagacccggagacaagaacgtgagatgcacgattctcctactcctcgactaccaacctctgcaattcaagctcgatccgagactggcccgattgcttggcgtacacacgcaaacaaggccagtgattatatcggctctgtggcagtatattaaaacccaccggctacaagacggccatgaacgcgagtacatcatttgcgacaagtatttagagcagatttttaactgtactcgcatgaagttcgctgaaatcccccaacgattgaaccccctgctacacccacctgatccaatcgttataaaccacgtcatatccgttgaagggggcgctgagagcaaacaaacagcttgctatgatatagatgtggaagttgacgacactctgaagactcaaatgaataatttcttgctgagtacagcgagtcagcaggagattcaagggttagatgcgaagattcacgagacagtggatacgataaaccagttgaaaaccaacagggagtttttcctgagcttcgcgaaggatccgcagcagtttatacataagtggatcgtgtctcagacgagggatctgaagagtatgacggatgtggtggggaatcccgaggaggagaggcgatcagatttcttctatcagccgtgggcgcaggaggctgtgtgccggtacttctacacgaaggtgcagcagaagagggccgagttggagcaggccctcggtattcgtaataattag

SEQ ID NO: 916 - DNA, 435 bp, Phyllotreta atra
atgcctaaagtacgacgaagtaagaaaccaccgccagagggttgggaacttatcgagcccacattggatgaattagaacaaaaaatgagagaggccgagaccgaatcccacgaaggaaaacgaaagaacgaatctctgtggcccatattcaaaattcaccaccaaaaatcccgatacatcttcgacctcttttacagaagaaaggcaatcagccgcgaactgtacgaatattgcttactggaaaacatcgctgacaagaatttaatcgcaaaatggaagaaacaaggctacgagagcctttgttgcctgagatgcatccaagcaagagacaccaatttcggaacgaactgcatctgcagggtccccaaatctaagctggaagaaggaaggattgtcgaatgtgtacattgcggttgcagaggatgttccggataa

SEQ ID NO: 917 - DNA, 885 bp, Phyllotreta atra
atgccagcagctactctgggtagcatttcacatcctaacaacgaagactgcggcattcgggacgtttgggcccacaatttagaagatgaatttcgaactataaggcaaatagtgcagaaataccaatatgtcgccatggacactgaatttcccggagtcgtggccaggcccataggtgaattccgaagttcggccgattaccaataccaaatgttaaggtgcaacgtagacttactgagaatcattcaactaggtttaacgttcttagatgataatggtaaaacaccaggaggtgtttataccacctggcagttcaattttaaattcaaccttcaagaagacatgtatgcacaagatagcatcgatttactgcaaaattcaggaatccaattcaagaagcacgaagatgaaggtatcgagccgttggagttcgccgaattgctaatgtcgtctggaatcgttctcatggaaaatatcaaatggttatcgtttcattccggctacgatttcggctatttaataaagttactaaccgacaacaatctcccacaagatgaaactgaattcttcgatctgttgaaattgtattttcctacgatatacgacgtgaagtatttaatgaaatcgtgtaaaaatttaaaaggtggtcttcaagaagttgccgaacagttagaattggaaaggattgggcctcaacatcaagctggatcggactcgcttttgaccggaatggcctttttcaaaatgaaagagatgttttttgaggatactattgacgattcgaagttttcggggcacctttacggactcggcacgtctttcacagttaatggtacaactaacaattacggaaacgataacggcgacacaacaaattcctcatga

SEQ ID NO: 918 - DNA, 1212 bp, Phyllotreta atra
atggcggaagctcagaaaaggggcgcctcggtgttcgaggacctctcgaacgtcgaattcgagaccagcgagaacttagacgtgatcgaaaagttcaaagacatgaagctgaaggaggaactgcttcgcggcatcttcgcatatggtttcgagaagccttcggctattcagcaaagagctattattcctgtgatgaaaggccgagatgttatagcccaagcacagtcaggtaccggtaaaaccgctacattctccatagctattctacaagccctggatttaacgatgagagaaacgcaggtgttgtgtttatccccaacgagagaattggctgtacagattcaaaaagttatattagctctgggcgatttcatgaacgtacaatgtcatgcttgcatcgggggtaccaaccttggagaagacattagaaagttggattatggacagcacgttgttagtggtacacctggaagagtttacgacatgattcgtagacgagctctgagaaccagatcagtgagaatgctagtcctggatgaagccgacgaaatgctaaacaaaggcttcaaagaacaaatctacgatgtgtacagattccttccaccgtccactcaagtggttctcatatctgctacgttaccccacgaaatcttggagataacgtccaaattcatgaccgatcccatcaggattctagtcaaacgtgatgaactgacgctggagggaatcaagcagtttttcgtggccgtggagagggaagaatggaaattcgacaccctatgcgatctgtacgacaccttaaccatcacgcaagccgtaatattctgcaacacgaagagaaaggtggattggttaaccgaaaagatgcgagagaataacttcaccgtgagttccatgcatggagacatgcctcagaaggagcgtgacaacattatgaaagaattcagatcaggacagagtagagttttgatcactactgacgtatgggctagaggtatcgatgtgcaacaagtatcgttggttatcaattacgatttgccaaataatcgtgagttgtatattcatcgaatcggtcgatctggaaggtttggaaggaagggtgttgctatcaatttcgttaaatccgatgatatcaggattttgagggatattgaacaatattattcgacgcagattgatgaaatgcctatgaatgtggccgatttaatttaa

SEQ ID NO: 919 - DNA, 1602 bp, Phyllotreta atra
atgaccgctcctgctgccggtggagatgcaagaggaagaactcttgcctacaaagacaaaagcaaacccgccgatgtccgaactagcaacattaacgccgctaaggctgtttgcgatgcaattcgtactagtttggggcccagaggaatggataaaatgatacaagctggtaacggagaagtaactatcactaacgatggagcaaccattttaaaacaaatcaacgttatccatcctgcagcaaaaatgttggtggaactgtcaagagctcaagatatcgaagccggtgatggtacgacttccgttgtggttattgccggagcccttttagacgctgcggagaagttgctacaaagaggaatccacccgacggctatttcggaatctttccagagggccgcccatttggctgtcgagattctacaagaaatttcaacacccgtagaaatcactaacagggagttattaatcaaaagtgcatccacttcgttgaattctaaagtcgtatctcaacagtcgagtctcttaggtcctttggcagtcgatgctgttcttaaaattgttgaaccagggcaagaacaagcatgtaacttattggacgtcaaagtgattaaacaattgggtggtactgtagaagataccgagttgattgagggtatcgttttctcgcagaaatctgctaacgtatctggccccaagagaatcgaaaaggctaagattggtttaatccaattctgcatttctcctccgaaaaccgacatggaccacaatgttattgtatcagattatgctgccatggatcgagttttgaaggaagaaagagcttacattttgaacattgttaaacagatcaagaaagccggttgtaacgtacttttggttcagaaatcgattctcagagatgctgtctccgatctggcccttcactttttggataaaataaagtgcatggttgtcaaggatattgagcgagaagatgtagaattcgtatgcaaatcgttgggttgtcggccaatcgcatcactcgatcatttcaccgcagagaatctagtaactgctgatttggtcgaagaagttggagtaggcggtaaccgaatggtgaaaataacaggtattcaaaacgccgggcgtactgttaccctgcttgtgagaggctcgaataaactagtattagaggaggctgagaggtctctgcacgacgctctttgcgtcattcgttgtcttgttcgcaagaaggcgctgatcgcaggtggcggggcaccggaaattgaagtcgctcttaagctggctgctatggctaataagttggagggcattgatgctatttgcaccagagcttacgctactgctttggaaatcataccgtttactttggcggaaaatgctggattgaatcctatacagacagttactgaactgaggaacagacatgctaaaggtgaaacttcagctggtattaatgttcgtaagggaaccattacggacattttggaagagaatgttgtacaaccgctgttagttagcacatctgctttgagctttgccaccgaaaccgtcagatccatattaaaaattgatgatattgtgaacacaataacataa

SEQ ID NO: 920 - DNA, 1230 bp, Phyllotreta atra
atggaggctatggagattgtaataccagagaaagaggaaggcagccctgccgaagtcaagcaaggccggcaagagctagacatggaggatttgtacacgaaatacaagaaactacaacaaaccctggaattcctagaagtccaggaggagtacatcaaagacgagcagaggaacttgaaaaaggagtacctgcacgcacaagaagaagtcaaacgtatccaatcagtaccgctggtcatcggccaatttttagaagcggtagatcagaataccggcatcgttggctcaactaccggctcgaattactacgttcgcattctctccaccatcgacagggagctactgaaaccctctgccagcgtagccctgcacaagcacagcaacgctttggtggacgtgttaccccccgaagccgattcctccattagcatgctccaagccgacgagaaaccggacgtgcaatacagcgacatcggaggtatggatatgcaaaagcaggagattcgcgaggccgtggagctgccgttgacccacttcgagctgtacaaacaaatcggtatagacccgccgaggggcgtgctgatgtacgggccccccggctgcggcaaaaccatgctggctaaagctgtagctcatcacaccacagccgctttcattcgagtggtgggttcggagttcgtgcagaagtacctgggcgaggggcctaggatggttagagatgtgtttcgtttagctaaggagaattcgccggctattatattcatcgatgaaatcgatgcgatagctactaagagattcgatgctcagaccggagccgatcgggaggtgcagaggatcctgttggaattgttgaatcaaatggacgggttcgatcaaaccaccaacgtgaaggtaataatggctacgaatcgagctgatacgttggatcctgctctgcttaggccgggtcgtttggataggaaaatcgaattcccgttgcccgatagaaggcaaaagcggttgatttttagtactatcacttcgaaaatgaatctatccgaagaggttgatttggaggattacgttgccaggcctgatagaatatccggggcggatattaatgccatttgccaggaagcggggatgcatgctgtaagggagaatcgttacatcgtgttgccgcaagatttcgaaaagggttacaagaattatatcaagaacgatgaaagcgagcatgagttttaccaataa

SEQ ID NO: 921 - DNA, 489 bp, Phyllotreta atra
atgccaaatataaagctgcaatcttcggacggcgagaccttcgaaatcgacgtcgaaatcgccaagtgctcggtgacgataaaaaccatgctggaggacctcggcatggacgaggaagaggaggaagtggtgccgttgcccaacgtaaactcagccattctacggaaggtcatccaatgggccacctaccacaaagacgacccacccccgcccgaagacgacgacaacaaggagaagcgaacggacgacatatcctcgtgggacgcggatttcttgaaagtcgatcaaggaacgctgttcgaactgatcctagccgcgaactatctcgatataaaaggcttgctcgatgttacttgtaagactgtggccaacatgataaagggcaaagcgccggaggagatacgtaaaacgtttaacatcaaaaacgatttcacgccgtccgaggaagagcaagtgcgcaaggagaacgaatggtgcgaggagaaatag

SEQ ID NO: 922 - DNA, 930 bp, Phyllotreta atra
atggacgataaggcttcatgtaaggaactagatcaatggatagaacagttaaatgactgtaagcaattaaccgaaaaccaagtgaaaactctgtgtgataaggcgaaagaaatactgtccaaagaatcaaatgtgcaggaggtaaaatgtcctgtcaccgtctgcggagatgtgcacgggcaatttcacgatctgatggaattatttaggataggtggccgaagtccagatacgaattacctttttatgggtgactatgtcgaccgtgggtattattccgtcgagactgttactcttttggtggctttgaaagtcaggtataaagaaagaatcacgatcctgaggggaaaccatgaatcaagacaaatcactcaagtatatggattctacgacgagtgcctgcgaaaatacggaaacgcgaacgtttggaaattcttcaccgatctgttcgattacttgccgcttacggcgctcgtcgatagtcaaatattctgtttgcacggagggctcagtcctagcatcgataccttggaccatattagagccttagatcgtttacaagaggttcctcacgaaggcccgatgtgcgatctgctctggtcggatcccgacgatcgcggaggttggggcatttctcctcgcggcgcaggatatacctttggacaggatatatcggaaacgttcaaccacagcaacggtttgacgctggtctctcgggcccatcagctcgtcatggaggggtacaattggtgccacgacagaaacgttgtaacaatcttcagtgctccgaactactgctatagatgtggtaatcaagctgccattatggaattagatgatgcgcttaaatattcattcttacaatttgatccagcaccgagacgtggtgagcctcacgttacccgcagaactccggattatttcctttaa

SEQ ID NO: 923 - DNA, 1602 bp, Phyllotreta atra
atgcaaatattcgttaaaactcttactggtaaaactataaccctcgaagttgaaccatctgatactatcgagaacgttaaggctaaaatccaagacaaagaggggattcctccagatcagcaacgtctaatcttcgccggaaagcaactggaagacggaagaaccttgtccgactacaacattcagaaagagtccacactgcatttagttcttcgtctacgtggaggaatgcaaatattcgtcaaaactcttactggtaaaactataaccctcgaagttgaaccatctgatactatcgagaacgttaaggcgaaaatccaagacaaagaggggattcctccagatcagcaacgtttaatcttcgccggtaaacaactggaagatggaagaaccttatccgactacaatattcaaaaagaatctactctacatttagtacttcgtctccgtggagggatgcaaatattcgttaaaactcttactggtaaaactataaccctcgaagttgaaccatctgatactattgagaacgtgaaggccaaaatccaagacaaagaggggatcccaccagatcagcaacgtctaatcttcgccggtaaacaactggaagatggaagaacattgtctgactacaacattcagaaagagtccacattgcatttagttcttcgtctacgtggaggaatgcaaatattcgttaaaactcttactggtaaaactataaccctcgaagttgaaccatctgattctattgagaacgttaaggccaaaatccaagacaaagagggaatcccgccagatcagcaacgtctaatcttcgccggtaaacaactggaagatggcagaacattgtctgactacaatattcaaaaagagtccacactgcatttagttcttcgtctacgtggaggaatgcaaatattcgttaaaactcttactggtaaaacaattactcttgaagttgaaccgtctgatactatcgaaaatgttaaggccaaaatccaagacaaagagggtattcctccagatcaacaacgtttaatcttcgctggcaaacaactggaagacggaagaaccttgtctgactacaacattcagaaagagtccactctgcatttagttcttcgtctacgtggaggaatgcaaatattcgtcaaaactcttactggtaaaacaattactcttgaagttgagccgtctgatactatcgagaacgttaaggccaaaatccaagacaaagaaggaattcctccagatcaacaacgtttgatctttgccggcaagcaactggaagatggaagaaccttgtccgactacaacattcagaaagagtccacactgcatttagttcttcgtctacgtggagggatgcaaatattcgttaaaactcttactggtaaaactatcactcttgaagttgaatcatctgatactatcgaaaatgttaaagccaaaatccaagacaaagagggtattcctccagatcaacaacgtttaatcttcgctggaaagcaactggaagacggaagaaccttatctgactacaatattcaaaaagaatctactctacatttagtacttcgtctccgtggagggatgtga

SEQ ID NO: 924 - DNA, 1623 bp, Phyllotreta atra
atgatgcaaccacagatattactcctcaaagaaggcactgattcgtcgcagggcaagccccagttgatatctaacataaatgcgtgccagagtatagtggacgctatacgcacaactctgggccccaggggcatggacaaactgatagtttccaacagaggctcggccaccatctcaaacgacggagcgacaatactaaatctactagacgtagtgcacccagcagcgaaaactctagttgacatagcgaagtcacaagacgccgaagtaggcgatggcacgacctcagtcgtgctgttagccggcgagtttctgaagcaactcaagtcctacatcgaagaaggcgtccacccgaggatcatcatcagagccgtgcggaaggccacccagatctgcttggagaagatcaacgcgctggccgtcaaaatcgacaaatccaacgccgaggaatacagatcgttgctggacaaatgcgccgccaccgcgatgagctcgaagctgatcaacaaacagaaatcgttcttctccaaaatggtagtcgacgccgtgttgctcctcgatgagctcctgccgttgaacatgatcggtataaagaaggtccaaggcggcggtttggaggaatccatgctggtggctggagtggccttcaagaaaaccttctcgtacgccgggttcgaaatgcagcccaagatctacaaagactgcaagatcgccctgttgaacatcgaattagaactgaaagcggagagggacaacgccgagatccgtttgagcagcgtcaaggaataccaaaaagtagtcgatgccgagtggaacatcctgtacaacaaactcgagaaaatctacgaatccggtgctaacgtcgtactatccaaactacccatcggcgacgttgccacgcagtacttcgccgacagggacatgttctgcgctggcagagtccaagaagaagacatgaagaggactttgaaagcctgcggtggctccgtgatgaccacagccaacgatttgaaagatgaagtgctaggtaaatgccagctgttcgaagagaaacaaataggaggcgaacggtacaacttcttcaaaggctgtcccaacgccaaaacctgcaccatcatcctacgaggtggagccgagcaattcttagaagaaaccgaaagatccctacacgatgctatcatgattgtacgcagaacaatcaaaaacgactcgatcgtagcaggcggtggagcaatagaaatggagctgtcgaaattacttagggattactctcgtactatcgccggtaaagaacaactcctgatcggagctatagcaaaagcgctagaaataatccctagacagctatgtgacaatgctggattcgatgctacaaatatactgaacaaactgcgacagaagcacgctcagggcaattcttggtacggagtggacgtcaacatggaagatattgcggataactacgaaacttgcgtgtgggaaccagccattataaaaattaacgctttaacagcggctgcggaggccacttgcttgatcttgtctgtggatgagacgatcaagaaccagaaatctgaagcgcccccgcaaatgggaggacgtggaatgggcagacccatgtaa

SEQ ID NO: 925 - DNA, 10845 bp, Phyllotreta atra
atgggggactccttagaagcctcggaaacggctcatgaaactcaaaatgtggcattagtggatttcactgcgttttcaaattttattttgaaagcggctactgtactgttgcccgaagatgatagccaagcggaaccggctaaccttatagcagctatagatgacaaaaccaatcaggaatgtataaagaaattcataagcgatccccaaattgtgatactgtatgtccaaaggaactcttcaaaagatgatgacaatgtccagcctcccgaaggagaagaagaaaaagaacctgttacttactacatcagcaatgaagtgcattattctaattcgaaaatgtccagtttggtgtgcatcaaaaggggtccggtgatagaagctgataaaagcattagagctcaggttcgcttgatgaacttcagcgaagggtccccttatgaaattctgcacgattatgtcagtagaaccgttgccccttacttcaaatcttacgtaaaagaatcaggtagagctgatcgtgatggtgataaaatggcgcctgcagttgaaaaaaccatcgccgaattagagatgggacttctgcatctgcaacaaaatatagatattccggaaataacgcttcaagtacatccgtacgttgccagccttataaagcaatgcgccgatgaaggaaggaagccgaaagtcgccgattttagtgacaaagtggacgactcgaactttctcaaccaacttcaacatggagtaaatcgttggatcaaagaaattcaaaaagtaacaaaattagacagagacccctcttctggcacagccctccaagaaattagtttttggctcaatctggaaagggcccttcaccgcatccaagaaaaacgcgaaagcatggaagtagctctaacattagacatcctcaagcacggtaaacgttttcacgccacagtatctttcgataccgatacagggctgaaacaagccatagctacagtcaacgattacaatccgctcatgaaggatttcccaattaacgatcttttggctgcgaccgagttggagcgaattcgcgccgctgttcagatgattttttcccatctaaggaaggtcagatctactaaatatcccatcacgaggtgcttaagactggtcgaagccatttcgagagatctgggcatgcagttattgaaagtattgggtacccgccgtttaatgcacattccattcgacgaattcgaaaaagtcatgacccaatgttttgaagtgttctcgatttgggatgacgaatacgagaaattacaaggactcctcagagatatcatgaagaagaaacgagacgaacatatgaaaatggtctggcgcatttcgccgcaacataaaaaactgcaaagccgaatggatcaaatgcgcaaatttcgcagacagcacgaacagctgcgtacggttatagtacgtgtattgagaccaagtgtaaaagagagcgcagtgcccgttgaaggaagtgatatcgaacctccaaaaccaacattttcccttgatgctgcagatgcaaatgctattgaggaagtaaatttggcgtatgagaacgtaaaagaagtcgactgtctcgacattactaaggaagggcaagatgcttgggatgctgctgtacaacgatacgaagagcggatcgatagagtcgaaaccaggatcaccgcacatcttcgcgatcaattgggaacggccaaaaacgccaatgagatgtttagaattttctcgcgttttaacgccctgttcgtcagacctcacattaggggagctataagggaataccaaacccatctaattcaaagagtgaaagacgatattgaagcactgcatgaaaaattcaaagttcaatatccgcaaagtaacagtgctaaaattagtaaagtgagagatttgccgcctgtagctggttctatagtctgggccaagcaaattgatcatcaactaacaacatatttgaggcgggttgaagatgtgctagggaaaggttgggagaaccacatcgaaggacagaaactcaaagccgacggagacagctttcgtttgaagctaaacacccaagaaatattcgatgattgggcgcgaaacgtgcagcaacgtaatctcggcgtgtctggaaggatatttaccatcgaagccgtgagatccaggagtggtcgcggtaacgttcttaaattgaaggtcaacttcctaccggagatcattacactggctaaggaagtgcgtaatttgaagtgcctgggattcagagtaccgttggccatagttaataaggctcatcaagcgaatcaactttatccattcgccatatcgctcatcgaaagcatccgaacctatgaaatgactttggagaagatcgaagacaaagccagcattattccgctcgtcgctggcatgcgaaaagaagtccaactagtcctagccgaaggaatacaactagtatgggaaagctacaaactggacctctacgtacagagactttcagacctagttgtgggtttccaagagcgagtcgaagagctggttttcgtcggcgagcaattagaagtagacgtcagatcgttggaaacgtgtccttactccgccaacaccttcgccgacatattatcgaagatccaacacgctgtcgacgatctatccctgaagcagttctcgaacctgcacatttgggtgttgcgattggacgaggaagtcgagaagaacctcgccaggcgactccaagcgggcgtcgaagcctggacggaagccttaagcggccagaagaaagaaatcgatcatagcatggacacggacgccccggcccaacccacccacaaacccggaggcgatccccaaatccaaaccatgatacacgaagtgcgaatcaccaatcaaaccatgtacttgtttccgagcatcgaagaggcccggttcctgattatgcagcaattgttcgcttggcaggcgatcgtgacgtgccagcaacgtcttcaaagcagccgctaccaagtgggcgtggataagccggtcgttgaaacttacaggaatattttgactagattaccggccggcgctcaaccgttgatcaacgcttacagtgctatttcttctaaaattaaagaggttcaaaattatgtaaatgaatggttaacttaccagtctctgtgggatctgcaagctgataatctttacgggaaactgggagaagatattagcaaatggatggaatgtctgaatgacataaagaaaactcgaactacattcgatacatcagacactcgccgcgaattcggccctatagtcatagacttcgctaaagtccagagcaaagtttctctcaagtacgactcttggcacaaagaaaccttaagcaaattcggaagcctcttgagcaacgaaatgacctccttccactctaacgtatccaaatccagatccgatctagaattgcaaagcatcgaggcagccagcacttcagacgctgtcagctttataacgtacgttcaacaattgaaacgaaacatgaaagcttgggagaagcaggtagacatctacaaagaaggtcagaggatcctggaacgccagcgattccagttcccaacgaactggttgcacgtggagaacttggagggcgaatggggagcattcaacgaaatcatcaagaggaaagattcgagcattcaaacccaagtcgctagtcttcagcaaaagattgtttcagaagacaaagcagtggaaagccgcaccaacgatttcttggtagactgggaaaggagcaagccggtggaaggccatcttagaccggacgacgccctctcgcagctacaactattcgagagtaaattttcgcgactcaaggaagaacgcgacaatgtcgctaaagctaaagaagctttggacttgcaagacccaggcggcataagcactagcgaagataaaatgcaagtcgtttacgaggaattgcaagatttgcgaggcgtttggtccgaattgtccagaatttggcagcaaatcgacgaaaccagagagaaaccttggctttccattcaaccgagaaaactcaggcaacaattggaccaactctcaacgcaactccgagaattaccggcccggctgagacaatacgcctcctacgaatacgtgaagaaaactcttcaaacctacaccaaagtcaacatgctaatagtggaattaaaatccgacgccctcaaggaacgccactggaagcaactcatgaagcaactgagagtcaactgggtcctctccgatttaacgctcggccaagtatgggacgtcaatctccaaaaaaacgaaatgatcgttaaagatgtcattctggtagcccaaggggaaatggccctcgaagagttcctgaagcaagtgcgagaatcctggcaaaactacgaactggacttgatcaattaccaaaacaagtgcaaactgatcagaggatgggacgatctcttcaacaaagtcaaagaacacatcaactccgtcgccgccatgaagctgtccccgtactacaaggtcttcgaagaggaagcatcgacttgggaagaaaaattaaatcgcatcaacgctttattcgatgtatggatagacgttcaaaggcgctgggtgtatttagaaggaatattctccggtagcgcggacatcaagacgctcctaccggtggaaacgtcgcgtttccagagcatcagctccgatttcttgggattgatgaagaaggtcagcaagagtccgatggtgatggatattgtaaatattctaggcgtacaacgcgtgctggaaagactcgccgatttattaggaaaaatccaaaaagcgttgggcgaatacttggaaagagaacgtacatctttccctcgattctacttcgtgggtgacgaagatctcctggaaatcatcggcaacagcaaaaacgtcgcgagattacaaaagcatttcaaaaaaatgttcgccggcgtagcttccatattattaaacgacaacaacactgttattaccggtatagcttcaagagaaggcgaagaagtggtattcaaaacgccagtttccaccgtagagcatccaaaaatcaacgaatggctgagtttggtcgaaaaagaaatgcgcgtcacattagcctcgaatctaacgcaagccgtacaagatattaaacaattcaaagatgaaatcgactcgaaatcctacatggaatgggtagacaaatatcaagcgcagattgtggtgttagctgcgcagattctctggagcgaagacgtcgaagctgcgctcgtcaaaatgaacagcgaacctcaaagaggcgtgttggaaaaagtcctgcaacaagtcgagaatactctcaacgtactagcggattccgttttgcaagagcaaccccagttgagaaggaagaaactggagcacttgatcaacgagtttgtgcacaaaagaactgtgaccaggaggctcatcgctaacggggtgtgcagcaacaaggcgttcgaatggctgtgcgaaatgaggttctacttcgatcccagacaaaccgaagttcttaaacaattaacgattcatatggcgaacgctaggttctactacggatttgaatacctcggcgtgcaagatagattagtgcaaactcctctaacggataggtgttacttgactatgacacaagctttggaagcccggctgggaggatctcctttcggacccgctggaactggtaagactgaatccgtcaaggcgctaggaaaccagctaggtcgtttcgtgctcgtgtttaattgcgacgagacgttcgacttccaagccatgggcagaatattcgtgggtttatgtcaagtgggcgcttggggttgtttcgacgaattcaacagattagaagaaagaatgttgtccgccgtttcgcaacaaatacaaactatacaggaagctttgaaatcccagatggaagctgccgccgaaggagtcgccaccggcagtataagcgtcgagctcgtgggaaaacaagtaaaagtgtcccctgatatggctatcttcattacgatgaatcctggctatgcgggtcgttcgaatttgccagataatttgaagaaattgttcagatcgttggccatgactacgcccgacagacaacttatcgccgaagtgatgctgttctctcaaggattcagacaggccgaaaaattggcttcgaaaattgtacccttctttagattatgcgatgaacaattgtccaatcaatctcattacgattttggtttgagagctttaaaatccgtactaatatcggcgggaaacgtaaaaagagatagaattcaaagaataaaagaaggtatgacccaacgaggcgaaactaacatagatgaagcaaacatagccgagaatttaccagagcaagaaatattaattcaatcagtttgtgagactatggtccccaaattagtcgctgaagatattccattgctgttcagcttgttgaatgacgtgtttcccaacgtacaatacaccagagccgaaatggaaggtcttaaggatgaaattagaaaagtgtgtaacgaagagtacctcgtctgcggagaaggcgacgaaaggggttcagcttggatggaaaaagtactacaattataccaaatttcgaatcttaaccacggtctcatgatggtcggcccgagcggttcgggtaaaagttcagcgtggcgagttctgctcaaagctctagaacgatttgaaggaacagaaggagttgcccatgtaattgatccgaaagcgatcagcaaagagactttatatggtgttttggatcccaataccagagaatggacagatggtctgttcacccatattctaagaaaaattatagacaacgtgagaggtgaaattaacaaacgccaatggattatcttcgatggtgacgtcgatcccgaatgggtggaaaatttgaactctgttctcgacgacaacaaattgttgactcttcccaacggagaacgtctttctctgccacctaacgttagagttatgtttgaggtacaagatttaaagtatgccactttagctacagtttcgcgttgtggcatggtgtggttctcagaagacgtattatccacagaaatgatattcgaaaattacattcttcgactgaggaacattccactcgaagaaagcgaagagggcttcggcaagaaatcggacatgaaagacgacatgttgtctccgacacttcaattgcaactcgacgttgtaaatctacttcaaccgtttttgggacccgatggccttgtagtacgctgtttggagtacgccatggaacaagaacacataatggacttcacgcgactcagagctctgagctccttgttctccatgctcaatcaagcagtgagaaatgtcttgcagtacaatcacatgcatcccgattttcctctgtctagcgaagccctcgacaaatacatacccaaatgtttgatatattcgatcttgtggagctttgccggcgatgcgaaactcaaagttagatcggaattgggcgatttcattagatccgtcaccactgtacccttaccgtccgatcgcaacttgcctattatcgattacgaagttactatcgaaggagaatggtcgctttggtctaacaaagtgccgcaaatcgaggttgaaactcacaaagtcgcctcacctgatatcgtggtgcctacgttggacacagttagacacgaatctttgctgtacacttggttggcggaacacaaaccgatagtattgtgcggtccacccggttctggtaaaacgatgaccttattctccgcattgagagctctaccagatatggaagtcgttggtttgaatttctcttcagcaacaactccggagttgctgttaaaaacctttgatcattactgtgaatacagaaaaacgccaaatggcgttatcctatcgccaatacagttaggcaaatggcttgtactcttctgcgacgaaatcaacctaccggacatggacaattacggcacccaacgcgtcatcatgtttctccgtcaaatagtggagcaaaaaggcttctaccgcgcttcagaccaaacctgggtgtcattggaacgcatacaattcgtaggcgcttgcaatcccccaacggaccccggacgaaaacccctctctcaccgtttcctcaggcacgtacccgtcgtttacgtggactacccaggcgaaacgtcgctcaaacaaatttacggcaccttcacgagagcaatgctgagactagccccgggactgaagggctacgcggaaccgttaactaactccatggtggagttctacttgtcctcgcaggataggttcactcaagacatgcaacctcactacgtgtactcccctcgtgaaatgacgagatgggtgagaggcatatgcgaagccatcagacctttagacaatctttccgtggaaggtttggtgagattgtgggcccacgaagcgcttcgactgttccaagacaggttagtggaagacaccgaaaggcgatggacgaacgaaaacatcgatgctgtcgctttgaagcatttcccatcggcggattgcgaaaaagccttagaacggcctattctatacagcaattggctatccaaggattacgtaccggtaggaagagagcaactaagagaatacgtcaaggctaggttgaaagtgttctacgaagaagaactggacgttcctttggtactcttcgatgaggtgctagatcacgttctcaggatcgacaggattttcagacaaccgcaaggtcatttgctcttgattggtgtgtctggagccgggaaaaccactctgtcgaggttcgtggcttggatgaacggattgtccatattccaaatcaaggttcacaacaaatataccgctgacgatttcgatgaagacttgagatcggttttgagaagaagcggatgcaaacacgaaaagatcgcgttcattttagacgagtctaatatgttggattcgagtttcttggaaagaatgaatactcttctagctaacggcgaggttcctggattattcgaaggagacgaatatacaactctaatgacacagtgcaaagaaggagcccaaagagaaggattaatgttggattcgaacgatgaactatacaagtggttcacgcagcaagttatgagaaatttgcacgtagtttttacgatgaatccttcaactgatggattgaaggacagggctgctacctctcctgctttattcaacagatgtgttttgaattggtttggagattggtccgatggagctcttttccaggtcggaaaagaatttacgaatcgtttggatctcgagaaacaaagttggaaatgtcccgatttcttccctgcttcttgcaacaacatttctgcttcgcccaatcacagagaagccgtcatcaatgcctgcgtatacgttcatcagacccttcataaggcgaacagcagattagtgaagagaggaagtcgaaccatggcgatcactcctaggcactacttggatttcattcaccatctcgtcaaattgtacaatgaaaagcggtccgatttagaggagcaacaactccatcttaacgtcggtttgaacaagatcgccgaaaccgtggaacaggtggaagagatgcaaaagagtttggctgtaaaatctcaagaattgcaagcgaaaaacgatgccgccaacgctaagctgagacaaatggtaaaggatcagcaagaagccgaaaagaagaaagttcaaagtcaagaaattcaacagcaactcgctcagcaaactgtgcacatcaagcagaagaaatctgaagtaatggccgatttggaacaagtagaaccggccgttatcgaagctcagcaagctgtaaaatccatcaaaaaacaacaattagtagaaatccgtaccatggcgaatcctccagctctagtaaaactggcgctagaatcaatttgcctgctattgggagagaacgccagcgactggaaatccattcgagccgtgattatgagagacaatttcatcaacagcgttgttaatttcaacaccgaagatatcagtgacgatgtcagagaaaaaatgaaaggccgctatttgagcaaccccgattaccagatcgacaaaatctatcacgccagtaacgcctgcggcccgctggtgaagtgggcgtgcgcccaagtcgagtacgccgacatgctgaagaaggtcgagccgctgcgagaagagttgcagtctctggaaacgcaagccgaaaccaaccagaagcgcggcgaagacgtcaaagttctcatcggccaactcgagcaaagtatcgcctcttacaaggaggaatacgcccagctgatcgcccaagctcaggccatcaaaaccgatttggagaacgtccaagctaaagttgaccgatcgatagcccttctcaaatcgctggtcatcgaaagggagagatgggaggccagcagcgagacgttcaggtcgcaaatgtctactatcatcggggacgttctgttatccgccgcgttcattgcatacggaggctactttgaccaacattaccgtcaaaatctcttcagcacttggtgtcaacatttaactctagctaacatccaatacagagccgacatcgctagaacggaatacctatcgaatcccgacgaaaggctcagatggcaagccaacgctttaccatcggacgatctgtgcacggaaaacgccatcatgctaaagagattcaacagatacccgctcatcatcgacccgtcgggtcaagccaccgaattcataatgaacgaattcaaagacaaaaagatcacgaagaccagcttcttggacgactccttcaggaagaacctggaa

SEQ ID NO: 926 - DNA, 2673 bp, Phyllotreta atra
atgagtcgtcagggccccagcaaacgttacgactcggattcggactccgatagcgtggacagcgcggaggaggcccgaaagcgggacttgcaggaacgagatgaatttgccaatcgtctcaaaaagcgggatgaggatcgtacgaggaacgtagtgcagaatttcgataaaagaacctacgaggaggcggcgaagcgcctgaagttggacaacgccggcagagataaggtgatatcggagcttcgaaagacctcgagatggaagtacctggagaagaggaaggacgacaagctgcaggaattggaggccgatattgtggatgatgagtacttgttcgaagaggaaatattaacggagagggaaaagaaggagcgccagcacaagaaggaattgttacagctagcccaggagcatgagaaggcgcgggaactggaacgcattcaacgctaccacatgccgagggacttgggtaaagattcgacagcggattacatcgaagtggacgaactggaaaaagtaccgcaatccgaacagaagaaatgggagaaagaccaaatggcttcggctgtcttcaaattcggggctaaagatgtcaagaaaaccgacgattacgaactactattagaagatcaaatcgatttcatacaagccttacaaatgcctggaagcagcgagaagaaagtaccggaactatccgacgtacaaaagaagaaactcaccatcgaagaaacgaaaaaaagcctaccgatttaccctttcagagacgatctaatccaagccgttaaagagtaccaagtgctgattataaaaggtgaaaccggttcgggaaaaaccacacaaataccgcagtacctccacgaagccggtttcactgctgatggtaaaaaaatcggttgcacccagcctagaagagtcgctgctatgtcagtagcagccagagtagcccaagaaatggacgtaaagctaggcaacgaagtcggatacgccatcagattcgaagattgcacatccgaacgaaccgttataaaatacatgaccgatggtactttacacagagagtttctatcagaaccggacttgcaatcctacagtgtgatgattatagacgaagctcacgaacgaacgcttcacactgatatattattcggtttggtgaaagacatagctagatttagaccagatttgaagctgttaatatccagtgctacgttagatgttaccaagttttcggaattcttcgacgatgctccggtgtaccaaatcccaggcaggagattcccagtggatatttactacacgaaagcccccgaagcagattacgtagacgcttgcgttgtttcaatactacaaatacatgtaactcaaccattgggcgatattttagtattcttgacgggtcaagatgaaatcgaaacttgccatgaactcctgcaggatcgagtaagatgtttgggttcaaaagttaaagaactgattatacttccgttgtatgcgaaccttccgagtgatctgcaagctaaaatattcgagcctactccaccgggggctagaaaggttatccttgctactaatatcgcagaaacttcactaacaatcgataatatcatctacgttattgatccaggttttgccaagcaaaaccacttcaattccagaaccggaatggagagtttgatggtggtgcctatatctaaagcttcggctaaccagcgagctggaagggctggaagagtagctgccggaaagtgctttaggttgtacacggcctggtcctataagcacgaattggaggaaactaccgttcctgagatacagagaatcaacttggggaacgctgtgttgatgttgaaggcgttggggattaacgatttggtgcatttcgattttctggatccaccaccgcacgagacgctggtgttggctttggagcagttgtacgctttaggggctttgaatcatcacggcgaattgactaaattgggaagaagaatggctgaattaccggtggatccgatgatggcgaaaatgatattggcatctgagaaatacaagtgttccgaagaaatagtcactataggagctatgttgtcagtaaatggggcaatattttacagaccgaaagataagattatccatgcggatacggctaggaagaacttcaatcacttggctggcgatcatttgagtcttctgaacgtttataatcaatggagagactccgattactcgttgcaatggtgttatgaaaacttcattcaacacagatcgatgaaacgagccagagacgtcagagaacaactagtcaacttaatgaccagagtagaaatcgaaatagtatccggaatcgatgaaaccgacaacgtccgcaaggctattacatctggatacttctatcatattgccaggttttccaaaggtggtagttacaaaacggtgaagcacaatcaaagcgttactatacacccgaacagtgctttgttcgaaacgttgccgcggtggattttgtaccacgagttagtgtttacgactaaggaattcatgaggcaagtcatcgaaatcgagagtaagtggctgttggaagtggcgccgcattactacaaggccaaggaattggaagattccaccaataagaaaatgcccaaaactgtcggaagaagtaaaatgactgattaa

SEQ ID NO: 927 - DNA, 1371 bp, Phyllotreta atra
atgaaggtagaagaggtgaaaagcacggtgaaaactcaacgaataagcgcccatactcacataaagggcttgggattagatgaagggggtttcgcaatcccttcggcggccggcctcgtcggtcaggagcaggctagagaggctgcaggagtcgtcgtggacatgataaggagcaagaaaatggctggtagggctgtccttctagccggtcctccaggtacgggtaaaacagccattgccctggcaattgcccaagaattgggcaacaaagtgccattttgccccatggtgggctctgaagtctacagcacggaaataaagaaaaccgaagtactcatggaaaatttcagacgagccatcgggcttagaattagagaaacgaaggaagtctacgaaggagaagtcagcgaactaactcctgtcgaaacagaaaacccagcaggaggttacggtaaaaccgtcagtcacgttgtaatcggtttgcggacggccaagggcagcaagcaattgaagctggatcccagcatatacgaggccctgcaaaaggagaaggtcgaggtgggagatgtcatttacatcgaggccaccagcggggctgtgaaacgacagggaaggtccgatgcttatgccacggaattcgatttggaagccgaggaatacgtgccccttccgaagggggatgtgcacaagaagaaggaagttgtacaggatgttactttacatgatttggacgctgctaatgcgaaaccgcagggtggtcaagacgtgttgtccatgatggggcaactgttaaaaccaaagaaaaccgaaataacagataaactcagaaaggaaatcaataaaattgttgacaaatacattgatcaaggtattgctgaattggtaccgggtgtattattcatcgacgaagttcatatgttggatatagaaacgtttacttatctccatagagctttggaaagcgccatagccccgattgttatttttgctactaatagaggtcgttgtcttattagaggaaccgatgatgtattttctccgcatggaattccattagatcttctagataggctgctgattatccgtacgattccttacaacaaatccgaaatggagcaaattattaaattgcgagcagttacggaaggtttggaaattgatcaggaagcaatctcaagtttgggagaagttgggacaaaggccactctgagatacgcagttcaactattaacaccgtcatttttaacggctaaaattaatggaaggagtaacattctgcaaagtgatgttgaagagattggttgtctattcctcgatgccaaatcttctgctaaaatacttaccgagcataaagataaatttatgacgtaa

SEQ ID NO: 928 - DNA, 1557 bp, Phyllotreta atra
atgacctcaataattaaagtacaagccttatccggcgccaaagatgaatctcccccttgttacctcttgcaggtcgacgacgttagaattctattagattgcggttgggatgaaaaatttgatatggaattcataaaagagcttaagaggcatgtacatacaatagatgcagtgttaatatcttacccggataactaccatttaggagctctgccttacgcagttggtaaattaggtttaaattgtccaatatacgccactataccagtgtacaaaatgggtcagatgtttatgtacgatctgtaccaatctcagtacaacatgaaagaattttgtatattttctctcgatgatgtcgatgccactttcgaaaaggttattcaattgaaatataatcaaacggttcccttaaaaggcaaaggatatggcataactgtgactcctctaccagccggtcatatgatcggaggaaccatatggaaggtaaataaagtaggcgaagaagatattgtatactgcaacgattttaatcacaaaaaagaaaggcatttgaacggttgcgaactgaagaaacttcaaaggccatcgttactcataacggatgcatttaacgctacatatcaacaggccagacgaagggcgagggatgaaaaattaatgactaatattctccagactttacgaaaccacgggaacgtccttatagccgtagacactgctggtagagtactggaattggctcacatgttagatcaactgtggaggaacaaggaatccggacttttggcttattcgttggcttttttgaacaacgttagttacaatgtcgtcgaatttgccaaatcacaaatagaatggatgagcgataatctaatgaggagtttcgaaggagccagaaacaatcccttccagttcaaatatttgcagctatgccacagtttaggggagttgagcaaagtgcccagtccgaaggtcgtactggctagttcgcctgatttggaaagtggattttctagggaactgtttttacaatggtgttctaatcctaataacagtattatattaactacaaggacctcaccaggaactttagccagggatttaatagacaatggaggaggaagaaccatagacttgatagtagagcgaagagttaaattggaaggccaagaactcgacgattatgaaaggcgacaaaggtctaaatatgacaaattagaagaagatgaagccgattccgattcggattccgatattgaaatgtcagtcacctctaaaggcaaacatgacattgttatcaaacaagaaggcaaaatatccacagggttttttaaagtcaccaaaaaaatgtaccccatgtatcctttcaaggaagataaaataaagtccgacgaatacggcgaaattgtgaaagcggaagattacaaattagcggaaatttcagccgaaggcgaagataacaaagagaacatagtgattaaaaaagaggaagaggaaataagtaagtattattcatttatgaacgatctaatcgttacactaattatttttagctga

SEQ ID NO: 929 - DNA, 2268 bp, Phyllotreta atra
atgcctccgttggaggtaacgggcaacaccaacaacgacgaatcggcgcccatcaacccagtggtgggcataatctaccctcccccggaggttagaaacatcgtcgacaaaaccgccagtttcgtggcgagaaacggccccgaattcgaagcccgcatcaggcagaacgaactcgggaaccccaaattcaacttcctcaatggcggcgatccctaccacgcctactaccaacacaaagtcaaagatttcagagaagggaaaggtcaagagcccactccgggtttgagccaagccgtagccaaattatcggtgagcgcctccgcgcagcaaaaacaacaggaaatattgaagcaagtcgagcagccgtttgtgccgaaagatcctccgtccgaattcgaattcatagccgatcccccttcgatttcggctttagatttggatatcgtgaagcttactgctcaatttgtagctcgaaacggtcgagctttcctcacacaattgatgaatagagaacaaaggaacttccagttcgatttcctgaggccgcagcattcgttgtttcaatatttcaccaagctgttggagcagtacactaaagtgctaatacccccgaagagcatggagcagaggctccgagacgaggccaaaagcgccaaagctgtcttagagcaagtcaagtacagggccgaatggttgcggtatcaagaacagcaaaaggccaaggaagaggagatactcgagagagaacgggtggcttacgcgcaaatagattggcacgatttcgtggtggtggaaacggtggattaccaaccgttcgaaattgggaatttcccgccgcctactacccccgaagaagtgggcgccaggatactcatacaggagcggatcgaagaaggcgaagacatcgagatgcagctggagagcgacgaagacgacgatacgaacgctgatgacggtttgagttcgatgcaggataagacgaagcgtaagggcggcgatgacaatcgcttgcaggacatggaagaggatacgtctgatgaggataatgatgatgatggcggtaaaacggggccgtcttcgtcgcttattcagccgcctttgccgcctatacccgataaagtgctggtgaagaaatatgatccgaaacaagccgtaaaagtctccagaccgacagtaggcgacgactacctagtatcccccatcacgggcgaaaaaatcccggccagcaaagtacaagaacacatgcgcataggcctgctggacccccgatgggtcgaacaacgggacaaacaaatgtccgataaaatgaaccaagacacggtgtacgcggccggtagcgccatcgacgcttcgctgaagttgctagccgaaagacgtacggatattttcggcgtgggcgacgaagaaacggctatcggcaagaaaatcggcgaagaggacgtgaggaaggacgaaaaggtgacgtgggacgggcacacgagcagcgtggaggcggccacgagggcggccagggccaacatcacgctggaggagcagatccatcagatacataaagtgaaggggctgttgcctgatgaggagaaggagaagatcgggccgaagaatatcggttcgaagaagattaatatacagagcgttattactacgaagccggcgaatcaagctgcgcagcaacccaaaccgccggtctcgatgatccaaaccggcgcccaaccaataattccaacgcaacccgcgatgctggccccgcaaccgtccatcatgatgatgccagcgccgcctatgcccaccattcgaccgccgccattgatgatgcccggaggcgtggcgatgggcggttatcccgtaggccccatgcccccggggcccggcatgaacatggcccccatgaagcaccccaacgaggggcccagcgaggacgagccgagcaacaagaagttgcgaaacgaggattcgttggtgcccgagaacgtgttcctgtccaggaatccgagtcaagtgtctatcaagatttcgataccggtgatgccggagaagagcgaatggcgattgaagggacagatggtgtcgtggacgttggctttgaccgagagcgtgtcgaatttgaaggctaaaatacaggaggaaactaacatgccgccggccaaacagaagttgttcttcgatggtatgttcttcaaggactcgaacacgttggcctactataatgtaacgcaaggagccgtcattcaattgcagatcaaagagagaggaggaaggaagaagtga

SEQ ID NO: 930 - DNA, 978 bp, Phyllotreta atra
atgccgagtacagaggttacaacgactaaggtgatagtgcacccgctggtgcttctcagcgtagtggaccatttcaatcggatgggcaaaatcggcaatcaaaagcgtgttgtcggtgttctactcggttgctggagggccaaaggagtcttagatgtgtccaacagtttcgcagtccctttcgatgaggacgacaaagacaaatctgtatggttcttggaccacgactacctggaaaacatgtacggcatgtttaagaaagtcaacgctagagaacgagtcgttggttggtaccacaccggtcctaaattacaccaaaacgacatcgctatcaacgaattagttcgaagatactgccccaattcagtcttggtgattatagatgcgaaacctaaagatctggggcttcctactgaagcataccaagcggtagaagaagtccacgatgatggctcacccacatctaaaacgtttgaacacgtcccgagcgaaataggcgcagaagaagctgaagaagtcggagtagaacatttactaagagatatcaaagacactacagtgggaactttatctcagaggattactaatcagttattaggccttaaagggttgcatttgcaattgaaagatataagagactatttgatgcaagtgtgcgataacaaactgcccatcaaccatcagatcatctatcaattgcaggatattttcaatttgttgcccgatataaatcaggatgcgttcaacaattcgttttacgttaaaaataacgatcaaatgcttgtagtttatttaggggctctcgttcgatctatcgtcgcattgcacaacctaatcaacaacaaactcaccaacagagacgcagaagaaggcaaaaaggaggagaaaaaggacaacaaggataaagatagcaaagacaaggataaggaaaaaacggacaaagagaaggaagcgaagaaggacgagaagaaaaaataa

SEQ ID NO: 931 - DNA, 1560 bp, Phyllotreta atra
atgctgaaaatgttgatggaccccatggggggcatcgtgatgaccaacgacggcaacgccattctgcgagagatcaccgtgcagcatcccgctgctaaaagtatgatagaaatagccagaacccaagacgaagaggtaggagacggtactacttctgtaatagtattagctggagaaatgttggccgctgccgaacagttcctcgaacagcaaattcaccctacgatcatcatccgacaatacaggcaggccctcgaagatatggtgcaatttctggaaggacccctaagcgtgcccttggatcgaaacgacaaaaacgccgtagcccaagtggtcaagggctgcataggaacgaaattcttgagcaagtggtcggatttggccgtcaatatcgctttagatgcggtgaataccgtcttattggaagagaatggtcgaacggaggtggatatcaaacggtacgccaaagtggaaaagattcccggcggttcggtggaggaatccaggattttgagaggcgtaatgttgaacaaagacgttacccatcctaaaatgaagcgacacattaagaatccgagaatcgtccttttggattgcgctttggaatacaagaagggagaatctcaaaccaacgttgaaattagcaccgaaactgattttaccaaactcctcgaattggaagaagagcacgtcaagcgccaatgcgacgagataatcgccctcaagccggacgtcgtgttcaccgaaaagggagtatccgatatagcccagcacttcctgctcaaggccggcatcaccgccatcaggcgcgtcagaaaatctgacaacaaccgaatcgccagagcctgtggcgccgtcatcgtcaacagaaccgaggaactccaggagtccgacgtcggcaccggagccggcgtattcgaaatcaagaaattcggcgacgagtacttctgtttcatcgacgaatgcaaaaatcctaaggcctgtacgatccttctgcgaggagccagcaaggatattctgaacgaaatcgagcgaaacctccaagatgccctgcaagtcgccaggaacatcgtgctgtcgccgcgtttggtgcccggcggcggggccattgaaatggccgtggcccaacggttgatgcaaaaggccacgcacgggccctaccgggcgctcgcccacgcgttggaaatcattccgagaacgttggcgcaaaattgcggcgccaataccatcagaacgttgacggcgctgagggccaagcacgccaaccacgctgaagccgacaaaccgtgcacttggggtatcgatggcgaaagcggggaattggtcgatatgaaaatcaaaggcttgtgggagccgttgtctgtgaaactgcaaacctacaaaacagccgttgagaccgccattctcctgttacgtatcgacgatattgtatcgggatccaaaaagaagggcgacaaggaggtcccgacgcccagtcaaatgcaacaacaggaaacccaaggaggcgactcgacatttggttttagtaatttattctcgtttctttcgttagttatttaa

SEQ ID NO: 932 - DNA, 702 bp, Phyllotreta atra
atgatgcaaactggaatacgtccctattatccagactattctacaattcccgttgaacgccagattaatccgtacgctgataatggaggaagcgtagtagcaattgcaggaaaagattttgtggttattggcgcagatacgcgtcttagttccggcttttccatttacacgaggaaccagaacaagctgtttcctctgtctgagacaactgttttaggatgttcaggttgttggtgcgatactttaacgttgactcgtattataaagtctcgtatgcaaatgtactatcaagagcacaacaagaacatgtctacaacagcggctgctcaaatgttgtcgaccatgttgtactataagcgatttttcccttattacatatcaaacattcttgttggattggataatgagggaaaaggttgcgtctacagctacgatcccgttgggcattgtgaaaaagctacctaccgagcaggtggttctgcaggagctttgcttcagcccttattggacaatcaaattgggcagaaaaatccacagaagccttcgcaagaagatcttactcaggaaaaagccatctctacactgaaggatgtcttcatttcggctgcagaaagggatatttacactggtgatagtgtgcttattaaaatcattacaaaagatggaatgaaagaagaaacgtttgaattgagaaaagattag

SEQ ID NO: 933 - DNA, 900 bp, Phyllotreta atra
atgttccaattcggcttcaacatgttcccggacatcccgaggcccttcaacatgacctacaagtgctactcggtggccatgttcccgggaaacgaaagacaggacgtcgaacgtggtggaaaaataatcatgccaccttcggcactggaacagcttactcgattaaacattaactaccccatgttgtttaaactagttaataagaaaacaaatcgtacgactcattgtggcgtattggagttcgtagcggacgaaggaaaggtctacctaccattatggatgatgcacaatttggtactaaccgaaggcgatttggtgcaaatggaaagcgtctcgttgccagtgggaacgttttccaaattccaaccgttgaatccggatttcctcgacataaccaacccgaaagccgtactggagaattgcttgcggtcttttgcttgtctgaccaccggcgacgtaatagctgtgaggtacaatcaaaaggcctacgaattgtgcgtattggaaaccaagcctggtaacgccatcagtataatcgaatgcgatatgaacgtggaattcgccgctcctgttggctacaaggaacccgaacaagctaaaaaagaagaagaaatgtctgtggatcccgcagacttgatgcccgaaccgtcgggattcgtggcttttaggggggctggtgttcgattggatgggaaaaaacgcaaagattcttcatctaatgacactccttcggttaaaccggtttacgttaggggaattcccgactacgattatcaaattggcactctagatttcatcaggcgtaccgtggcgaagcctaaagagaaggagaatagtgaagatggggacgatttcaaggcttttagtggtactgggttcagtttgagaagtaggaattag

SEQ ID NO: 934 - DNA, 1623 bp, Phyllotreta atra
atgtcggccttaccaggagctatcgctttcgacgaatatgggagaccatttataattctaagagaccaagacaagcaaaaacgattgaccggaatcgatgccctgaagtcgcacattttagccgcaagtcaaattgctcacactgttcgcacctctttggggcccaaaggcttggacaagatgatggtctcctctgatggggaagtcactgtaacgaacgatggggctactattttgaagatgatggatgttgaacatgaagtagctaaattgttagttcaactatctcaatcacaggatgatgaaataggagacggaaccactggtgtagtagtattagcgggggctcttctggaacaagccggcgccctcctggaccgtggaatccatccgataagaatagctgatggtttcgaattggcatgccaaacggcagtggatcatttggagaaaatcgccgaactgtttccagtttccgctgaaaacactgagccccttgtaaaagttgcgatgactacactgggttcgaaaataattaacaagtgtcacaggcaaatggccgaaattgccgtaaatggcgtgttagcagttgcggatctccaacaaaaggatgtcaactttgaactcattaaagtagaaggaaaggttggcggtaaattggaggacacgacattagtgaaaggtgtcgtcatagataaaacaatgtctcatccacaaatgccgaaggaacttaagaatgttaaattggccatcctcacctgtccgtttgaacctcccaaacccaagaccaagcataagttggacgtcaccagcgtcgaagactacaaagaactaagattgtacgagcaagaaaaattcaaggaaattgttggcttagtcaaaaaagctggagctaccttggctatttgccaatggggatttgacgatgaggccaaccatttgctgttgcagcaggagttacctgctataagatgggttggcggtccagaaatagaactaatagctattgcgaccggtggaagaatagtaccaagattcgaggaactcagccctgagaaacttggttctgccggtttggtacgtgaaatatcgtttggaactaccaaagataagatgatggtgattgaagaatgctcgaattcccgtgccgttaccattctcgtcagaggcggtaatcaaatgttggttgatgaagccaagaggagtttacacgatgctttgtgcgttgtgaggagcttgattcaggaaccaagagtcgtgtatggaggaggcgcagctgaaatagcttgcagtttagctgtggctgctcaagccgatcagttagcttctttggaacaatacgcttatcgtgcgtttgctgaggcattagaaagcattccgctggctctagctgagaattcgggtttctccgccattcatactttgggagaaatcaaggcaaagcaagctgcatctggggatccggcacttggcgtggattgcatgaatattggcaacataaacatgagagaacagcatgttacagaatctctgcgatctaagaggcaacaattgttgttggctacgcaattagtgaaaatgattctgaaaattgacgatgtacgtcagcccggctccggctaa

SEQ ID NO: 935 - DNA, 351 bp, Phyllotreta atra
atggcagcagcttcagctatggacgtggacgatgatgatgaggtcgaattgccaacatcgagtagcagcaaaggtgagaagaaacggttcgaggtgaagaagtggaacgctgttgccttgtgggcgtgggacattgtcgtcgacaactgtgccatctgtcgtaaccacatcatggatctttgcatcgaatgccaagccaatcaagctgccgccaccagtgaagaatgcacagtcgcctggggtgtgtgtaaccacgcttttcattttcactgcatttcccgatggctcaaaacgcgacaggtgtgtcctctcgataatcgggagtgggagttccagaagtatggtcactag

SEQ ID NO: 936 - DNA, 1605 bp, Phyllotreta atra
atggtgtcactaaacccggtgaggattctcaaacacgatgccgaggatgaaagggcggaaattgcgcgtttgagcagcttcgtcggcgcgattgccattggagatttggtcagaagtaccttggggcccaaaggtatggacaaaatcctcgtatcaagcggcagaaactccggaatggtagaagtgaccaacgacggagccactatattaaaatccgtgggtgtcgataaccccgctgcgaaaatcctcgtcaacatgtcgaaagtacaagacgacgaagtaggcgatggaactacgtcagtaaccgtattagcgtcagaattattaaaagaagctgaacgtctaatcgagcaaaagatccatccgcagactatcatagcgggttggagaaaagccgtggatatcgcgagaaaagcccttttggacgcttcgaccgacaacagcgccaacttggaagcgttccgagaagatctgatgaacatcgccaggacgaccttgagctcgaaaattctatcgcagcacaaagaacacttcgcgaagctcgccgtggacgccgtgctgagattgaagggctctggtgatttgcaagccattcaattgatcaaaaaaaccggaggaactttgcaagaatcgttccttgatgatggtttcctgctcgataagagacctggcgtacaccagcccaagcgagtcgagaacgctaagatcctgatcgccaacactccgatggacaccgataaaatcaaggtattcggctcgcacatcaaagtcgactcgatggctaaaatcgccgaattggaatccgccgagaaagataaaatgaaggacaaagtcaacaaaatcctcaagcacaacgccaacgtattcatcaaccggcaactcatctacaactatcccgaacaattgttcgcagatgccggtgtaatggccattgaacacgccgatttcgatgggatcgaaagactggcgctggtcaccggaggagaaatagtctcaactttcgatcacccggagctcgtgaaactgggaacttgcgatctgatcgaacaaatcatgataggagaagatactctcctgcgtttcagcggtgtggccttaggtgaagcctgcacgatagtcattcgaggagccacccagcaaatcatagacgaggcagatcgttcgctacacgatgccctgtgcgtactagccgctacagtgaaagaaagcagaatcgtattcggaggcggttgcagcgagactctaatggctacagctgtagccagagcatctgtaaatacagccggtaaggaagccctcgctatggacgccttcgctagagctctattacagctaccgaccatcatcgctgataatgccggttacgattcggctcaattgattagcgagctgaaagccgcccacaacagcggcctcaacaccatgggcttgaacatggagaagggcgagttgggcgacatgcgagcattgggcattaccgaatcgttcgttgttaaacggcaagtattgatatcggccggcgaagcagccgagatgattcttcgcgttgataatatcatcaaggcggcgcccagacagcgaaccgaagacagaggaatgtgttaa

SEQ ID NO: 937 - DNA, 843 bp, Phyllotreta atra
atgttccgaaaccaatacgacagcgacgtgaccgtctggagcccccagggccgcctccaccaagtcgagtacgccatggaagcggtgaacctcggttcagccacggtaggcctgaaaagcgccagtcacgccgtcataatagccctaaaacgggcctcgtccgaactatccgcttaccaaaagaagatcattcaaatcgacgatcacatcggcatcaccatctcgggcctaacggcggacgcgagaatcttgagcagatatatgcgcaacgaatgtttgaactacaagtactctttagacgcttacatgcctttgaatagattaattaacatcttaggtatcaaaatgcagcactgtactcaacgatacgatcgcagaccgttcggcgtgggtctgctagtagccggctgcgacgacaacggggcccacatataccaaacgtgcccctcggcgaatttctacaattgcaaggccatgtcgatcggggcgcggtcccaaagcgctcgcacctatctggagaagaagctcgacgagttgccgtcgtgttcgctggaagatttgatcaagcacggcttgagggctctaagagacactctgccgccggaggtggatttgaatacgaagaacgtgtcgatcggttacgtgggcaaagggattacgtttaagatattggaggaggaggagacggctccctatttggctttgatcgagggcgaggagcgtagaggaggcgctggtggtggcggcggtagttccgaaggacaggccgatcctttgagggaatcgggggacgacgggcccaaggatcccgtgccggctgtagcgatggatactacggaataa

SEQ ID NO: 938 - DNA, 2544 bp, Phyllotreta atra
atggggttaaagccaggaaataaccaagaaccaatggaaataacattccacgacgatgatttgccctacgaggaagaaattctacgaaacccctactcggtgaagcactggctgcgatatatagaccacaagaaaacggctccgaacaacgaaatgaacataatattcgaaagggccctcaaggagctaccgggttcgtacaaattgtggtacaattacctacgaacccgaaggaatcaaatcaaaagcaaatgcatcaccgatccgggcttcgaagaagtaaataatgccttcgagcgttcgttggtgttcatgcacaagatgcctcgaatttggatggactattgcacgtttctcacagatcaatgcaaaataacgagaacacgaaaggtgtttgacagggctctgcgagccctgcctgttacgcagcacaacaggatatggcctttgtatctgaagttcgtgcagaaacacgatatatcagaaactgctgttcgagtattcagaaggtacatgaaattgtgtcccgaaaacgccgaagaatacatagattacttaacaaaagtagaaagattagacgaagccgctataattacagctaaaatagtaaacgacgataacttcgtatcgcaacagggcaaatcgaagcatcaactatggaacgaactgtgcgaattgatttccaaaaaccccgaaaaagttcgctctctaaacgtcgacgccatcatcagaggcggcctgcgcagatacaccgaccaattgggccacttgtggaactctttggccaattactacgttcgcagcggcttgttcgaacgggctagagacatctacgaagaggccatacaaaccgttacaaccgttagagatttcacacaagtgtttgatgcttatgcgcaattcgaagagttaagtttgagcaaacgaatggaagaagtggccactaagcagaaccccagcgaagatgatgataccgaattggaactgcggttagctcggttcgaatatcttatggaaaggcgattgttgctgttaaattcagtattgctaaggcaaaacccgcacaatgtgcaagagtggcacaaacgtgtacaactttacgaaggtaaaccacacgaaatcatcaatacctacaccgaagctgtgcaaactgtggatccaaaactggctgtaggaaagctgcatacgttgtgggttgaatttgccaagttctacgaaagcaacgatcaaatcgaagaggccagattgatattcgaaaaagcctcccaggtgccttacgtgaaagtcgacgatttggcaacagtgtggtgcgaatggaccgaaatggagattcgcaacgagaactacgacgaagctttgaagctcatgcaaagggctactgtaatgcctagccgtaaagtagcataccacgatgataccgaaacagttcaaagtagactgtacaagtcgcttaaagtgtggtcgatgtacgcagatttggaagaaagcttcggcagcttcaaatcctgcaaagccatctacgacaggatcatcgaactgaaaatcgccacgccgcaaatcatcatcaactacggtgtatttctcgaggaaaacaattacttcgaagaagccttcagagcctacgagaagggcatctcgttgttcagatggcccaatgtatacgacatatggaacacctatttaaccaagtttttgaaacgctacggcggcagtaaattggagagagctcgcgatttgtttgagcaatgtttagacggttgcccccctcaattcgccaaacatctctatctgttatacgccaaattggaggaggaacacggcatggccaggcatgcgatggctgtatacgaaagatcaacaaaagcagtaccagagaacgagatgtttgatattttcaatatttatattaaaagagccgctgagatatatggcataccgaaaactagacaaatctacgagaaggccatcgaggtacttccggaggacaagacaagggaaatgtgcttgagattcgccgatatggagacgaaattaggtgagatcgatcgagctagagccatctacgctcactgcagccaaatctgcgatccacgtgtaacagccgaattctggcaaatatggaaggagtttgaagttaggcacggtaatgaggacaccatgagggagatgttgaggatcaaacgcagtgtacaagctgtatacaacactcaggtgaatatgatgtccgctcagatgctgagctctgcaggtagctcgagcggtaccatagccgatttagctccgggggttaaggacggtatgaggctgttggaggccaaggcggccgagatggctggttcggtggcgcagaagcccaatattatgttcgttagaggggagactcaaggggataagaaggataaagtggtgaatcctgatgagattgatataggaagcgaggacgaggaggaagaggaggaggagatttcggtggagaagcaaaacgtgccatcggaggtgttcgggagtcttaagaagaagggagctgatgatgaggatgattaa

SEQ ID NO: 939 - DNA, 1113 bp, Phyllotreta atra
atggcaaacggaccgatagccgaaagaaacagagacgctacgatctacgtcggcggtttagacgacaaagtatcggaatctctgctatgggaactcttcgtgcaagcggggccgttagtgaacgtacatatgcccaaagatcgcgtcacgatgatgcaccagggctacggcttcgtcgaattcatgggcgaagaggacgccgattacgccataaaaataatgaacatgataaaattgtacgggaaacccatacgggtcaacaaggcgtccgctcaccagaagaatttggacgtcggagcgaacattttcataggcaatttggacccggaagtcgacgagaaactcttgtacgacacgttttcggcctttggcgtcatattacaaacgcccaagataatgagagatcccgagactggtaattccaaaggcttcgcgttcataaacttcgccagcttcgaggcctcggacgcttccatcgaggcgatgaacggccaatatctctgcaatcgacccatatccgtatcgtacgcgttcaaaaaggattccaaaggcgaacgacacggctcggcggccgagcgattgttggccgcacagaatccgctatcgcaggccgacaggccccatcaattgttcgcagacgcccctccgattggaatgatgccgatgagcatggcgccgccaccgccgcctctaatcaccggcatgatgcctcctcccccgccgacgccgggcggcatgccgccgcctccgccgccggtaccgccgcccagttcgttccccgccggtataccgccgccgccgctaccgccctctcaaccgccgttgccgcccggcgctccacccgccatggcagcggtgcagggcggcgcggccaggccgccgccgcctcctccgtggtcggcggcggcggccaacgtgccgatgccgcccggcccgcccgcttccaacgccggcggcggttttgggggaatgctgccgccaccgccgccgcctggcggcaggccgatgccgcctaattggaggccgccgccaccgccgccgaattttggcggtgccagaccgccgtttccgccgcgcgggccgcctccgccgccgcccaccttcgaagggtaa

SEQ ID NO: 940 - DNA, 774 bp, Phyllotreta atra
atgggtcgtgttattcgagcgcaacgtaaaggtgcgggatccgtattcaaatcccacaccaaaaggaggaaaggggcccccaagctccgttacttagatttctccgaaaggcatggctacatcaagggtgttgtgaaagacatcatccacgaccccggtcgcggcgcccccttggctctagtgcacttcagggacccctacaagttccaaactaggaaggaaatattcatcgctcccgagggcatgtacacagggcaattcttgtactgtggaaagaaagctaacctccaaattggaaatgtgttgcctgtaggaacgatgcctgaaggtacaatcgtctgtaatttggaagaaaagactggtgaccgtggccgattggctcgagcatccggtaactacgcaaccgtgattgcccacaatcacgatacaaagaaaactagagttaaattgccatcaggagctaagaaagttatccccagcaacaacagagctatggttggtatcgttgctggtggtggtcgtatcgacaagcccatcctgaaagccggtcgtgcctaccacaagtacaaggtgaagcgtaactgctggccgaaggtgcgtggtgttgccatgaaccccgtcgagcatcctcacggaggtggtaaccaccagcacattggtaaagcgtccacggttaagaggggaacgtccgctggtcgtaaggtgggtcttattgctgcgcgtaggaccggtcgtatcagaggaggtaaggtcgagactaagaaggacgattaa

SEQ ID NO: 941 - DNA, 411 bp, Phyllotreta atra
atggctcgtacgaagcaaacggctcgtaagtctaccggtggcaaggctccgcggaagcaacttgctacgaaggctgcgcgtaagtccgcaccggcgaccggcggtgtgaagaagcctcatcgctaccgtcctggtaccgtggctttacgcgagattcgtcgctaccaaaagtcgactgaactgcttattcgtaaggctccgttccagcgccttgttcgagagatcgctcaggacttcaagacggatttgcgtttccagtcgtcggccgtgtctgccttgcaggaggcatcggaagcatacttggtcggtctttttgaagacacgaacttgtgcgctatacatgccaagcgtgttaccataatgccgaaagacattcaactggctcgtcgtatccgcggcgagcgcgcttga

SEQ ID NO: 942 - DNA, 1593 bp, Phyllotreta atra
atggcaataagtttgttgaatccgaaagccgaagtggcgagagccgcccaagcgttggccgttaacataaccgcagccaaaggtatttcagaagtgatgaaaaccaatttgggacccaagggtaccatgaaaatgttggtgtccggtgccggcgacattaaaataaccaaagacggcaacgttctcctgcacgaaatgcaaatccaacatcccactgcttcgttaatagccagagcttcgacagcacaagatgatatgacaggagacggaacgacctctactgttttagtaatcggtgaactcctgaaacaagccgacatatacatcgcagaaggcctgcaccccagaacactcacagaaggcttcgacaaagcgagagcgaaggccctcgaagtattggagaagctgaaagtacccatcgaagtcaacaaagaatcgttaaccgatgtttgtcgaacgagcttgagaacaaaattgcatcaaaaattggctgatctccttactgatgtctgcgtcgaggccattctcgctatcaaacagtccgacaaaccggtcgatttgcacatggtggagctcatggagatgcagcacaagaccgagacggacactcaactggtcaaagggatagtgatggatcatggtgctcgacaccctgatatgccgaagagcttgaagaattgctacatccttacatgcaacgtgagcatggagtatgaaaagagcgaagttaattccggtttcttctacaaaaccgccgaagaaagggagaaattggtgttggccgagagagatttcatcgaacagcgagtcaagaaggtggtcgagttgaagaaggccctttgcaacggcacaaacaaatcgtttgtcgttataaaccaaaaaggtattgacccgatgagcttggacatgctggccaaagagggaatcgtggctctgcgaagggccaagagacgtaacatggaacgtttggctttggcatgcggtggaatagccgtgaacagtttcgacgatttacaggaatctcacctcggttacgccgggcatgtatacgagcacgtcctgggcgaaagcaaatatacgtttgttgaagattgcaaagttccccaatctgtgacgatcttaataaaaggacccaacaagcacactttgatgcagatcaaagacgccgttagagatggcttgagagctatcaataacgcaatcgatgacaaagcgcttatacccggtggtggtgctttggaagtggcagtaaacaaggaattactggcttacaaggacgaaatcaagggtaaatctcgcttgggcgtagccgcttacgccgaagctctgttggtcattcccaaaacgctggctgtaaactccggattcgatgcccaggataccatcgtgaagctgcaagaggaagctcgactgagcaccgaaccgatcggcctcgacttaacctcaggagagcccatcaatcccaaagatgccggcatctacgacaactacgtggtcaagaagcagattcttaactcgtgctcgataatcgccagcaacttgttgctcgtcgacgagattatgagggctggcatgagcagcttgaaaggataa

SEQ ID NO: 943 - DNA, 3126 bp, Phyllotreta atra
atgtctagtgctggaatcgcagacagccccatcgatcctccagcaaagaagcgaaagctcgactcgaaaaattgcagccccgacatggcgaacaacgaagcttcaggatcctcgaacgccggcgaaatcgacgagggactctactcgcggcagctgtacgtgttgggacacgatgccatgcgccgcatggccaccagtgatgtgctcgtatcgggtttgggcggtttgggtgtcgaaatagctaagaatgtgatcctaggcggcgtcaaatcagtgactctacatgacgatgccgtttgcaccgttcgagacttgtcgtcgcagttttacctcaccgaagccgatgtgggcaagaaccgcgccgaggcctgctgcaagcacctctccgaactcaacacctacgtccccaccagagcctacacgggccccctcgacgagaaggtcatccagaagtacagggtggtagttctgacgaacagcactcgagccgaacagctgcgtatcagcgagataacacacaacaacgatgtggctctaatcgtagctgatactaaaggtctgtttgcacaggtattctgcgacttcggcaaggccttctccgttgtggacatcaacggggaaccacccgtatccaccatgatagccgatatatccaacgatacggagagcgtagtaacttgcatagatgatactaggcacggtatggaagaaggagattacgttaccttctccgagattttaggcatgaccgaattgaacaactgcaagcccattaaaatcaaagttttggggccgtacacgttcagcatcggcgacaccactaaattctccaagtacgttcgagggggtatagtcactcaagttaaaatgcctaaagaagtgcactttaagccgttgaaagagtctttacagaatcccgaattcgtggtgaccgatttcgccaagttcgatcaccccattcaattgcatctcgctttctccaccctacacaagttcgtggagaagaccggtcgattgccgaaaccctggaacaaagacgacgccaccgagttcatcgctttggcgaaatcgttggccgtaaacggatctacggataccgaagtcaacaccgatatcctcaacattttctccaagtgttgctcaggcgatcttaaccccatcaatgctacgatcggaggtatcgtggcgcaagaggtcatgaaagcctgttcggggaaattctaccccatctaccaatggttgtacttcgatgccatcgaatgcctgccccaggacaaggaggagatcactgaggaactcgctgcccccgttgatagtagatacgatggacagatcgctgtgttcggaaaagacttccaaaagcgattaggtgaactgaaatatttcatcgttggtgccggagcgatcggttgcgagttgctgaagaacttcgccatgatgggaataggcacgcaaggcggtcaagtcaccgttaccgacatggatttgatcgaaaagtcgaatttgaataggcaatttttgttcaggccccacaacgtccagcaacccaaatccgctaccgctgctaaggtaattaagaagatgaatcccgacgttaacatagtggcccacgaaaaccgagtgggccccgaaactgaaaacgtctacaacgacgagttcttcgaggttttagacggggtagccaacgccctggataacgtagacgcgagaatatacatggacagacgttgcgtttactatcgcaagcctctcctagagtccggtacattgggaacgaaaggcaacactcaagtagtggtaccattcctctctgagtcctacagctcatcgcaggaccctcccgagaagagcataccgatttgcacgttgaagaatttccccaacgccatcgagcacactctgcaatgggccagggacaatttcgaggggctgttcaaacagaacgccgagaacgcttcgcagtacctcagagatccggatttcatcgaacgaaccgtcaagctgccgggcgtacagccgctggaagtgctggaatccgtcaaagctgctataatcgacgaaagaccaaaggattacgacgattgtctggcctgggcgcgtctgcattgggaggaccaatacgccaatcagatcaagcaactgttgttcaatttcccgccggatcaactcaccagtaccggccagctgttctggtctgggccgaagaggtgtccggaaccgctcgtattcgatatcaatgaagatttgcacgtggattacgttatagcagccgctaatttgaaggctcaagtttacggtattcccacgaataggaacagatgctacgccaaacaagtcgtcactagcatcgaggtaccggagtttgtgcccaaatcgggcgtgaaaatcgccgtgaccgactcgcagatggccatgaacggcaacaacgtcgacttggatcgcatcaatcaaatcaaacaggagctgccttcgatgcaggagctcagcgggctgacgctcacgccgctggaattcgaaaaggacgacgatagtaatttccacatggacttcatcgtggcggcctcgaatttgagggccgccaactacaagattcccatggccgatcgacacaaatctaagctcatcgctggtaaaatcatcccggctatagctacaactacatcggtggtggccggtttggttggtttggaattgtacaagctggctaggagcatcaagagtctaacgccgtttaagaatggttttgtgaatttggcgttgccgtttttcgggttctctgaaccgatcgcagcccccaaaatggagtactgcggcaaccagtggacgttgtgggatagattcgaggtgcaaggagaaatgaccctcgctgagtttctagagtatttcaaggagaagcacggtttggaaatcacgatgctgtcccaaggggtgtgcatgctgtattcgttcttcatgcccaaagccaaagctcaagaaagattaggattaacgatgtctgaagtggtgaggagagtgtcgaagaagaagattgagccgcacgttagagcattggtgtttgagttgtgctgcaatgatgctgatggagaggacgtggaggttccttacgttaaatacaacttgtattga

SEQ ID NO: 944 - DNA, 1221 bp, Phyllotreta atra
gcaaatgagaataattcaacagaagttcagaaaaaaggggttaaaggaacttatgtctctatacacagttcaggttttagagatttccttttaaaaccagaaatccttcgagctatagctgattgtggtttcgaacacccttcagaagtgcaacacgaatgcattccccaagcagtaatcggcatggacatcctctgccaagcgaaaagcggtatgggtaaaacggcggtcttcgtcctagccacactacagcaactcgaacccaccgaaaacgtcgtctacgtgctggtgatgtgccatacgcgcgaactggccttccaaatcagcaaagaatacgagcggttcagcaagtacatgtccaacatcaaagtcggcgtgttcttcggcgggctgcccatccaaaaagacgaagaagtattaaaaaacagctgtccgcacatcgtcgtcggaacgcccggccgcatcttggccctcgtcagatcgaagaaactcaatctcaagcacatcaaacactttattctcgacgaatgcgataaaatgttggagctacttgacatgagacgcgacgttcaagaaatatacagaaatacgccgcacgagaaacaagtaatgatgttcagtgcgacgctcagcaaagaaattcggccagtttgcaagaaattcatgcaagatcccatggaagtgtatgttgacgatgaagcgaaattgacgttacacggtctacaacaacattacgttaagcttaaagagaacgaaaagaataaaaaattatttgagttacttgatgtgttggagtttaatcaggtggtgatatttgttaaatcggtgcaaagatgtgtagcattggcgcaacttttgactgaacaaaatttccctgctattggaatacaccgaggaatggagcaaaaagagcgattatccagatacgaacaattcaaagatttccaaaagagaatattagtggctactaatctctttggtcgtggtatggatatcgagagagttaatatcgtttttaactacgacatgccggaagattcggacacttaccttcaccgagtggctagagctggtcgtttcggtacgaaaggtttggccattactttcgtttctgaagaaggagatgccaagattttgaacgaagtacaagacagattcgatgttaacattaccgaattacctgatgaaattgatttgagttcatacattgagggacgatag

SEQ ID NO: 945 - DNA, 1458 bp, Phyllotreta atra
aacagtttcaccgagattcgagaacaggccaagcaaatcgaaaagggcataatcaacaagagagacaaagatctaaacagtttcaccgagattcgagaacaggccaagcaaatcgaaaagggcataatcaacaaggaaaaccgctttattctccgagtgctgcgctgcatgcccaacaccagacgaaagctcaacggcatcgtcctcagaagtctcatcaaccaaatttacccggtggtcgagcgagacgtgctcctcagcttcatcgaagaatccgccggcgaactcgaccaaactcaaaccaaagccaggccggccaccaagtcccccgtagcagaaatcgacacctacatcaacctgctatgtttagtccatttaatcgacaccaacaaactagcagaagccgaacgctgctcgcaaatcctcatgaacaagatcaccagccagaacagacgaacgctggacctagtcgctgcgaaatgctacttctactactccagggtagcggagctcaccgacaagctggactcgatcagaggcttcctgcattcccgcctgcgtacggccaccctcagaaacgatttcgaaggacaagccgtactaattaactgcttattgaggaactatctacactattccctgtacgatcaagccgataagttggtgaacaaatgcgtgtttccggagacggccagcaacaacgaatgggcgaggttcttgtactacttgggcaggatcaaagcggcgcgattggagtacagcgtggcgcataagcatctgatacaagcgatgcgcaaagcgccccagaacacggcgatcggcttccggcaaaccgtacaaaaactaacggtcgtggtggagttgctgttgggggatattccggagaggcagatattccggcaggcgagcatgcggcattcgctcgccccgtatttccagttaacgcaggccgtgagaatggggaacttgcaacggttcggggaggtgttggagaatttcgggccgcaatttaggctggatcatacgtttactctaatcctgcggcttcggcataatgttataaagacagctatcagatcgattgggctgtcgtattccaggatatccccacaggatatagctaagaagctggggctggattcagccgaggatgcggaattcatcgtagcgaaggctattcgagatggggttatcgaagctactttggacccacaaggggggtacatgaggagtaaagagagtactgatatctactgtactaaagagccccaactggcttttcatcagaggatatcattttgtttggatttgcataatcagagcgttaaggctatgagatacccgccgaatgcgtatggaaaggaactggaatcggctgaggaaagacgggagagggagcagcaggatttggaattggccaaggaaatggctgaagatgatgatgatagttttccttaa

SEQ ID NO: 946 - DNA, 1668 bp, Phyllotreta atra
atggccgctagccatcaagcccttccagtgtcggccatcctgaaatccaaaagcgaagtcgaggatgagcccaagaagaagtccagggaggactggcgcaaggccaaagagctggaggaggcccggaaggccggcacagccccggcagccgtcgacgaagaaggtaaagacatcaatccccacataccgcaatacatatcttcggctccttggtattacggaacctctggccccacgttgaagcaccaaaggccccaggatgataagcagaaagagtattcagatttgaacgattggtataaaagaggcgttgatacttcgaagatcgtaacaaagtatcgtaaaggcgcttgcgaaaactgcggggcgctgactcacataaagagagattgcatggacaggccgcgtaaagtcggcgctaaattctcaggcgctaatatagcccccgatgagtttatccaaaagaatttatcactgagtttcgacggtaaaagagataggtggagtggttacgatccatccgaacataaaacggtaatagaagaattccagaaagtggaggaagccaaacggcaactaaaatccgacaaattgaacgcgaacgaagagtccgaagacgaagaaaaagacgaggataaatacgtcgatgaagtggacatgcccggtacgaaagtggacagcaaacaaagaataacggtgaggaatttgcgtatacgagaagatacggccaaatatttgagaaatttggatcccaactcggcgtactacgaccccaaaaccagatcgatgagagaagatccgaacgctggaatggacgctacataccatggggaaaacttcgttcgtttctccggagatactacgaatcacgccagagcccagctgttcgcttgggaagcgcacggtaaaggagtcgacgttcatctactagcagaacctacgaaattggaattactgaagaaggaatacgagaagaagaaggacgaagtgaagtcgaatattcagggtacagtattagagaaatacggaggtgaagaatacctcgaagcgccgccgaagagtttgttgttagctcaaactgaaaactacgtggaatattcgagatcgggtaaagttatcaaaggtgccgaaaaagaagttattagatcgaaatacgaagaagatgtttacattaataatcacacgtcagtttggggttcttattggagtgggggacattggggttatcgctgttgccattctttcattaagaattcttattgtttgggagaatcgggaaaattagtgaacgctcaacctacggcagaattaataactaatgatgagcctaaagaggaacagagtcaagaagatgataaggttgaagcattagaaaaagaaagcgaagaatctgaatctagcagttcatcggacgatgaaaaatccaaagcgaaatcgaagaaaaaactcaaaaagaaaatgaagaagcagaagaagaagcaaaagaaaaaggacaaggaggttaaaatgtcttcgttgatgaaagacgaagacgaagaagtggttttggacgacagaaagcggccttacaacagcatgttcgaagcgaagaaacccaccgaagaacaaatggaggaatacttcaagaagcggcgaagggacgaagacccgatgaaccaattcatgtag

SEQ ID NO: 947 - DNA, 621 bp, Phyllotreta atra
ataagccgagatcattggcataaacgaagggccaccggaggcaagaggaagcctcttcgcaagaagaggaagttcgaattaggtcgtccggcggccaacacgaaactaggaaccagaaggatccactatgttcgtacaaggggtggcaacttgaagtaccgtgcgctaagattagacactggaaacttctcttggggaagcgaaggaactgcccgtcaaacacgtattatcgatgtcgtttacaacgctagtaataacgaattggtgcgtaccaagacgttggtaaagaacgctattgtcgtcgtcgacgctaccccgttcagacaatggtacgagagccactacatcttaccgttgggacgcaagaagggtgctaagatgacgcctgaggaggaggagattttcaataagaaacgtagcaaaaaagtacagaagaagtacgaaactaggcaaaaaaccgctaaagtagagcctgcgattgaagaacaattccacactggaagattgttggcatgcctagcatcaagacctggacaatgcggcagggccgatggttacgtcctcgaaggaaaggaacttgaattctacatgcgtaaaattaagtctaagaaagctaaataa

SEQ ID NO: 948 - DNA, 936 bp, Phyllotreta atra
atggatagattgcttcgtcttggaggcggtatgccgggtttaacccaagcaccgccgccttccgacgcccccgtggtggacaccgccgagcaggtctacatttcatccctagccctactgaaaatgctgaaacacggcagggccggcgtccccatggaagtcatgggtcttatgctaggtgaattcgtcgacgattacacagtgagggtcatagacgtgttcgccatgccccagacgggtactggagtgagcgtagaagccgtggatcccgttttccaagcgaaaatgttagatatgctacggcaaaccggccggccggagatggtggtcggttggtaccattcccatccgggtttcggctgctggttgtcgggagtcgatatcaacactcagcagagcttcgaggccctctccgagagggcggtggctgtagtcgtcgatccgattcaatccgttaaaggaaaagtcgtcatcgatgcctttaggttaatcaatcctaatatgatggtgttggggcaggaaccccgacaaacgacttcgaatttggggcatttgcagaaaccgtccgtacaggctctgatccacggtttaaatcgccactactactccataagtattaactacaggaagaacgagctggagcagaagatgttgctcaatttgcacaagaaatcctggatggatgggttaacgttggctgattattcggagaattgcagcgttaacgagaaaaccgtcgccgatatgttggaattggctaagaattacaacaaagcgttggaggaagaggagaaaatgacaccggaacaactcgctattaagaacgtgggcaaacaggctaccaagaggcatttggaggagaaagtggatatattgatgaccaacaacatcgtacaatgtttgggagccatgttagatactgtcgtgtttaaataa

SEQ ID NO: 949 - DNA, 1215 bp, Phyllotreta atra
atgactgttattaataagatggaggtcgatgggcccctcaagggggaagggttcaggtcctactatattaccaaaatcgaggaattgcaactaatcgttgccgaaaagagccagaacctcagaagattgcaagcccaaagaaatgaacttaacgccaaagttcgtatgcttagagaagaactaatgctccttcaagaacaaggaagctacgtcggtgaagtggtcaaacccatggataagaagaaagtactggtgaaagttcacccggagggaaaatttgttgttgatatcgacaaaaatatcgacattaatgacgttacgccaaattgtagagtcgctctgcgaaatgaatcgtacactttgcataagattttaccgaataaggtggacccgttagtgtctcttatgatggtagaaaaagtaccagattcgacttacgaaatggtgggtggtttggataagcaaatcaaagagatcaaagaggttatcgaattgccggtgaaacatcctgagctctttgatgctttaggtattgctcagcccaagggtgtgttgttgtatggacctccaggaactggaaaaactcttctggctagagctgtagctcaccacacagaatgtacgtttattagagtatcaggatcggagttggtgcaaaaattcatcggggaaggttccaggatggtaagggaactgttcgtaatggctagggagcatgccccttcgatcattttcatggatgaaatcgattctattggatcctctcgtatcgaatcaggttctggtggcgattccgaagttcaaagaactatgctggagttgctgaatcaactcgatggatttgaagctacgaagaacattaaagttataatggctacgaacagaatcgacattttggatcccgctttactcaggcccggtagaattgacaggaagatcgagttccctccaccgaacgaggaagcccgattggacatcttgaaaattcactcgagaaaaatgaatttgaccagagggatcaatttgaggaaaatcgccgaattgatgccaggtgccagcggtgctgaagtgaagggagtgtgtactgaggcaggcatgtacgccctaagggagagaagggtacacgtaacccaagaagatttcgaaatggctgtggccaaggtcatgcagaaggattcagagaagaatatgtcgattaaaaaattatggaaataa

SEQ ID NO: 950 - DNA, 600 bp, Phyllotreta atra
atggtaaaattatattgcatcagtatactctacaaagatactacatacgctacgtggttgaagtctgctttcgatttacaaagtttcagttttttccaaaggggatctgtacaggagtttatgtcattcttttgtaagactatcgtggaaaggactataccatcgtccaggcaatccgtcaaagaaggagaatacatgtgtcatgtttatgtaagacatgataacttggccggtgttgtaatatcagatcacgaatacccgtctagggtgtcgcatacgctgatcacaaaaattttggacgaatttgccgctaaaataccagctgtgaattggcctaccttgcaagagagagacgtggcgtttccacagttgaacacatacctggccaaataccaaaaccctaaggaagccgatgcgatgactaaaatacaagaggaccttgacgaaaccaagattattctgcataatacgattcaagctgtcctggaaagaggggaaaagttggatgacttggtaaataaatcagagggcttaagtatacagtccaaagctttttacaagactgcaaggaaaacgaacagttgctgcagtttcacttaa

SEQ ID NO: 951 - DNA, 729 bp, Phyllotreta atra
atgtttctaacaagaagcgaatacgatagaggtgttaacacattttcgcccgaagggagattattccaagtggaatatgccattgaagctattaaattgggatctacagctatcggaatatgcactagcgaaggggttgtgctagcagtcgaaaagcgtattacttctccattaatggaacccactacgattgaaaagatcgtagaagttgataaacacatcggctgtgctgtttcggggctcatggcagattcacgtacaatgatcgatagagcaagagttgagtgccaaaatcattggttcgtttacaacgaaaacatcaccatcgaatcgtgtgctcagggagtatcgaacctagccattcagttcggagattcggatgatgatggtgctgctatgtcgaggccattcggtgtggccatcttgtttgctggcatagacgaaaaagggcctcaactctaccacatggacccatcaggtacatttgttcagttcgatgcgaaagccataggatctggttcagagggcgcacaacaaagcttacaagaagtatatcatcgtagcatgactttagaggaagctaccacagcagcgttgactattctcaagcaggtcatggaggagaaattgaactcttctaatgtagaagtcatgacaatgacgccaaaggatatgttccacatgttcactaaggagcaagtggaggaggtaattactaaattatcttaa

SEQ ID NO: 952 - DNA, 1158 bp, Phyllotreta atra
atgacagaatattggttgatttccgccccaggtgacaagacctgtcaacaaacatgggataccatgaataatatgactagtaaacagaacaatttgtctgcaaattacaagttctcaatacccgatttgaaggttggaactcttgaccaattggttgggctatccgacgatttgggaaagctggatggtttcgtggagcaggttacccggaaggtggctcagtacctcggcgaggttcttgaagaccagagggacaagttgcaggagaatttgcaggcgaacaacaccgatttgccaagttatttaaccagattccaatgggacatcgccaaataccccatcaagcaatcgctgcgcaacatcgccgatataatcagcaagcaagttggacaaatcgatgccgatcttaagaccaagtcgtcagcgtacaataacttaaaaggcagtcttcagaatttggagaaaaaacaaacagggagtttgttaacccgtaacttggcagatctggtcaagaaggaacactttattttagattctgagtacttgcaaacgctgctcgtcatcgttcccaaagctcagttcaatgagtggaacgccacttacgaaaagatcacggacatgatcgtccctcgttcgtcggagttgatcattcaagaccacgactacggcctgttcaccgtgtcgctcttcaagaaggtggtcgaggagttcaagctgcacgccagagagaagaagtttatcgtgcgagatttcacgtacaacgaggaggaactggcggccggcaaaaacgaaatcaccaagctcgttaccgacaagaagaagcaatacggtccgttggtgagatggttgaaagtcaacttcagcgaatgcttttgcgcttggatacacgttaaagcgctgagagtgttcgtggagtccgtgttgagatacgggttaccagtcaattttcaggctattctgatccatccaaataagaagcaagccaaacgtttaagagatgttttgaatcaactctacggtcatctagatagtagtgcagctctttccggacctaacgttgatagcgtagacattccaggattaggtttcggccaatcagaatattacccctacgtgtactacaaaataaatgttgatatgatagaatcgaaggtctaa

SEQ ID NO: 953 - DNA, 1674 bp, Phyllotreta atra
atgtcgatattagcaagtcctctatcagtagccggttcgcgaaccacaggcgcctcagttcgcacccaaaatgttatggccgcttctaccatagccaacgtcgtgaagagctcattgggacccgtggggctcgacaagatgctcgtcgacgacatcggagacgtcaccgtaaccaacgacggggccaccattttgcgcctgctggaagtagagcaccccgccgccagggtgctggtggaattagcgcaattacaagatgaggaagtaggcgatggaaccacttcagttgtcatcatagctgcagaattactgaaaaacgcagatgaactggtaaaacaaaaaatccaccctacatcgattataagcggatacaggctggcttgtaaagaagcttgccgatacatacaagaccatttgactattcccgtggaggaattgggcaaggagtctatagtgaacgttgcgaagacttctatgagctcgaaaattataggagctgatgcggatttcttttcgcaaatggtagtcgatgctgccaccgcagtgaaagtgacagactcgaaggggaactcgatgtaccccattaaggcggtgaacgtgttaaaggctcacgggaaaagcgccagggagagtttcctagtggccggctacgccttgaactgcactgtcgccagccaagccatgcccaagaagatcgtcaacgccaaaatcgcctgtctggatttctcattgcaaaaggccaaaatgaagatgggcgtgcaagtgctgatcacggaccccaatcaactggagggcgtcagagccagggagctggacatcaccaaggagcgcatccagaagatcctggccaccggcgtcaacgtggtgctgctgtccggcggcatcgacgacgtctgtttgaagtacttcgtggagcgcggcgccatggccgtgcgccgcgtcaagaaggccgatttgaagcgcatcgccaaggcgacgggggcggcgttcgtcacatccttgagcaacatggagggcgacgagaccttcgattccaatatggttggtgaagccgccgaggtagtgcaagagaggatttccgatgatgaattgatcgtcattaaaggccccaaggctcgcacggccgcctcgatcatcctgcgaggccccaacgatttctactgcgacgagatggagcgctccgtccacgacgccctctccgtggtgaaacgcgtactggaatcgaagagcgtggtggcgggaggcggtagcgtggaggcggcgctctccatctacctggagaacttcgccacgacgttgagctccagggagcagctggccatcgccgagttcgctaggagtctgctggtgataccgaagacgttggccgttaatgctgcgcaggacgcgaccgatttggtggcgaagctgagggcctatcagaactccagccagactaagaaggatcatgcgcatttgaagtacgtgggattggatctgcttgaaggtaccgtgagagataacaggaaagctggcgtgttggagccgactatgtctaaagtgaaatcgttgaaattcgctacggaggcggcgataactatactcagaatcgacgatatgattaaattggatgctgagcagaagggtgggaaaaactaccaggatgctatgtctagtggtgaattgtacgattag

SEQ ID NO: 954 - DNA, 822 bp, Phyllotreta atra
atgtttaattcttctcaattaaaccctccaccgttttggagtaacggtccagctcctggggccttctataacttcccaggaacagaatggaaacctgtatcacatccaataactcatacccaatctccagtaacaacttcaacctcaattgtatctataacctacgataagggagtactaatagccggagacttgctggcctcttacgggtctttagccagatacaaaaactgccctagggtaatcgaaattaacccaaacatcatcctaggcgctggaggagactacgctgatttccaatacgtcaaaagctttatcgagcagaaaataatcgatgaagattgcctagatgatggctggaaaatgaaaccgaaatctctttattgctggctaactaggattaggtaccaacgaaggagtaaactcgacccgttctggaacaatctagtagtcggaggaatccaagatggagtacctttcctaggaacagtcgataaacttggcactgcgtacacagataaagtaatctgtactggttacggggctcatattgcccttcctgtcttgcgggatgccctcgacaagaagccgaatttacatctaaatgaggctaaggctctaattaaaaagtgcatggaagttttgttctacagagacgcgagaagttacccgacatatcagttgggtataatcgatatggatgatggtgttaagatcgagggaccgatttctgtcgaggagaattggaacattgcttatatgacatattttttgtattttattcttgaaaaaatgatattatttaataaaggatggaactga

SEQ ID NO: 955 - DNA, 2106 bp, Phyllotreta atra
atggaattttcgaaagaacccaactttgaattactaacagccaaagatttttcgccagaaaaatatgtgaaaaaattgtcccaaaattatgtgggtggatccgaattgcaaaatcttcgcagaaaaatccaagggctctccgaagaaactagctctaatttgaagaaaaatgtttacgaaaactacattcaatttatcgaaaccgcgaaagagatttcacatctcgaaagtgaaatgtaccagctttcccacttactttcagagcaaaaggccttacttaattgtctatcagccacctcgatactagaagatgtccaacctgttaacatcgagagagataataaagtaaacgaaaaggatattgaagaagaaaataaacaaaaaatagctgctatattagaaaaagtagaaggttgtcaggaattgttaaaagtgccagggagaatttttttgtacgaaggagatttattagaaatcgaacccaccgaaaacactgctttaaaaatagttcatgtttatttattcaccgatagctttatgataaccactagaaattcaaacagtcgaggcctcatgaaatacatctacgaaagcatatacgacctaagcagcctagcagtcgtgaacgtaagagatttgggaaacgttaaacacgcctttaaacttctcattttccccgataccagagttttccaatgctcttccaactccaataaaaaagaatggttagacaagttcgatcaagccaagaagacccggctagcccaagaacaacaaaaaagggaatccatatcggaaaaatcccccacccgcgtttccttcgagtcccccagctacaatccctttgatgaagtggaagaagaaacgagcgcgttgcatccggagtggttcgtggacattccggaagagctggacgtttgcgtagcccaaaggcacttcgaagacgctttatctttactacaaaaagccaaagaatacttgaatcaagcgacctctgcatcaggtgacaaacgggacaccgtctttacggacatccagcgaaaagtagagcaaagacagaacaatctaacggaggtgctgatgaaggaactggaagtgaacccggataaatcgctgcagggtggactgagagcagctcgcagggctgtgagattgttaaatcaattaggaagggaaacacaatcttgtacgttgttcctgaagttatgcagcagcatgttaagaacgcagtgtaaacgagttaaaagagaaggctctaccactacttatataaaacatctttcgagtgtggttttcactaatatgtgtcacatgtccgatgaatttctaagggctttccccgactctccggcctgtgcttcagcgtatgtggtgtgggcgagcaatgaactactgcaatttactacccattttattaagcaggtctttatgccgcagacttccttatcaacggtgaccgagtgcatagttttagttagacaacagtgcgaaaggttgtacgtttacggattggacctttgttatcaattggacggggctttgagatcgtcgctgatgaaggcgttgaaagatgctcgagataaactcatcgattcgattaaattgagagtattagatgataaatggataccgattaatttgcattctaaatcggctttgagccgttgcgtgcaagagtattctcaaatgggactcactaacgtaggaagttacgtttctggcgatacttggttgcaattaacagctagtactttatcgtttacgaaaatgtatctgaacttgttaaacgattgcatgaaattgaaaactacggagttaatgtatacgatcgatgagactttgtataacgtgttcgaagctcaagttaggcataatgaaaatgcacttagaagcgaattgaatcaagatcaaaggaactttcttacgaaaaatgcagagtttttgttggttagtttaatgcaagtggtgcagaaacagtacgaggaaaatgtcggatacgaatgtcctacgctagcgaaattgcaaaaggaatacatagcattgcagaaaggcgttacgcccgcgtcaagaagtacaaaagccaagtattcatcagagtttatttaa

SEQ ID NO: 956 - DNA, 3762 bp, Phyllotreta atra
atgaacgaattagagaaactagagtacctctctttggtctcaaaaatttgtacagaattggagaatcatcttggaatgaacgacaaagatttagctgaatatataatacatctttccgaaaaaaacaacacattggagtcttttaagaaagtcctgttagaaaatggcgccgaattctcagactcttttatttctaacctgttgcgaattatccaacacatgaaacccaagaaatcatcaaataaggaagacaccgataaagtcgaaaaagaaggattggcttttaaattccccggtttagcaatacccaatgagaaacaaaaacctttacaattagaagaatttggcaaggaaaatgaaaatgacgaaatagatgttgtagccgatatgatgaaacagctcgaggctgatgcaccttctcaaaaacagaccaaagaaaagtccagaagcccaagcatcgaaagaaaatccagaataagatctagaagtcgatcaaaagaaagaagaagatcaagaagcagatccaaagatagaagaagatctagaagccggtcgagagacaggagaagatctagaagtaaagataggcattctagaagagacaaaaggcatagaagtaggtcaaatgaagactacaagaggagaagaagagacaacagttactcgagagatagaagggaaagaggtaggtccaaagaatcggaaagaagagacagaaatagatccagagatgatagaaaaagggatagaagtagatcaagaacgagaaggcgagaaaggagttacgaaaaaaaattcaaaagtgaaaaggataatcccgaattcgaggatgatcctaccccaggaaagatttacaatggaaaagtatcaaatgtggttccatttggatgtttcgtacaactagaaggtctaaaaagaagatgggagggtttagtgcacatttctcaactaagagcagaaggtagagtcaccaatgtgaccgaagtggtctctagaggaagcaaagttaaagtaaaggtgttaactataaccggtcagaaagtatccctttcgatgaaagatgtctgccaaacgacaggaaaagatttgaatcctctatcccacgctagtacggaacgagaagataaagatcgtaaccctgacaggcctactaataatagcacatcagtgttgaggctaccggttagtatcgatgaaggtgaagaagattccaggaaaagggtaaccagaatatccagtccggaaagatgggaaattaagcaaatgatttcttccggatgtatagacaaaagcgaattaccagaattcgacgatgaaactggtttgctgcccaaagatgaagatggtgaagctgatattgaaattgaattggtcgaagatgagccaccatttttacagggtcatggtagagctcttcatgatttaagcccagtgagaatagttaaaaacccggacggttcgctagcccaagctgccatgatgcaatcggccttggccaaagagagacgcgagcaaaaaatgctgcaaagagaacaggaagtggattcccagccgtctggaaagaacaaaaactggatagatccccttccggaagaggaatctaaatcgatggcaagaggaatcggtctgcaaagtcaagatttacccgaatggaaaaaacacgttatcggtaattatttctcgatcacacaattaatttcgaagtttgtactaaacaacattttaggtggtaaaaagtcttcttttggtaaaaaaaccaacttaacgatcatcgaacaaaggcagtctcttcctatatacaaactcaaagaggagttacgaaaagccgtaacggataatcaaatactgatcgttatcggtgaaaccggttcaggaaaaaccacacaaatcacccagtacttagccgaagccggtttcacagccagagggaaaattggctgtacacaacccagaagagttgcagccatgtcggttgctaaaagagtggccgaagagtttggttgtagattaggccaagaagttggatataccattcgattcgaagattgcaccagtcccgaaacgatgatcaaatacatgacagacggtatgttgcttcgtgaatgcctgatggatttggatcttaagcagtactctgtaataatgttggacgaagctcacgaacgtacaatccacactgacgtgctatttggattattaaaacaagctgtaatgaagcgggatgaattgaaattgattgtaacttccgctactttggacgctgtgaagttttcgcagtatttctttaaggctccgatattcacgattcctggtaggacgtttcctgtagaagttttgtacaccaaggagccggagactgattacttagatgctagtttaatcacagttatgcaaatacatctcagagaacctccgggtgatatattactgtttttgacgggtcaagaagaaattgatacagcttgcgaaatattgtacgaaagaatgaaaagtttaggtcctgatgtacccgaactaatcattctaccggtatactcagctttaccatcggaaatgcaaactagaatattcgaaccggcacctccaggtagtagaaaagttgtaatagctactaatatagcagaaacttcgttaacaatcgatgggatatattacgtagtagatccaggattcgtcaagcaaaaggtttataactccaaaactggaatggattcgttggtagttacaccaatttcgcaggcacaagcgaaacaacgagctggtagagctggcagaactggtcctggaaaatgttacaggctttacacggagagagcctatcgggacgaaatgcttcctacacctgttccagaaatccagaggactaatttggcgacaacggtacttcaactgaaaactatgggtataaatgatttgctgcatttcgattttatggacgcccctccggtggaatcacttataatggctctcgagcagttgcattctctatccgctttagacgacgaaggtttattaactagattaggaagaagaatggctgaattcccgctggagccgaatttgtgtaaaatgttgattatgtcagtggctcttcaatgctccgatgaaatattgaccatagtgagcatgttatcagttcaaaacgtgttttaccgtccgaaggataagcaagcattggctgatcagaaaaaggccaagttcaatcaacccgaaggtgaccatttgacgcttttggctgtttataatagttggaagaacaataaattttcgaatgcttggtgttatgagaatttcgtacagatcaggactttgaaaagagcgcaggatgtgaggaaacagttgttgggtatcatggataggcacaaattggacgtggtgtcggctgaaaggaacacggtgagagtgcaaaaggccatttgttcagggtttttcaggaatgctgggaagaaggatccgcaggaaggctacaggactttggttgatagtcaggtggtgtacattcatccttccagcgcgttgtttaatcggcagccagaatgggttatctatcacgaattggttcaaactacaaaggaatacatgagagaagtgacaacgatagatccgaaatggctggtggaatttgcgcctgcattcttcaagttttctgatcctacaaagttgagcaaattcaagaaaaatcaaagattggagcctttgtataataaatatgaagaacccaacgcgtggagaatttctagagttaggagaagacgaaattaa

SEQ ID NO: 957 - DNA, 1254 bp, Phyllotreta atra
atgaacgatggcctccaaagaaaaaacaaaaaaaacatactggcaaaagtgaatttccctctgtacaccgtccagatggtaacgtcgcggcacgttatcgtaggaggcggcggtggaacttcgaagactggggttgaaaacggtttcgaaatatacgaaatctatcatgacggtagcaaattctcagcgaaagaagttacaagacacgaaaccggaggaaacgtagtcatgaactgctgtgtgtttagtgataggaaacattcgtttttagtagcaggtcaagagaactactctcaactttatagagtcaatacgaaattaatcgaacatgaacaagtagaaacaattggagactctgcaagcgttcgacatagaaataccaagcccaaagaacacgtagacaataacaaaaacattaaaaaggagctggttttcgacatgagtcctttagatagcatacaaaccgactttaagggatccgaacccctatgcagagtagttcgaattaatcactcgggaaaaatattagctactggaggaactgacggcgacgtaagactttggaaattccctacgatgcagccattgtccattctcaagggacatacgaaggaaatagacgatatagatttcagtaaattcgataatctcatcataactttagcgaaggacggtttggctattttgtgggacgcccaaacgggtaaattgaaatcgaaactgacatggaacactccagagggatcgaaatatttgtacaagagatgcaggtttggcgttatcgaagatcaaaagaataagtgcatgctatacatgatagcgaatgcgactaattcgaagcaaaaatcgtttctacaacaatggatacctgaggagaatactttaaaaaagttctcggaatttaatgaaacactgtccgcacttgcagttagagacgatggacgatttgttgctgtcgggacaatgttcagcggttctgtttcgattcacattgcatttagtttacagaaaatattagtagttgtcggtgctcattcgatgtttgtaactggtctggaattcctatctcatgaaaatactaatcattccataagtagtgtcgcagaggccgctgtattgtctatttcggtggataatcagctttgtatacactcggtgccatacagacgaagtataccgttatggattggaattatggtgttaattttagtattatttattacatttatgttatgtgcatacatgggtttgtga

SEQ ID NO: 958 - DNA, 1242 bp, Phyllotreta atra
atggctggtgcaatgttattcgaaagagctcagtccgttccttcccaacatgacaagttgttaaaattaaatccggcagacgaagatgacgaggagaatattgttaataaagagcaggacatcctcaacttgggcgagaagtacaaaaaggagggcaaggctaaagaactagcggagctgataaaggccaccaggccatttttgagtcttattagcaaagcaaaagcagcaaaattagttagatcactggttgattactttctggacttggaggcaggcatcggtatcgaggtgcaactgtgtaaagaatgtatagaatgggcgaaagaggagagaagaacgtttttgcgccaatcgctggaagcgcgtctcatcgccctgtatttcgacaccggcatgtacaccgacgccctgcagctggaatccaccttgttaaaagagctgcagaaactggacgacaaaaacctgctggtcgaagtgcagctgctcgaaagcaaaacatatcacgctttaagcaatttaccgaaagcccgggccgctctgacgtccgccagaacgaccgccaatgccatctattgccctccgaagatgcaggccgccctcgacctgcagtcgggcgtgctgcatgcagccgacgaaaaggatttcaagaccgcttactcctatttctacgaggccttcgagggtttcgacagcgtcgagtcccccaaagctcggaccgctctgaagtacatgcttttgtccaaaattatgatcaatagtcctgaagatgtacagcaaattgttagtggaaaattagccataaagtatgcaggtaaagatatcgaggccatgaaagcagtcgcacaagcagcccacaaaagatctcttgcagattttcaactggctgtaaaacaattcaaacacgagctggaagacgacgttattgtaagagcacatttaggaacactctacgacaatatgttagaacaaaatttatgcaggatcatggaaccttactcacgtgtccaagtagaatatatcgcaaagacgattaagcttcccgtgttacaagtagagaagaaactgtcgcagatgattttagatgccaagtttcatggaattttagaccagggtgatggtgtcctgatagtgtttgaagaaaccccggtagacaaaacctatgaaatggcgctagaaacgatccagagtatgagtaaagtagtagttactctctatcaaaaagcgaaaaagttgtcatag

SEQ ID NO: 959 - DNA, 1824 bp, Phyllotreta atra
atgaagaagactatgcgtgtgctattcgtgaggtttgtatccgagtgtttgtgttgtgctaagcatcgaagcaagtttctcaaaaaaatggcttcgcggtcgaaaaagagctcaacgccgtcggcccagcagcggccggctagcccgctcagccccaccaggcattccaggctgcaggagaaagcggacctgcaaaatctgaacgaccgcctggccggctacatcgacaaagtgcggtttctggaagcggaaaacaacaaactatccagagaaatccaaaccacccaggagacggttacacgcgaagtgtccaacatcaagtctatgtacgatcacgaactatcggacgctaggaaactgctggacgacacccaccgcgagaaggcccgcctggagatcgacgtgaagcgtctcatcgaagagaacgaggagctgaaagccgagctagccaagaagagcaaggacctcgtcatagccgagaaccatgccaggatatacgagaccaggtgcaacgagtaccagctcaaagccaaccaagccgccgccgacgccaagaaggccatcgccgacgccaaggaactggaaaaggaaagggacaagctgaagaagctcctcgatgcagctcgtaaacaattggaagaggagtccttggccagagtcgaggtcgagaatcacaatcagagtttgagggaagagatcgtcttcaaagatcagattcatcagcaggaactcacagagacccgcactcgccggcaagtcgagatcagcgaaatcgatggccggctggcgcagaagtacgaggccaagctccaagaggccctccaggacctgcgggaccagtacgaatcgcagatggccaacaatcgccaggagatcgagttgctgtacgagcagaaaatcaagaacctgcaggccgccgccgaccggcatcaatccaccgcctccggcgctctcgacgagctgagacaggttcgaacgaggatcgacaccttctcgtcgaggatccaggacctggagaaccagaaccagggtctggcagctagaactagggatttggagaagttgctcgagaacgagcgcattcgtcacgccgaagacctagcgttagtagagagggaattgcacaggatgcgcgaggaaatggcgactcaactgcaagagtaccaagacttgatggacatcaaagtgtccctcgatttggagatcgccgcctaccgtaaactgctcgaagcggaagaagctcgattgaacatcacgccaacaggcggtgaccacgaggtgcaccaaaggagctcctctcaacgccggacgccggtgcgactgggggccaagaggaaacgggccctgctcgaggagacgcaggagtcgagcatgtcggactacagcgtgaatagttcgtctaaaggggacattgaagtggccgcagtcgatccggacgggcagtttgtgagattgcacaacaaaagtaaccaggaggtgccgctcagcggatggcaggtcataaggcgggcgggcgatgaggagactttctacaaattccacagaaccgttaaagtagagggaaatggtaccgtaaccatttggagttctgatttaaataaggatcacgaaccccctagtaacctggttatgaaagggcaaaaatgggtgactggagataacatgtttacgatagtattgaacagcaacggagaagaagtagcgtcatccgaaagggtgaaaaggcagatttcgacgtcgcatttaagacacagggaattaggggacgaagaactttttcaccagcagggggacctgcaaggtgaaaagtgcggactgatgtga

SEQ ID NO: 960 - DNA, 2385 bp, Phyllotreta atra
atggctgatagcaaaagccctgacgatctagcgactgcgattcttcgcaaaaaggaccgtccgaacaggcttttggtcgaagaagccgttaacgatgataattccgttgtggccctgtcccaggcgaaaatggacgaactacagctctttagaggcgacactgtactacttaagggcaagcgtcgaaaagaaaccgtctgcatagttctctccgacgatagttgtagtgacgaaaagatccgcatgaacaggaacgttcggaataacttaagagtcaggctgtccgacgtcgtttctattcagccctgccctgatgttaagtacggtaaaaggaatgataattccgttgtggccctgtcccaggcgaaaatggacgaactacagctctttagaggcgacactgtactacttaagggcaagcgtcgaaaagaaacggtctgcatagttctctccgacgatagttgtagtgacgaaaagatccgcatgaacaggaacgttcggaataacttaagagtcaggctgtctgacgtcgtttctattcagccctgccctgatgttaagtacggtaaaagaatccacgttcttcccatagatgatacagtagaaggacttacaggaaatctgtttgaagtgtatctgaagccgtatttcctggaggcgtatcggcccatacacaaggacgacgtttttatcgtaaggggcggtatgagagccgtagaatttaaggtagtggaaaccgatccggctccttactgcatagtcgctcccgatacggtcatccattgcgacggggatccgatcaaacgcgaagaagaagaggaggctcttaacgccgtcggctacgatgacatcggaggttgcaggaaacagctggctcagatcaaagagatggtcgagttgccgttgagacatcccagtctgtttaaggctattggtgttaagccgcctcgtggtatcctcttgtacggtccaccgggtactggaaagactctgatagccagagccgtcgccaacgaaaccggagctttcttctttttgattaacgggccggagatcatgagcaaacttgccggagagtcggagagtaacctgcgcaaggcgttcgaagaagccgacaagaactccccggccatcatcttcatcgatgaattggatgctatcgctccgaagagagagaaaacccacggagaggtggagcgtcgtatcgtttcgcaattgcttactctaatggacggcatgaagaagagctcccacgtcatcgttatggccgctacgaaccgaccgaactccatcgatcccgctctacgtcgattcggcagattcgacagggaaatcgacatcggcattccggacgccaccggtagactggaagtgctgagaatccacaccaagaacatgaagttggccgacgacgtcgatttggagcaaatcgcggccgagactcacggtcacgtgggcgccgatttggcctcgctctgttcggaagcggcgcttcaacagattagggagaagatggacctgatcgatctcgaagacgatcaaatcgacgccgaggttctcaattcgctggccgtgaccatggagaacttccgctacgccatgacgaagagcagcccgagcgctctgcgcgaaaccgtggtcgaggttccgaacgtcacttgggacgatatcggcggcttggcgaacgtcaagaaggagttgcaggagttggtgcaatatccggtcgagcatcccgataagttcctgaaattcggcatgcagccgtccaggggagtgctgttttacgggccgcccggttgcggtaaaaccctgttggccaaggccatcgctaacgaatgtcaggccaacttcatatccgtcaagggaccggaattgttaaccatgtggttcggtgaatctgaagctaatgttagagacattttcgataaggccaggtcagcagctccttgtgtactgttctttgatgagttagattcgatcgctaagtcgagaggtggaaatgtgggagatgccggcggcgcagccgatagggtgattaatcaaattttaactgaaatggatggtatgggagctaaaaagaacgttttcataattggtgctacaaatagaccagatattattgatcccgctatattacgtcccggtcgtctggatcagttgatctacatcccgttgccagacgaaaagtctagggaagcaatctttaaggcgaacctaaggaaatcacctgtagctaaagacgtagatcttatatatattgccaaagttacacacggcttttcgggcgccgatttaacagaaatatgtcaaagagcttgcaaactcgctataagacaaagcatcgaaaccgagattagacgagaacgagagagagcattgaatccc

SEQ ID NO: 961 - DNA, 825 bp, Phyllotreta atra
atgagtgaccaattcgactgtgcactcgatttaatgaggcgcttgcccccgcaacaaatcgaaaaaaatttgagcgacttgatagatttagtgccaagtctctgcgaggatctcctttcgtccgtggatcaacctttaaaaatcgctaaagacaaggattcgggcaaggattttcttttatgtgattacaatagagacggggattcttacaggtcaccatggtcgaatacctactatcctccattagaagacggttcgatgccctccgagaggctaaggaaattagaattagacgccaatttagcgttcgatcaatatagagaaatgtatttcgaaggcggcgtatcttctgtttatttttgggacttggatcacggtttcgcaggtgtaattttaattaaaaaaaccggcgatggtagtaggaaaattaaaggttgttgggattccctgcacgtggtggaggtacaagagaagagttccggaaggaattcccactacaaaatgacgtccaccgccatgctgtggctgcaaaccaataaacaaggctcggggaccatgaatttgggcggcagtttaacccgacagatcgagaatgatgcggccgtgaacgacatcaatccccacatcgccaacatcggtcgaatggtggaagacatggaaaacaaaattcggaacacgttaaacgaaatctactttagcaaaaccaaggacatagtcaatagcttgaggtcggtgcagccgttaacggagagccgtcaacagcaggcgcttaaacaagacttggccgccgcccttcagcgtaggcaaaataaatccgagaattga

SEQ ID NO: 962 - DNA, 3291 bp, Phyllotreta atra
atggaacgtccaccccgcaatgagccgcccgtggagcctgtcaacggtgtggtacaaccgccggtgcacccgcccccggacagtccaggacgcgtaacgaaccaactgcaattcctgcagaaaaccgtactaaaggctgtatggaaggacaagttcgcctggccctttcaacaacccgtcgacgctaagaaactcaacctgcccgactatcatagaataatcaaacagccgatggacctgggaacgataaagaagcgtttagagaacaactactattggtcgggtaaagagtgcattcaggatttcaacacgatgttcacgaattgctacgtctacaaccagcccggcgaagatgtggtggtcatggcccaaacattagaaaaagtatttttaaccaaagtggccgacatgcctaaacaagaatttgtcgttgatatgccgatgaaaggcgccaaaggcaagaaagggcgagttagcgtcggtggcgtcggtggcggcggcggcggcggcagcacgccatcctccagcggcccggtaccagcagctatagtaccaggaggtgtcagaggcaggccgcccgcgaccgtatcctctaccagtaccacaccgattgcgaccactaccggttcgtccggcttgccgttgggcacccaagcgcccgcgacgctgccgggcagtaccgccaccacgacgatagcgccggccaacaacaacaacagctctctgacgccgcagcagctcggcacgcccgtcagctcgatgcacggcacgccgggggcgccgctgtcgaattccctcgatcccaccggaggagtgctaccctctaacgtcatgccgccggcgcaaccagccaaggtaaaaaagggcgtgaagagaaaggccgacacgacgacgccggcgacggcctacgattatccgacggtgttggaatcgaagtcggcgaagatttcgacgcgccgagaatcgggcaggcagatcaagaagccggcgcggcgggaaatcgaccttcacgtacctcagccggcgatccacaagcccaacgacaagttgtcggagtcgctcaaggcctgcaatgaaatcctcatggaattgttctccaagaaacattcgaattacgcttggcctttctatcaaccggtcgatgcagaactattgggcctgcacgactaccacgacatcatcaagcgaccgatggactttggtacggtcaaagagaagatggacaacagggagtaccgcaccccgcaggactttgccgccgacgttagactgatttttagtaattgttacaagtacaatccctctgaccacgatgtggtcgccatggcgcggaagctgcaggacgtgttcgaagtcaagttcgcaaagatccccgatgaacccttgaaccggataggaggagctgtaaataatctacccataaaatccgaatcgagtagttccggttcgagttccgattcgtccagcgaatccgaggattcggaggaggaacgacgtaataaacaattaaaagtactggaaaaagagctgacggcgttgcaagagaagatgcgcaagctggtggaggagagctcgcgccggaaaaaggagaaaaagaagaacaagatgaaaaagaagccgagcggcggtggcggcatgtcggccgcgggggcgggagcgctgccgaacagcagcagcggtctcggtttgcgcggcaacaagcccgccgccgccgccaacgccgcccccaaacgggtgaaggccaacaacaagaccggcgccggcaggaagaagaacgccgcccagccgccgcccatgccgttcgattccgaggacgaggacaacgccaagccgatgtcctacgacgagaagcgacagctttcattagatattaacaaattacccggcgacaaattgggtcgagttgtacatataatccaatcgagggagccgtcgttgagggattcgaatcccgatgagatcgagatcgatttcgagacgttgaagccgtcgacgttgcgggaattggagagctacgtcgcgtcgtgtctgcgtaaaaagccacataaaaaagtagccggcaaatctaaagacgaacaaatggcggagaagaagcaggagctagaaaaaagactaatcgatgtaaacgataaaatcggcaattccaaaaaagcacctaaaaaagatgaagcgaacaaggtggacccgacgggcgctggcggtccctccggtcgcctgtcgtccagctcgagcagctcggattcggacagcagcagcagcagcctgtcgtcgagttcgagcgattccagcgacagcgaagcaggtggtacgaccaacagatccactaaaaagaaagtgaacaaaaagagccccaacccatcggtcgataatactacgataacgaaaccacagcaaccaacaacagcaccaccaatgccacaaacacccgccaacgctagcgtaaccgccgccgcgccggccaacaccaacgcgccgccgccgcaggtacccgccaccgtcaacaacaatttcccgccgccgcagcaacaacaacaggcggtagctcccggcaaacaacagcagcacaacgtggttaacgtaccgcccgcgcagctggtgccgccgctgaacatcaaacccatcggcatcgagaagctgtcggcggtgaatcccgtaaccccggccagcgtgccccaagcccctaaatccgtcgccctacccacaccctcgcccgacaaacctaaacccaacgtcatcgcgcacatggacacctacaccgaccccatcgagcagagcctcgccaacctggagcaggacaccgtcaccgtgcaacagctcaccaatcccatccccacccatcccgtacacatgaacctcaatcctaacgtcacgcatcccgttttacagcccagttccttgaacatggacatgaaggcgccggtgacgatggccaccagcatgctgcaccacatgccgatgtccatggacgccggggatctacccgccttgatgcaaacccaagctaacttgatgcacgcgcagaacaacgggttcggcatcaagcacgagtttgatttaaccgcgaacaacaacggtatcacgtcgatggggttgcccatggagatgtccatatcgtcgatgttcgaccagctgccgcagcacatcagcggccagatgatcaagccggatccgggccaggatcggctcgacgggctggtgggggcgctgatcagcgagaagaaaccgccgccgggcgtgccgccggccgcctccaagccgcagacgttcgggttcaagcaggagaaggccgag

SEQ ID NO: 963 - DNA, 1218 bp, Phyllotreta atra
atgtctttatccactgctcgccctttagtgagcgtatacaatgagaaatcggaagaagtaaaaggcaacggggtagccctacccgctgtctttaaggccccaattagaccagatgtcgtcaatttcgttcatcagcaggtctcaatgaaccatcgccagccttacagcgttagcgacaaagctggacaccagacctccgccgagtcgtggggaaccggtcgcgccgtggcccgtatacctcgtgtacgcggtggcggtacccaccgatccggtcagggagccttcggcaacatgtgtcgcggcggtcgcatgttcgcgcccaccaagccgtggcgccgctggcacagacgcgtcaacatcaaccagcgtcgctacgccctggcgtcggccgtcgccgccagcggcgtcccagctctggtcatgagcaaggggcacgtggtcgatcagattcccgagctgccgttggtcgtcagcgacaaggtgcaggagatgcacaagaccaaggaggccgtgcagtttctgaggaggatcaaggcttgggctgacatccagaaggtttacaagagccagcggttccgtgccggtaaaggaaagatgcgtaataggagacgtatccaacgtaaaggaccactcatcgtctactacaaggatcaaggtcttcgtcaagctttccgtaacatcccaggcattgaccttatcagtgtccaaaagttgaacttgttgaagctcgctcctggcggtcacgtaggtcgattcgtgatctggactgaatcggcgttccaacgtttagacaaattgttcggtacatggaaaaacccatcgaccgagaagaagggttacaacttacctcaacccaagatgtccaacaccgatttgtctaggttgttgaaagctgacgagattaaagctgtgcttaggactcctcagaagaaggtggtacgtcgtgttcgtcgtcttaatcctttgaccaacactaaagccatgcttaaattgaacccgtacgctgctgtactcaagagagaagcaatcttgaagaaccaaaaaaggcagttgcaaagagacgaagctttggctaagaaacgaggaatcaccctgacccctgacaacgctgtaatcaggaccaggaaattgcaggaaagaaggagagcgcaaattttgaaagataagaaatcaaaacccaagaaggccgctaaagcgccggccaagaagcctgctgga

SEQ ID NO: 964 - DNA, 5274 bp, Phyllotreta atra
atggcagattttcttaattcagaagccgaggaatctagcgaggaggaagaattagaccatagggatcgaaagaaggcacaaaaagcaaaactcgtagatagctctgacgaggaagaggaagaagatgacgaagaaaaaattagagaagaattaaaagatctaatcgacgataatccaatcgaagaaagtgatgctgaatccgatgcttcaggtcgtgagaaaagaaaaaaatctgatgacgaagacctcgatgatcgattggaagacgaagattacgatctgttggaagaaaatttgggtcataaagtagaacgaaggaaattcaaacgtttacgccggtttgaagatgaagaaagcgaaggggaagaagaacatgatcccgaccaggatcgcgaacaaatcgctatggacatattttccgacgatgacgaagaaagaaggtcggaaagaagccaaagaccggtcgtcgagcaagaatctttcggtgtaggcgaagaagaagaagaaggcgattattcggacgccgatgattttattgtagacgacgacggcagaccgttaatcgagaagaagagaaagaagaaaccgattttcaccgacgccgcgctgcaagaggcccaagaaacgttcggcgttgatttcgattacgacgagttcaccaaatacgatcaagacgaatacgaggacgaggaggacgaagaagaggacgaatacgaagaagatgacaacgaacgaaggaaacatccgaagaaagctgcgaggaagaagctgacgaaaaagtccattttcgaagtgtacgagccgagcgaattgaaaaggggtttcttcaccgatctggataatgaagttcgtaacaccgatatacccgaacggatgcaacttcgtgacgttcccattacacccgttacggacgattcgactgagctggaagacgaggcggagtggatttacagacaagcgttttgtaataaggctgtgtccaatgtcgatgcgcacctttcggccgaagcgagagagaaaatgaagaaaggctcccaaacggtggggaaaataaagaaggcgttggattttatgaggaaccaacagctcgaggtgccctttatcgctttttacagaaaggagtacgttcaacctgaactgaacattaacgatttatggaaagtttataaatacgatgcgaagtggtgtcaactaaaatctcgcaaggaaaatcttcttaaactcttcgataaaatgaggcattatcaactggatcaactcgtaaaaaatccggacgctcctattccagacaacgtgcgagtgatgaaagattcggatatcgaacggctgaaaaacgtccaaactgcggaagaactcaatgatgttcacaatcatttcatattgtattattccggagacttgcctgccatgcatgccgcttggagaatcaaagaaaaagagcagcggaaattcgagaagcgacaaaaaagactcaagcaaattgccgaagcggaagaaggtgctgacattcccgatgaaccagaggatgatgatgatgacgaaccagaaatagaaactttgaagtatgctaatcgatctggcagttatgcattatgctctaaagctggattagatcctttggcaaagaaattcggtttatcacccgagcaatttgcggaaaatttgcgagataattatcaaagacacgaagtcgatcaagagcccgtcgaaccctccgatgttgccaaagactttatttctcctaaattttcaactgccgatgaagtattacaagcggccaaatatatggtcgccttgcaaatagccagagaaccgttagtaagaaaatgtgttagagaagtttattttgaaagagccaggcttaatgtatatccgacaaagaaaggacaaaaagtcattgatgagtctcacaattgttacagcatgaaatatttaaaaaacaaacctgtgagagatttgaatggagatcagtttttaaagttgtgcttggccgaagaagagaaccttctaactattacaattaacgataatatcgaaggaaatacatcaaactcttacatagaggaagttaaacagctctacatcaaggacgaatttagtaaaaatgtgcaagattggaacgcgttgagaatggagtgcgtagaaagggcgctaacgaagagcgttttgcccgatttgcgaacagaattgaagagaactttattatctgaagccaaagaattcgtccttaaggcgtgttgcaggaaactctacaacagcattaaagttgctccatactcgataacatttcccgatgaagacgaagacgagtgggatacatcgaaaggcgttagagttatgggattagcctacgttccagaatatacagtttcggcatttgcttgcatcgcagcacccgatggagatatcacggattatttgcgtttaccgcacatattaaaacgaaaaaacagtttcagaacggaagaaaaattaatgaaggaaacggatttgcaagccctgaagaactttatcttcttgaaaaaaccccacgtgatcgcgatcggcggcgaatccagagaagcgctgatgatagccgatgatttgaaggccttgattaacgagttagttgaatccgatcaatttcccgaaatcaaagtcgaaattatcgacaacgaattggccaaactttacgcaaactccaacaaaggccaggcggactttagggactatcccgagttgctgagacaggccatttccttggctaggaaaatgcaagatcctctcatcgagtactcgcagttgtgtaacggagacgaagaaatattgagtttgagattccatccattacaagaacaaataggcaaagaggagctcatcgaagccctgtgcctcgaattcgtcaacagaactaacgaagttggcgttgatattaatttggctgtacaacaggcgcacaaaagcagtctcgttcaattcgtttgcgggctaggccctcgcaagggtcaagccttgctgaaagtccttaagcagaccaaccaaaggctggaaaatagaacacagttggtgacggcatgccacatgggcccgaaggtgttcattaattgttctggtttcatcaaaatcgatactaacagcttgggagatagtactgaagcgtatgtggaaatattggatggttctcgtgtacatccggagacttacgaatgggctagaaagatggctgtagacgctttggaatacgacgatgatgaaggcgctaatcctgccggtgctttggaagaaatcctggaaacgcccgagagattgaaagatctggatttggatgctttcgccgaagaattggaaagacaaggatttggcaacaagagtatcacgttgtacgacatacgagccgaattgaactgtaggtacaaagatttgaggcagcctttccattcggctaatcctgaagagttgtttgatatgttaacgaaagaaacgccggaaacgttctacataggaaaattggttactgcttcagttataggtatcgcgagaaagaagcctaaacctgaccaactcgatcaggccaatcctgtcagaaatgacgaaacggggctttggcaatgtccgttttgtttgaaaaatgattttccggaattatccgatgtctggaatcatttcgatgccggtgcatgtcccggtcaagctactggagtcaaacttagattagacaatggaataatgggttatatttatataaagaatattagtgataaaccggtgtcgaatccggaggaaagggtaggagttggtcaattaattagttgtcgtataataaaaatcgacgttgaaagattcagcgttgactgtacgtcgaaatctagcgatttgttggataaaaaccacgaatggaggccaccgagagatccacattacgatacagaacgcgaagaaaaagacaacagaactgaggcggaaaagaaaaaggaaaaacaacgtttgacatacataaagagagtaatagttcacccggcttttcacaacatttcttacgccgaagccgaaaaatgcatggtcaatatggatcaaggtgaagtcatcatcagaccatccagcaaaggagccgatcacttgaccattacatggaaagtcgccgataacatttatcaacacattgatattagggaagagggaaaaactaacgcgttttctttgggtaaatcgttgttgataggcaacgaagagttcgaagatttagatgaaataatagcgagacatgtcactccgatggcggcgcacgctcgtgatttgctctacttcaggtattttaaagaattcgagggcggtcacaaagacaaggccgaggagttcctaaaagacgagaagaagaagaacgcctcgaaaatacattacgtcgttagtgcagcaaagcacttacctggtaaattcctgctttcgtatttaccgagaaataaagttagacacgaatacgtaacggtgactcccgaaggatttagattcagacagcaaatgttcgattcgattacgtcgctgttcaagtggtttaaggagcactttagagaaccaccgccgggcggaatgacacctggaacaccaagaatgtccaccggaagaacaccttatgatatgagtaccgaagctattcaaagagttgcgcaaaatcttcccagcgacatggtccaagctttatccgctgcaacgaatcaaactcctcactacccgcacactcctggcggttacggcggtaattacatcaatacaccgtacacgcccagcggccaaacgccctacatgactccattccaaacccctcacgcccaacaaacgccgcggtacggccaacagacgccgtcccagccgtcgctgagcaacccgttcctccatcccggcgccgtgacgccgtcgcaacggacgcccagctacaggaacctgtcgagccaaagtccgatgataccgcagagtccggtgccgagtccgggatcgcagagttcgtacagcagccacatgagccaccatacgagggcgagctacggggattcgatgaggttccagccgccggagtcgccgaggaattacccgagcagcaggggctcctatcccgatgggcggtacggtggcagcgaatcgatggattggcagaaggcagctgaagcttgggcttctaggtcgagatgtaagtgttttgtggaggtttatagatatcgaatgattgtttttttattgtttagcaacgccacgaagcgaaggtcgggggactcccaggtcgtctggtcacagaactcctcgtaa

SEQ ID NO: 965 - DNA, 2250 bp, Phyllotreta atra
atgctaacttcccgaacaggaggagcttacataccgccagcgaagctccgtttgatgcaagagagcataacggacaaatcttcggctgcttaccaacgtatcgcctgggaggcccttaagaaatcggtacacggttacatcaacaaaatcaatacgtctaacatcggtataatcgccagagaaatcctgcacgaaaacatagtgagaggcagaggtctgctttgcaaatcgataatccaagcccaagccgcctctcctactttcaccaacgtttatgccgccttagtggccgtaatcaattccaaatttcccaatatcggggaattgttgttgaaaagactggtgctgcagttcaaaaggggctacaagcagaacaacaagtccatttgcatttcggctactacgttcgtagctcacttggtaaaccaacgggtggctcatgagatactggcgctcgaaatactgactttgctcgtcgaaactcctactgatgattccgtggaagtggctatttcttttctcaaagagtgcggacagaagctcacggaagtctcgagtaaaggaattactgccatattcgagatgcttagaaacatcctgcacgaaggccagctcgagaaaagaatacagtacatgatcgaggtgatgttccaaattagaaaggacggctttaaagatcacgccgctgtaaccgaggaattagatttagtagaagaagaggatcaattcacccacctaatcatgcttgatgacgtaaaggaggttaacgctgaagatattctaaatgtattcaagttcgatgaacattacgaagaaaacgaaggcaaatacaaaactctgagtaaggaaatcttgggaagcgatagcgaatcggaatcgggatcggagggatccgaagaggaatcggagggcgagggcgaggacgaagaagtcaaagatgccgggaaaatcatcgacaataccgaaacgaatctaatagcccttagaaggacgatatatttgactatacaatccagtttggatttcgaggaatgcgctcataagcttttgaaaatggagttaaaacctggacaagaaatcgaattatgccatatgtttttagattgttgtgccgagcaaaggacatatgagaaattctacggactgctagctcaaaggttttgccagataaataaaatatacatcgagccttttcagcaaatattcaaagacactttcgccactacccatcggttggacaccaatagattgaggaacgtcagcaaatttttcgcccacttgctctttacggacgccataggttgggaggtgttcgagattatgaaactcaacgaagaagacactaacagctcgagtaggatttttattaaaattttgttccaagaattagccgagtatatgggattgggaaagttgaatgcgagattgaaagatgaaacgcttcaacaacattttgcgggattatttcctagagacaatccgaaaaataccaggttttccattaatttcttcacgtccatcggtttaggaggtttaacagacgaacttagagagcatttaaaaaacgtccctaaaattatggaaattaaaacgaccgccgtgaaggaagaaagcgaaagtagcagcagtagcagcagcagcagcagtagtagttcaagtgaagaagatagcagtgattatagttccgggagcagtagcagtagttcaagtgaagaagatagcagtgattatagttccggggattcgagttcagaggatgaaaaacaaagggaaaaatcgaaaaagaagaaaaagaaacgcgattcggaaagcaaatcttcaaaatcggattctaaaagtaatcctaaagacgaaaagcgcgatagaggtaagcacaagaagaataaggacaaggaagatcgtaaagaaacccataaaaataaagaaaatagaagcgattcggacaagcacgtttcaagggagaaacaaaactcgaggcaagataaaagaaaagatgacggtgacgttaaggaaaaacccagaaaagatgatagggatgacagggagaggcaacggaggaacgaagaaaagggcgggaggaaaaaggactatgaatgggtgaaaagtagacacgaggataacatacatcaattaaaaacatctaaaaaagtgtttgaaaaaccatcaaagcacaggtcgaggtcgagggagaaaattagtagtaaagaaaaggacagaaagcataggagtaaagaaaggcgaaaaagttga

SEQ ID NO: 966 - DNA, 1821 bp, Phyllotreta atra
atgcattttacagcaagcagataccattctcattgccagttgaaaaaccaagtcggtcaaaaaataatgaacgaggtgataaagcataaagcctccaagaagaacggacctgcagttacacagccccacaacgctagtggtgttgactggagaatcctggtggtcgatcaactggcaatgagaatggtatcggcttgctgtaaaatgcatgacatatctgctgagggtattacattggtcgaagatataatgaagaagagagaaccgcttgctacaatggaagctgtgtacttgatcacgccttctgaaaagtctgttcatgctctcatgaacgatttcgaatctccgagacccatgtatagaggagcacatgtatttttcacagaagcatgcccagacgaattatttaacaaattaagtaagagtcatgcagcaaaatatataagaacgttaaaagaaatcaacatagcatttataccctcagagtcacaggtattttctttagattccccagacactttccaatgtagttacgatccttcctttgctgccgcacgaaatgcgaatatggaaagaatggccgaacagattgcaacattgtgcgccactttgggggaatacccgcacgtccgatataggagcgactgggaacgtaacgtagagttggcgcaattgattcagcagaaattggatgcttacaaagcggacgagccgaccatgggagaagggccggagaaggcccgatcgcaattgctgatcttagaccgaggcttcgattgcgtgtcacctttactccacgaactgacgttccaagctatggcctacgatttacttccaatcgaaaatgacgtgtacaaatacgaggcttccgctggggtacaaaaggaggttctcttggatgaaaatgacgagctgtgggtggagttgcgccatcaacacatcgccgtggtatcccaaagcgttactaagaatttgaaaaagttcaccgattcgaagcgcatgactcaaagcgataaacaatccatgaaggatttgtccactatgattaaaaagatgccgcaatatcagaaagaattatcgaaatacgctactcacttgcatcttgccgaggactgcatgaaggcctaccaagggtatatcgataagttatgcaaagttgaacaggatttggcaatgggaactgacgccgaaggggagaaaattaaagatcacatgcgcaacatcgttccgattcttttagataccaaaataacgaacgaatacgacaagatgcgcatcatagctttgtacgctatgaccaaaaatggaataaccgaggaaaatcttacgaagctagcaacacacgcccaaattaaagacaagcaaactattgctaaccttcagcttttgggagttaatgtcattaatgatggtggccccagaaaaaagatctacaccgtaccgcgcaaagagcgaattacagaacaaacttatcagatgtcgagatggacacctgttattaaagacatcatggaggattgcatcgaagacaaattggatcagaaacatttcccctatctaagtggacgagcgcaaaccacaggatatcacgcagcaccgtccagcgctcgatatggacaatggcacaaagatagaggtcagcaggccgtcaagaacgtcccgcgtttgctggtcttcgtcgttggaggcataagtttctctgaaattcgctgcgcgtacgaggtaacaaacgcccagaagaactgggaagtcataatcggatcgtcgcatatccttacaccagaaggtttcctcagtgatttagcgacgttagccggctag

SEQ ID NO: 967 - DNA, 2139 bp, Phyllotreta atra
atgatgcaacaatatatgaaagagttagaacaagagcctttcgatgccgaagaatttgtggaacgtttagcctggagaactttagctgaatcaaaaagcgagggagaggaaaatgaaattaatccggcgcttcttcacgagtcctttgttcaagccataaaggaccttaatttattgcacgaaaggcaacagaaaaaatgcgaaaaattagaagtcgccgttagagaagacgaagcgacgttttttcaagaagtttacaatttattggaacaaaataagcaagctatggatacatttcaagaactggacggcaaaattaatcatgtagcaaccaaagttctccacttgggtgatcagttagacagtgtcaatggtcccagatccagagttgtcgatgcattaagcttaatgactcatttaagagaatttttatcgaatgagccagtttcatccacaatatttaccaatgaagaatacattgatgaagcagctgacgtgattcaaaagttgtatttaatatcgcaagatttgccacccaagtttgaatcgataaaaagaaaaatagaaaggaagtattcggatattgaaaaaacgctaatagaagagtttgttggggccatggataatgagaatttaacaagaatgaaggagatagcgttggtactgtcccaatttaaaggctactctcagtgcattgactcctatatagatcacagccaagtgggttgtttatctagtaaagatgtcttctataactttttgaatttgtgtaaatacaatgatgaaataattcgaaaagttttcaagaatccagagcaagtgatggcgaaattcgttttaaatatatatcagctaaaattagtggaatatatagatcaaaaactaaattctaaattgggtacttacagctatttacaaacattatatgaactgtattccaagactaatcatctatcaagcgaattaaccgtttttcatatgggaaacgacaaaaactatctctctaaactaacgacaaatatttttaataagtacattaacgattacatttctatggaacttaagtgtctgaaagacagatgttcaactaacttacaaaaatattacgattcgaaaaatcatcaaaagaaacagattcagtctgggggctttcaagatcttagaagagacttacaagcagtaataggcacaagggcaaacattaacatagcacaaatagaaaattatggcggcgagactttcttatctgaggaattggcaatcatgatccttcaagatactaaacaagcttttcaacgttgcttattgttatcaaaaggtagtgaaagggcttccaacgccactcaaattttagacaggcttattaatagtttgctgatagaacatgtagactatgcagttgaattgggtctacacgctgtacccgttgtcgaaggcgttagaaatccccctgttttgtatttttttaacatcgttcatcagagtaataatataacccatctcgtcgagaaacagttcatggatttggtggttccattagtagaaaatacttcgaaatatagcgattgcgtacagaagaaaaaatttgttttggaggatatagaaagaaaaattaatacgggattggatagatgcttgagtgcgatattaaattgggtgaagttgtatttacaatctgaacaaaagaaatcggattttaagccagagtctgatgattttgatacagtggcctcaccagcctgcaagaacgtacttaattatgttaatagtattgtcaaagaaattaaaactaatttggatggcaataatgtaacagctatccttcaggagttagggattagactgcatagagttgtttacgagcacttgctgcagtatcaatataacactgcaggtgcaatggtggcaatttgcgatttaaacgaatatagatcttgtactaaacaattaggtcctttagttgcggagctttttgatactttacatgctttgtgcaatcttttgctggttaaaccagaaaaccttcaacaagtgtgctctgaagattctttggttaagttagacagagcgatcctccatagttttatacaactacgaagtgattttaaagttcaaaagcagactattttgaaagtttag

SEQ ID NO: 968 - DNA, 813 bp, Phyllotreta atra
atggatttccaaaacagacctggtgggaaaacgggcggaggcggcgtcgcctcctggtcggaaaccaaccgagaccgcagagagcgactgaggcaactggccttagaaaccatcgatctgcagaaagacccctatttcatgaaaaaccacctggggtcttacgaatgtaagctttgtttgacgctacacaacaacgagggcagctacttggcccatacgcaaggcaaaaagcaccaagccaatttggccaggagggcggccaaggaagctaaagacgcccccacgttactccaaccggagaagcctcgagtggagcccaagaagttcgtgaaaatcggtagacccggttatcgggtaaccaaacaaagagaccccgaaactggtcaacagagtttactgttccaaatcgattatccagaaataagcgacttggttctgccccgacaccgcttcatgtctgcgtacgaacaaaaaatcgaaccccccgaccgtaaatggcaatacctactcttcgctgccgaaccgtacgagaccatcggcttcaaagtgccgagcagagaagtggaaaaaactgacactaaattttggacgcactggaacagggacaccaagcagtttttcctgcaattcgcctttaagaacgagaacaaacgcaacgttaactcggtagttcaaaggcattcgatcgttggcggcgttccaccgcctcccatgctgccggtaccgccgccacccaggcctcctatgtttaatcccattccaccgccaccgccgatgatgagggccgttttgccagtaccccctccgaattaa

SEQ ID NO: 969 - DNA, 402 bp, Phyllotreta atra
atgtcgatcggtgtacctattaaggttctccacgaagccgaaggccatattataacctgcgaaacgataaccggcgaagtttacaggggtaaacttatagaagccgaggataatatgaattgccaaatgacccaaataactgtaacttacagagacggacgagtggcgcaattagaaaacgtttacattagaggttccaagataaggttcttgatattaccggatatgttaaagaacgctccgatgtttaaaaaacaaaccaaagctggcactgctggcagagggaagtctgcaattctacgagctcaagctcggggaagaggccgagggcaaccgcctgttcgaggaggcagaggggcttggcagaatcagcaaaacgcccctgcaggtcgagcaaaatag

SEQ ID NO: 970 - DNA, 1329 bp, Phyllotreta atra
atggctacaaatctatcacgaacatcgctcctgcgaatcattaacgctaggggctacgcagcctgtccccatccactttctggcgttccaaacgcagaagtaaaaagcaccgtactccccaacaaaacggttgtagctgctgtcgacaacaacgcagccctcaccagagtttcgatcgtattcagggctggaagtcgtaacgaagatcccgacaatttaggcgtagcccacgtgttgagatcggccgcaggtctgagtacgaagaactgttcgcaattcgctattattcgcaacattcagcaactaggggccaatttaacggccacttccgatagagaaactatctgctacacgttggaaggcaccccggaagctgtggaatgcgctataccattcttaaccgaagtagccacccaacaggaattcagaccgtgggagatttccgaattgtccggtagattgcagttggacattgctacaagaccgttgcagttgagagctatcgatttgctgcacaacgctgcctttagaggacgcggcttgggtaattctctatttattccgaaaactcaaatcggtaaaatttcgtccgaaaccctacaacactacgttgcctcgaacttcgtgagcggccgcatggccgtagtaggctcaggtatctgtcaaaaggaactgacatctttcgcaaactccttgaaaattgaaaatggcgaaggcaacaacgctccttcaccttacgtaggaggtgaactaagatcgaacaaaggcggtcaactagcattcattgctgtagcaggagagggtgctgctatcacgaacaccaaggaggctctggctttcgctgtgctgcaaggagccttaggaggaggcccgcaggttacacatggagtttgtgacaacggtgtcttcaggaaggctctgggaagcaaccccaatgtcagttcagtggccataaacgccagttactcagacacaggtctctttgggcttctgctggctgtaccaacgaagtctgcaggaggtgctctggaagcagctgttaaagtgctcaagagtggatcggtgtctgatgaagatgtccgcagaggtaaaaatcaattgaaaacgtcgattctctttggggctgaaagcggagctgatattgtaagaagaattggacaggaagctgttttgacgcaaaaagctaccagtgttgatgcacttgtggctgatgtagattctgtttctaccagtgatgttgcaaatgctcttaagaaagcaggcaagaaattgtcattagcgtctgttggaaacttggccggagtaccatttttagatgaactaaagtaa

SEQ ID NO: 971 - DNA, 333 bp, Phyllotreta atra
atgaggagagcccacgctggtaactactacgagccactgccgcagaattccaacgaaattgaagatgaaaatgatcggatgactaacgaactacaagagaaaatcggagccctaaaatccctcactattgatataggaaatgaggttaaataccaggacagaatgctcagggatgtcgatgacgatttggagaaaaccggaggcttcctgggaaccaccatgaacaaagtgttgaggctgtcgaaagggggccacaattacatcattgtgtatttgtttttattttcgattgttgtattttttatactttactgtgttattaaatttaggtag

SEQ ID NO: 972 - DNA, 1491 bp, Phyllotreta atra
atgtcttacccatcgacgttaaactcaaaacaggccgcacaggagcacggtttggccgtgtccagagactttgtatcccagccgatgctcacttacaaaacagtgtctggtgtcaacggaccgttggtaatcctcgaagatgtcaaatttccgaaattcaacgaaatcgtccagctcaaactggccgatggcagtctacgatccggtcaagtattggaggtgagcggctccaaagccgtagtacaagtgttcgaaggtacttcgggaatcgacgccaaaaacaccgtgtgcgaattcaccggcgacattctcagaaccccagtgtccgaagacatgctgggcagggtgttcaacggctcaggaaaaccaatcgataaaggacccccgattttggccgaggacttcttggacatccaaggtcaaccgatcaatccttggtcgcgtatctacccggaggagatgatccaaaccggtatctccgccatcgatgtgatgaactcgatcgctcgtggccagaagatccccatcttctcggcggccggtctgccccacaacgaaatcgccgcccaaatttgtagacaagccggtcttgtcaaggtgcccggcaagtcggctttggacgatcacgaagacaacttcgccatcgtgttcgccgctatgggagtcaacatggaaacggctcgtttcttcaaacaagatttcgaagagaacggttcgatggagaacgtatgtttgttcttgaatttggccaacgatcctactattgagagaatcatcacgccccgtttggctctaacggctgccgaatttttggcctatcaatgcgagaagcacgtgttggtcatattgactgatatgtcttcgtacgctgaagctttgcgtgaggtatccgccgccagggaagaagtgcccggtagacgtggtttccccggttacatgtacaccgatttggccaccatttacgaacgagccggtcgtgtggagggccgcaacggctccatcacccaaatccccatcttgaccatgcccaacgacgatattactcacccgattcccgatttgaccggttatattaccgaaggacagatctacgtcgaccgtcagctgcacaacaggcaaatttacccaccgatcaacgtcttaccgtcgctgtctcgtctcatgaagtccgccatcggcgagggaatgaccaggaaagatcactctgacgtttctaaccagttgtacgcttgctacgccatcggtaaggacgtccaggcgatgaaggccgtggtgggagaggaggccctgacgcccgacgatttgctctacctggagttcctgaccaagttcgagaagaacttcatatcgcagggcagctacgagaaccgtacggtgttcgaatcgctggacatcggctggcagttgttgcgtatcttccccaaggaaatgttgaaacgtatcccggccgccacgttggccgaattctacccgagggactcgcgtcactag

SEQ ID NO: 973 - DNA, 492 bp, Phyllotreta atra
atgaacgaaatacgcgaacgcgaaagggcaggaatacgagtccccgatgaattacgagccatgttactcgaattcacttgcagctatttgctagaacagcccgaagatgtagtatcgtatgcacaagaatacttcactaaatttaaagaaagtagaggcactgcgttgatatatgatcaggacatgtacgaagaggaaacgatgggtatcaaaacagtcttggctcgccaaatcttcgactccagaggcaacccgaccgtcgaagtcgacatcaccaccgagttggggctcttcagagcagccgtaccatcaggagccagtactggtatctacgaagccctcgagctccgcgacaacatcaaaaccgaataccatggcaaaggcgtgagtcaggccatcaaaaacatcaacaccatcatcgcccccgagctgatcaaggccggcttcgaggtgacccaacagagggaaatcgatgagtttatgattaactag

SEQ ID NO: 974 - DNA, 2343 bp, Phyllotreta atra
atgagttacatgcagactaaccaaaatagaccaatgtctcaaggttatcatcagggagccaacgatctcccaatgcagtcgtccaaagaacagaccctgctgtggcagcagaactcctacatgggagactcaggcatccagtcaggcgctgccactcaagtgccatcgctctccggcaaagaagaggaagagatggacctcttcgatctcgaccagccctaccaaggattcacgcaagagcaagtagacgaaatgaacaaccagttgaaccacaccaggtctcaaagagtgagggcagctatgttccctgaaaccttggacgaagggatcgagattccttcgacccagttcgatccgaaccatcaaacggcggttcaacgtttggcggagccaagccagatgctcaaacacgctgtggtgaatttaatcaattatcaagacgacgctgacttggcgaccagggctataccggagttgatcaagctgctcaacgatgaggatcaagtggtggtatcgcaagccgctatgatggtgcaccagctctcgaagaaagaggcgtctcgacacgccatcatgaacagcccccagatggtggccgctttggttcgagccatctccaattccaacgatttggaaaccaccaaaggcgcggtcggcacgttgcacaaattatcgcaccacaggcagggtttgctggccattttcaagagcggtgggatcccggcgctcgtgaaattgttgagttctccggttgaaagtgtgttattctacgctataaccacgcttcacaacttgttgctgcatcaggatggttcgaaaatggcggtcagattggccggaggattgcagaagatggtggctttgctccagagaaaccacgtcaaattcttggctattctcaccgactgtttgcaaatcttggcttacggcaatcaagagagtaagctcatcatactcgcctctcaagggcccatcgaattggtcagaataatgagatcatacgattacgagaagctgttgtggactacttcgagagtactgaaagtgttgtcggtgtgttccagcaataaaccggctatagtagaagctgggggtatgcaagccctcgccatgcatctgggcaaccccagcacaaggttggttcaaaactgcctttggaccctcagaaatttatcagacgcagctactaaagtcgacggattggagagcttgttgcagtcgttggtgcaagtgctgcaatcgtccgacgtgaacgtggtgacctgcgccgccggcatcctgtcgaatctgacgtgcaacaatcaacgcaacaaagtgacggtgtgccaggtgggcggcgtcgacgccctggtgcgcaccatcgtcagcgccggcgatcgcgaggagatcaccgagccggcggtgtgcgccctacggcacctcacctcccgccacgtggagtccgagatggcccagaacgccgtgcggctgaactacggcatacaagtgattgtcaagctgttgaacccgccgtcgcgttggccgctggtgaaggccgtcatcggtttgattaggaaccttgctctgtgtccggccaatcacgccccgctgcgcgagcacggcgccattcatcacttggtgcagttgctgatgagggctttccaagacactcaaagacaacggagtagcgtcgctagtggtggcagccaaccgcccggaacgtacgcggacggtgttcgcatggaggagattgtagagggaacggtgggagcgttgcatatattggcgagagaatcgcataatcgggccatcattagacagcaaatggtgattccgatattcgtgcaattgctgttcaacgatatcgagaacatacagcgcgtcgccgccggcgttctttgcgaactggccgccgataaagagggggcggagatgattgaaaacgagggcgccacggcccctttgactgaattgttgcattcgcgaaacgaaggcgttgctacgtatgcagctgcggtgttgtttagaatgagcgaagacaaaccacaggattataaaaaacgactgtctatggagttgactaattctttatttagagaagaaaatctttggaatcccgatctaggcatgggtccggatttgcaggtatgttacaagtttgtattgtttgaataccgttactcgaaatgtgagtggggtatgtattatcaaagtatcgaatttggcatgaacgctcttgctaccgtttttagtatattatttatgattattttgaagtatatttattcgacggtatatttttttattttcgttttgttttgttttttgcatttttttttgtttgctatttttaggatattttaa

SEQ ID NO: 975 - DNA, 801 bp, Phyllotreta atra
atggcccggaacgctgagaaggcaatgacaacattggccaggtggagggcggcccaactaggcgaaatcgacaagcacaaaaaacgccggccctatttagcttcagaatgcaaaagtctgtacgcctgcgagaagtggcgcatgcagataatcagggaaatagcgaaaaaagtggcccaaatacagaacgcaggactcggggaattccgcattcgcgacctaaacgacgaaatcaacaaactcctgcgcgagaaacgccattgggaggaccaaatcaaggagctaggcggccccgattaccaacgagtcggccccaggatgctggatcacgaaggcaaagaagtccccgggaacagaggctacaagtacttcggagccgctaaggaattacctggcgttcgagagctgttcgaacaggaaccgccgcccccgccgaggaagagtcgcgcggaactgatgaaggacatcgatgccgattactacggctacatggacgacgacgacgggatactgatacctttggaaatcaaagctgaaaaaacagccgtacaaaatgcgatagccgaatgggtgaacaacaaggaaaagaacctagactctaccaaaggaatcgaagagagtatctacgtggtggaggattcggatgaagaagatgtcgttcaacagttcgatggttcgcaacagagattcgtagcccacgtaccggtgccatcgcaacaggatatcgaacaggctttgttgaggagaaggaagcaagagttgatggagaaatatggcgtacaggacgagcaggatgtatga

SEQ ID NO: 976 - DNA, 645 bp, Phyllotreta atra
atgacacaacaagatatcccaacattcaagtgcgtgcttgttggcgacggaggtacaggcaaaacaactttcgtcaaacggcacttaactggtgaatttgaaaagaagtatgttgcaacactaggagttgaagttcatccactggtttttcacactaacagaggcccaatccgattcaatgtttgggatacagcaggacaagagaaatttggcggtcttcgtgatggttattacattcagggtcagtgcgctatcgtcatgtttgacgtcacatcacgagtaacgtacaaaaatgttccaaactggcatagagatcttgttcgtgtttgtgaaaatatcccaattgttctctgcggaaacaaagttgatataaaagaccgcaaagtcaaggccaaaagtatagtttttcatcggaagaaaaatcttcagtactacgacatcagcgccaagagcaattacaactttgagaaaccatttttatggctggccagaaaattgatcggggatgctaaccttgaatttgtagcgatgcctgctcttgtacctcctgaagttgtaatggatcctcagtggcagacccagattgagaaagatctcagggaagcccaagaaactgcattgccagatgatgatgaagacctatga

SEQ ID NO: 977 - DNA, 159 bp, Phyllotreta atra
atgatctacactaccgtatcccttataagtctctgtttcgccagcggtgatcacaaaacatctttcaccgatattttaatgaacatagtcggtgtgttcatgtgggtggccgttggagcaacagcacttcactactggctcggttatttgtcagaatag

SEQ ID NO: 978 - DNA, 2517 bp, Phyllotreta atra
tcaatcttcaaaatgccaagaataatgataaagggtggtgtttggagaaacacagaggatgaaattcttaaggccgccgtgatgaaatacggcaaaaatcaatggtctagaatagcatctctgcttcacaggaagtcggcgaagcaatgtaaagcccgttggttcgagtggttagaccctagcataaaaaaaaccgaatggtccagagaagaagatgaaaagttgttgcacttggctaaactaatgcccactcaatggagaaccatcgcgcctataataggcaggaccgcagcccaatgtctagaaagatacgaatatttactggatcaagcgcaaaaaaaggaagaaggcgaagatgcagtggatgatccgaggaaactaaaacccggagaaatcgaccccaatcccgaaaccaaaccagcccgacccgatcctaaagacatggacgaagacgaattagaaatgctttccgaagccagagccagactggccaacacccaaggcaaaaaagccaagcgtaaagctcgcgaaaagcaattggaggaagcccgccgtttggcggctttgcagaagcggcgagaactgcgagcagccggtatcgaagtcacctcgaggcgcaagaagaaacgaggcgtagattacaacgcggaaattccgttcgaaaaacaaccggctatcggtttctacgacacttccaacgaagccctcgacttgatggccccggatttctccaaaatgagacaacagcatttggacggcgaactcagaagcgaaagggaagagagggaacggaagaaggataagcaaaagttgaagcaacgcaaggaaaacgacattcctcaagccatgctgcaaaacgaggaacccgctaagaaacgatccaaactggtattgccggaaccgcagatatccgatcaagagatgcaccaggtggttaagttaggcaaagcgagcgaaacggccagagaaatcgcaacagaaagcggagtcgaaaccactgacactctacttaacgattacatgttcacaccgcaagctgccgctactccaagaactcccgcgccccaaactgacaggatacttcaagaagctcagaacatgatggctcttacgcacgtcgatacgcctcttaaagggggtttgaacacgcccctgcataactcggatttcagcggggttctgccgcaatcgcaagcgattaccactcctaatacggtactcgctaccccgttcagatctactagaagcgatgggggagctacaccgggaagtactgccggattcatgactcctaaaagcggagccctgactcctgttggcaaaaacgcgacgccttctatcagagataagctgaatattaacgccgaagaaagtttagatgtgggaagtactccggccgaacatcgaatgtttcagatgtcgatgaaagaccagttgaaacttggattgagcagcttaccacaacccaggaacgattatgagattgtcgtgcctgaaaatgaagcgcaggatgaaccggaagaagcccaagctcaattggtcgaagaccaagcagatgtcgatgctagaaaacaagaagaactgagagccaaagcggctcaagaattagcatcgcgttcgcaagtcatccaaagggaattgccgaggccccaagaggtgaatttgaccgtgctgcgaccgcccaacgaaagctactccttaaccgaccttcaacgagccgaagagttgattaaatgcgaaatggttactatgttgcaattcgacaacctgaagaatcctttaccagcgcaaagtaagcgatccaacatgtcgcaagcccagcaattggcctttctcgagcaacacccttacgactcgttcaaaaaggaagatttagaggtggccaaaacgctgttgagaagcgaaatggacgtggtgaaaagcggcatgaatcacggggaattgccgttggaggtgtacaatcaagtgtgggaggagtgtctgagccaagtgctgtatttgccgaaccagacgaggtacactcgcgcccatttggcgagcaagaaagatagattggaatccgcggagaagcggctggagcagaatcgatcgcacatggccaaggaggcgaagcgcgccgccaagatggagaagaaattgaagatattaacgggcggttatcagtccagggcgcaggtgttgattaagcagttgcaggatcagtacgagagcatcgatcagtcgacgttggagttgaacacgttcaaattcctggccgagcaggagaagaacgctttgccgatgcgaatacagtctcttactgaggacgttaataggcagatggaaagagagaaggtacttcaaatgaagtatgcagattaccagggtcaaattaaagagttgcaagaggagtatttagttcaaatgcaaactgttccaaatgaagaaacaagtaaatatgacgaagtcacttcgaccaccaatgaagaaaatggtatggatacgtcggaaaatgataaaattactgctgagaactaa

SEQ ID NO: 979 - DNA, 474 bp, Phyllotreta atra
atgatgcaatttatgttattgttcagtaggcaaggaaagttgcgattgcaaaagtggtatgtggctcatcctgataagctgaagaaaaaaattacaagggaattaattactaccattcttgccagaaaaccaaaaatgtgcagttttttggaatggagggatttgaaaatcgtttataaaaggtatgccagcttgtatttttgctgcgcgatagaacaatgcgacaatgaactgctaactttggaaatcattcatcgttacgttgaacttttggataagtacttcggaagcgtatgcgaattggatataattttcaactttgaaaaagcgtatttcattctggacgagctgatgcttggtggcgaggtgcaggaaaccagtaagaaaaatgtcctgaaggcaattgctgcacaggatctcctacaagaggaggaaacgccgcaaggattcttcgacgatcatggattgggctaa

SEQ ID NO: 980 - DNA, 1251 bp, Phyllotreta atra
atgtatggattacaacgatactcgttttgttataccctcaaaaatgcggtgcgttattactcgagagaacccgccaagagatcgtcgtttctcagccgcctgtacgacaatttcaaagacgaaatgaacaaaaacaaagaaatgaaagaatccctaaaaaaattccgcgaagaagcccaaaaactcgagcaaagcgacgctctaaaagccgcccgacagaagttcgaaaccgtagagaaagaggccagtaaaagcggcgaagtcttcaaagagagtttaggttccattaaagaaagagtcaaaggagtaatagacgaggccagtaagtcagatttagccaaaaaggctgggaagtttaccgaagaagtggggaaaaccacgcacaaaatcagcgaaaccgcacaggaaatcagcaaaaccggagcctttcaaagcatatcggaagccaccaaagccgttaaacaagaaatcgacaacaccagcatggaaggtcgagtgtacgtcagccctaagaagcttcgaaaacgaaccgaaaccagcgcagtggtccaacaaaagtactacgaaccgaacacagacgccaccggcgtagagctacacaaagactccaaattctacgagtcctggcaaaacttcaaaaacaacaacccctacgtgcacaaagtcatggactggaaactcaaattcgacgaaagcgagaaccccatcatccgagcctccagggcgctcacagaaaaagtaggagacataatggggggactgtttcagaaaaccgaactctccgaaacccttacggaaatctgcaaaatcgaccccgacttcgacacgaaacggttcctaaaacaatgcgaaaccgacatcatccccaacatcctagaagccatgaccaggggcgacttggacgtcctaaaggactggtgccacgaaggccccttcaatttattcgccgtgccgatcaaggaggcctacaagaaaggctacaaaatcgaatcgaagatcctagatgtagaccatgtagatctagtgatgggtaaagtgatggatcagggccccgtgttgattatttcgtttacatcgcagcaagtgatggccgtgcgggatccatcgggggctgttgtagaaggcgatccggacagggtgatgagggtgaattacgtgtgggtgttgtgtagggatgtggtcgagcctgatccgagggcggcttggagattgctggatctgtcggcgagtagtaacgaacagttagtgtaa

SEQ ID NO: 981 - DNA, 909 bp, Phyllotreta atra
atgagtagcagtgattcagaattaaacgatagtgacgctgagttgcaacaagcgttattagatggtaagctgaaacctggattaaataaaatcgaacaggccccaaagcaattcgtaaacaacgtaagtggtttaaatcagaaaatcgaagagttcaaattgaatctgccatggatcgaaaggctggattgtacgaacgcccaagcccccttagcgcccgaattagcggaagagatgttagctcacgaagaaaaaagaagtaatcaactgcgaaacaacaaaaagcttccccaattccaaccgtcggaagatccagttctaaacgattttaaacgagaactaatattccacaggcaagctcaagccacaattctagacgcaattccgaaaatcaaagaattagggatatctactaaaagaccagacgattattttgctgaaatggcgaaatccgatgagcaaatgcacaaaatcagagagaatctgaagcagaagcaggagcagcagaagcggagtgaaagggtgaagcaattgaggcagcaaaggaaagagggcaaatcgctgcaggtgcagctgaagctgcaacgctctaaggagaagaaggaaatgatggatcaagtgaagaaagcgaaaaaaaatttcgattttctggatgagaaaaacaagcccatgggaaagaataaggtggcggaaaggcgcaagatgaaggacaagaaattcggttttggtggtaagaaaaagggaatgaagaaaaatacaaaggacagtgcgggcgatattagtgagtatagaaatcctggaaaagccaagaaacagatgggaaacaaattcgtcaataaaaacaaaccgaaaaatcaaagaatgggtaaaaataggagaattaaaactaaggctaaaggaaaaaaataa

SEQ ID NO: 982 - DNA, 3762 bp, Phyllotreta atra; identical to SEQ ID NO: 956

SEQ ID NO: 983 - DNA, 1872 bp, Phyllotreta atra
atgaatcccagcgccccaaattatcctatggcgtctctgtacgtcggggatttgcattccgatattaccgaggccatgctttttgaaaagttttcatcggctggccccgttctatccatccgcgtctgcagggatctgataacccgcagatctttgggttatgcctacgttaacttccaacaacctgctgacgccgaacgtgccctggacactatgaatttcgacttgatcaaaggcaggcccattcgcatcatgtggtcccaacgcgacccttctctgcgaaaatctggagttggcaacgtgttcatcaagaacttggaccgatccatcgataacaaggccatgtacgatactttttctgcgttcggcaacatcctcagctgcaaagtggctcaagacgagagcggagtcagcaagggatacggtttcgttcacttcgaaaccgaagaagccgccaacaagtccattgaaaaggtaaacggtatgctgttgaacggcaaaaaggtctacgttggtcgcttcatcccgcgcaaagaaagggaaaaggaattgggcgagaaagccaagctcttcacgaacgtttatgtgaaaaatttcggagaggacttgtccgaggaacagctgagaacgatgttcgagaaatacggcaagataaccagctacaaaataatgagcaaggacgatgggaagtcgaaaggattcggattcgtcgcattcgagagtcccgaggcagccgaatcagctgttgaagccctaaacggcaaagaaatattggaaggcaaacctctgtacgtcgggcgggcccagaagaaggccgaacgccagcaggaattgaagcgtcgcttcgaggctctaaaaatggaaaggctcaaccgttaccaaggcgtaaatctatacgtcaaaaacttggatgataccatagacgacgaacgccttcgcaaagaattctcaccgttcggcaccatcacctccgccaaagtgatgatggaagaaggccgcagcaaaggcttcggcttcgtttgcttctcctcgccggaggaggccaccaaggcggtgaccgaaatgaacggcagaatcgtcggcacgaagccgctctacgtggccctggcccaacgcaaggaagaccgcaaggcccacttgacctcgcagtacatgcaacgcatggcgaacatgcgcatgcaccagatgggccagttcatccagccgggcggctccagcggctacttcgtgcccaccattcaagcgacggcgccgcgattctacgggccggctcagatgccgattcgcacgagcccgagatggccggcgcagacgcccgtgcgccccggcgcccaagggagcaccgccacctacaccggcatgccgaacagctacagggccgccgccagaccgccgggccagtcgacgatgcgcagcaacatcagcgtgccgcgacccatcaccggacaacaaccaccaagtatgcacggtcgtccacttgttggacaaggtgtagctgctgctggaaatcgcgcagccaacttcaaatacaccgccaacatgcgtaatccaccgcaagcgttgttacccggagctcaagctcaagtacagcaagcagtccacattcaagggcaggaaccccttactgccaccatgctggccgccgctcctccgcaggagcagaaacaaatgttgggagaacgattgttccctctcattcaaagaatgtattcagatttggctggtaaaatcaccggtatgttgctggaaatagacaacacggagctgttgcacatgctggaacatcaggaatcgctgaagaacaaagtggaagaagccgtggctgtactccaagcccatcaagctaaacaagctgctataaaaaaagattaa

SEQ ID NO: 984 - DNA, 2601 bp, Phyllotreta atra
atgaccgactcaaagtattttacaaccaccaaaaagggagaaatattcgaattaaagtcagaactcaacaatgataagaaggagaaaaagaaggaagccgttaaaaaggtcattgcttccatgactgtaggcaaagatgtctcagcattatttcccgatgtcgtgaattgcatgcaaactgacaatttggagcttaaaaaattggtttacttgtatctgatgaactacgctaaatcgcagccagatatggctattatggcagtcaatacctttgttaaggattgtgaagatccgaatccactgatcagagcacttgctgttagaacaatgggatgcattcgagttgataaaatcactgaatatttatgtgaacctctaaggaaatgtctgaaagatgaagatccttatgtcagaaaaactgctgctgtttgtgttgctaaattgtatgatatttcatcaggcttagttgaagatcagggattcctcgaacagttaaaggaattattaagcgattctaacccgatggtagttgcaaacgctgttgctgctttgtctgagatcaatgaaagcagtcctacaggtcaacctcttgttgaattaagcaccaacacaataaataagcttctcactgctctaaacgaatgcaccgaatggggccaagttttcatactcgattccctgtcgaactacactccccgagacgagcgagaagcccaaagtatatgcgaaaggatcactccccgtctagcccacgctaacgccgctgtcgtactatcggccgttaaagtattgatcaaaatgatggagattttggcgggcgacactgaattctgtaacacgcttagcaaaaaattagcgccgcccttagtgactctgctaagttctgaacccgaggtgcaatatgttgcgttgagaaacattaacttgatcgtccagaaaaagccggacattttgaaacatgaaatgaaggtattttttgtgaaatacaatgacccgatttacgtcaaactggagaaacttgacataatgattcgattggcttctcaagtcaacatagctcaggttctcagcgaactcaaagaatacgctacagaagtagatgttgattttgttagaaaagccgtgagagcaatcggtcgttgtgccatcaaagtggagccttctgcagaaaggtgcgtcgctacgctgttagacttgattcagaccaaagttaattacgtggtacaggaggccatcgtcgtcatcaaagacatatttagaaaatacccaaataaatacgaaagtattattagcaccttgtgcgaaaatttggataccctggacgagccggaagcccgagccagtatggtctggattataggagaatacgccgagagaatcgataacgcagatgagttactggatagtttcttggaaggtttcggtgacgagaacgctcaagtacaactacaattgctaacagccgttgtgaagctattcttaaaacgtcctcaacatacgcaaggcttagtccaacacgtactgagtttggccactcaagactccgacaatcccgatttgagagacagaggtttcatatattggagattgttgagtaccgatccggccgctgccaaggaggtggttctcgctgataaacctcttatttcggaagaaacggacctcttagagccgactcttctcgacgagctcatctgccacatatcatccctggccagcgtttatcacaagccacccacagcgttcgtagaaggccgaagtgcaggtatcagaaagacattgccggctagacaaggctccgatgacacagccgccgctcccgaaacaacggttattccgaaccaagaaagcctcattggtgatttgctttctatggatattaacgcgcccgccccgtctgctgctgctgctcctgccgcccctcagactagtaacgttgatttactcggcggtggattggatgttttgttgggaggaggtaatgatattgcggcggctcctgctagtgctgctgctcccaccaccactggtcttctcggggacatattcggcatacctactgcacctaccatgtacacaccgccgaaagttatctggctgccggccgaaaaaggcaagggaatggagatctacggtactttctccagacgatctggccaaatggccatggaaatgactataaccaataaggctatgcaggctatgtcgggtttcgcgattcaattcaacaagaacagcttcgggatcacgccgagtgcgcctatgaacgttccgactttgcagccgggccaaaatctcgaatacagcctgccgttgaacactacggggcccgtgcaacgcatggatccgttaatgacgctccagattgccataaaaaacaacgtcgacgtgttttactacgcttgtcaaatacccattcagatattgttcggggaggacggtactctggataagagggtgttccttaccacttggagggacattccgggagctaatgaggttagtatgttggtaaatttgaacgttgtttggtacagtgtttataattttcgaggtattaaaaaaatgtttgatttctatgcaaaaataacgacggggtaa

SEQ ID NO: 985 - DNA, 498 bp, Phyllotreta atra
atgggtccaaaattcgatccaaacgaaattaaagtcgtttacctgcgatgtgtcggaggtgaagttggagccacatcttcccttgctcctaaaattggtccactaggtttgtcccccaaaaaggttggagatgatatcgccaaggctacatctgactggaaaggacttaaaataactgtacagttgacaattcaaaacagggtggccacaatctcagtagtcccatctgccgcatctttagtaattaaagccctcaaggaaccccctagggaccgaaagaaggtcaagaacatcaaacacagtggtaatatcacattcgatgatgtactcaacatagcaaggaccatgcgatcaagatcaatggccaaagaattcaaaggaaccgtcaaagaaatattaggaacctgccagtctgtcggatgtgtcattgatggcaaacaaccccatgattatattgatatgatcgatgatgaagaactagaaatacctgacgaataa

SEQ ID NO: 986 - DNA, 1095 bp, Phyllotreta atra
atgagtgaggaagggaaaagagcgttaattttagtcgggggctacggcacaagactgaggcctctaactttgagccgccccaaacctctagtcgaattcgcgaacaaaccaatcctgctacaccaaatagaagctctagtagacgccggagtaacggaagtcatattggccgtgtcgtatcgagccaagcaaatggaggaagaacttacagtcgaagcggctaaactgggcatttctatagtattttcgcacgagactgagcctttgggcaccgcagggccaatagccttagctagagaacacctttcgaaaagcaccaaaccgtttttcgtgctgaattcggacataatatgcgacttcccgttcagagagctagagaagttccacgaaggccacggcaaagaaggcaccatagtcgtcacaaaggtcgaagaaccctccaaatacggggtggtagtgtacgatcaaaacaactgcatcgagagcttcgtggagaaaccccaggagttcatttcgaataaaatcaacgccggcctgtacatcctgaatcccagcgtgatcaaccgaatagaactccggccgacttccatcgaaaaggaagtgttcccttacatggcctccgaccagcagctgtacgccttcgagttgaagggattctggatggacgtcgggcaaccgaaggatttcctgaccggaatgtgcctgtatctgaaccatttgcgggagaccaacagccagaagttgtacaaaggtcctggagtggtcgggagcgtgctggtcgatcccacggccaaaattggcagtaattgccaaattggacccaacgttacaatcgggccaggtgttgtaatagaaaatggtgtttgtataaaacgctcgacgatactaaggggtgcaacggtttgttccaactcttggttagaaagttgcattgtggggtggaagtgtcacataggtaaatgggtgagaatggaaggaagtactgtacttggagaggatgttattgtgaaagatgagacgtacataaacgggggacaggttcttccacacaaaagtatcgctacatctgttccagaaccacagattattatgtag

SEQ ID NO: 987 - DNA, 867 bp, Phyllotreta atra
atggcgtcggaaggtgaagaagtgataagtgaccaagaaaaagttaaaatagtttcggatttcatcctccattcgccgccgggcgagttcaacgaggtcttcaacgatgtaaggaagcttctgaataacgatgaccttctgaaagaaggggtaaccggggcgttcgcccaatacaataaagaccaactcacccccgttaggatagaaaacgccgatcaaatggtgctgattacagaatacaacgatttaggtaacaatagattcttcgacccccgtagtaagcaaagtttcaaatatgaacatttaagaaaggaagcttctgattaccagccttatagtgttgataccgcggcggagccctggcgggccgctctagataacgagtttatacagtacacgagaaaccattataaagacggcgtttgtagcgtgttcggtcgcagccaaaacggcgccatcgccctcaccgcttgcatcgaagaccaccaattccagcccaagaacttctggaacggtcgatggagatcccagtggtctgttagtttaaccgatgaagccaccgcagaagtacggggagtcctcaaagtgcaagttcattattacgaagaaggaaacgttcaactggtgagtactaaggaaatcaaggaatcgattccggtttcgaacgaagcgcaaacggccaaggaaatcatccatgtaatagagcaggcggagaatctgtaccaaacggcgatttctgaaaactaccagacgatgtctgatacgacgtttaaggctctgcggagactcctgcccgtcaccaggacaaaaatggattggaataagattgtatcttatagtattggaaaagaactaaaaacacaatga

SEQ ID NO: 988 - DNA, 3225 bp, Phyllotreta atra
atggaaagagacctcagggacaggcaagacaggatgggagtggaaataagggaaaggttgaaatgggacataagagaaggagttatcggttcggagaccttcaatcccaaacacgccataatcgtaacgtggaagaacgtatccttcaacggaggatacgccaacgcagtttatcagaccaacacattccaaatggtcctcgccactgacgaggtattcacctacgccatgttcaactacctaaatttggactggaccagtcacaccgaagccggaggagacactagaaaaggcgaaggcggtacaccggcattcgttggattcaacgccggtaacggcaccagaagcttccagtacgctccctacagtcaagcatcggtcattcgggacttaacagctaccggctggggtaacaacaaacccggcaggcacattttccgaatcgacgagaacatcctgctaggttcttgtaacaaagatatcgacggggctaatttgcctcttcaatttgctccggagagcggcaatatgctgggaggaaccgtcgtgaacatcacaggtccttgcttccaacccaacgataggatcagatgtaaattcgacgtgtacgatgaagttgttggatacgtcgtggacaggaatcgtgctatttgcatccaacctcgcctctactcagaaggttgggtgaggttgcaaatcgccatcaattccgacgccttcaagtggaacgtgaacatcacaggaccttgcttccaacccaacgataggatcagatgtaaattcgacgtgtacgatgaagttgttggatacgtcgtagacaggaatcgtgctatttgcatccaacctcgcctttactccgaaggttgggtgaggttgcaaatcgccatcaattcggacgccttcaagtggaaaggaaaatactacgtcgaatcgccggccagcgcctcgcagaagatcttcttcaaagacatgaagtaccacgagaagtcgcccagcgagattcgcatcacgtggcagaagcagaacttgaccaccaacgaaaatgccaacatcagaatttccttgtggggttacagggaaactaccatgagacccacgttcgtttacatcacagaaatagccgataatgtccagaacaccggggagtacaccatcgtaccgtcgcagtacaggggcaaaatcaaccagttcctcactgacattaagtttggattcctccaaataaatttgaccgaatcgataaaggtcaacatttactctaccaacaaccagaacatcgatatcacaccgataatatggagcaggccgattcctctaggttggtatttccaattccaatgggagaaccaatacggcaaaaattggcctaaacacctctgcgacgattggctcaggaccgacagatatctgaaaaacttcgctcacgaattaccccaatgtccttgcacggtccaacaggctctggctgataaggggaaattcatgcccgactttgattgcgacaaagattcgaatcccgtttgttattacaacaaccaagctttgcattgcgtcaaaactggtgctcccacaatggaaggctccgagcaacaatgttgctacgacaaaaacggctacctaatgctgtcctacgatcaacaatggggttccagccctcgtcgatgccacaacctcggaaaaatgccatacaacgaagccaccaaggttcccacgttgtctcaatggttcaacgacatcgtgcccaagtacctctgctgtctttggcaggaagagcaagccgtgggctgcgaaacgctgcgattcgaaagaaggccttcgcaggactgcgtcgcctatcaagcgccggctgtggcaggagtgtacggtgatccacacattgtcacattcgatgacgtagagtacacgttcaacggcaaaggagagtactccttggtgaaatccgtgaaggtggacgataatttggaaatacaggctagattcgagcaaatggacatgaatgcttatggagaggtgagagccacgcaactgacggccatcgtggccaaaggaaataagacgattcctatagaagtcagaagaagaccgttggaagccagatggaggtatagattagatgttatagccgagaacagaagattgttctttgatagaccttcgttgaaattccaacatttccaaggggtcactgtttatacaccaacctacattttgaatcaatctgaagtactaataatgttcgacaatggagccggcgtcgaagtactggacaatcaagggtacatgagcgccagagtatacttaccttggtcgtttattaacaaaacggtagggttgttcggtaactggagcttcaacaaagaagacgacttcacgctgccggacggatccaaggcggccgtggtgagcaacatcaacgacatggagagggtgtttaacgatttcggttcgaagtggatgctggacgacgtgagcgacgcgcgcaaaggccagtccctgttctacagggaattcggccgcacgtcggccacctacaacaacaagaccttcaagccgcagttcctgatgctgcccgaggacatcctgccgcccaataggtccgagcaaatacagcgcacgtacgacgtgtgctcgaccaagatgtacgagtgctactacgactacgccatgacgttgaacagagacctggcgcacttcacgcagaactacaaggctaccatttacgagctgaagcaaaccaccagggagaagatcatgtcctgcggcgtgctggaaacgccgcggttcggcaggaagagtacgttcctgttcgtgcccggcacgaaggtgacctacgaatgcatacaagatttcgtgctcgtcggtgatcctagaagagagtgcgggggtgatggaaaatggaatataccggattatggatacacatattgtttgcgtcagcaggaatattcccaacgacaagcaggaatcacgtccgggataataatgttagtgctcataccactcatcctgctattcgtgtatttggcgtaccggttcttaaagaagaaacagaaagaacgggaagagaacaggctggagcaagaacaatacagagaacaatctaggaaagcgcaggaggcggcgacgatgaaattgaccgaacacgaggaagagttcaattctgaggaggaagatgatcacagtaacgtgaccagcacgggagctaaagaaacaaatatttattag

SEQ ID NO: 989 - DNA, 321 bp, Phyllotreta atra
atgcgttacgtggctgcttacttattggccgttttgggcggaaacgcttcccccagctccgctgatgtggaaaaaatcctcggctctgttggagtcgaagctgaagctgaaaaggtcaagaaagtcctaggcgaactcaaaggcaaatccatcgaagagctcatcactaaaggtcgtgataaattgagttccatgccagtaggtggcgcagcccccgtagctgttgctgcagttgccgctgcaccagctgccgccgagcaaaagaaaggtatatttttattctactcgattacttataataatcacagtaaaaaaagttaa

SEQ ID NO: 990 - DNA, 2721 bp, Phyllotreta atra
atgactgaccgttttggattaaaatgggaccccaaaaatttagaaattagaaccatgtcagtggagaaaactctggagccccttgtgctgcaagtaactaccctcgttaacacgaaggggcccagtaaaaagaaaaagggcaagtcaaaacgtgccaatgctctcgttagcacggtagaaaaggccaccgagaatttcatcgagaaaggcgagcaaatcgcctacgagaatcctgatataacggacgagatgatagctgctgtcgaagaagtcaggaaaactggcaacgcaatgagcatagctgccagggagttttccgaagacccttgttcctctttgaaaaggggcaacatggtacgcgcagctagaaatctattgtctgctgtaacaagacttctgattctcgccgatatggtcgatgttcatcttctgctacaatcgctgcacgttgtcgaagacgatttggagaaactaaaaaacgcttcgagccaaggggaacttcttgacaatattaaggccttcggtcaaaatgcaaacgaacttatgaatcaggctgctaaaagacaacaggaactaaaagatccccagctacgcgacgatttggctgccgctcgagcagtactcaagaaacattccacaatgcttctaacagcttctaaagtttacgtccgtcatccggagctagctgcagctaaggctaacagagattacgtgctaaagcaagtttgcgaagctgttaatacgataaacgatgttgcgcaggggagaacaccgcagcccgcttccggcccttacgatggtccgggagaactcgcggctgctttagacgatttcgatgatcacatggtgatggagcctctggcgtacaacgaggtgcacacgagaccatcgttggaagaacgtttggagagcattatcagcggtgctgctttgatggctgattcgagttgcactagagacgagagaagagaacgtatcgttgctgaatgtaatgccgtcaggcaagcgttgcaggatttgttgtccgaatacatgacgaacatgggtaaaaaggataagagcgaaaatctaaacagggctattgacaatatgggcagaaagacccgcgaccttagaaggcagctcagaaaggccgttgtcgaccacgtttcagacagcttcttggaaaccaacgtgcccctcttggtcctgatcaaagcggctcagaacggcaacgaaaaggaagtggaagaatacgccgtcgtgttcaccgaacattccaacaagctcgtagaagtggccaacctcgtctgcagcatgtccaacaacgaagacggcgtcaaaatggttcgatacgccgccgctcaaatcgacaatttatgccccgaagtaataaacgccgctagaatcctggcggccagatctcgcagcaaagttgctcaagaaaacatggaagctttcaagcaatcgtgggagaaccaagtgcgcatattaaccgaagcggttgacgatatcaccaccatcgacgactttttggctgtgtcagaaaaccacattctagaagacgtcaacaaatgcgtgctagcccttcaagaaggcgatgctgatacgctggatcgcaccgctagcggcataaagggcagatcgaacagagtatgcaacgtggtaacggccgaaatggacaattacgagccgtgcatttacaccaagcgcgtgctggaggcggtgaaagttttgaacgatcaagtgatgcccaagtttacccagagagtccaggtggctgtgcaggctttgggcaacagcccgcccaaggaggtcgacgagaacgatttcatcgatgcgtcgagattggtttacgacggtgttagagaaataagaagagctgtactgatgaacagagccgacgaagatttggatcccgaagatgtagaactcgatgagaattatttgatcgagaccagaagcaaatcgagtgctcatactggtgaacatggcgttgatgagtatcctgacatcagtggaattacaacagctcgggaagctatgggtaagatgccggaagaggataagcagaaaatattgcagcaggtggagtttttcaagagcgagaagctcaagttcgatcgcgaggtcgccaaatgggacgataccggcaacgatatcatcgtgttggctaaacacatgtgcatgattatgatggaaatgacagattttactaggggaaaaggtcccctgaaaactaccatggacgtcataaacgcggccaagaaaatatcagaagcgggcactaaattggacaagttgaccagacaaattgccgaacagtgtccggaaagttcaacgaagaaagacttactcgcctatctacagcgtatcgctctttactgccatcagatgaatatcacttctaaggttaaagctgacgtccagaatatcagcggagaattgatcgtttctggtctcgacagtgccacatctttgattcaagcagccaaaaatttgatgaacgctgtcgttctgactgtgaaagcttcatacgtcgcttctaccaagtatcctagacaaggaactatagcttctccgattgttgtgtggaagatgaaggctccggaaaagaaacctctcgtaagacccgagaaacccgaagaagttcgtgccaaagtgcgcaaaggctcacaaaagaaagtgcaaaatccgatacacgctttatctgaatttcaaagccccacagagtctgtgtaa

SEQ ID NO: 991 - DNA, 1230 bp, Phyllotreta atra
atgtcgttcaatttcggaaatactggtactccaaaaacagctgctacaggttttacattaccgtcaaatccagccactagtactactagtgcaacaggattgcagtttaattttggaggaggagacactaaaactgaagttaaaccatcatctacattatttcctacggccacaagtaccccaccagctttcgggataaccccaaaacctgcaacacctgcatcagctgctgcaccatcgtttaattttggtacacctacaacccaacagacaacagcatccgcttttggaactgcaacaccagcctcattcagtactccaacctctgctctccaatttggactaaccactactaaaccagaaacatccacagggttatttggatcaactgcagctgcaacgcctatttcagcttcaactggacttagttttggaacagcggtgtctacaacatcttcagccaccgcagctgctacaggaacccccctttttggagttgctcctacctcgagcactactacaatagccagtgtacctgctttaggtttatcgactacagtttctgtcgctgcttcgacaactccatcgacttcgttaagtactacaacagcacccccggcttactcgacatcgacgcttccttctagtggttcgttaacttttagtcaactagaagattctattaacaaatggaccattgatttggaagaacagggcaagtttttcattaatcaagcgaaacagctcaatgcttgggattcgttgcttatttcaaatggcgagaaaattctcaatctgaatggtagtatcgagagagttaagcagcagcagcagcaattggatcaagaactcgattttgtcttggcgcaacagaaggaattggaagagttaataacgccgctggaaaaggaattattggaaattcccgtaacagacatagatcgaaatcaaatgtatcaattttcggaaataatcgattcgcaattaaagcaaatgtctgatgatttgaaagaaattattgagcacattaatgaatctaataaaagcgaagaaatttcgaatcctttgacccaaattagccgcataatgaatgcccacatgaattccctccagtggttagacagaaatacggcgcaaattgtttctcatctggaacaaatcagtaaaatgcaggactccaacagaagaaattttcctctgaatcattcattcaataattcactcctttaa

SEQ ID NO: 992 - DNA, 582 bp, Phyllotreta atra
atgttcatatgggattggttcacgggcgtgctgggctacctgggactatggaagaagtccgggaaattgctgtttttagggctggacaacgctggtaaaaccaccttattacacatgcttaaagacgacagattagcccagcatttacctacattacatcccacatctgaggaattatcaatcgggaatatgaggtttaccacgttcgatctaggaggccattcgcaggctcgaagagtatggaaagactacttcccagctgtagacgctatcgtattccttgtagatgctaacgacagatctcgattcggcgaaagcaaacgggagctcgatgcgctgttgacggacgaaaccctggccaactgccccgtgctgattctaggcaataaaatcgatctgcccgacgcggcgtctgaggatgagttgcgaaacgtttactcgttgtacggccaaacgaccggtaaaggtaaagtcgctcgatcggatctgcctggcagaccgttggagctgtttatgtgctcgattctgaagaggcagggctacggggagggttttcgttggttggcgcagtacattgattag

SEQ ID NO: 993 - DNA, 1380 bp, Phyllotreta atra
atggtgtactccgtactatccactccatttctttacttttcgtacgactacgatcttacgcattccttgcaacgcctgcacggcataagccctgatttctggaagcaatccttattcgagcgggccgatcagcggttcgtctggaacggcaacctgttgtactccttcaagggattctccatacaccgattctgcttgccgctcatgcacggattcgtttcgataaacttctgcgtggtgaacggccacagtttgaactggtcgattgtaagtagaagaagcgtgcaaagagcgggcacccgattgcaccgaagagggttggacaaggaaggaaacgtcgccaatttcgtggaaaccgagcagatcatcgaataccaaggggaccgggcgagcttcgtgcaaatacgaggcagcattccactgttctggcaacaagaccccgatttacgatacaaaccaccgcccactctgctcgacgtcgatccgcaggatcagcactcgatgtgcctgaagcacatgaacgatctaatgactttctacgggaagatcgtttgcgttaatctggtggatcagaaaggagccgaagggaacatggaaatggcaatgaagaatgcgataaacaacgtatcatcaccatcggttaagtacgaatcgttcgatttccatgccgagtgcagcaaaatgagatgggacagactgtcgatactcatcgatcgattggctcacgatcaagacgagatgagtttctttctgttgttgagagacggctcgttgagttcgttacaagacggcgtattcagaacgaattgcatcgattgcttggaccgcacgaacgtggtgcagagcatgctggcccatcggaatctggaaagcgtgctcagaaaattgcagatcctccatcagaatcaaacgttggagttccagtattcgtttgaggtgttgttcaagaacgtttgggcggataacgcggatataataagtacccagtattcgggcaccggtgctttgaagacggatttcacgaggaccgggaaacgtacgcggtacgggttgcttcaggatggcatgaattcgctgacgaggtactacaagaataatttcgctgacgggatgcggcaggacgccatcgatctgtttttaggtaacggcaaacccctttcgccattgcatatcgataaaggatggaagtacgtgacgtatccgtcgattctgctgatcgctgtggccatgttcgtggcttgtgctgtcactccttctgagtattcgacggattcgttgctgtttctcttgttctggggttccatggtctatgcgactttgcacactattttgaagtacggttcggagtttgtcgataagcctaggctcacccattcttag

SEQ ID NO: 994 - DNA, 1506 bp, Phyllotreta atra
atgcctcctacgattcagcagaataatcagaacgccgcaaatggcgttgaaaaaagacaagtaaagactgtcgagaaaaggtccgatttactatgcaaagttaaatactgcaacacactgcccgatataccattcgatttgaagttcataacataccctttcgaatccattcgattcatccagtacaaccccacgtccttggaacgcaactacaagtacgaagtattaaccgaacacgatttaggcgtaagcatagacctcatcaacaaagatatatacgccatcggagcgggcgccgccttggacccggccgacgagaaactcctcgaagaagacatcctcacgccccaagactccaagaggtcccgccaccatgccaagtccgtctcgtggcttcggcgaaccgagtacatctccaccgagcagaccagattccagccccaaaccatggacaaggtcgaagccaaagtgggctacagcatcaagaagtccctgaacaacgaaaccctctacatggacagggactcgcaaatcaaggccatcgagaagacgttcgacgataccaaaactacaatcgacaagcattacagcaagcctaacgtagtccctgtggatgtactgccggtgtatccagatttcagtttgtggaaatacccttgtgcgcaggttattttcgattcggatccggctccggtgggcaagcaagtaccggctcaaatcgaggagatgtctcaagctatgattcggggtgtaatggacgaaagcggtgaacaattcgtagcctacttcctccccacggaggaaactctgcaaaaacgcagggaagacgtggccaatcaagtccaataccaagacgaagaagaatacgaatacaaaatggccagagagtacaattggaacgtcaagagcaaggctagtaaaggctacgaggagaattacttcttcgtcgtacgatcgagtggtattttttacaacgaattggagactagagttaggttgagcaagcgtagacagaaggttgggcagccgccgagtaatactaggctcatcgttaaacacaggccgatggatgctaatgaatttaggatgcaacggtacagggaaaagcagctggagcctacaggtgaagatgatgaagagatggaaatcgacgagccccaggaagaggataacgtgcttgagccggataacgaaagtcgggataaagaaaccgaaagcgacaacgaaaagaaacgatccagagcttcctcagtatcttcccaaaggaggtccagatccaggtcgaattcgtcggctaaatcgaattccaggtctagttctaggtctgcgtcgaagtccaggtctcgttcgaggtctaagtcgtcgtcgaggtctcggtctaggtcgccgtcgaagtctccttctaggtctaggtccgtgtcaaagtctccttctaggtctaggtcgccgtcgagtgccagatccaagtcggcttccagttctggctcgaattccgaaagcgagtga

SEQ ID NO: 995 - DNA, 1170 bp, Phyllotreta atra
atgccgattgaaaatttggaagatcaaggtttagaaaagaacccagacctagagctagctcactacaaatttctcctgacgctccccgaatatcgcagcgaccgcaatgtccattcgaagatcacagaagccatcaagaaggatgatatggctccgtggtacgaactcctctgcaaggaagtcggctggaagttggacgcggccttgctgaaggccctcaaagccaagaacgccgaaaaggtcaagcttctggacgaagccatcgaggatgcggagaagaacttgggggagatggaggtgcgcgaggcctatttgcgtaaagcggagttttacagcagaatcggcgacaaggaaaacgccgtgagcactttcaggcagacttacgataaaacggtgtctttgggccaccgtttggacatcattttccacttaattagaataggcttgttcttcatggaccacgaccttatcactagaaatatcgacaaagcgaagaccctaatcgaagagggaggcgattgggacaggaggaaccgattaaaagtctaccaaggcgcttattgtatgtccgtgagggacttcaaaaccgccgctaacctgtttttggacaccgtgagcaccttcacatcctacgagctcatggactacaaggctttcgtcaggtacaccgtctacacttccataatcagcctgccgagaaaccaacttagagataaagtaataaaaggctccgagatactggaggtgcttcattccgagccgttcgttaaagattacctgttttctttgtacaactgccagtacgcggagttcttctcgaatttggccgaggtcgagacgatcttgaggaaagattacttcctgaatccccattaccggtattacgttagggaaatgaagatttcggcctacacgcaactgctggagtcctatcgatctcttacgttgcaatatatggccgaagctttcggggttaccatcgagtacatcgatgaggagttgtcgactttcatcgccgctggaaggctgcattgtaaaatcgatcgggtgggaggcatcgtggagacgaacagaccggatttgaaaaatgctcagttcaattccgtggtgaaacaaggggatttgttgcttaatcgagttcagaaactctccagagttattaatatttag

SEQ ID NO: 996 - DNA, 15420 bp, Phyllotreta atra
atggaggaattaacctctggtttggatcccgacgatttgatggatctggacgagcccgagggctccgatctggaggaggacgacgaggatctcatcgacgatcacgtctcgtcgcctttcatctcgtcctcggcgcccgagtccacggccaactccgtcgcctcctcgcccatccacgaagacttcccgccgcccttcaacttcacggggaagcctctgcacgtcaaacgaggaagaggccggccccgaagagaaggaggtaagccttcggcgccgcgaacgacaagaggcggtggaactggagtatcgagagtacgcagaccgagacctccggggttttcaagaaggggctcgttaggaggaagtcgaagtgttaggcaagtagatagatcggattatgacatgtccttgttcaccggttcaccggtggacgacggtttgttggatcccgaaacgggttcgatgatcttccccgagaagtttgttcccgcgatcgaggagcctccgtactttccggagcattggccggggaaagtttgtgccttgtgtaatttaggtgaaagaagccagctaggacaaggtgaaatgttaagattaaattgtccggaaggattctcgccggagaaggttattagtgaacaaatattagaaagagcgttgcaggctccggataaagaatgcggggataagagtccgaaaggtcctgtgacgtgtagaaggcagaaaagtttcaacaaatgcagacatccttcgataaccagtgaatacgttgatgaattaactataattggatataatgaagtacctgatgtatctagtttgtttgagtctaacggacagttttacgttcatcgtaattgtgcgttgtggtctaacggtgtgacgaaagcagaaaattctgctttgttgaatgtaggacctgtagtgtcgcaatgttcttccaaaaagtgtaccttctgtaatcattacggagccagcctgacctgccacgttgacaaatgtaccaaaatttatcactttccctgtgctactgctgccggtgcctttcaggacgtttctgcgttgacaactttatgcaacgaccatttcggacaagtggctatgctcaccaccgcatctccgtgtttaacttgcggctctatgggagatatagcgaatttgatgttttgttcgggttgcggtgcgcattaccatggaatttgcgtgggattggctcagttgccaggcgttagatccggttggcagtgtaggaaatgccggtgttgccaagtgtgtcgagtcgtcggagacgaatcgaagctgatgacttgcgaacaatgcgataaaatttaccacgctagttgtcaaagacctgtagtgacttcgataccgaaatacggttggaagtgtagatgttgtagggtgtgcggcgattgcggtgcaaggactcccggggccggtttatcttcaagatggcacgctcactatacagtatgcgattcttgctaccaacaaaggaataaagggttttcttgccctatttgccataaggcctaccgcgctcacgctcatagagaaatggttcagtgttcgagttgcaaaaagtttgttcatggaacctgtgatccggaggcagacgttgttacctacaatcaaaagaaagaaataagcatggactatgaatacgtttgcttgcattgcaaaaatagcacagctagacaaataacagcgaaacgagcaagtattgatgatccttccgatgtatccgcttcacacgattctctatatgacgatacgtccgaattcgatcttccatcgcccgacgagttcgccaggaacatgggtttgggtaaagggaaaccgtacagcgcgaataaaatagccaagaagcgccttagtttcacagtgaatccggttggcaggccgaaaggtaccggaaaagtgccacccgggaaaatggggtacatgaaacgctaccgactgacggagttcaatagaaaacggggccccaaagccaaaatgaggggtattttcggcgtgccgggcgtcggtctgcaaagaccgatctcggatgggaaaaccgacgaagaaccgggcgttgagaatcgattggtattgtgttcagccaaagataaattcaccctaactcaagatatctgcgtaatgtgcggggcgttcggcaccgatcaagagggttgtttgatcagctgcgtacaatgcggacaatgttaccacccatattgcatcaacgttaaagttactaaagtgattttacagaaaggatggagatgcttagactgcacggtttgcgaaggctgcggccaacgaaacgacgaaggccgcctcatactgtgcgacgattgcgacgtatcgttccacatctactgcatggacccgccgctcgactacgtgccgcacggcaactggaagtgcaaatggtgcgccatctgccaatcctgcggcaccaccgatccgggtttcaattgcacgtggatgaacagctcgacgcagtgcggcccgtgcgcctcgcacgtgaactgccccagctgcaacgagccgtacggcgagggcgatctgatcatacagtgcgtgcagtgcgagcgctggctgcacggcgcctgcgatttcatcaagtgcgaagaggacgccgagaagtgcgccgaagagggttacaattgtatattgtgcaggccgcgggacgtgccgccgccgcatatggtgccggcggcggtcacgccgaagccgcccactcccacgaagagtcccgagttggggaagagtacgagctattacatggacggcgtgtgtctcagcgaattcggtagcaacttgatcaaatcgttggctctcgagtaccacgggtcgaggaagaaacggaaaaagatacccactgtgcaggataaggaagccggtattatggctactattgaatcggtggttgccggcggtaatgttattcctactaatatggaagacagcgctaaattggagctagtcgacatcaaagacgaacctcaagaactgtacaaggaaggcatgatgtggaccaaagaagacggtccaccacccgaagggtttacgataataacgatggagaacggtttgaacgtgctgcgaaggaagaggcagcgcaatctgcagaagctcggtattgggggattcgtcgtcaggatgagaggtatcagaacaggtcaggataacgatgatgttgattcgtccattggtcaaagtgggctcaacgccaacgatatcgtcccatcgcctgcggacggggacaaacctagaaggaaaactattcgtcgaaagttgaagagtaaattagcagaaacgtttccagcctatcttcaagaggcttttttcgggaaagatcttatggatacggtcgattgtaaaaaggaagaagtcgattgctatagcagcgatgatgagaaaactgacaagcattttaaatcgattaatttatcacaagacgaaataatagcaatagtggcatcaggtaaaaccgagaaattggaaaacaataacaaagattcgaccaaagaagtcaaaccgactgtgttgaaggaggaagaagaagataatccggaggatttgaaagatgttcttgccctaccgggcgacttactcgataccgatttggttaatagcattatggaagatgaggaggaactgagcaaaactacagcgtctcttgttgctttagattcgaatttacagcacgatgcggaactgacggacactttgagtagttcaggaaattcgaaagaaaccaaagatgaattgagcgacattttaggccctcatttcaacctcgattccatatcgaacataaacagcaaggacgtcgaagacatatttaagggcgtattaacagacgagtcgcaggaatcccaagaaagcagtagcttctccctacaaggaaataatatgttttcgaataataatgcgcaacaaaacgttgcccaacaccccattattaatcaagcggtgagaccgaaaacattgcctactgttaatcacaatttgaattcccctgttagtttcccacccccctcaccgtaccactcggaatacagcaacagtcctcagtttagtcctgcgttcaccgattcgtcctgttcgtgggtaggaagtaacgaaacgccggaaatcgatagtaccaacgtgacggtgacgtcgacgtacaatcagaggtcatctgataaaatgaaagccgatgaaagtttgggtaaaagcgccacgatttcggccgttttgtatgcgaacatcaaccatcccgaatggaagaaggagtatccgaattggcccgataggtataagcaaataataaagaaatggagaacgttgagtcaagaacagaaagcgccgtttttgcaacacgctagagataacaggagtcagttgaggatgaagaaagcgcagcagtcacagaccgtcaaggaaaccgcctcgaccgccacgtcccccaatgcgaccaagcctccgcaccaagccggtccagccttagtgacaactctccaggcggtaacgcaacagccggcgggggcggccgcggcccccgcgccgcccgtttcagaggaccaagaaaagatcgccctgcaacagaaatccgccagggaagccgaacaggagagacaatggaagcaattgcaggccctcaggcagcagcagacccaacaaacgcagaacattctacacgaacagcgcgttcaagcgatcgcccgtgtacaacgacagatatcgaccgatccagcgcagcagttcataaacgagcaacagagccctctgcaggtgaacacgcctcaggaattgagcccgtcaaccacgccggctcccagtcctcggccatttttgggcattaaatctcccacgttccccgtaccttcgcccgttccgccaacgggcgtcagggccaacacgccctcgcaatcgccccacgatatctcccaacccagcacgcccgacggtaacgatcactttatccactcccccaccaatcctaaacctaatttccaacctagattgcccaatgatccgttcgccgcgcaacccgccacgccgcgaccgcaattcgggatggcccggccacctctgcagaatttcggcggtacggttcgcaacgagcaacaggacatcaacatcaaccgccaattgagggagctgttgcagcggcagcaggttaaaaaactggacgaattgttgcctggaaaagcgccacctcaaagattgtggcacgcgaatgatcagcaagaggccggcgacgcctcgatgacgtcggctgtggtccagggcgccggtgcccaaggcaccgacgccaccttccggcagcctctaccgcccggtgtggtgaaacctaggttggcgatttcgtcggtgaataggccgatattgggcacggttagagtcaatcaattggatcccaggatacaaaatttggatccgaggatgaggttgattttgcaacatcagcaacaaagactggccaccggtattcagcagcaattcatccgtttcacatcgaacgtgcgaccgacgacggtggagcagtatgagcaattgttgcaacgtcagggtaataatcagaatcaaattcacgcggaggaacaacagcagggcgttgcccgaatacccatagcccaggccagcgttatacaaaggccgcacgtggctcaagcggtggtgacgggcgccactgctgttaccacgagtaccacagaaagtaatcccagcgaggagggaatccccgataatgtaactgccgaattggagaaactcgaacaggaaacaggcaccatggtggagcttcaaggcgtaagcgatatcttaggaggtttggacgatgacgatgagcttttggccgaaatgggcgccgattttaacatactcgaatacgcggatcccgaattggaggccctaacgggcggcaaaacgaacattttagacctggagctcgaagaggaaccggtcaaaaaagaaaaactagcctctaacgcgaacacttgcgctccttctcaaaaaccgactcctaacgtcgctactacagccattagcaacagcaccgctgtcactacaccgaccgaagctactgcagaacctaaaatcgagaatacaattcaacagagcattccgaaatcgacgccacaacagctacaacatcccgcttctcttccgcagcagcagaacatgccccagcacggggcccaagttcaagtgcaatcgcaacaatcccagccgcatccgccgcagcaaatgcccatccaatcgacgctgcatatccagcaaattcaccagcaaatggtgcatcaagttcagcaagccgccgcacaaggaagacccatgccaccgggttcgaagatgcaaaccaccgatggattcgttggtgttgtgatggcgaacaacgccgtacaattacagatacctccgaattatcaacaacggttgctgctgttgcaacaactgcaaaatcaaaaattgatgcgagtgggaagcacgcagcccagggccgctttgcaagtggcccccaatcaaatgcccgtaggtatgaatccgggagccaggatgccggtgtcggcgccgccgccgcctccaccgccttatcccgggccgccgccgccctatccgggcaacgcgaatcaacatcaacaggagcaaccgctgctgttggaagatctgctcgagcaggagaaacgcgaacaggagaagctgcaaaaccaaccgcccaaccacgaagtcacctcgtcgaccggcaacgagacggaatcggcgctgctgagcgaccaagacttcgagcgactcaaagccgacgtatttaacagcgccccagtgagtaatatatcgtctacgaatcaagggaacgccgcccaaacgtcgcaagcgtggccccagctgcaaaataggcaggcggcggtaccggccgccgcttcgcagcacacgatggaagtgactactagagttcaaatgtacaatcctaatttgataccggcgccgccgctcccgccggagaatatcgctacggagcaggacaagcaggcgcagctgttgtacgagcagtggctgaaccaccagaacaactcgctggtgcagcaattgcgctattacgagaccgaagtgcagaagcttcgtaagagtaaaaagtcgctaaatagtaagcaacggcaattgaggaaagctggtaaccagttgaccgacgcagatgcgactgaacttcagagaattacagcggaacaggctatattacagaaacatttggaatcgagcaggaaacaaaatcggcaacatggaatgttgatacaggaatatcgaaacaagcatcccgccatcaagcagagaaccgtaacggaccagatccaatcgccgttgggccatccggcgtcgtcgcccatacaacaatcgagcgcctcgttgtcgcccatgttgtcgccctccgtgtcgccgatgacgcagaacagctcgccgttgaacagccccgggccgatggtgccttcgtcgcccggccacggtcccgtgcagaacattttgcaaagccccaacggcgccaacgcggctcaaatgtcgcccatgcaggcgtccccgatgcaatcttcgccgagaatcggtacgcctcattctcaaagtgatgaaagtcccggatcggcgcaatcgccgtcgcaggtttgcctgccgccgcccatgcctcgaatgacgtcgcctcagcaccgacgagtcgttaccagtccggtgggaatgtcgcaaatgcgttttatcaacaacaacatgttgcagcaacgcgttcgcatgcaatcgcctatacagaatttccaacagaaacccggcacgccttcgccgttgaacagcccgacgtcgcagcaaatgaacgtcaaccaacaacatcaaatccagaaacagctgcaacaacaacaacaacagcagcagcaacagacgttgttgcagcaaaatttggaaggcgatcctaacgccattcactcgcagaggaccacgcaattgttgcagcaccggaatttcatcaggcagcaggtgtcccagcagcaaatatcgcctcagacgttgacgccacaacagcatcagttgatgctgcaacagcaaaagcagctggcgcagcagcaacaacagcagatcgcccaaatgaacgcggcgagattgcaacaacaacagcaacagcagcagcaacaacaacaacagaataaccccccgcattcgccgatgccacccaaaagtccaatgattaaccagcagataatgtcgccgcattcgatgccccaatcgcccatgcagatgccgccgaagagtcccatggtgccgtttaatcccaaccaaacgaatcccaattcgcctgcggctagaagtccggctttccatcagggtatgaaccaaccgacgagtcccatcactcacggccatcaacctccgagttctccgatgcccaggagtcccatgatcaatcaaacgcactctccgcataacgttcgaaggcctcccagcgccaacagcagcccggccatgcctgataggccgcacagcgtagaaaactcatcgcccaggatgtactctatagatcaattggtgcaggagagtttggccaatcaaaatgtgaacgcgcaatataacagttacaattcggatatgatcaacgaaagcggtggagggaattcgaataacccgataccttgtccaccggaaataccgagatttcgttattttaagctcggcttgagaggcggagcgccgatgtggagcttcggaagaggcgccaaaaggatcccagcgcctccgaacgccaaaccggacgagcccaaggcgaagaaggagtcgcatctgagcaaagtttcgatactgaaaaggaaacccccgatggcttctatcggcaaagtgggctcgttggttagttcggattacaacgatttagacgacagttcgacaacgcctcccgtaacgccgccgttggcttcgaccagcagaggaagtctgtcgaagaagaagaatctcgaactgcaagcccaaaaggattcggtgatcgtcatgcacagtcccgacgacaacaacaaacagctcgaaataatggattacgacgacgataataacacggtgctatcgtcggaagtgtcgttgagttctgtggcaagaaacgacgacgacttggtggagatcgaaacgatatcgcaagacctcgccgaagggctatccagcccgttggaatcggatcaaataggcgacgaattcctgttgtttcccggcaatatggtggtggacatgtccggtgaagagcattactcggaaaaagaggaagaggaaaccgtcgacggggaatatacagatcagaatatgcacatagtgatacgcagcccgaccaccagcgacgacgagttcataatgccttgcaaagtgaagcagtacaacgcggacgagcaggaggataatcccgaatcgcccgatcaggaggaattcggcgaatccggcgatatgatggcgagtttcgataacgaagacacggatataatcatttcggatcaaaccgccggcgttcccgaggactcgatttccacgaaggaagacttcgaggagctcatcgacgaggggtcgcgtaaaaacaacatcagcaaacaggaggtgaccgccaaacacattcaagatttccacaggtacaccgaattgttcgattacggtaaacctgaagctcaaccggttaagaaaccagtcgctaaaaagttccaaccgaaagtatctctagttagaggagtagctttgcccagtaagcccaacaccgagaagatcatcatcacgcaaaattcgaacgtgttgaatacttctcaggcttcgaaagtcaccagcatcattttaacccacaacgccaacgttagaaggaacattataagcgtaccgaaaatagtgagtaccgtttcacctgccataactatagtgagtgccagtacatcgcaaatggcctcgatattaccatccaaattcaccgtgccggttataagcgccagcgcggtacgccagctatccaacgtcaaagtcatcgacaagccttccacttcttcattgtcgatttctaccagagacaacgtcctgccgaagaagatattcgaggacgattcggtgtcgccggacagttccaattgcgacgatgagaaatccaaagattcgttcgacgataaggtcaagtcggagtcgccgccgcaggaggtcaaacagttcgtgaaatcggattcgcaggttatatcgttgaaatcgaagaactacgccgatcaatcgaagaagatcgaacatctgcaaatagtgaatatatcggcgaaggatgtggttcaaaggcagaggataccgagtcctttgatatcgaaagcttctccagttatcatccacaatacgccagagttgaaaatgactgcgcaagttattcaagagagccaaactcgcatgaaaattacgactactactgataccgaacattacgatgagtctacggatgatacgaaatcagttgtaatttcaattccatctcctacaccttcgcaagaacaaatgctggatagtatagcctttcaggcgttggaaaacaggagaagagagtacgattctattgaagacgtgttagatatgattgagaatatagaaaacatcaccgccgaaccgcccgagatattagaagaaaacacgttgcaaaattccgattccaacagcaacatcgaaaccaaaaccgccgaaacgaaggagctgcaattgcctaccagcgaaagcgaagcgcccgctaccaaatcgtccatcgtaccgcaattatcgcctctttcccaacccacggaattgaccacgaacatggccaacgcctcgcagcagctcagaactctgctgtcgtcgctgcaaaccacgtcgacgtcgtccccgaccaacgtggagtccatagccaagggcttcggccagaaaatcagcacctcctcgtcggctaaccagcccatagtcgcttcgagggtgatcggccaacaagccggcaggcaatcgccggttatcaccagcgtctctaccgttatagttccgaatttcaagcaaaaaatcaccgcggctactaccgctacctccagaagcagccccgtgaaggtggtcagcacctcgcagcaattaaccggatccataataacctcgactttgaattatataccgaacagaacgatcggtatacaaatggtggcggatcaatcgaaactgccgccggccagtatcgtgacgacgatgcagcaaatcaactcgatcacttccagccaggagtcgaagaagccttcgttgacgctcacggcgatgctgcagaaccaacccgcagcgaatatgatgactaaatcgtcagctgatactatcacagccgctagtttgctaggctcgcccatcagcctgccgaagaccgggttcaccacgtctttggtgcaagcccaaccgagcgtggtgctttctaacacgccgccaacgcctagccaaacttccacggcgacatcttcgactaaaaccaccgcggattcgatcacggccgctagtttattgggtagttctattaatatagttaaaactagttttgcgatgcaaccgagtagcaccgtaggagtggtgacgagctgcgtcaacaagacgcctacttccaccactaatttgctccacacgcagttgacgaaagtcgtgagaagcaaatccgtcgatgatgttaaagaattggtcaaaatcgacgagaacaagcaaagcgttagcagcgaaaatgtagacgatagcaacagcgggtgtaaattatcaacgataactacggtagcctgtaacaaaaccgaagattcgcagaacgtgttactgaagaaattgctgcagaacacggcttgcgccagcgctcaatcctccccgcccgcttctactagtactgttactaccagcgctgctaatactatgtctaaagtagctaatacgcagtgtagtactagcgctagcgtcgagcaaccgccggtaagcgctccttcgaacgttacagtccaaagaagcgccagcagagacgagttattatcaccgccacaagacgtccaaactatggtagtgattaagaaagaaccgccgctggtaccgctgtcccaaccgagtccagtgctgaactcgaattccaacgctcacacgcccgaggtgaagaaagaattcatcgacgaatcgtcgcagcactctgaagtatccgatcacagtagatcggacgcccccatcaaagaggaactggaaaccatggagaacaccgccgagaagatgatgctcgacaaggaggagctgaagaagcagaagcgcaggatgtaccagcagaagcgccgccagaaccagatcctcaacaaggagctggcgcagcagcagccgaagaagcggccgcgcaagaattcgaagatcgacgaggactacgacacgtacatcgacggcgtgctggcgcagctgcgccagctgccgcccatcgccgtctccgagccggtgttgaaccgcaacttcggcgtggtgccgctgttcgggtgcggcgatctcgccaagatcggcgccaaggattactcgacgcacctgggggagttgacggggaactacggctacggcgagctgcccggtttcaccgatttctactcgacgaaaccctacggggatatggatccgctgccggagaagccgccgtcgtcgacgcagcgcggcttctacgaccaggagttcccgctgattagattcgatgcggacgagcacaagaagtttgacgtgttttgcagggaggattcgcccgattcgatattgagcagctcgtcgcccgaatgtacgcgcgaacccgaaggcaaattcgtcgggttgaagctcatcagcgacagcgaagaggacgaagaagatgatgccaaagacgccgtttcgaaaggaagaatgtcaccggtggtgcccgtcatcaaacctgttcctattagactgaaacccgccggcgaattgtacttcaaagagaaccttaacgagaacaaggagaacatcaacagcgactcgttgcacgtaatgacgaaatccaaattcgacaacaagcagtcaccaccgtcgaacgtttccggccacgttacggtaactttaactctaacatcatctgcagctgaagatataatgggagtactgcgggatttggccaatattctacacatacctgctccgactagttaccaaatcgtggagagaacggcttctccgcctagccagaaattgggcttgtaccgcaccaaaggcaaggacggcaaagagggggctcccatcgacatacagagcatcctcaacggcgccaccaagttctgcaagcactgcgacgtgatcatcttgagcaacatcatcaggcggaaggtgtccgatttaccgttcctcgccaaggattcggatttgctcagcgacggggaggaattgttcttttgcagttccgcttgttacatgcagttcgctttgatgcaccgctcgccttcgatatccgaagataaggctgctgaaattataaatcacctatcgcagaaagacaatttggattcgaaacagaaattacccgcagacgcgttagacagcagtaaatcgatagcgcagaagttgtcgttcaacatcaaagatacgaaacgggaattcgagccgatggagacgaacgatgcgtttgcgttcttcgctcgcaccaccgctaataaacaggggaacaacttctacgatggggcgccgttcaaatcggtccccgctagggtgcacaggaacgataggtacaaactctggacgcccggctgtctccaacccacccagaaacacaaaacgcccaccgacaaggagatcatggagctgctctacaggatgcagatcaccgttactcctcccgtcatgccggaagatacgaggaagtgtttgttctgccacggtatcggtgacggcgtggccgacgggccggcgagactgctcaacttcgacgtggacaaatgggtgcacctgaactgcggcctgtggtcggacggtgtatacgaaaccgtaaacggggctttaatgaacgtcgaaaacgccctacagtccgggttgttggccacttgcgtgcattgccaaagcatcggggccaccatcaagtgcttcaagacgagatgctcgagcatataccacttgaattgcgccgtcaaagacaattgcgtgttctacaaaaacaagacggtgttctgcaaagtccatgcgccgaagaacgaaaaagacaacgaactcaccacactctccgtgtctcgcagagtctacatcgaacgagacgagaacaaacaagtagccgccgtcatgcaccattcagattctacagatttactgagagtaggcagtttgatattcctgagcgtaggtcaactgctcccgcaccaacttcagaacttccacacgcccaatcacatctatcccatcggctacaagatcatcaggttctactggagcatgaggaacttgaacaaacgctgcaagtacatttgcaccattcgagaggtgtccggcaaaccggagtttcgcgtgatggtgcaagagccccccgaagcggacgtggagttctccgattccacaccgaaaggcgcctggcagaagatcctcgacagcgtcgctaccatccgcaaagagaacaattgtttgcacatgttcccgaaattcgccacaggcgaagatttgttcggtttaacggaacccgctatagttcgagtgttggaaagcatgccgggcatcgaaacgttgtcggattataaattcaaatacggccggaaccccttgttggagctaccgctcgccataaacccttcgggctcggccaggaccgagccgaggctgaggagccagttgcattggaagaaagcgcatacgcagagaactactggcggtacttcgtccattcgaccgatgttcgggccgtctctgacgggatctattagtacgccagcccaaggggagctggcttgtccttacagcaagcaattcgtgcattcgaagagttcgcagtacaagaaaatgaagcaggaatggaggaataacgtttatttggcgaggtcgaaaatacaagggctgggtttgtacgctgctagggatttggagaaacacaccatggttatcgagtatataggggaaattattagatccgaactggccgagtgtagagaaaagcaatacgaagcgagaaatcgaggaatatacatgtttagattggatgaagaacgcgtggttgatgctactttatgtggcggtttggctagatatatcaatcactcgtgcaatccgaattgcgtggccgagaccgtggaagttgatagggatattcgaataattatattttccaaacggagaattttacgaggagaagagttggcatacgattacaaattcgatatagaagacgatcagaacaaaatatcctgtatgtgcggagcgccgaattgtcgcaagtggatgaattaa

SEQ ID NO: 997 - DNA, 4107 bp, Phyllotreta atra
atgttttcaaccatgccgactaaacagaaaacagcagctaaagtcgatgacgacgaaatgctatcggaaatattaggcgaaatcgattctggtacagcaaatacatcggctatcgagaaacctaaaattagcaagtactctacactggccattaacttgtcagctaaggattacatgaggaatttttcccaaccggttaaaaaacgcgctatcgaaaaaaatgtacaacccagtgtgcccaaaccagtaatcaagttaaacaaaaaactaactaaatcaattcaaccaattaaaattgaagataccaaaaacgaaacgattgagcctgatgagcatatcgataaagaaaaggctgatccagatacatcacactttgatgatgatttggatgaaactttactagaagaaatcagcgaagatctgaataaaaccgccactgaatcccaaataaccgaatcagaaatgaacgaagacgattttccaggggattttgatacaacagtaatagatgaaatcgaagaacgaattaacattgccagcgaacaactaatcaacgatattcaagcggaagtcgagacggaatggcagtatttcaacgatgctaataaaagctttaaaatagcaacagtagattctggagatactgattctattgcttcggaagataccgattctattgccgattctcctgctgtcactactgccgatactccatttgtagaagtcgaagggaacagtgtgtttaggttcttttggtgggatgcttacgtggatccactacatcaacaagggactgtttttctctttggtaaaacgtactgcgaaacctccaagaaatacgaaagttgctgtgtggctgtgaagaacatagaaagaacactatttgtcttacccaggccatttgaagtagatgaggacgggaatcccaccgataaaccggttacatttaaagcagtccacgatgaatttaacaataagattttgaagcgactgggcatcggctcttttaaatcgagattgatcacgaagaaatacgcattcgatgccagcataccagccgaatccgagtatttggaaatcagatactctgcgtcattttcgcgcattcgatgcggcgatgaggattgcgaccaaaaagatggttatgactacattgaaggtgatctcggctatagcactttttcgaagattttcggcacaaaaacgaatttcttggagttgctttttctcgaacgtaaaatcaaagggccttgttggatcgacatatcagaccccgaaccggccactaacccgatgagcttctgtaaattcgaagtaaattgcctcaagcccaccaatttaaaaataactacattcataaaaccagttcctccaccacctctcgtagtagccactataaatatgagaaattgcattaatcgagcttcatctaatcacgaaatcgttatgctatcttgtctggtgcaaaatagctacgctgtgaacaaaccgcctccggaacccgcatttcaacagcatttttgcgtattcagctgcccccgaggagaggtgctacctctaaacttgtacgatactttagagaactacaaaataacgaaagtgctgaaaaccgacaacgaaaaggccatgctgaattgcttcgtccacaacatcgtacaaatcgatcccgatctaatcgtagggcacaacttgcaagggtatcaggccactatattggcagataggctggtgaaattgaactgccgttcttctaacagactaggcaggctcaagaagaagactactcaagccaaacaattagagaaaacgttgttcttggggcggttagtttgcgatataaaaatatcagcgaaggagctgattaaatccagatcgtacgatttggatacgctctgtcaggtcgtgttgaaattaaaggagaaccaacgagtcgatctagagcctgaggatgtgttcaaaatgttcaaaacgtcgcaggatttgattaaattaatatccttcactatgcaagattctgggtatattatgaaaatgatgtacaatttgaatatagtgcctctggcgttgcaaattacgaatatagcaggtaacgtcatgtccaggacattgatgggaggaagatcagagaggaatgagtttttgttgttgcatgctttccacgagaaagggtacattttaccggataaagtttatagaagaatcgaaagcgaatcgaaagggagttctaagaaaaagcccacatattcaggaggtttggtgttggagcctaaagtaggtttctacgacaagctaatactcctgatggatttcaattccctataccccagcatcatccaggagtacaacatttgcttcaccaccctccccgtaatggattccgacgaaaatctagtactaccagacagtaatcaaccggccggagtactaccaacagaaatcagaaaattagtagagagccgtcgccaggtgaaatcgctaatgaagaaaccggacgtcccgaaagacttgaaattgcaatacgacattcgccagatggcgttgaaattaaccgccaactcgatgtacggttgcttgggcttcggacactccagattctacgcgaggaatctagccgctttgatcacccaaaagggccgggagattctcgtgaataccaaagatttgatcgagaagatgtgtttggatgtcgtgtacggtgatacggacagtcttatgattaacactaatattttagaatacgatcaagtgttcaaagtgggcgttaaaatcaaacaagaagtcaacaagttgtacaagcaagtcgagcttgatatcgatggcgtttttaaatatttgttgttgttaaaaaagaaaaaatatgccgcagtttcgctgtctaaaagtccatcaggtgaattaatagccactaaagagtacaaaggattagatatagtgcgtagggattggtcacaattgtcatcagaaaccggcaaattggttctcgaacacctactaagcgatcaatctgccgatgaaaaagtacagaacatctacgactacttgtctaaaatcaaatctgatttggtcgagggtaaagtaccaataccactattagtgatcacgaagcagctgaacaaggcgcctcacatgtacaccgataaaaactcaatgcctcacgttcaggtggccttgcgatacaacaagaagagccgggatcacttcagaatgggcgacacagtgccctacgtgatctgtgtagacaacaccagcaacaaccccatgcagcgagcctaccatttggacgaattgaagggcaacccggagttgaaaatcgactacgattattatctggagcagcagattcatccggtgatagcgagaatttgcgagcccatagagggcttggacgcctaccagttggccgaatgcttgggcgccaacctgaagcgaatgaagaggcccaaaccgcaagggggcaacgagaacattcaaggggagaacgtcgttaaagccgaggtgaagttcaagaacgccgagaaatttacgttcgtttgctacatttgtaaacaccagaatgtcgttagcgaaccattggtgaataacattccttttttggaaacgtgtcaaaactccgattgcaaatcgaagcccatcgattacttaccaagcgttcaaaatcaactctacttatctattcgttcgcatataactaaatattaccagaaagtgttgacgtgtgaagacccaagttgcccaaacgctccgagaagattacccctaaaattcctgaagaaacggcccatatgcaacacgtgtggcaacgctgtaatgtacagggtttacaccgaattccacttgtataatcaactagcctactatcggtacatgttcgatttgagcaagctcaaaaacaagcctttgatggatggtgaaaccgagtcggggtacagaacgcttctagatacagttgagaaattcatgaatcaatctgagtactcgctcataaatctgagtgaggtgttcggtcagctcggttgggctgcgcctgttgagaaacgcgttttggaagagtctggaaatggtatccattttaacgaagaaggcagtgaggatgtctatgatgaatga

SEQ ID NO: 998 - DNA, 1398 bp, Phyllotreta atra
atggcggctgctgcagcggcaaaaattgccgaagtacgcgagacaactcgtgtagaaagaatcggtgcccattctcatatcagaggcctaggattagacgacagtcttgaagctagacatgtatctcaaggtatggttgggcaagtctcagctagaagagcagttggcattgttctgcaaatggtacgcgatggtaggatcgcaggaagagctgttttattagccggacagcctggtactggaaagactgctatagcaactgctttagctcatgctttaggacaagacacgcccttcactagcatggctggatccgagatatattcgttagagatgagtaaaactgaggctttgacgcaggctattagaaagagtattggagtaaggataaaggaagagagtgaaattatcgaaggtgaagtcgtcgatctgagcattgaacgtccagctacaggagttggtactaaagtcggtaaattgattctcaaaactacagacatggaaactgtatacgatttgggcggtaaaatgattgatagtattctaaaagaaaaagttcagtctggtgatgttatcactatagataaagctacaggaaaaattacgagattgggtagatcttttgctagagctagagattacgatgctactggccaacaaacgaggttcgttcaatgtccagaaggtgaactgcaaaaacgtaaagaagttgtccacacagtgactttgcatgaaattgatgtaatcaacagtcgcacccacggattcttggcactattttccggtgacactggagaaattaaatcagaagtaagagagcagattaacggcaaagtagctgaatggcgtgaagaaggcaaggctgaaattatacctggcgtactgttcattgatgaggttcatatgttggatatagaatgcttctcatttttaaacagagctttagaaaatgaaatgtctccaatcgtcataatggccaccaatagaggtataacaaaaattcgaggtaccacttacaaatctccgcacggcattccgttagatttactggatcgaacaattattgttcctactcagccatacgacgagaaggaattgaaagaaatattaaatattcgatgtgaagaagaggactgtcagatgtctgataatgctttggtggttttaacgagaatctgcaaggagacttcactgcgttacggcatgcagctcatcatgacatcgagtttaattgctagaaagcgtaaagcccacgaagtcgatgtagaggacattaaacgagcctatcaattattctttgatgaaggtcgctctgtgcaatttctcaaagaataccagcaagaatttatgtttaacgagatcgatgaaaaagatgatatggaaatggaaacggtttaa

SEQ ID NO: 999 - DNA, 1116 bp, Phyllotreta atra
atggcgttaagaacttacggagataaaccgatcagtttccagttggaggaaaatggagagtactactgtgttggatctgaagtgggaaattatctgcgactgttcagaggatccctgtacaaaaaatatcctgggatgttcaggaggtctataaccaacgaagaaagacgaaggttgattgaactcggtttgagccagcacgttttagcgagcagtgtatcactgcttagagcagaagaagttgaagatataattgaaggaaatgatgagaagtataaagctgtatctgtacacacttcggagcctcctatgccaagagagggtaaatccaagaaaaacatgcaatgggtaccatcgttacctaattccagtcacttagatgccgttccacaagctacccccattaataggaacagagtagctgctaaaaaggtgaggacattcccactatgttttgatgacacagatccccaaataaacatagaaaatgcttgtcaacaagaattgctagttcctattagactggacatggaaatcgaaggacagaagctcagagatacattcacttggaataaaaatgagagtttaataacgcctgaacaatttgctgaagttctctgcgacgatcttgatttaaatcctttaacatttgtaccagcgattgctcaagcgattagacaacaactcgatgcattcccaacagaacctcctgctattatagaggaaacctgcgatcaaagagtcattattaagttaaacattcacgtgggaaacacttctttagtcgatcaagttgaatgggatatgagtgaaaaacagaataatcccgaagaatttgcgttgaaactttgcgcagaattgggtcttggtggtgagtttgtcactgcgattgcttattctattagaggtcaactctcttggcaccagaggacttatgctttcagtgaggcacctcttcctgttgtagaggtaccattcagaaatcccagcgaatcggatcagtgggctccgttcttggaaaccttgactgatgctgaaatggaaaagaaaattcgcgaccaggacagaaatactcgtagaattagaagattggctaacactacgccgggttggtag

SEQ ID NO: 1000 - DNA, 684 bp, Phyllotreta atra
atgcaggctatcaaatgtgtagtggttggagacggcgcggtgggaaagacgtgtctgctcatcagctacaccactaacgcctttccgggcgaatacattcccaccgtattcgacaattattcggccaacgtgatggtcgatggacgacccattaatttggggctttgggataccgctggtcaagaggattacgatcggcttcgaccgctcagctatccgcaaacggattgtttccttctttgtttcagcctagtgaatccggcatcgtttgaaaatgtaagagcgaaatggtaccctgaagtattgcatcattgtcctagaacgccgatcatcttagttggtacgaaacttgatctccgcgacgacccggcatcgtttgaaaatgtaagagcgaaatggtaccctgaagtattgcatcattgtcctagaacgccgatcatcttagttggtacgaaacttgatctccgcgacgacccgaaatccattgaaaagctaaaagagcgaagattatttccgatcacgtatacacagggtttgcaaatggccaaagaaatcaaagccgtcaaatacttggaatgttcagcgttgacgcaagtcggcttgaagcaggtgttcgatgaggccattcgagccgtgctttgtcctccgcccgtaaagaaaaagaagtcttgctcagtgttataa

SEQ ID NO: 1001 - DNA, 4020 bp, Phyllotreta atra
atgaatgcgtccacttttaatcccagaatggaagccgctcaaaatccggtgcaaaaaatggaattggcgtccaggaatgtggaaaattcgttgttaatcgacaacaatgcgccgagattgatcgatttcatgaacatcaatccacaaagcggctccactgcaagcggtttcgcagaccacgattacccaactttgagtggattgtcgcatattatcaacagcatgacccaaatcaaatgcgtgagcaacgttcccataccttcggaaattgttgaccactttgcccgtgtgcaatgccactgtatgatgggtttattttctgaaataaacagagcttggctaactgttgatagcgatatttacgtatggacctacgaggaaaataccgacttggcttatttcgatgggataagtgaaacgattgtttgtgtgggtctagtgaaacctaaaccaggagtatttcacgcctttataaaatacctcctgattttggcgacatctgtcgatattgtcgtattaggggttacgttcactgaacgacccggtgacaacgctgatgaaattcaactcatacctgatcctgtgttcatattgcctaccgatggttccactgttacgataatcaacagtactgatgatgggaggattttctatggcacaaaagaagggaatttatttgaaattgcatatcaagctgagagtggttggttcggcaaaagatgcaaaaaaattaatctatcgaccagcactttgtcgttcctggttccctcgtttattaatgcagcgttaagtgaagaggatggaataacgcaaatttcaattgacgatagccgacatattctctacattcttacggaaaaaggatccattgaagtttgcgacctaggagacaaagggaattcgttttccagaattagtaaaatatctcaaaacacgttggttaaccaagcaatgaatactgttaaaactcttgacagtcagaattttcgaccaatagtgagcatatccgccatcgaagcgtccgaatcggttaatttaaatttagtagctgtatctcaaactggagtaagattttatatgagtgttacgagtttgtcaaaccaaaatcctaatcaaagaccatacacgctaaccctggctcatgtaaggcttccaccgggctattcagcgaacattaccgtaagacccagggcggtgcatgtgtcccaatatagggacagaaacttgatattgatatccacagttaatgagaaagatgtgttgtggtgtatgagctcagacttatttccattcggccgaggactgacagaagcttacacggccattaatttggacggaccagctttagctatctctgaggtgaggaacggtagtccccttcaaataaaagatttacatgaagcgccacctttagtcgtccggcaacatgccgaacctccgaaaaagtacattgttcttacttcgcacagcattcaaattttcattaagttaagaccggtggatgtattgaaacaaattttgaaagacagccacgggcaagacaccgaggcattgaaagccttctttacaattcaaaaagaggaccaagcgtgcgctactgctttgatactagcttcattggaaaacgaggacaacatggatatagccgagtttgcaaccagggctttcttcttatttggaggcgagccaaaattggtggctccaataaatactttttccgggccgtccgtattttgcccacccgtcatgtctactccaaatatacaccaatatcaacagcaacagcaatttcaaccttcgccgcaataccaacacaactttccccatgccatctcgcccggagctaatgcatacgaattgaccagtccattcgttttttctcccaagcacaacggcctctatttatatttaagtagaatattgagacctatctggaatcgaaggacagtggataagctttgcttagatgggaaaattgttacaaatcacagtacagtgactagtgaagactgcatatttattttgaactacataacgtccctgcataatttcctaatgcgtaatactcagctttcaaccttaagcgccggtccaggtcccggtcaaaatcctcaaaccttcaacaatactacaattaatatgactagattgaaccataccattcaagacgttcaattggaggaaagggcatctctagacgctttgaaaacattcgtttgccactgttgtcaaatattaggcctatggagaattctttgtgagcaccaattccacacattaatcgcttctttgcctgaaactgagcagcagattttgcaaaatacaaccttcaaggatctacttttataccgacacgatatctgttcgttgttgattgcgacattagtcgatagttacttgggcgataacgcctctgtcgattcgattagcagcaaattgagagaagtttgtccgctgttttacaaaacggaagatgcagctttttcaaaagctgtcgaaatattaaagatgacccgggcaattcaaaacaacgacgaaaaggaagagatgatccaatccgctttgcagatttgcaaatcaatcggtcccactattaatatcactgacatatgcaaggaattcgctaatttgaaagcttacaaagctgttacggaattgtgtgcgcatttcggtaagaaaatagatccggataaaatagcagaaagttactacaacgccgaagacaacagcggtgaccaagaagggtacaattattaccaaagaaggttggaaatttatcgtcacatattaaacatgttggatcaactatacaacgaacaaaatcaaacgcaggttactagtagagatacctcatactcagttaatcagaccatattactggatggcgtagaacaatctcaagtaggatacgtgatgaagcaagtaataaaagacgttatggaaacgcccgatgagatcatgcacttcgccctttacgattggctagtgttcaaaaatatgactggagatttaataaacatccaaaacccgtctttggaaacgtatttgaaacgaacgtccacccagaatcccaacaacatcgaggccatgaatttgttgtggaaatactacgaaagttgtaacaatcacgcggccgctgccaaaattttgaacaacctcgcctcgagaactggcatcaatgttccgttgaaagagagactgtcttacctagcgagagctatcatgtgcatgcggagcgataaaataggctatgcgccctatcttggtgtatttttgagagatcttgaagataaaatggaggtagcgaaggtgcaagagcaaattttggatgccattgtaaatttgcaaggacaaattcctaacgctcaggaagcaataagtgcacttaatgctggcttgtacgaaatttctcagttgtatgaaaatttcgctgaacccttcaaactattagaatgccaattggcaatcatagaatgcgccggatacactgatcaggttttgatcgaatccatttggcagcaaattttgactgaagaactaaggaaaacctacggaactggtacagataaagtctgtcaacttttgaacaaagtaaagcagttgtcgaagcaatacgctcaatctgcaaactgttttccattgaattacattgtttacgaattggaaatagtgaacgcaaaacttcgaggagacaaacaactcgttccttgtgccttggaaagcatgaatattcctttcgaaaatttaatcaacgtttacaatagtttaaatacgatttctataaatgatcacttttggcaattagaggagaacgaatttcatctttctgaagctactgctgcattaataaattgcttcctaagccatctcgaacagtacagcagcgttgaaaagaggaaaataacttcgctttgtcaagatgcagtggttgctttactatccaacttgtatagcaagcctaacactgaggtgttagttaataagttaagaaatatacaagccaagttgtcaagaatttag

SEQ ID NO: 1002 - DNA, 4143 bp, Phyllotreta atra
atgagcgaattcactttgagctacagggaagtcactccggagcaaatagatttcgaaaattggaaagaaataaccctcaccacaggaggaacccaaagcacccttcaagatataaaagtagccgagaaagccaatggatactgttacaaagactccactaaacactgcacgaggaatagattcatctattggagaattaatcacaatgtattggagctagtagagcacagtttagatataaatcttacaggaaatcgtatcagatacaagttcgatactccaattttagatggtgtttcgatacacgaggtactcgataatattgttattttggttcctacagtttgtagtgtacacaggctgatttttccccatccaaatgttttccatgcacaggacgatttactgggaatatatccggatttaacagccttatcgatattttcgaaagcttcgattgtagacaccagaaacccaaacagcttttatgtgttcaacaatcccagcactgccaacgatcaattaccgaacctagccaattcgtacttcgtaccggaaaccggggaagcttacttcgtattggcctttccttcgactgaactcttactaatcaggcagagtcccgatcaagtcacttgcgcagaactcaaaggggaatctttggttcccagatttttcgccggtatagcagacaaattcaggcaaaggaattcggatagcgaaaatgtggttagtttgctattttacgatttggacgaagaaacttacgtgttgtcattaacacaagatgctcatttgaaattttggtcatgcagtaaaggccaatgcgtagcagtaatagatgttcgtgaaaaaataagaactaacttgaaatatagagtacaatcagcgattctaaagaaagcagaagatggaaacagttcagagaatattctagttctatttctaagtttcggaaataaatgccagttccatattttgaaaccctcgattagagaacaagagatcactctaaacagattagccactctcgaatcgccattgaacgatttgatagatttcgcagcacaaatagactgcttatggtcagtatggcgatcagaagaaggcgaaacggtggtgtacaatgcatcgttcaaatccaaccgatggactcaagttatactggaaaccgaaccgtgcgaatttaaatatatccctataaaacacaacgatgtcaagacgctttacttacagcacattttccatccaggcagattccctttgcacgttattaacaaaactctttcgatatataaaatgcctacgattgcctcagactcccatctttccgtttctgctctaaagcaaagagtgtgcttggctgtcgagaacgacatacaaaatctctttaataatggtagcgatatcgatagcgttgaagttgatgagtatgtagagtgtgctgaatggagttggcaaaaattctacacctattgtgtccaataccatacagctagcagaaaaccgttgggtttgatgctattaccatccgtatcaggagctatgttcttgaaaaaatctgtgttttcgtttctacgccctgtggattcgttggaacatatgacgttgtgtacagatttgtacagagagcagttttacaatttttccatgttgtccgaagatttggatacagtagacgacgtaatcaacgtgtttaaagtgattgtttacatcgaacaacaactaaaggatgttttcatgcaatcgttcgaaacagaacttctcaatctccaatcccccgatgttgtaacagaggaattgttgaagagaatttacgttgaaatggattccgattttttctcgcatattttgcatctaatcaaagacgtcaacgatttgtacaaagccatacacaaaatcctggagctgttgagatacgaaaacaccttggccaatcccgataacgacattaacccatccgctatgtactatttcaattcactgttaggcacttctttagtcgcccaaagcttccgacaacaagccgaaattaggtttcaaatttgccgcaatttgttgctattatgcaacttcttggtgatggacaggacgctggattggggcgttttggaaggcgttcgatcagtctgtatgccagacattgtcgttctaacccaagccagtttcgttgttctgtggctaagcggtttgacaatgttcgaaagcgactcgattcgtgattcttcgatgagcatactgaacccgttaaaactaactccagtttacaacttgttaccgttcactcgttgcacgtctttattggaagtattcatatcatcatcaggcgttcaagatgctaggaaatcgttcgcaagggtttcctgcaaggacgaggccttggtgcattggcattggtcgctgttgccctacgtgaaccacatcaggcatcttatatggccaataagcggttgtacggtgttagaagaatggctgttgtccagtggacaacacgtgtggctgcagcagtacgttcggctacttagcaattggtgtgaatggaacgcttgtacacgtaacttcttattggcctcgtcgtttctgactaccggcgaattttataaagccgaagagctgttcgagactgcggcgaaaggggtttttaccgacgcgtttttgaagaacagaatcaaaagtgtcgatgatagtaattttagaacgactattcattattatttaaaggttatccagctgttcgagttgtgtaatgcaagaaaccacgtgatttacgtagccaatacggccttatgtgttgtcaaaagggacgatcctttagctgctacattgttttcgatcaaattcaagcaccatttggctttgaagcactaccaactggccttcgattcgttgaattcgaaccccgatggtgaaaggaggaaagataatcttagggatttagtaaaaacgttgctggacgagaaaaaactcaacgtattgttgaattttacttacggaagcatggatgagttctttgcgaatattattttaactcgagctagagcggccgatgttaataataacgtgttttatgattttttgtattcgtaccagattaagaaagggccaccttctttcagattagccgcttcagctatgtacgaacaagcctttcgactaagccagaaaactaccatcgaagctttagaaaagcaagtgaaatgctacctagcagctaaaaatgttctacatttgtgcccatcccaacacgcttgggttgtgagacctgcagatcccgatgaagaagacgaacaaattatattccaacctttagccggctccaacggggaaatacgcacgttcaaaatcaaaaaacaaatcgaagtagtagacatcgaaaccataggcaaagaactgacgttcgccagcgctaaattgaaactactccaattcaatcccactgtttccattaacatgtacgatccactggagctggtgatatcgttgaacaactccgggatgttcaaagtggctttcgagatttgttcgacgttcgatttgccttattcgttggtgttcgaggctcttacgaaacgctgcgtattgctcacagaagccgaggatcccaacgcttggaattggttggtggagaacgatttgcaagatttaccggttaatagagagtcagcggccgatgtagtttggaagttcctgcaggattgtttggagaaatacgaagagcctcacatgtcgtgtttgcataacgtggtttgcaagaaaattattaacatgcaaatttacttgccgcattggttgaaagcttcttataagtctcgaaatccgtccgaattgttaagattactgcacgcctccgggcgtttggaggaagccgtggaattggccaaagattacattttatcagcgatgggatacggcaaagaggaattcggattcaagcagcctttggcgccgacgtcaccggccttctgtcttcctgtctacgccatacaaaggctagtagatgaattgaacatacagaattccatgaacatcgagaagccttacgttcacgagtatgatgatttgaacgtgttgtttactaagtatctcgaaacagcaattagagtttctaatcagatgtgccaggttaagtgtaaagctttttaa

SEQ ID NO: 1003 - DNA, 2262 bp, Phyllotreta atra
atggaagtctccgacaagaatttggaaactttgagcagatatttgcaagaaacgctcaacccggaccccaacgtgcgtaggccagccgaaaaattcctggaaggagtcgaagtcaaccagaactacccgctattgctgctcaatctggtgcacaagcccgaggcggccatgaccatcagggtggccggctcggtggccttcaagaactacataaaaaggaactggctagtcgaagatgaccaggccgatcgtatacacgaatccgatcgattggccatcaaaaatctcatcgtaactctgatgctgagctcgccggagtccattcaaaagcagctcagcgatgccattagcatcatagggaaaaccgattttcctttgaaatggccggagctcattacggagatggtcgagaaattttccaccggcgattttaacgtgattaacggcgtgttgagaacggcccattcgctgtttaagaagtatcgatacgaattcaaatccaacgagttgtggacggagattaaatacgtgctcgagaagctagcgaagcctcttactgatctgttagtcgctaccataagtctatcgcaaacccacgcaaacgatgtagcggcattgaaaataatctacagttcgctggtgctcatctgcaaagtgttttattcgttgaatttccaagatttgcccgagttctttgaagataacatacaaatctggatgaccaatttccatacgctgctctccgtcgatgtgaaatcgttacaaagccaagaagacagcgaagcgggcgtattggagcagctcaagtcgcaagtgtgcgataatgtggccttgtatgcgcagaaatacgacgaagagttccagccgtacttaccgcagttcgtcaccgacgtttggagtttattagtcgctactaatttacaaccgaaatacgatttgctggtttcgaacgccttacagttcctttcgtctgtggccgaacgctcccaatacagaaacctcttcgaggacgacaacgtgttgagcagcatctgcgagaaagtcatcatacccaacatggaattcagaacctccgatgaggaattgttcgaagacaatcccgaagagtacacgagaagggacatagaaggctccgacattgacacgcgcagacgagccgcctgcgatttggtcaacactttgagccagaacttcgagcaacggatcgtcgagatattcggcagatatctacaagtgatgctcgcgaagtacgcggagaacccgaaggagttctggcgcagcaaggacgcggccttgtacttggtaacgtcgctggttagcaggggatccactcagaagcacggcgttacgcagaccagccaattggtggacattacccagttctgtcggcagcacattttgcccgaattagagcgaccggacgttaacgatttgccggtgttgaaagccgatgctataaagtacgtgatgacgttcagatcggtactgcccagcgatttggtcgtatctactttaccgcaactgataaggcatatgccgagcgaaagttgcgtggttcacacgtacgccgcgtgcactttggagaagattcttatgttgaaatccaacaatcaagctatagtaaccggggctcagttggagccgttggcctccgagttgttgaccaatttgttcgccgtattacaaaaacccgtgtcggaggagaacgagtacatcatgaaggctttgatgagaacgttcgccacgctgcaagatagaatcataccgtatttgaacgtggctttgccgaagatgaccgagaaattgcgaatggtggccaagaatccttcgaaacctctattcaatcattatctgtttgagtgcttttcgttggccataaagattatctgtaaggtgaatcccacggcggtgacttcgttcgaagacatattgtttcccatatttcaaggaattttacaacaggatatacaagagtttattccgtacgtgttccaaattttatcgttgctcatggagcacacgccgcagggctccttgtccgagccctacatgcaactgttgccttgtctgttggcccccatcttgtgggaacggccggccaacattagcccgttggtgagattgttggctgcgttcgctacgcaggccgccccgcagatcgtactgcaagataaagtggtatttatttatttatttattaccagcataccaacacctaaacttaaaactaaaactgtatgcagattgaatttacatcgatga

SEQ ID NO: 1004 - DNA, 600 bp, Phyllotreta atra
atggcaaaagtacaattatgcaatatcacagttatggacaatccaagtcctttcttgaacccatttcaatttgaaatcacgttcgaatgcatagaggaattaaaagaagacttagaatggaagatgatttacgttggttcggccgaaactgaagaacacgatcaaatcttagactccgtatttgtaggacctatcccagaaggcaaacacatgttcgtctttcaggcagatcctccgaacgtctctcgtatacctgaaaatgatgccatcggtgtaacagttgtgcttctcacttgctcctacaagagccaagaattcattcgtgtaggttattttataaataatgaatacagcgatccggaaatgagggaaaatttgcctagtccacctcaattcgataaggtaattagaaatatattggcttccgaaccgagggtgacgaggtttaaaatcaattgggaagaatcgagcggtactcaggaaaacggaactacaattgccgaggcccccgctaaccaaacaaccgaaacttccacttccgtagaggtacctgccttcaacgagaactctaattcgtgggccaccatggagtgttcataa

SEQ ID NO: 1005 - DNA, 939 bp, Phyllotreta atra
atggatcaaatgctaccgagccctggttttagtatacctagcataggtacacctcttcatcaacccgaggaagatcagctaattttaccaaacgccattcaacaacaacaaagtctacctactactaactcacaagtgcctcctctagctccaatgggaggttctactccaacgcttggtctaggtttaggccatgctatgtccatgccacatactaagtatgtaaccggattttcactgcctatcagctctatggcacctcaaacaccacaacatacaatgatgagtcccatggtaaatgttggtggaactggtaccactagttctggtgtaacgcctacgttaggtccctctacaccttcaccaatgactcctatgacaccacattcagcagatcctggaatcgttccacaattacaaaacattgtgtcaactgtaaacttgagctgtaaattagatttaaagaaaattgccttgcatgcgagaaatgccgaatataatcctaaacgttttgccgctgtgattatgaggatacgagagccaaggacgacagctttgatattttcgtcgggtaaaatggtgtgtacaggtgcgaaaagtgaagaagactcgagactagctgcaagaaagtatgctcgaattatacaaaaactgggtttccctgcgaaatttttggatttcaaaatacagaatatggtgggaagttgtgatgttaaatttccaatacgattagagggattggttctaactcacagttctttcagtagttatgagcccgaattgtttcctggtcttatatatcgtatggtgaaaccaagaattgttctgttaatatttgtctccggtaaagttgttctgactggtgctaaagttagacaggaaatttacgaagcgtttgataatatttatccaattttaaagagttttaagaaacaatga

SEQ ID NO: 1006 - DNA, 453 bp, Phyllotreta atra
atggctgcaatgcgttccatgtctcgcctgttattctccagatcaatgcaaactactgtaaaaaggggttacgcagatcaaatgagcttcacttttgctgctggaaaccaggtcttctacaacgcaacatcaataaaacaagtagatgttccttctttctcaggtagctttggtatcctaccagcccacgttcccactcttgctgttctaaagcctggagtagttactgtttatgaagacgctggtaatgtcaagaaaatcttcgtatccagcggtacagtgactgttaatgacgattcatctgttcaaatcttagctgaagaggcccatccagtagaaaatttagacgttagtgcagccagagatcttcttaacaaagcacaaagtcaattgtcatcggccactacagatcaggccagagctgaagccgccattgccattgaagtgggagaa

SEQ ID NO: 1007 - DNA, 972 bp, Phyllotreta atra
atgagcggcgatggcaaccaaaacgagcatttcgacacgttattcctatcaatcgcacagcatcatccccaggggcccacgcaacttctagacacttttgtgaacttcctgagcagaaaaacggatttcttcacaggcgggaaggaaggcgaatgggaaaagttagtgttgaatacgttcaagaagtacgagaagtccagcagggagcagcacgcggccgaattgaaggagaaacaggaacaggaggcccgcaggaaggccaagaaagaggccgaatcggccaagcaggctcaaattaccgaactaacggaagagcaggctgagaaattgcaagccgaactcgatgctaaaaagtccccagcttcggcagccacttcgaatagctcgagtggcccttcgacttccactgcgaagatcgaagaagacgaagacgagtcggagaagggtaaattgttacccaataaaggcaacggatgtgatttagacaagtataattggacccagactcttagtgatatagagctgcgagtgccgctccggtgcaatttccgagccaagcaaaaggatctcacggtgaatttaaccaaaaaacatctcacgtgcggcctcaaaggccatccccccatcatcgacgacgatttccagcacgagatcaaactggaagagaccaattgggtgattgaggatgggaaatcgttgctgttttccatagaaaaagtgaataagatgaattggtggagtaaaatcgtgaagaatgatccggagattagcactaagaaaataaatccggagccttcgaagttgagcgatctggatggtgagacgaggggtatggtggagaagatgatgtacgatcaaaggcagaaagagatgggattacccaccagtgatgaaagaaagaaacaggatgtgttgaagaagtttatggagcaacatcccgagatggatttctccaaatgcaaattcaattga

SEQ ID NO: 1008 - DNA, 501 bp, Phyllotreta atra
atgcagtctcctagcggaatggtgcacggtcatcccggcgcctcaatactgcaatggagccctgataaaaaatacagcgatagagaaaggtggatttgcgtttatccagcatacatcaattgcaaaaaaaccatagcccaaggcaggaaaataaacaaagaaaaatgcgtggagaatcccactcatcaagagatcagagacgttttgctcgctgcaggtttgaaggttggcgtagaaaacaaattgtacagcagggaacgaagcaaagaattgttgtatcgagggcgaattagagtccaattgaaaaacgacgacggtacgctgtgcaatccaaacttcccaaccagagacagcctaatgctccatttgggagacatgattcccaaattgaagagcagacaaaacaagggcagtggagatcctcaaccgaccaccaccagctcgaagggaaagggcaaaggcaaaggttggcgtagaaaacaaattgtacagcagagaacg

SEQ ID NO: 1009 - DNA, 2199 bp, Phyllotreta atra
atggaagaaccggagcctactaaacgccagaagatgcccaaagtggccaaagtgaaaaacaaagccccagccgagatccagatcacagctgaacagctactgagagaggcgaaagaaagagacttggaaatcctcccgccgccgccgaaacagaaaatttctgatccggctgagttggcggactatcagttaaggcgcagaaaacagttcgaggataacatcagaaaaaacagggcggtcatttcgaactggatcaaatacgcgcaatgggaggaatcgcaaaaggagatacaaaggtccaggtcgatatgggagagagccctcgatgtggaccacaggaacattaccatttggttgaaatacaccgaaatggaaatgcggaacagacaagtaaatcatgccaggaacttatgggacagagctacagttcttttaccaagggtaaaccagttttggtacaagtacacctatatggaagaaatgctggaaaacgtagccggagcaagagcggtattcgaaagatggatggattggcaacctgacgaacaagcttggcaaacttacataaatttcgaactgagatacaaggaaattgacagagccaggcaaatatacgaaagatttgttataacgcatccggaggtgaagcattggatcaaatatgcccgtttcgaagaaaatcacggtttcattcattcagctagacagatttacgaaagagctgtccagttttacggagacgatcatttggatgagaagctctacatagctttcgccaaattcgaagaaaaccaaaaggagcacgatagagccagggttatctacaagtacgccttagaccacatccctaaggatgaaacgaaagaactgtataaggcgtacaccatccatgaaaagaaatatggagacagaagcggtatcgaggaagttataatgtctaaacgaaagctgcagtacgaacaagaaatactccaaaatcccaccaattacgatgcttggttcgattatctccgactggtagaaggagaagcagatttggaaataactcgagaaacctacgagagagccattgcaaatatacccccgtcgaaaaacaaacaatactggagaagatacatttatctgtggatcaattacgctttattcgaagaactggaagcaaaggattacgaacgaaccagacaggtatataaagcctgcctggaaatcctgccgcataaaacgttcacgttttccaaaatctggctgctctacgcacagttcgaagtgcgacagaagcatttaaaagcagcccgcaaagtcctaggcatgtccataggaatgtgccctagggataagttgttccggggttacatagagctggagatacaactccgggagttcgataggtgtcggaaattgtacgagaaattcctggaattcggtccggagaattgcgttacttggatgaaattcgctgaattggaaactcttttgggggataccgacagagcgagaggcatttacgaattggccataaaccaaccgagattagacatgccggagttactgtggaaagcttacatagatttcgaaatatctcaagaggaacccaacaatgccaggcaaatttacgaaagattgctagagaggacatcccacgtgaaagtgtggctgtcgtacgccaaattcgaattgaacaatccgagtgaagaagatttcaacatacgtttagccaggaggatcttcgagagggccaacgaaaatctgaaaaacgtccccgaaaaagaatccagagtattattgctggaaaactggagggaattcgaaaacaatcacggcgatgaggcgcacaaagaaaaggttaacgctaaaatgcccaagagaattaagaagaggcagaaggttatcgatgaggatggggtcgaacaaggctgggaagaagtatttgattatatattccccgaagacgaagccagcaggccgaacttgaagttactggccgctgctaagaactggaagaagaacactgatgagccggaggaagatacggaaaatagaacaaccctttccagcagtagccaaaggatgaaagaaaagctattagcctccgtgaagaattggaagaataatgacaaagaaaatagtgattctaataacgatgactgttcgaatgaagaggaagttcaagttgtttctaacaatgaagtagaaaattga

SEQ ID NO: 1010 - DNA, 1431 bp, Phyllotreta atra
atgggaattaaatttttggaagttatcaagcctttttgcagtatcctgccggaaatcgcaaaaccagaacgaaagatacaatttagagagaaagttctatggacagcgataacactattcatctttctagtatgttgccagattcccttattcgggatcatgagttcggactctgcggatcccttctactggatccgtgtgatcctcgcctccaacagaggcaccctcatggaactgggtatctctccgatcgtaacatccggattgatcatgcaactcttagccggagcgaagatcatcgaagttggcgacactccgaaagacagagccctgtttaacggagcccagaaactgtttggtatggttataacggtgggtcaagccatcgtgtacgtaatgaccggaatgtacggagacccagccgaaataggagctggagtctgcctgcttatcatcatccaactgttcgtggcaggtcttatcgtgctccttctcgatgaattgttgcagaaaggatacggtttgggttctggtatttcgcttttcatcgctacaaacatctgcgagacgatcatatggaaggctttctctccggctactgtcaacactggaagaggcaccgaattcgaaggagctgtaatcgctctgttccacttgctcaccaccagacaagacaagattagaggattacgagaggctttctaccgccagaatcttcctaacttgatgaacctcctagccacagttttagtgtttgctatagtaatatacttccaaggttttagagtcgatttaccgataaagagcgccaggtaccgtggccagcactcgagctaccccatcaaacttttctacacttccaacattccgatcattttgcaatctgctttggtgtccaatttgtacgttatatcccagatgttggcggttaaatttcaagggaacttcttcatcaatctgttgggggtttgggccgatgttgggggcggcggcccggctaggtcttaccccatcggcggtttgtgctattacttatcgccgcctgagagcgttagccacattctggaagatcccgtccacgctgttatgtacattattttcatgctgggttcctgcgctttcttctcgaaaacgtggatcgaggtatccggcagttcggctaaggatgtcgccaagcagctgaaggaacagcagatggtcatgagaggtcacagagacaattccatgatacatgaactcaacaggtacattcccactgccgctgctttcgggggtttgtgtatcggagccctgagtgtgctggccgatttcatgggggccatcggttctggtactggtattttgctcgctgttacaatcatttatcaatatttcgaaatatttgtcaaggaacaaagcgagatgggcggcatgggcgctttacttttttaa

SEQ ID NO: 1011 - DNA, 453 bp, Phyllotreta atra
gtcgaattagtgtgtttaccaaaagtattagaatatagccgttttaaactatattttaaatatagtacaatcatgtcgacggtttcatcttcagctgttgaattaagttcatacagggatcagcattttaagggcagtcgagctgagcaggacaagttattaaggctttctacgaccttatacgtaggaaacctatcattttacacaacagaagaacaaatttatgaattattttcgaaatgcggcgacattaggcgaatcgtgatgggcctggacaagtataagaaaacaccttgtggattttgtttcatcgagtattacaatcgcgaagatgcagaaaattgcttaaggtacatcaacggtacaagattggacgataggatagttcgaacggattgggatgcgggttttatagaaggcagacagtacggaaggggaaagaccggtgggcag

SEQ ID NO: 1012 - DNA, 921 bp, Phyllotreta atra
atggctgccaccgtagggcgaatttgtggtgtagggctattaaagccgaataatttaaccaccatcggtcagatcaactcctattcgaccgccaaagaatggagtagaggtaaaaaggcacttttaggaacattagggttattagccggaggcactggggccgtactagtggccctcgaccaatcggttaaagcgtcggatctagaactgcacccgccgaagaacatctggagccacagcgggatattcagctcacttgatcacgccagcgtccggaggggttacgaagtctacaaacaagtatgcgccgcatgtcactccttgcgtttcgtggcctaccgcaatctaataggcgttactcacaccgaagccgaagccaaagccgaagccgaagaccagatgatcgaagacggccccaacgaggagggcaacatgttcaaacgccccgggaaattgtccgactacttccccagcccttaccccaacgaggaggcggccagggccgccaacaacggggcctacccgcccgatttgagctacattacgtctgctagacacggagccgaggattatatttttgcgctgttgactggttactgcgaggccccagccggggtggttgttagagaagggcagtactacaatccgtacttccccggcggggctatttcgatggctcaggctttgtataacgagacgattgagtacggtgacggtactccggctacggctagtcaattagctaaggatgtgtcgacgtttttgaagtggacagcggagcccgagcacgacgataggaaaagaatgctgatcaaagccatagggatattctcgttcttgttagggatcacttggtacatcaagaaggtgaagttcgcctcgctgaagtcccgaaagatcgagttcaggccgaagaaatga

SEQ ID NO: 1013 - DNA, 1389 bp, Phyllotreta atra
cgagcccacgtcagcgaattccaattcgaaaaccaaagaaggactttcaccagctacggttacgctttggacccgtctgtaaccaacgacgggaaaattaaagtggttggatcttcggaagccgatgataatagcattaagactgtgttcgaagcctctaagacgagacctttagataagcgaaaaaggaagaagaatgatgaccccagcgatgtggaaggtttcttaggtccttggggtggattcatagacgaacaaaaagtatccaaaccgaccgaggaagaacaaatcgaattggatgagatatcctccaagaagaataaaaagggtaaacccaacgaagataaacccctcgaagaaaaatcagtcttgcacatcaaagacgccgtggattaccaagggcgctcattcctccatgcgccacaagatgtcggggttaatctcagatcggacactcctccagagaaatgtttcctacccaaagctcatattcacacttggactggccattcgaagggcatcgctgctatccgattgttccccaggactgctcatcttctattatcagccggaatggactgtcgtattaaaatttgggaggtttacaacgaaagacggtgcgttaggacctactatggacatcgacaagccgttagggatattaatttcaacaattccggaaagcattttctttcggccggttacgacaggtatataaaattgtgggatacggaaacaggacaggttttgtcgcgtttcaccagcaggaagataccctattgcgtaaaattcaatccggataaaaacaagcaacatttgttcgtggccggtacttcggataagaagataatttgttgggatacgaggtcgggggatatcgtgcaagagtacgacaggcatttgggtgctgttaatagtattacgtttgtggatgaaaatcgacgattcgtgacgacttcggatgataaatcgttgagagtatgggaatgggatattcctgttgatatgaagtatattgctgatcctactatgcacagtatgccttctgtaactcctgcaccaaacggtaaatggttagcttgccaaagcatggacaacaaagtggtcatattctcttccatgaacagatttaagattaatcgtaagaagacattcagtggccacatggtggccggatacgcttgctcgttggacttttcgccagacatgagttacttatcatccggcgatgccgatggtaaagtttatatatgggattggaagtccactaagcttttcaagaagtggaaggctcacgataacgtttgcatcagcgtcctgtggcatccgcacgaaccgagtaaactgatatctgctggatgggacggcctaataaagtactgggattga

SEQ ID NO: 1014 - DNA, 732 bp, Phyllotreta atra
atggtgcagaaaaagcccaagaagaaggtgggaaagaaggtagccgcggctcctttggcagtcaaaaaagtcgagcaaaagaaagaagtcaatcccttattcgaaaagagacctaggaatttcggaataggccaagacatccaacccccgagggatctatccaggttcgtgaaatggcccaaatacatccgcatccagaggcagaaggccgtcttacagaaacgcttgaaagtgccgccgccaatcaaccaattctcccaaaccatcgacaaacaaacggccacccaattgttcaaagttttggagaagtaccgaccggaaaccgccttgcagaaaaagaaccgactgaaggctaaggccgaggccaaggtggccaaaaaggaagaggcccccgccaagagacccaatactttgagagccggtactaacaccgttaccaaattggtcgagcaaaagaaagcccaattggtggtcatcgcacacgatgtagaccctatcgaattggtactattccttcccgccctctgcaggaaaatgggagtcccctactgcatagtgaagggtaaagctaggttagggctactcgttaggcgtaaaacttgtgcgactgtggcactaacacaagtcgattccggagacaggtccaacttcaacaagctcttggaggttatcaagaccaacttcaatgaccgtgctgatgaaatcaggaggcactggggaggcggtatcctc

SEQ ID NO: 1015 - DNA, 1002 bp, Phyllotreta atra
atggcaacaataattaaggacataaccctacaagaaaacattccacaaaacatactattcgaaaaacatatcgacttcataaaggaatacggccaaaaggaaaacaacttcgaatatgcaatgaccgactatttgaggatatccggcatgtactggggcctcacggctctcgaattaatgaacgcctcaccaccacactcaatagacgagatttcagattacatcaaacagtgccaagaccccgaaagcggtgggatcagctcttgcctgaaccacgatcctcacatactccacaccttaagcgccgttcagatactgtgcatgtacgataacttaaaagctatagatgtagagggcgttgtgaagtacgtaaaaaacctacaattacccgacggtagcttcacaggagacaaatggggcgaagtggacaccaggttctcattctgtgccgtcgcgacgctctcgctattggacagaatggacgtcatcgacgttaataaagcagtagacttcgtagattcttgtaaaaacttcgatggcggtttcggctcgaggcccctctccgaaagccacgccggcttaatatactgctgcttaggattcctgtctgttaccaatcgattggatgttgtggatcgagatatgctggcttggtggctctgcgaaaggcaattaccttcaggcggtttgaacgggcgtccggagaagctgcccgacgtttgctactcctggtgggtgctgtcttctttaactatattaggaaaactgcattgtatcgacgccaatgcgttgaagaaatttatattagcatgccaggataccgagagcgggggcttcgctgataggcctggagacattccagatcctttccacacagtgtttggaatatcagcgctgtctctactcggaaacgacacggtccagaaagttaatcctacttattgtatgccccagcatgttatcgataggcttcagttgaaacctcaaattttagatgattag

SEQ ID NO: 1016 - DNA, 2667 bp, Phyllotreta atra
atgcaccaagaaacattgcaactaatccaaatattagaaaaaacagtttcacccgacaagaatgaattggagcaagcttcgagctttttggaacaagcgtcccaaacgaatttactaggattcataaagaccctctcagatatactgcggcatggcggcaacagcccggtggcccgaatggccgccggcttacagctgaagaaccaactcacttcgaaagacgcgaccatcaaagccacctaccaacagcgctggctggtcttctccgaagaagtcagagactacatcaagaagaacgtggtcggcgccctcgggaccgagaccaacaggccgtcgtcggccgcccaatgcgtcgcctacatagcggtgaccgaattaccgcaaggacaatggccggatctcatatcgacgctggtgagcaacatttgccaggggaattccaccgaaatgcagaaggaggccacgctcgaagccatcggctacatctgccaggaaatcgaatccgatgtcctagtgacccaatccaacgatatactaacagccatcgtgcacggcatgagatcttcagaacccagcaatcacgttcgattggccgccacgcaggctttgctaaactcgttggaattcaccaaagccaacttcgatttacccaccgaaaggaattacatcatggaggtcgtttgcgaagccacgcagtcgccggtgtcgcaaatcaaggtggccgctttgcaatgtctagtgaaaatcatgtcgctgtattaccaacacatggagccctacatggcgcccgcgctgtttcccataacgttagaggccatgaagtcggagaacgatgccgtggctctgcagggtatcgaattttggtcgaacgtgagcgatgaagaagtggatttggccatcgaagatacagaggctactgaagctggtagaccgcctacaagggtgtcgaggcattatgcgaagggagccctgcagtacatcataccgattatcctgcagaaactcacgaaacaagaagagttggacgacgaggacgattggaatcccagtaaagccgccggggtgtgcctcatgcttctggccacttgctgcgaagacgaaatagtcccgcacgtgttgccgtttatcaaagaaaacatcaaatcagacaactggcggttccgcgacgcctccctgatggccttcggttccattctgggtggcttggagccgaatacgctgagaccgctcgtcgaacaggcgatgcccactttgatagaattaatgtacgataacagcgtaattgtaagggatacggcggcttggacgtttggtaggatatgcgaaatcataccggaggcggccatcaacgagaattacttgaaacctctgctggagagcctcataaccgatttgaaagcggagccccgtgtggctgccaacgtgtgctgggcattctccggattggccgaagcggcctacgaagctgctgccgttaacgaggaaactggagctcccgatacttacattttgtcgccgtattatgagtttattatacagaggttactcgagactaccgatagagctgacggtgcacaagctaacttgagaccggcggcgtacgaggccctgatggagatggttaagaattcgccgaaggactgttacgttacggtgcagaaaaccacgatggttattttggaaagactgcaacaggtactgcagatggagaatcacattgccagccacaacgacagatcgcaattcaacgatttgcagagccttttgtgcgccacattgcaatcggttttgaggaaagtcacgcccgaagatgccccgcacatctccgatgccatcatgacggccatgttgaccatgttcaattccaattcttgtaaaagcggaggcgtacaagaagacgccctcatggctgtatcgaccctcgtagaagtcttgggagagaatttcatcaaatatatggacgcttttaagcccttcttatacattggtttaaagaaccaccaggagtatcaagtgtgcggcacagccgtaggcttgacgggcgacatcttccgagctttgaagctcaaagttctgccttactgcgacgaaatcatgactcttttactggaaaatctcagcgatcaatcggtacaccgtagcgtcaagccgcagatactctccgtattcggcgacataggtctcagcatcggttcggaattcaagaagtacttggacgtggtgctgtcgacgttggcgcaggcgtcccaagcgcaagtcgaccgcaacgacttcgacatgatggattacctgaacgaattgcgcgagggcgttttggacgcgtacaccggcatcatacaggggctgaagggggacgggccgtcgcccagtccggacgtgatggtcctcgagccgcacattccgtttatcgtacagtttattatcgtggtggcgcaggatgccgagcattccgacggcacggtggccgtagccgctggaatcgtaggggatttgtgtacggcgttcggtagttcgatggtgccgttgttggatttggcttcgatcaacgatatgttggcgcaaggtagacgcagccgcgtcagcaggaccaaaacgttagcgacgtgggcttcgaaggagctgaggaaacttaagatgccgccatccgcggcggctgctagctggtga

SEQ ID NO: 1017 - DNA, 1221 bp, Phyllotreta atra
atggaaacgattttagaacaacaacgtcggtatcacgaagaaaaagagcggctcatcgacgccatggttaaagaaatgctccataaaaaaaacacctatagagaggcgataaattcggaccaccggcaaaagtaccttctagacagatacatgacgtccaccgaaagactgatagatttgtacgaagacaaagacggacaacgtaaggccgaggtggccgccctgacgggccccaatgaattcaacgagttctacagcagactgaagcaaatcaaagatttctacagaaggcacccgaacgagataagtgtaccgatgtcggtggagttcgatgaattcgccaaagccagggagaatcccaacgaagatatggccaatttcgtggaatttaccgacgaagaaggctacgggaaatatttagatttacacgagtgctacgagaagtacataaatctaaaaggcatcgagaaagtcgattatatcacctacttggccatgttcgatcaactgtacgacataccgaaagaacgaaagaccggcgagtacaggaaatatttgctgtacctcatcgagtacctcacgtggttcgtgcaacgcatcagaccgctgatggatctcgatagcgatttgcaggagcaggccgatcaggcgtcgggcggctgggagaacggaacggtgcccgggtggccgaaagaaaccggttcggctttggcgaacgtgggcgcccatttggacctgtcggccttctccagttgggaggaattggcttcgttgggcttggatcgcttgaaatccgcccttatggcgttgggattgaaatgcggaggaaccttggaggagcgcgcccaacggttgttctcgacgaaaggcaagggctccttggacccgtcgctgatgacgaagaacagcaagaatcgcgtgacgaaggagaaggaggcgctgaggcaaagggaactggccacgttagaagcgcaaatttaccgattggccgatctggtgtcggcccaacgcgccgccaccaaggagaacgtccaaaggaagcaggctcgcacggacggcgaaagggacgacagcgagaacgaagaaagcgaagaggagagtccggacgaggccgatgacgacgtgccctacaatcccaagaacctgccgctcggttgggacggtaaagtaagtcgtgcgaaacgcgacagggaacttatagtattggaaactaatggctaa

SEQ ID NO: 1018 - DNA, 639 bp, Phyllotreta atra
atgacgataggaaagaataataaaatgatccaacacataaactatagagtccgaataacattgcaggactctaggacgtttatcggcacctttaaagctttcgacaagcatatgaacatgatactcggcgattgcgaagaattccgtaaaattaaacccaaaaactcgaaagtcgaacgagaagagaagcgggtattaggatttgtactgctgagaggcgagagcatagtctcactaactgtagaagggcctccaccaccagaagaaggacttcccagggtacctatacccggagcagctcaagggccaggtataggaagagcagcaggtaggggaatgcctcccggtatggctggagtaccggttggtctccaaggtcccgttagaggagtcggaggaccgtctcagcaagtaatgactcctacgggtagaggacaggtctcagcgccaccacaaatgaaccaagcgcctccgaggatgggtggccctccgcctggtatgatggggccgccgccgggaatgatgggcatgccgccgcaaatgggtatggggcgcggaggaccgcctccgatgggtatgaggggtcccccgcccggtatgatgagaggtgggccacccggaccgccaaggccttactaa

SEQ ID NO: 1019 - DNA, 876 bp, Phyllotreta atra
atgaactttggagacttggagtttggttttaaaatttcaaggaaaacaataccattaattgtaagagaaacttgtttggccatatggaatgttattcaacctcaagaaattccatttcctacgaaggagctgtggttagagaagtccaaggaattttatgagattacacagtttcccaattgtattggaagtatcgacgggaaacatatcaggataatttgtccccctaactctggctcagagtatttcaattacaagaaatacttctcgattgtccttttggcggttgctgacgcaaattattacttcacagctgtcgatattggatcttttggacgcgaaggagactctacgatcttcaaaaagtcaaattttggactaagactcaaaaataacgaactagacctgcctgcagataatcccctaccagtacctgacaatgtggagcaaggttccgaggtaccctatgttttgctcggggatgaggcttttgggttgtcaaagcatgtgatgcggccatacccgtccaagggattatcgcaagaaaagaggatctacaactacagacactgccgagctcggcgtgtcgtagaatgctctttcggaattctctctaacaaatggcgtgtgctacattcttctatgttaatacatcctgaatttgctgtcatcgtagtgcaggcttgttgtgttttgcataattttgtgcgaagaagagatggctacctttttgaggatactctaacctgcccactgcaggatgtgcaagaatccgctgttgtagggggcatgtcaaaagggatcgatgtaagagaagtgttctgtcaatatttcaatggttctggagcactttcttggcaaaacaaatatgtgtaa

SEQ ID NO: 1020 - DNA, 15540 bp, Phyllotreta atra
atggaggaattaacctctggtttggatcccgacgatttgatggatctggacgagcccgagggctccgatctggaggaggacgacgaggatctcatcgacgatcacgtctcgtcgcctttcatctcgtcctcggcgcccgagtccacggccaactccgtcgcctcctcgcccatccacgaagacttcccgccgcccttcaacttcacggggaagcctctgcacgtcaaacgaggaagaggccggccccgaagagaaggaggtaagccttcggcgccgcgaacgacaagaggcggtggaactggagtatcgagagtacgcagaccgagacccccggggttttcgagaaggggctcgttagggggaagtcgaagtgttaggcaagtagatagatcggattatgacatgtccttgttcaccggttcaccggtggatgacggtttgttggatcccgaaacgggttcgatgatcttccccgagaagtttgttcccgcgatcgaggagcctccgtactttccggagcattggccggggaaagtttgtgccttgtgtaatttaggtgaaagaagccagctaggacaaggtgaaatgttaagattaaattgtccggaaggattctcgccggagaaggttattagtgaacaaatattagaaagagcgttgcaggctccggataaagaatgcggggataagagtccgaaaggtcctgtgacgtgtagaaggcagaaaagtttcaacaaatgcagacatccttcgataaccagtgaatacgttgatgaattaactataattggatataatgaagtacctgatgtatctagtttgtttgagtctaacggacagttttacgttcatcgtaattgtgcgttgtggtctaacggtgtgacgaaagcagaaaattctgctttgttgaatgtaggacctgtagtgtcgcaatgttcttccaaaaagtgtaccttctgtaatcattacggagccagcctgacctgccacgttgacaaatgtaccaaaatttatcactttccctgtgctactgctgccggtgcctttcaggacgtttctgcgttgacaactttatgcaacgaccatttcggacaagtggctatgctcaccaccgcatctccgtgtttaacttgcggctctatgggagatatagcgaatttgatgttttgttcgggttgcggtgcgcattaccatggaatttgcgtgggattggctcagttgccaggcgttagatccggttggcagtgtaggaaatgccggtgttgccaagtgtgtcgagtcgtcggagacgaatcgaagctgatgacttgcgaacaatgcgataaaatttaccacgctagttgtcaaagacctgtagtgacttcgataccgaaatacggttggaagtgtagatgttgtagggtgtgcggcgattgcggtgcaaggactcccggggccggtttatcttcaagatggcacgctcactatacagtatgcgattcttgctaccaacaaaggaataaagggttttcttgccctatttgccataaggcctaccgcgctcacgctcatagagaaatggttcagtgttcgagttgcaaaaagtttgttcatggaacctgtgatccggaggcagacgttgttacctacaatcaaaagaaagaaataagcatggactatgaatacgtttgcttgcattgcaaaaatagcacagctagacaaataacagcgaaacgagcaagtattgatgatccttccgatgtatccgcttcacacgattctctatatgacgatacgtccgaattcgatcttccatcgcccgacgagttcgccaggaacatgggtttgggtaaagggaaaccgtacagcgcgaataaaatagccaagaagcgccttagtttcacagtgaatccggttggcaggccgaaaggtaccggaaaagtgccacccgggaaaatggggtacatgaaacgctaccgactgacggagttcaatagaaaacggggcccgaaagccaaaatgaggggtattttcggcgtgccgggcgtcggtctgcaaagaccgatctcggatgggaaaaccgacgaagaaccgggcgttgagaatcgattggtattgtgttcagccaaagataaattcaccctaactcaagatatctgcgtaatgtgcggggcgttcggcaccgatcaagagggttgtttgatcagctgcgtacaatgtggacaatgttaccacccatattgcatcaacgttaaagttactaaagtgattttacagaaaggatggagatgcttagactgcacggtttgcgaaggctgcggccaacgaaacgacgaaggccgcctcatactgtgcgacgattgcgacgtatcgttccacatctactgcatggacccgccgctcgactacgtgccgcacggcaactggaagtgcaaatggtgcgccatctgccaatcctgcggcaccaccgatccgggtttcaattgcacgtggatgaacagctcgacgcagtgcggcccgtgcgcctcgcacgtgaactgccccagctgcaacgagccgtacggcgagggcgatctgatcatacagtgcgtgcagtgcgagcgctggctgcacggcgcctgcgatttcatcaagtgcgaagaggacgccgagaagtgcgccgaagagggttacaattgtatattgtgcaggccgcgggacgtgccgccgccgcatatggtgccggcggcggtcacgccgaagccgcccactcccacgaagagtcccgagttggggaagagtacgagctattacatggacggtgtgtgtctcagcgaattcggtagcaacttgatcaaatcgttggctctcgagtaccacgggtcgaggaagaaacggaaaaagatacccactgtgcaggataaggaagccggtattatggctacgattgaatcggtggttgccggtggtaatgttattcctactaatatggaagacagcgctaaattggagctagtcgacatcaaagacgaacctcaagaactgtacaaggaaggcatgatgtggaccaaagaagacggtccaccacccgaagggtttacgataataacgatggagaacggtttgaacgtgctgcgaaggaagaggcagcgcaatctgcagaagctcggtattgggggattcgtcgtcaggatgagaggtatcagaacaggtcaggataacgatgatgttgattcgtccattggtcaaagtgggctcaacgccaacgatatcgtcccatcgcctgcggacggggacaaacctagaaggaaaactattcgtcgaaagttgaagagtaaattagcagaaacgtttccagcctatcttcaagaggcttttttcgggaaagatcttatggatacggtcgattgtaaaaaggaagaagtcgattgttatagcagcgatgatgagaaaactgacaagcattttaaatcgattaatttatcacaagacgaaataatagcaatcgtggcatcaggtaaaaccgagaaattggaaaacaataacaaagattcgaccaaagaagtcaaaccgactgtgttgaaggaggaagaagaagataatccggaggatttgaaagatgttcttgccctaccgggcgacttactcgataccgatttggttaatagcattatggaagacgaggaggaactgagcaaaactacagcgtctcttgttgctttagattcgaatttacagcatgatgcggaactgacggacactttgagtagttcaggaaattcgaaagaaaccaaagatgaattgagcgacattttaggccctcatttcaacctcgattccatatcgaacataaacagcaaggacgtcgaagacatatttaagggcgtattaacagacgagtcgcaggaatcccaagaaagcagtagcttctccttacaaggaaataatatgttttcgaataataatgcgcaacaaaacgttgcccaacaccccattattaatcaagcggtgagaccgaaaacattgcctactgttaatcacaatttgaattcccctgttagtttcccacccccctcaccttaccactcggagtacagcaacagtcctcagtttagtcctgcgttcaccgattcgtcctgttcgtgggtaggaagtaacgaaacgccggaaatcgatagtaccaacgtaacggtgacgtcaacgtacaatcagaggtcatctgataaaatgaaagccgatgaaagtttgggcaaaagcgccacgatttcggccgttttgtatgcgaacatcaaccatcccgaatggaagaaggagtatccgaattggcccgataggtataagcaaataataaagaaatggagaacgttgagtcaagaacagaaagcgccgtttttgcaacacgctagagataacaggagtcagttgaggatgaagaaagcgcagcagtcacagaccgtcaaggaaaccgcctcgaccgccacgtcccccaatgcgaccaagcctccgcaccaagccggtccagccttagtgacaactctccaggcggtaacgcaacagccggcgggggcggccgcggcccccgcgccgcccgtttcagaggaccaagaaaagatcgccctgcaacagaaatccgccagggaagccgaacaggagagacaatggaagcaattgcaggccctcaggcagcagcagacccaacaaacgcagaacattctacacgaacagcgcgttcaagcgatcgcccgtgtacaacgacagatatcgaccgatccagcgcagcagttcataaacgagcaacagagccctctgcaggtgaacacgcctcaggaattgagcccgtcaaccacgccggctcccagtcctcggccatttttgggcattaaatctcccacgttccccgtaccttcgcccgttccgccaacgggcgtcagggccaacacgccctcgcaatcgccccacgatatctcccaacccagcacgcccgacggtaacgatcactttatccactcccccaccaatcctaaacctaatttccaacctagattgcccaatgatccgttcgccgcgcaacccgccacgccgcgaccgcaattcgggatggcccggccacctctgcagaatttcggcggtacggttcgcaacgagcaacaggacatcaacatcaaccgccaattgagggagctgttgcagcggcagcaggttaaaaaactggacgaattgttgcctggaaaagcgccacctcaaagattgtggcacgcgaatgatcagcaagaggccggcgacgcctcgatgacgtcggctgtggtccagggcgccggtgcccaaggcaccgacgccaccttccggcagcctctaccgcccggtgtggtgaaacctaggttggcgatttcgtcggtgaataggccgatattgggcacggttagagtcaatcaattggatcccaggatacaaaatttggatccgaggatgaggttgattttgcaacatcagcaacaaagactggccaccggtattcagcagcaattcatccgtttcacatcgaacgtgcgaccgacgacggtggagcagtatgaacaattgttgcaacgtcagggtaataatcagaatcaaattcacgcggaggaacaacagcagggcgttgcccgaatacccatagcccaggccagcgttatacaaaggccgcacgtggctcaagcggtggtgacgggcgccactgctgttaccacgagtaccacagaaagtaatcccagcgaggagggaatccccgataatgtaactgccgaattggagaaactcgaacaggaaacaggcaccatggtggagcttcaaggcgtaagcgatatcttaggaggtttggacgatgacgatgagcttttggccgaaatgggcgccgattttaacatactcgaatacgcggatcccgaattggaggccctaacgggcggcaaaacgaacattttagacctggagctcgaagaggaaccggtcaaaaaagaaaaactagcctctaacgcgaacacttgcgctccttctcagaaaccgactcctaacgtcgctactacagccattagcaacagcaccgctgtcactacaccgaccgaagctactgcagaacctaaaatcgagaatacaattcaacagagcattccgaaatcgacgccacaacagctacaacatcccgcttctcttccgcagcagcagaacatgccccagcacggggcccaagttcaagtgcaatcgcaacaatcccagccgcatccgccgcagcaaatgcccatccaatcgacgctgcatatccagcaaattcaccagcaaatggtgcatcaagttcagcaagccgccgcacaaggaagacccatgccaccgggttcgaagatgcaaaccaccgatggattcgttggtgttgtgatggcgaacaacgccgtacaattacagatacctccgaattatcaacaacggttgctgctgttgcaacaactgcaaaatcaaaaattgatgcgagtgggaagcacgcagcccagggccgctttgcaagtggcccccaatcaaatgcccgtaggtatgaatccgggagccaggatgccggtgtcggcgccgccgccgcctccgccgccttatcccgggccgccgccgccctatccgggcaacgcgaatcaacatcaacagacgggattgagaatggggcctggtcttctcccaatgggacattttcatcccagtacactgcagggttttcccatgcatccacacttgcagcggagacctcttctcctggaggagcaaccgctgctgttggaagatctgctcgagcaggagaaacgcgaacaggagaagctgcaaaaccaaccgcccaaccacgaagtcacctcgtcgaccggcaacgagacggaatcggcgctgctgagcgaccaagacttcgagcgactcaaagccgacgtgtttaacagcgccccagtgagtaatatatcgtctacgaatcaagggaacgccgcccaaacgtcgcaagcgtggccccagctgcaaaataggcaggcggcggtaccggccgccgcttcgcagcacacgatggaagtgactactagagttcaaatgtacaatcctaatttgataccggcgccgccgctcccgccggagaatatcgctacggagcaggacaagcaggcgcagctgttgtacgagcagtggctgaaccaccagaacaactcgctggtgcagcaattgcgctattacgagaccgaagtgcagaaacttcgtaagagtaaaaagtcgctaaatagcaagcaacggcaattgaggaaagctggtaaccagttaaccgacgcagatgcgactgaacttcagagaatcacagcggaacaggctatattacagaaacatttggaatcgagcaggaaacaaaatcggcaacatggaatgttgatacaggtctatatgaaggaatatcgaaacaagcatcccgccatcaagcagagaaccgtaacggaccagatccaatcgccgttgggccatccggcgtcgtcgcccatacaacaatcgagcgcctcgttgtcgcccatgttgtcgccctccgtgtcgccgatgacgcagaacagctcgccgttgaacagccccgggccgatggtgccttcgtcgcccggccacggtcccgtgcagaacattttgcaaagccccaacggcgccaacgcggctcaaatgtcgcccatgcaggcgtccccgatgcaatcttcgccgagaatcggtacgcctcattctcaaagtgatgaaagtcccggatcggcgcaatcgccgtcgcaggtttgcctgccgccgcccatgcctcgaatgacgtcgcctcagcaccgacgagtcgtcaccagtccggtgggaatgtcgcaaatgcgttttataaacaacaacatgttgcagcaacgcgttcgcatgcaatcgcccatacagaatttccaacagaaacccggcacgccttcgccgttgaacagcccgacgtcgcagcaaatgaacgtcaaccaacaacatcaaatccagaaacagctgcagcagcaacaacagcagcaacagcagacgttgttgcagcaaaatttggaaggcgatcctaacgccattcactcgcagaggaccacgcaattgttgcagcaccggaatttcatcaggcaacaggtgtcccagcagcaaatatcgcctcaaacgttgacgccacaacagcatcagttgatgctgcaacagcaaaagcagctggcgcagcagcaacaacagcagatcgcccaaatgaacgcggcgagattgcaacaacaacagcaacagcagcagcaacaacaacaacagaataaccccccgcattcgccgatgccgcccaaaagtcctatgattaaccagcagataatgtcgccgcattcgatgccccaatcgcccatgcagatgccgccgaagagtcccatggtgccgtttaatcccaaccaaacgaatcccaattcgcctgcggctagaagtccggctttccatcagggtatgaaccaaccgacgagtcccatcactcacggccatcaacctccgagttctccgatgcccaggagtcccatgatcaatcaaacgcactctccgcataacgttcgaaggcctcccagcgccaacagcagcccggccatgcctgataggccgcacagcgtagaaaactcatcgcccaggatgtactctatagatcaattggtgcaggagagtttggccaatcaaaatgtgaacgcgcaatataacagttacaattcggatatgatcaacgaaagcggtggagggaattcgaataacccgataccttgtccaccggaaataccgagatttcgttattttaagctcggtttgagaggcggagcgccgatgtggagcttcggaagaggcgccaaaaggatcccagcgcctccgaacgccaaaccggacgagcccaaggcgaagaaggagtcgcatctgagcaaagtttcgatactgaaaaggaaacccccgatggcttctatcggcaaagtgggctcgttggttagttcggattacaacgatttagacgacagttcgacaacgcctcccgtaacgccgccgttggcttcgaccagcagaggaagtctgtcgaagaagaagaatctcgaactgcaagcccaaaaggattcggtgatcgtcatgcacagtcccgacgacaacaacaaacagctcgaaataatggattacgacgacgataataacacggtgctatcgtcggaagtgtcgttgagttctgtggcaagaaacgacgacgacttggtggagatcgaaacgatatcgcaagacctcgccgaagggctatccagccccttggaatcggatcaaataggcgacgaattcctgttgtttcccggcaatatggtggtggacatgtccggtgaagagcattactcggaaaaagaggaagaggaaaccgtcgacggggaatatacagatcagaatatgcacatagtgatacgcagcccgaccaccagcgacgacgagttcataatgccttgcaaagtgaagcagtacaacgcggacgagcaggaggataatcccgaatcgcccgatcaggaggaattcggcgaatccggcgatatgatggcgagtttcgataacgaagacacggatataatcatttcggatcaaaccgccggcgttcccgaggactcgatttccacgaaggaagacttcgaggagctcatcgacgaggggtcgcgtaaaaacaacatcagcaaacaggaggtgaccgctaaacacattcaagatttccacaggtacaccgaattgttcgattacggtaaacctgaagctcaaccggttaagaaaccagtcgctaaaaagttccaaccgaaagtatctctagttagaggagtagctttgcccagtaagcccaacaccgagaagatcatcatcacgcaaaattcgaacgtgttgaatacttctcaggcttcgaaagtcaccagcatcattttaacccacaacgccaacgttagaaggaacattataagcgtaccgaaaatagtgagtaccgtttcacctgccataactatagtgagtgccagtacatcgcaaatggcctcgatattaccatccaaattcaccgtgccggtcataagcgccagcgcggtacgccagctatccaacgtcaaagtcatcgacaagccttccacttcttcattgtcgatttctaccagagacaacgtcctgccgaagaagatattcgaggacgattcggtgtcgccggacagttccaattgcgacgatgagaaatccaaagattcgttcgacgataaggtcaagtcggagtcgccgccgcaggaggtcaaacagttcgtgaaatcggattcgcaggttatatcgttgaaatcgaagaactacgccgatcaatcgaagaagatcgaacatctgcaaatagtgaatatatcggcgaaggatgtggttcaaaggcagaggataccgagtcctttgatatcgaaagcttctccagttatcatccacaatacgccagagttgaaaatgactgcgcaagttattcaagagagccaaactcgcatgaaaattacgactactactgataccgaacattacgatgagtctacggatgatacgaaatcagttgtaatttcaattccatctcctacaccttcgcaagaacaaatgctggatagtatagcctttcaggcgttggaaaacaggagaagagagtacgattctattgaagacgtgttagatatgattgagaatatagaaaacatcaccgccgaaccgcccgagatattagaagaaaacacgttgcaaaattccgattccaacagcaacatcgaaaccaaaaccgccgaaacgaaggagctgcaattgcctaccagcgaaagcgaagcgcccgctaccaaatcgtccatcgtaccgcaattatcgcctctttcccaacccacggaattgaccacgaacatggccaacgcctcgcagcagctcagaactctgctgtcgtcgctgcaaaccacgtcgacgtcgtccccgaccaacgtggagtccatagccaagggcttcggccagaaaatcagcacctcctcgtcggctaaccagcccatagtcgcttcgagggtgatcggccaacaagccggcaggcaatcgcccgttatcaccagcgtctcgaccgttatagttccgaatttcaagcaaaaaatcaccgcggctactaccgctacctccagaagcagccccgtgaaggtggtcagcacctcgcagcaattaaccggatccataataacctcgactttgaattatataccgaacagaacgatcggtatacaaatggtggcggatcaatcgaaactgccgccggccagtatcgtgacgacgatgcagcaaatcaactcgatcacttccagccaggagtcgaagaagccttcgttgacgctcacggcgatgctgcagaaccaacccgcagcgaatatgatgactaaatcatcggctgatactattacagccgctagtttgctaggctcgcccatcagcctgccgaagaccgggttcaccacgtctttggtgcaagcccaaccgagcgtggtgctttctaacacgccgccaacgcctagccaaacttccacggcgacatcttcgactaaaaccaccgcggattcgatcacggccgctagtttattgggtagttctattaatatagttaaaactagttttgcgatgcaaccgagtagcaccgtaggagtggtgacgagctgcgtcaacaaaacgcctacttccaccactaatttgctccacacgcagttgacgaaagtcgtgagaagcaaatccgtcgatgatgttaaagaattggtcaaaatcgacgagaacaagcaaagcgttagcagcgaaaatgtagacgatagcaacagcgggtgtaaattatcaacgataactacggtagcctgtaacaaaaccgaagattcgcagaacgtgttactgaagaaattgctgcagaacacggcttgcgccagcgctcaatcctccccgcccgcttctactagtactgttactaccagcgctgctaatactatgtctaaagtagctaatacgcagtgtagtactagcgctagcgtcgagcaaccgccggtaagcgctccttcgaacgttacagtccaaagaagcgccagcagagacgagttattatcaccgccacaagacgtccaaactatggtagtgattaagaaagaaccgccgctggtaccgctgtcccaaccgagtccagtgctgaactcgaattccaacgctcacacgcccgaggtgaagaaagaattcatcgacgaatcgtcgcagcactctgaagtatccgatcacagtagatcggacgcccccatcaaagaggaactggaaaccatggagaacaccgccgagaagatgatgctcgacaaggaggagctgaagaagcagaagcgcaggatgtaccagcagaagcgccgccagaaccagatcctcaacaaggagctggcgcagcagcagccgaagaagcggccgcgcaagaattcgaagatcgacgaggactacgacacgtacatcgacggcgtgctggcgcagctgcgccagctgccgcccatcgccgtctccgagccggtgttgaaccgcaacttcggcgtggtgccgctgttcgggtgcggcgatctcgccaagatcggcgccaaggattactcgacgcacctgggggagttgacggggaactacggctacggcgagctgcccggtttcaccgatttctactcgacgaaaccctacggggatatggatccgctgccggagaagccgccgtcgtcgacgcagcgcggcttctacgaccaggagttcccgctgattagattcgatgcggacgagcacaagaagtttgacgtgttttgcagggaggattcgcccgattcgatattgagcagctcgtcgcccgaatgtacgcgcgaacccgaaggcaaattcgtcgggttgaagctcatcagcgacagcgaagaggacgaagaagatgatgccaaagacgccgtttcgaaaggaagaatgtcaccggtggtgcccgtcatcaaacctgttcctattagactgaaacccgccggcgaattgtacttcaaagagaaccttaacgagaacaaggagaacatcaacagcgactcgttgcacgtaatgacgaaatccaaattcgacaacaagcagtcaccaccgtcgaacgtttccggccacgttacggtaactttaactctaacatcatctgcagctgaagatataatgggagtactgcgggatttggccaatattctacacatacctgctccgactagttaccaaatcgtggagagaacggcttctccgcctagccagaaattgggcttgtaccgcaccaaaggcaaggacggcaaagagggggctcccatcgacatacagagcatcctcaacggcgccaccaagttctgcaagcactgcgacgtgatcatcttgagcaacatcatcaggcggaaggtgtccgatttaccgttcctcgccaaggattcggatttgctcagcgacggggaggaattgttcttttgcagttccgcttgttacatgcagttcgctttgatgcaccgctcgccttcgatatccgaagataaggctgctgaaattataaatcacctatcgcagaaagacaatttggattcgaaacagaaattacccgcagacgcgttagacagcagtaaatcgatagcgcagaagttgtcgttcaacatcaaagatacgaaacgggaattcgagccgatggagacgaacgatgcgtttgcgttcttcgctcgtaccaccgcgaataaacaggggaacaacttctacgatggggcgccgttcaaatcggtccccgctagggtgcacaggaacgataggtacaaactctggacgcccggctgtctccaacccacccagaaacacaaaacgcccaccgacaaggagatcatggagctgctctacaggatgcagatcaccgttactcctcccgtcatgccggaagatacgaggaagtgtttgttctgccacggtattggtgatggcgtggccgacgggccggcgagactgctcaacttcgacgtggacaaatgggtgcacctgaactgcggcctgtggtcggacggtgtatacgaaaccgtaaacggggctttaatgaacgtcgaaaacgccctacagtccgggttgttggccacttgcgtgcattgccaaagcatcggggccaccatcaagtgcttcaagacgagatgctcgagcatataccacttgaattgcgccgtcaaagacaattgcgtgttctacaaaaacaagacggtgttctgcaaagtccatgcgccgaagaacgaaaaagacaacgaactcaccacactctccgtgtctcgcagagtctacatcgaacgagacgagaacaaacaagtagccgccgtcatgcaccattcagattctacagatttactgagagtaggcagtttgatattcctgagcgtaggtcaactgctcccgcaccaacttcagaacttccacacgcccaatcacatctatcccatcggctacaagatcatcaggttctactggagcatgaggaacttgaacaaacgctgcaagtacatttgcaccattcgagaggtgtccggcaaaccggagtttcgcgtgatggtgcaagagccccccgaagcggacgtggagttctccgattccacaccgaaaggcgcctggcagaagatcctcgacagcgtcgctaccatccgcaaagagaacaattgtttgcacatgttcccgaaattcgccacaggcgaagatttgttcggtttaacggaacccgctatagttcgagtgttggaaagcatgccgggcatcgaaacgttgtcggattataaattcaaatacggccggaaccccttgttggagctaccgctcgccataaacccttcgggctcggccaggaccgagccgaggctgaggagccagttgcattggaagaaagcgcatacgcagagaactactggcggtacgtcgtccattcgaccgatgttcgggccgtctctgacgggatctattagtacgccagcccaaggggagctggcttgtccttacagcaagcaattcgtgcattcgaagagttcgcagtacaagaaaatgaagcaggaatggaggaataacgtttatttggcgaggtcgaaaatacaagggctgggtttgtacgctgctagggatttggagaaacacaccatggttatcgagtatataggggaaattattagatccgaactggccgagtgtagagaaaagcaatacgaagcgagaaatcgaggaatatacatgtttagattggatgaagaacgcgtggttgatgctactttatgtggcggtttggctagatatatcaatcactcgtgcaatccgaattgcgtggccgagaccgtggaagttgatagggatattcgaataattatattttccaaacggagaattttacgaggagaagagttggcatacgattacaaattcgatatagaagacgatcagaacaaaatatcctgtatgtgcggagcgccgaattgtcgcaagtggatgaattaa

SEQ ID NO: 1021 - DNA, 2079 bp, Psylliodes chrysocephala
atgcccaaagatcacaggtctttcagatttgaatataaaaaaaagacaacggaaagttctctttcttcagattcccaagattaccatcacaaaaaaatgagaaaacattcacgagatagaagtaaagaaaaacgtttagataaaacatattttgatgataaaagacgtgaaaaaccaaagaaatctaagaagaaacgatccaaacattcttctgacgattctagttcaagcagcagcgaaagttcggataattcagtaaagttgttggaaaaacttaccaaagaacgaataagacagacggaagaaaaaaagaaagaaaaagaggtacttaaggctacagaaacagcagaagaaaaaagattaagaaggttagttaaaaaagaagcaaaggaacgaagaagaaaagaaaaaatgggttgggataatgaatacttgcactacacaaacagcgataatccatttggagatggtaacttgctaagtagtttcgtttggaataaaaaattgtctaaagaaggtattaagaacgtcagtcaacaagacatagaggctagaaacaggttaaaacaggaagaaaataagagagaacttgaaaaagtgaagaaaaggaggttggaacgagaattagaaagacaaaagagagaagaagaaacacaaatgttacaaaggagtaaagaagctgcacaatttgaagaatgggaaaggcaggaagacaagtttcatttggaacaagctagattaaggtctcatataaggatacaagatggtcgagctaaacctatagatttgctggcaaagtatataagtgctgaagaagaggtagatgcagtggagatgcatgagccatatacatacctcaatgggttacaaattaaagacctagaagatctagttgaggatattaaagtgtacaaagaattagaaaggggtaaaaatttggattattggaatgatataacagtcatagttgaagatgagctacaaaaattgagaaaaatagagaagcaaaacgattttgatttaggattaaatagaagagaaggtatacatcagtcagttgctactgatgttacatcagtgttcaaaggaaaaactgctgctcaactagcagctttagaaaagcacattgaaagtaaaattagtggcaaagctgatggaatagatataggctactgggaatctttattgtcccaactaaaagcccacatggcgagagcaagattacgagataggcatcaagaaagtttaagaagaaaattacaagttttaaaagcagaacaagctattacagcccccagtgaaagtcagtccagtgactccgaggagccaatttctgaacaaaatgaacccaaacctggtacttctcaagatgctcataattcagctgaagacagtaatgaggcaactgaagacactgctaatatttggataaatgaatgtttttcagcgtaccaagcaggtggatacagtccaaaatttttaactgctgatgttattgagcctggtacaattattgtcacagaagaggatgatgttaagagattagaatttgctagaattcaggtggttggacaaggagctaaagttgaaaatgttataacaaaggaagaattgttgttacaaaaggaagctaggaaaggtatggatgctgatgaagctcagttttctgttgaacaagctttggacagtcaagtgtatctttggtctgataaataccgtccacggaaacctagatactttaatagggtacatactggttttgaatggaacaaatacaatcaaactcattatgatatggataatccaccaccaaagatagtgcagggttacaaatttaatatattttatccagatttaatagacaaaagtagtaccccagaatattatctaacaccatgtccagaaaataaagaatttgccattttaagattccatgctggcccaccttatgaagacattgcttttaaaattgttaatagagaatgggaatattcctataaaagaggatttaggtgtcaatttcataataacatctttcaattatggttccacttcaagagatacagatatagaagataa

SEQ ID NO: 1022 - DNA, 1278 bp, Psylliodes chrysocephala
atggacaacctagaagcaaatattatggacaagtccatgagatcagttttcgtgggtaatattccttatgaagctacagaggagaaattaaaagatatatttggggaagtcggtcaagtattatcttttaagcttgtttttgatcgcgagacaggtaaaccaaaaggttatggattttgtgaatatagagatcaagaaaccgccttgagtgcgatgagaaatctaaatggctacgaaattggcggcagaaacctaagagtagataatgcttgtacagaaaaatctcgaatggaaatgcaaaatttgcttaatcaacctccagtagaaaacccttatggagagcctattcaagctgagaaagctcctgaagctattagcaaggctgtagcttctctgccaccagaacaaatgtttgagttgatgaagcaaatgaaaactacaatacagaacaacccaacagaagcaaggcaaatgttacttcaaaatccacaattagcttatgctcttttgcaggctcaagtagttatgaaaataattgatccccatacagcagctacattattacatcctgtaaatcaagttcctgcaactttaatgcctggtgataagaatgttccagtgcaagtaccaattaataaccaatatagggaacccccagcacctgttcaaccacctagacaagaattccagcctgtgcctccacctattatgattcccaaccatgttcaaccacctgtttttactgggcaagatgttgacttaaggtccctgggaaccgccccagatccaagactcgggcctgtggtgagggaccaagatatgagacaaattccaggccctattcaaaatcccttaccgcctaccattggagaaagctttgcaagggatccacgaggcataactgcttttcccaccgatccaagacaaacgcgtatggaccctcgtcaaaaaaatttggttcctccattaactcaaggacctgtaccaactccagctccaagaccggtcccaattgtccctcaacctgtaccagtagtcagaccggcacctgtaacaactacacccggtccagtgactcctacgcctgcagctgccagtcccatagtaggaacggctggagcgtcagaccaggaaaaggctgctcttataatgcaagtattacagctgtcggatgaacagatagcaatgcttccaccagaacagagaaatagtattttggtattgaaggaccaaatagcaaaaagtgcacattctcgtggctcctttttctttttttaa

SEQ ID NO: 1023 - DNA, 1179 bp, Psylliodes chrysocephala
atgactcaaatagatgcagatcgtgaaaaaagtctccaagagtacagaaagaaattactggaacacaaagaagtggaatccaggttaaaagaaatgcgagagcagctgaaggatctaacaaaacaatatgataaatcagaaaatgacctgaaagcattgcagagtatgggacaaattgttggagaagtcttaaaacaacttacagaagaaaaatttatcgtcaaagctactaatggtccacgttatgttgttggttgtcgtcggcaattggataaaacaaaattaaaggcaggaacaagagtagctctagatatgaccactttaactataatgaggtacttgccaagagaagttgaccccttggtttacaacatgagccatgaagatcctggtgatgtaacttattctgctattggtggtctttctgaacaaattagagaactccgagaagttattgaattaccattaatgaacccggagttatttatgagagttggaattacacctccaaaaggttgtttgctttatggaccaccaggtacaggaaaaactttgttggcaagagctgtggcttcacaacttgatgcaaatttcttgaaagttgtatctagtgctattgttgacaaatatattggagagtctgccagacttatcagagaaatgttcaactatgctaaagatcatcaaccttgcattatttttatggatgaaattgatgctataggtggtcgcaggttttcagaaggtacatcagcagacagagaaattcagagaactctcatggaattgcttaatcaaatggatggatttgactctttaggacaagtaaaaatgataatggccaccaacagacctgacacattagatcctgctttactccgtccaggccgtttggatagaaaaattgaaatccctctaccaaatgaacaggcccgtcttgaaattctcaaaatccatgccttccctattgccaaacatggggaaattgattatgaggcaattgttaaactatctgatactttcaatggtgcagatttaaggaatgtttgtaccgaagcaggactttttgcaatcaggtcagagagggaatatgttattcaagaagacttcatgaaggctgtaagaaaagttgcagataataagaaacttgaaagtaaattagattataaacctgtgtaa

SEQ ID NO: 1024 - DNA, 393 bp, Psylliodes chrysocephala
ttcggccacactttcacatttcgtgtacgaccacacaaccccattcgtagttcttcgcgccttcgcgacgccttcatcatgtctcgtcgctacgattcaagaacaaccatcttctcgcctgagggccgactctaccaggttgaatatgcgctcgaggctatttcccatgccggtaccgccattggtatccttgccaaggacggcatcgtccttgctgccgaacgcaaggtcacatccaagctcctcgagcaagacacctctgccgaaaagctctacgtcctcaacgataacatgatctgcgccgtcgctggtatgacagccgatgccaacatcctcatcaactacgcccgccaagccgctcagcgatacctcttgacctacaacgaagacatt

SEQ ID NO: 1025 - DNA, 2673 bp, Psylliodes chrysocephala
atgagcgaaacaaaagccgagccagtcaaggtggaagtaaaggcaaatggtaaaaatgatgacaaaaacaaaaatgaattgtctgatgaagacaaacaactgcaagaagaactaaacttgtgtgttgaaaaactactggaaaacgataccaaactttacttaccagctctgcaagctttggcaaatcacattcgagcttctactacttcaatgacttcagttcccaaacctttgaaattcatgaagcctcattatgataccatgaaacaaattcatgaaaaaattactgatgcccctgtcaaaaaagtttgtgccgatattatttctgtattggctatgactatgggagaaggcagagactgtcttaagtatagattgctgtctgatttagacaaaattggagaatggggacatgaatatgttaggcatttggctggggaaattgcaggagaatgggcagaaactgattttataataaacactgaagttagagataagcttattttgttaactaagcaaattgtaccctacaatatggctcataatgcagaggcagaagcttgtgatcttttgatggagattgagagacttgatttacttgaacaatatgttgatgaaaatatatattctagagtttgcttatatcttacaagttgtgtaccttatgtagcagatccagaaaacactactttacttcagactgcactaatgttattcagaaaatttaaacagcatcctcaagctcttagattagccatgcaactaaatgatcacagtcttatagaagaaatatttgtgaattgtccagacactgatattcaaaagcagttggcattcatgttagggaggcaacaaatttatattgaaattccagaaagcactccagaatatgaagacctcatagaaataatggccaactgtcatctgaacaaccacttcctaaatctcgcccgtgaattggatatcatggatccaaaaactcctgaagatgtgtacaagtcacatttagaaaacagccgtcccccatttgggggtagtcaagttgactctgccagacaaaacttagctgcaagctttgtaaatggttttgtgaatgctgcttttggccaggataagctcttgatggaagatggtaataaatggttgtacaaaaacaaagaacatggaatgctcagcgcaactgcttcattgggattggtattactgtgggatgtagatggtggtcttacccccattgataaatatttgtactcttctgaagatcacatcaaatctggagctctgttagcatgtggtatcgtaaattgtggtgttaggaatgaatgtgacccagcactagctctgttgagtgattatgtgctacataatacaaacatcatgaggataggcgctatagtaggactgggattggcttatgtaggttccaatagagaagcagttttaagcttgctaactccagtcttctctgatcctaaatccaacatggaagtcattggaatgtctgctctggcatgtggaatgatagcagtcggttctggaaatcctcaagttaccactaccattatgcaaactttaatggaaaagtctgaatctgaattaaaagacacatatgccagatttttacccctaggacttggtttatgccacttgggtaaacaagaaggcattgataccataattgcagctctggaagttatcccagagccatttaagtccatggcaaccacaatggttgatatttgtgcttatgctggtactggtaatgtactaaaagtgcaacatctactccatatttgctctgaacactatgatggagctgacagctcagacaagagttcaaaagataaggataaaaaagaaattactgaaaaagaaaaagatctctcttcaagacaagctgtagctgttcttggtatagctctaatcagtatgggtgaagatataggtagtgagatggctttccgcacctttggacatctacttcggtactgtgaaccagtaatacgtcgtgcagtacctctggctctaggtctcatttcagtatcaaatcctaaattgagcattctggacaccttgagtaagttttctcacgatagcgatgctgaagtagctcataacgctattttcgccatgggattagttggagctggtactaataatgctagattagctgcaatgttgaggcagctggcacagtaccatgctaaggatcctaataacttgtttatggtacgcatcgcacaaggtcttacacatttaggtaaaggtacattaactttaagtccttaccacagtgataggcagctgatgagtccagtggctgttgctggcttaatggctactcttattggatttttagatgtaaaaaatataattttgggaagatcccattatcttttatacacattagcagctgccatgcaacccagaatgcttgtaacatttgatgaagacttgaaccctttgccagtacctgtaagagtgggtttggctgtggatgtagttggacaagcaggaaaaccgaaaacaattacaggttttcaaacgcatacaactccagtattgttagcatatggagaaagggctgagctcgccactgaagaatatatagcacttacacccatcatggaaggttttgttatattaagaaaaaaccctgattttaatacttaa

SEQ ID NO: 1026 - DNA, 1521 bp, Psylliodes chrysocephala
atgactgatagcaaaatggaaccaaaagaagaacaacaaccttcgcccgaagaaataaaaccaaaagtagccgctcttgaaacggatccacagccaacccaaaacaacggaacaggcgttattagaagaaacttcattactccggctggaactatcattgaatcaaacgaagaacaacctcctgaaccgactgccgaagaaattgttaaaacatcagcgtccacaccaagtcctgtcgaacaaaaagttgaacgtacagaaacaactacgtattcagaaatattaacgcaggagcaacgggaacaatttccagataccaaaccgtacgccatagagatgccagctgagaatttcgaaaatcagaatttcgcacaagacattagttacacaactgtgaatattgaaggaaacgttgtaccggtaactctctcagaaatcgaacatcctggagattatgccaaccttcagactgcgcaatataataacggttacgctgatggttctcaatacctagctcaacatcagtatcaaaatttgttcataaacagaaacgatgttgataattcttctcccacggcggttttatacagaggcgatcccaatttagcagattctagataccaagtaaactttgaagtatccagtactcaaccccaagtgaacatcctcccttcttccggagattcctacacctacaccaccccaggaagttggaatgctagtagcagtggttcttatcaacaacaatatcccggaaacataaatgttcttcatcaagccgacagtactcagtcgtactctgctggacaatacgcaaactccacttggtcatctaacacgatggaggatggacggccatctagtcaagaggtactagtgaaagagtgcgttaattgtggcgctagcgttacacctctttggcgtagagacggtaccgggcattatctatgtaacgcgtgtggtttataccacaaaattaatggggttcacagaccgccgattagaccaaccaaaaaaccacaggcgactggaaataggcgaaacggagtatcgtgtgctaactgcaaaactaataatactaccctttggagaagaaataaccaaggtgaacctgtttgtaacgcttgtggactatacttcaaattacataatgttaacagaccgatcagtatgaaaaaagaaggtatccaaacacgcaagaggagaccaaaaagctcttccgctggaaattccggaaaccccggtcaaatgagaattggtcttcctcagtatcagtttcaacatactcaagacatagaaataccccaagatcagtaccaggtaccgatgagcgtttaccaacaaccacaacctgcgtatagacaatttgcaacagacagtcaccgattaaatgcccaacctttgcagcctataagcgccgaagacgagcaagccagtgtcatcacttcaacgtcacagcaagcaagatttaggacagacgtggaagacgaggacggaagtaatccatcaatgcaaacttag

SEQ ID NO: 1027 - DNA, 4866 bp, Psylliodes chrysocephala
atggcacttccagggaacgggatttttgtcgtcaaaggcgaaatatcaaacttgctggcggctatgaaaaggggcacaagatggtcatcacattcttatcaagacgatgatgtagatgccctattaagaaacttccaagagttaagagatattttagataatgtagacgacttgagattcgtagaacctaacacgtttttagctccttttttgaatgtcataaggtctgaagagactacagggcctgtaaccagtttggcactatctgcagtaaataagtttttgtcatatggtctcttagaccccgtacacgcctctatcccacaaaccattcacagcatagctgacgcagttacccatgcccgattcgtgggcaccgaccagtcatccgacggggtagtcttgatgcgcattttacaagtccttagaactctgaccctatccccggaaggtgccaccctaaccaatgaaagcctttgcgaaataatgctgtcatgtttccggatatgcttcgaaacaagactggccgatcttctacgaaaaactgccgaacactatctcaaagacatggtgcaattaatattcatgagactgccccaattctctgaagatctgaaggtttcctacatcaagcaactcaaaatgaaaccgggagctctagaccaaactcgaacaaaaagaaaaaagtattatccgaaaaaagagagtaaagaattagaaactccaccaccgcaagaaattattgttcaaaatcccgcacaaaccggcatagtagatatgcaaggagcaattctacaaaataacgatagtaccaccactactaactctgttaatattccttctagtccaactcaacgtgataacgatataaccatagatatacctacagacgaaagtttgaaaaactcagaaactacatcgagcttagaagatagtatggaagtgaaacctgttgtggaagaacctaaatctgaagaatccgaagagcagtaccatcaaactcaagattatgtgaatcggagaggtatacggttcactcctcaactacaacaagaagtgaatctatcgccctacggtctagcttgcgtaagggaacttctaaggtttctgattagcctttgtaaccctttggataagcaaaataccgatataatgatgcatttgggcctcactctacttacagtggcttttgaaataagtgctgataatataggaaaatacagcacattgttggcgttagttaaagatgatttgtgtagaaatttattcgcattgatgaacaccgaaagactaacaatattcgcagctgatctacaagtatcttttttactattcgaatcgttaagaacgcatttgaagtaccaattagaacattatttaaagaaattaatagagattattttaaacgattctaataaagtgacctacgaacataaagagatcgctttagacaatcttcttcaattatggaggataccgggattccacactgaactgtacgtgaattatgattgcgacatgtactgcgcaaatttgtacgaagaactgaccaaattattagctaaacattcgatttcttcgacttccggagtatatcacacccacttgctttctctggatgctctgttgattatagctgaaggtatcgagaatagatgttgcgaggaaaagggtaggatagaatcggaggataatgatgaaataacgaatgatattagctattttatagggaagagttctaggataaagatttcggaaaatgtgcccaaaaaggaggagctggctgccaagaagtcgatcaaaaaatggctgccgcaaggcactgaatattttaatcaaaagccgaaaaagggcatacaatttcttcaagagcacggcgttttgaagcacgagctggacgtcgatgaagtttcgagatttttaagagaaaatcccgctttaaacaaaggcatgattggagaatatgttagtaacagaagcaatttaaaaatactggatgcttttgtcaaaacttttagttttaccggagtacgaatcgatgaagctttaaggacgtttttagaatcttttaggttaccaggtgaagcgccgacgatttctctaattctagagcacttcgccgagcattggcacaagagcaatggtgaaccttttgccgatgttgattcggctttcacactggcttacgccattattatgttgaatgtggaccaacacaacgaaaatgccaaaaagcagaccgttccaatgacccctactgctttcaagaagaatctgaaaggtgttaatggaggtaacgattttgaagaagaaatgctagacgaaatctacacaacaatcaaaaacgaagaaatcgtaatgcccgcggaacacacgggcttggtcagagaaaattatctgtggaaaattctcttgcgcaaaggacaaacgaaggatggttgttatatacacgacaatagcggcacttatgattcagagttgttccaaattgtttacggacctatcgtggctgcattatcttctgtctacgaaaaatcagagaacgagagtgttcataaaaaagtcatgcaaggtttcgaacgctgcgctttcatagctgcaaacctcaacatgaccaaaaacttggacatgttgatactcagcatatccaaattcaccatcttctacaaccaacaaaagcaaaacaccatcgtcgttcaattcggcgccaacgccaaagctcaattagccttaaaatcggtcttttctctcatccaccagcacggcaacacgatgcgagaaggatggaagcatttattcgacctcctgttggccttgtatagtaacgggttgctgtcgaaaactttcgtcgaagtcgaggacttcatcgaacccagcgggaagctcaatctggtatacaaagaagctcccgcggccgccaagcaggatacaggattgttgagctctttgtactcctacatggtgtccgccgagaatctatcgaaaatgcctacgcctgaagaacagaactacatcgaagcggcgaaagaatgcatcaaggattgcaacttggagcagatgatcagcgattcgaagttcttgcacgaagaggccttgttcgagttggtgaagtcgctaattgaactgtcaaggggaccagatgtgcaagaaagcttggcgtatgattacaacgagaacgtgacgattttctttttggaggtgttaatcaaagtggttatacaaaacagggatcgagtcatgacgatttggaacaacgttagagatcatatttatacgttggtgatgaacgcgtcattgttcgattatcagttcttgttggagcgatctgttataggtttattacgaatcgccatccggttgatgcgaaacgaagaaatgagccacattgtcctacaatccttaaggatgcttctcctattaaaatctagcacactttccaggatatctcgtcaaatatcgttcggtttatacgaactactaaaaacgtccgcccaaaatatacacaccaacacggactggaccattatttttacgcttctcgaatgcgttggagctggcgcccaacctccgaaaccagtaacttctgctgaagatactgacttaaaatcgaaatctgacggcgaaacttcggatcatcatgaagaagaaggtgcgttatctgattcggagcttacgaaaagtccgaaacgcggcgttcaaaggcctcagagtcccgttacagtcgttacatcgcccgtcggtactcccaatacaggtggttggattctcgtcggcaacgaaggcgaaatccaaccggtcatgggccgaaccgtcccgccgactcaatacggcttgtctcttgaaaagaacctcggcagccacgatccgcgaagcatgatgaaatgctgcgagagcctcgcgttccttgtacgcgacgtggcccacatcactccatacaatttcgacgtgtgcgttcactgcatacgaaccttcgtcgaggccagtctgcacggcaccagcctcagacgaaccagatcgagaaaaaagtcctcggacaggcaccggacgagaaagagccctgccagcagtcctgatgaggacgacagtgatgacgacgacattccaagcggctaccatcaaatatccatacaattattagatttgatgcacacgctgcatacacgaacggcgcagatttttaaatggtgggccgaagagggcggcgaaatatcgcaagagacgtcgctgtggactcaaggctggtgcccgctgttacaagggatcgcgcgattgtgctgtgataccagaagacccgtgcggatgagcgctataacgtacctgcagagagcgttgctggtgcacgatcttcaaacattgagcgggcccgaatgggagcaatgtttccagagagttttattcccgcttttaagttacctactacaatcgatcagtcctaaagacgccatcgccatggaggaaactagaataagagcggcaacggtgctatcgaaagtatttttacatcacctcaccccactgctagcgttgccgagttttttcaatctttggttggtcgttctggactttatggacaaatatatgcatgcggataggagcgaactcttatacgaagctattccggaaagtctgaagaacatgctgctagtaatggactcggctagagtgtttgatggtcccgacggtaaaaatgtgctttggaatgcgacttgggatcgaatagggaaatttttaccgacgatgaaagacgatttgttcaaggaaatcgaagatcaaattcgaaaaaacgaggaagtggcggtgagtgttgatgtagttgtgaataaggatgaaagtcagatgaatgcggaaaaacttattgcctgttaa

SEQ ID NO: 1028 - DNA, 618 bp, Psylliodes chrysocephala
atgtcgattctagcctacaatggaggcgccatggtcgctatgaagggcgaaaactgcgtagctatagccgccgatcgtcgattcggcatccaagctcaaaccgtagcaacaaatttcgaaaaagtattcgaaatgggcccacatctattcgtcggcctacccggtttagctacagacacccaaaccgtaatggaaaagttacgatttcgtaaaaatctttacgaactcaaagaaaacagacgtatttcaccaaaagtatttgctgcaatgatttcaaatatgttatacgaaaagaggtttggcccctttttcgtcgaaccggtagttgcaggattaatgcctggaacttttgagccttatatatgtaatatggatcttattggttgtattaatcaacctactgattttgttgttggtggtactgcttccgcacaattgtatggtatgtgcgaagcactatgggaacctaatttgggacctgacgatttgtttgagactatatcgcaagcgctgatgaatgctttcgatagagatgctatttctggttggggagctacagtttatataattgaaaaggacaaggtgactgttaaaaacttgaagactcgtatggattag

SEQ ID NO: 1029 - DNA, 2808 bp, Psylliodes chrysocephala
atggatcagaaacctgcgttagatttagtgatatccgcagtttcagctctgtataacaatcctaacagaggcgagaaagaaagagcatcccaatggcttttagaacttcaaaaatccgtccacgcttggacagtagcagacgagctacttcatatgaaaagagatctagagtcttgctattttgcagctcagaccatgagaacgaaaattcaccaatctttccatgaattaccacaagaagttcatacatctctaagagattctttgttagaacatattggtcaaataaatgaagctaccagcacagctattgtgacacaattgtgtgttgcattagcagatctagcattgcagatgcctagctggcagaaagctactctagatttaataaataggttttctcagactaatatttggcctttattagaaattctgactgttttaccagaggaattggaaagtagatctgtaaggctaggtgaaaataggcgaattgaggtattagaagacatgaaattttgcgcccccactgtcaacgaattcttgaaacattgctccaatctttacggcacaaattggcaagagcacgttcaggtcaatgtaaaaatattgcgttgtttcacatcttgggtatccgtaggtgccataagtctgaacgatcttgcaaataacgtagtaatcaatagggcatttgaaatactgaactttaagcctcaaaatgacaaacataccatatcaggtgccttccacgaggctgctacagactgtatatgcaccttattgttatgtttagaagataacaataatcaactaggtttagaaagttatctttttaataatataattaatttggatgtaccttatcacttgtcagtcgccaacgaagatcaaggaaaatctatggactattgtaggttattcacagaattagcagaatcatttttggaaaagattatcaacaatagtaacacggaacagatgcattatgctactaaaattttggatttcgttttaatgtgtgttgggcatcatgattatgaggttgccgaaataacttttaatctgtggtatgtcctaagcgaagaattatatcaaaaaaacaacaaagaattgacagaacttttcaggccttacgtggaaaggctggtaaccgcattatgcaggcattgtcaaatggaacctgacagcgaaggcctactagaagaaggagatgaattcagagactttaggttaaaggtatctgacttgataaaagacgttgtatttatagtgggaagtagcagctgtttcagacagatgtttatgagtttacaagcacctggagtcacgtgggactccagtgaagctgctctatttattatgcaagcagtggcaaaaaacgttttaccatcagaaaatgaagttgttccgaaggtggtagaagcaatattgaacgtcccggaaaacactcacgtagcagtaaaatacacatccgttctgctattgggtgaactttgcgaatggatagaaaaacatccgaatactttggatccaattttaaattttttagtttgttgtttgcctcaacacggtgtaggcgccgcctctgccgtcgctctccagaatatctgcgccagttgtagtgagcacatgccgcgccatgtaccgatccttttacagctcctccaccaatcggaaacgtttgcgataagcaacaccgccacgatcggtctgctgaaaggcgtggcttctataatcggaaggatgcctcacggcgatatgacggcggcgctacgagaattgtgttccatgcaactcaatccgatctgtcaactcatcgaacaagacgtcactccgctcaaaggttctaaaactgatcccgtgacttggttggatagacttagttcggtgctgaggtacattaacgttaatgtacatgagggcgaattaaatccatgcaaacctgtcatactggaagtgtggccagtactgtcgcgagtatttgacaaataccaaagtgacattaggataatggagagatgttgccgtgcagtgcgtttcatgctgaggtgcgtgtctcaacaagttcgggaacttttagattcgctcgtaggacaaatagtgcgcatttatagtctatataaacattcttgcttcctatacgtaggaagcattttagtagacgaatatgcaacggacgcgcattgcgtccaaggacttttggacatgttacaagcatttttagagcccaccttccatttgttgcaagaggagaatggtctcaggaaccatcctgataccgtcgatgacttttttaggttgtgcgcgcggttcatgcagagggcgccagttgctttcttgaagtgcgcgtctctggtacacattttgcaatgtgcactgttggcatcgactttggaccacaaggaagccaatatgtctgtgatgaagttcttttatgatctggtcaatcaaggacagagcggtagagccgatcctgattatgaaacaaggaaaatgttggttcgaagtatattggacgaatacggtcagcagttagtctcaaatctcatccattcttgtgtgttctaccttcattcctatatgttgagcgaagtgggagatgtctttgttcaactgctagatttcgatagagagtcgactagtaaatggttggcggccggtatagaatgcttgccgaaacacagcaacggtggtattgtagccgctacacctcaacaactcacggatatacacattgccataactagatcgaatacttccaagtctgtaacgcatgctctgaaagatctaacgaggttatatcgttaa

SEQ ID NO: 1030 - DNA, 1509 bp, Psylliodes chrysocephala
atggcgcaaaggtttcccgtacccgtagtaaatcaaggtcctggcggtccgcctccgcctcaaagatatcaacagcagcctccaaatcaaggaatgaggcagtatgggcaacaaaactttccacccagacctggatataatcctccacctccaaatatgcaatcaagtggtggtacaatgatccaaagacctcctgggaccccatattctcctatgcgtggaggacctatgcccccacaacaaggaagtaaaagacccacagataacaggaaccccttacaacaaaaaactaatgaatatcctcatggaacgagcaagaaaaagaagaaattagcggacaaaattttaccccaaaaagtaagagatttagttccagaaagtcaggcatatatggatttgttggcatttgaaagaaaacttgattcaacaattatgagaaaaagactagatattcaagaagcattaaaacgtccaatgaaacaaaaacgaaagctaagaatttttatttctaatacattctatcctgctaaagaacctcaacccgaggggccagaagggccttgtcaggaaggttctgtagcatcttgggaacttagagtagaaggtagacttttagaagattctaaaaatgatccaaataaagttaaacgtaaattttcatctttctttaagtctttggtaattgaacttgataaggaactctatggacctgataatcatttagtagaatggcatagaacattgactacacaagaaacagatggctttcaggtaaagagacctggtgataaaaatgtccgctgtacaatcctgttactacttgattatcaaccactacagtttaaacttgatcctagactggctcgtcttcttggtgtgcatacacagactaggccagtcatcatttcagctttatggcagtatattaaaacacatcgccttcaggattctcatgaacgtgaatatattgtatgtgataaatatttagaacaaattttcaattgtactcgtatgaaatttgctgaaattccacaacgtttgaatccattattacacccaccagatccaattgttataaatcatgtcatatctgtagaaggaggtgctgaaagtaaacaaactgcatgttatgatattgacgttgaagtagatgataccctgaaaactcaaatgaataatttcttattaagtactgccagtcaacaagaaattcaaggtctggatgcaaaaattcatgaaactgtagatactatcaaccagttaaaaacgaacagggaatttttccttagttttgctaaggatccacaacagtttatccataaatggatcgtttctcaaaccagagatcttaaaacaatgactgatgttgttggaaatccagaagaagagagaagatctgactttttttatcaaccatgggcgcaagaagctgtttgcagatatttctacacaaaagttcaacagaaaagggcagaattggaacaagctcttggtattcgtaataattaa

SEQ ID NO: 1031 - DNA, 435 bp, Psylliodes chrysocephala
atgcccaaagtacgaagaagcaaaaaacctcccccggaaggatgggaacttattgaaccaactttagacgagcttgagcaaaaaatgagagaagctgaaacagaatctcatgaaggtaaaagaaaaaatgaatcgttgtggcccatctttaaaattcaccaccaaaaatcaagatatatttttgatctgttttatagaagaaaagcaattagtcgtgaactctatgaatattgtttagtggaaaatattgctgacaaaaatttgatagccaagtggaagaagcaaggctatgaaagcctttgttgcttaaggtgtattcaaacaagagatactaattttggaacaaattgcatttgtcgtgtacctaaagcaaaattggaagaaggcagaattgtagaatgtgtacactgtggttgtagaggttgttctggttag

SEQ ID NO: 1032 - DNA, 885 bp, Psylliodes chrysocephala
atgcctgcagctactttaggtagcatttcacatcctaataatgaagattgtggcattcgagacgtatgggctcataatttagaagacgaattccgaactataaggcaaatagttcagaaatatcaatatgttgcaatggacaccgaattcccaggcgttgtggcaaggcccataggagagtttagaagttctgctgattaccaataccaaatgctaaggtgcaatgtagacttattgaggataattcaactaggccttacatttttggatgacaacggaaagacacctggtggggcttatactacatggcagttcaattttaaatttaatctccaggaagacatgtatgcacaagacagtattgacttgctgcaaaattcaggaattcaattcaagaagcatgaggatgagggtatagaacctctagaatttgcggaattgctgatgtcttctggtattgttcttatggaaaatataaaatggttgtcttttcattctggctacgattttggatatcttataaaactattgactgacaacaaccttccacaagatgaaactgagtttttcgatttattaaaattatattttcccacaatatatgatgttaaatatctaatgaaatcatgtaaaaatttaaaaggtggtcttcaagaagtagctgaacaactcgaattagaaaggattggaccacagcatcaggcaggatctgattcacttttaacaggaatggcattttttaaaatgaaagagatgttttttgaagatacgatcgatgattccaaattttccggccacctatatggactcggaacatctttcacggtgaacggcaccacaaacaactatgcaaacgataatggcgacacgacaaactcttcatga

SEQ ID NO: 1033 - DNA, 1212 bp, Psylliodes chrysocephala
atggaagcagctcaaaaaaggggtgcttcggtatttgaggatctctcaaatgtagaattcgaaaccagtgaagatgtggaagttattgaaaagttcaaaaacatgaatctgaaggaagaattgcttcgtggaatttttgcatatggttttgaaaagccttcagctattcaacaaagggctattaagcctattatgaagggcagagatgttatcgcccaagcacagtcgggaactggtaaaactgctactttttcaatatcaattttgcaagcccttgatttgacgatgagagaaacacaagtattgtgcttatctccaacaagagaattggctgttcagattcagaaagttatactagctttaggtgactttatgaatgtacaatgtcatgcatgtattggtggaacaaatcttggagaggatataaggaaacttgattatggacaacatgttgttagtggaacaccaggaagagtatatgacatgattcgaagaagagcccttaggacaagatcagtaaaaatgctggttctagatgaagctgatgaaatgttaaataagggtttcaaagaacaaatctatgatgtatacagatttcttcctccttccacacaagtcgttcttatatcagctactttgccccatgaaattttggaaattacatcaaagtttatgactgatcccatcagaatcttggtcaaacgtgatgaattgacactagaaggcatcaaacaattcttcgtggcagtagagagagaagaatggaaatttgacaccctctgtgatctttatgatacattgacaattactcaagccgttattttctgtaataccaaaagaaaggtagattggttaactgaaaaaatgagagaaaacaacttcactgtcagctcaatgcatggtgacatgcctcaaaaagaaagagacaatatcatgaaagagttcagatcagggcaaagcagagtattaattactacagatgtttgggcaagagggatagatgtacaacaagtttcattagttattaattatgatttaccaaacaatcgtgaattatatattcatcgtattggtagatctggtagatttggtaggaaaggtgttgccatcaattttgttaaatctgatgatattaggattttgagagatattgaacaatattattctactcaaatagatgaaatgcctatgaatgttgctgatctaatttaa

SEQ ID NO: 1034 - DNA, 1683 bp, Psylliodes chrysocephala
atgactgctcctgctgccggtggagatgccagaggtagaactcttgcttacaaagataaaagtaaacccgccgatgtccgaactagtaatattaacgccgcaaaagctgtttgcgatgctattcgtacaagtcttggacccaggggaatggataaaatgatacaagctggtaacggtgaagtgacaataacaaacgatggagctactattttaaagcaaatcaatgttatacatcctgctgctaaaatgttggtcgaactttcaagagctcaagacattgaagctggtgacggtaccacctcagtcgtagtaattgccggtgcccttttggacgctgctgaaaaattgttgcacagaggaatccacccaactgccatttcagaatctttccaaagagcagctcttttagcagtagaaatattgaatggtatttctacaccaatagaaattacaaatagggaattgttaatcaaaagtgcttctacttccttaaattctaaagttgtatcacagcattctagtctattgggaccgttggctgttgatgcagtactcaaaattgttgaaccaggccacgaagaagcttgcaacttagaagacataaaagtaatcaaacaattaggaggaacggtcgaagacaccgaattagttgaaggaatcgtcttctcgcaaagatccgcaaacgtatctggcccaaaaagaatcgaaaaggccaaaatcggtttgatacaattctgcatttcaccaccaaaaaccgacatggaccataacgtcataatatccgattacgccgcgatggatagagttttgaaagaggagagagcttacattttgaatatagtcaagcagattaagaaagctggatgtaatgttcttttggttcaaaagtcaattctcagagacgccgtttcagatctagccctccactttttggacaaaatcaaatgcatggtcgtcaaggatatcgaacgggaggacatcgaattcgtatgcaaatctttgggttgtcgccccatcgcttctttggatcattttacgaccgaaaatttggtcggcgccgatttagtcgaagaggtaggcgtaggcggtaacagaatggttaaaattacaggtgctcagaacgcgggccgtactgtaaccttgctggttcgaggctcgaataaattggttctggaagaggccgaaagatctttgcacgacgctctttgcgtcattcgttgtctcgttcgcaagaaagcgcttatcgctggcgggggtgctccggagatcgaagtggcgcttaaattggctgctttggcgaataagttggatggtatcgacgctatatgtactagagcgtacgccaatgctttggaaattattccgtttacgttggctgagaatgctgggttgaatcctattcagacggttaccgaattgagaaacagacacgccaaaggagagacttctgccggcattaacgtacgcaaaggcgccatcacggacatactcgaagaaaacgtcgtccaaccgcttttcgttagcacttcggcactgagtttcgccaccgaaaccgtcagatccatattgaagattgatgatattgtaagtatatatattaagtttaatttttccctagatttacggaaaactaaacgacaatatagaaacggcaacgtcgctttgtatcataagtacagttag

SEQ ID NO: 1035 - DNA, 1230 bp, Psylliodes chrysocephala
atggaggctatggacattgttataccagaaaaagaggaaggcagtccttccgaagcaaagcaagctttacaagacttagacacggaagatctgtacacgaaatacaaaaaacttcaacaaatgttggagtttttagaagtacaggaagaatatatcaaagatgaacagaggaatcttaaaaaagagtatctgcacgctcaagaagaagtcaaacgtattcagtcggtgcctttagttataggtcaatttttggaggctgtcgatcagaatacagggatcgtcggatctacaacaggttccaactattatgttcgtattctttcgactatcgatagagagcttttaaagccttctgccagtgtagctcttcacaaacatagtaatgctttagtagatgttttgccccctgaagctgattcttcaataagtatgctacaagcagatgaaaaacctgatgtacaatattgcgatataggaggtatggacatgcaaaaacaggaaatcagagaagctgttgaattacctttgactcattttgagttgtataaacaaattggtattgatcccccacgaggtgtgttgatgtatggaccgcctggttgtgggaaaactatgttagcaaaggcagtggcacatcatactacagccgctttcattcgtgtagtcggttcggaattcgtccaaaaatatttaggagaaggaccgcgtatggtgcgagacgtattccgtttggccaaagaaaattcgcccgccattatctttattgacgaaatcgacgctatagctacgaaacgtttcgacgcccaaaccggcgccgaccgcgaagtccaacgaattttgctcgaactgcttaatcaaatggacggatttgatcaaactacaaacgttaaggttataatggctactaacagagcagatacattggatcctgctcttctaagacccggtcgtttggatagaaaaattgaatttcctttgcccgatagaaggcaaaaacggttgatattcagtactatcacttctaaaatgaacctttctgaagaagttgatttggaagactatgtggcaagacctgacagaatttcgggggctgatataaacgccatctgtcaagaagctggaatgcatgcggtgagagaaaaccggtacattgttttgccgaaagatttcgaaaagggttataaaaataatatcaaaaaagatgagagcgaacatgaattttataaataa

SEQ ID NO: 1036 - DNA, 618 bp, Psylliodes chrysocephala
cttttctgcaaacaatcacacatcgcttcagcatcagctaacgaccggcgcgccagaccatcgcactcttcttatcccatttctgactactattcatctcacaaaatggccgacgctaagcctatgtccaagatctggctgatctccaacgattcggccaccatcgaagttgaccgtgccgttgtcgagcgctccatgctcatcaagaacatgctcgaggatgtcggcgacgacaccatcagccagaccaaccccattcccattcccaacgtgaatgaggccgttttgcgcaaggtcatcgagtggtgcaaccaccaccgcgacgaccccgcccaggccgccgacgacgagtcggatgctcgaaagaagacgactgatatcgacgagtgggaccagaagttcatgcaggtcgatcaggagatgctcttcgagattatcctcgcctccaactacctcgatatcaagccccttctcgatgtcggctgcaagactgtcgccaacatgatcaagggcaagtcgcccgaggagattcgcaagacgttcaacattaccaacgacttcactcccgaggaggaggagcagattcgccgcgagaacgagtgggccgaggaccgataa

SEQ ID NO: 1037 - DNA, 930 bp, Psylliodes chrysocephala
atggacgataaggcttcatgtaaggaactagatcagtggatagaacagttaaatgactgtaagcaattaaccgaaaatcaagtgaaaacactgtgtgataaggctaaagaaatactgtctaaagaatcaaatgtacaggaagtgaaatgccctgttactgtatgtggcgatgttcatggacagttccatgacttgatggagttattcaggataggcggtcgtagtccagatacaaattatctttttatgggtgactatgtcgatcgtggttattactcagttgaaactgtcaccctcttggtagcactgaaagtcaggtataaagaaagaatcacaatcttgagagggaatcacgaatcaaggcaaatcacacaagtctacggtttctacgatgaatgtctaagaaaatatggaaatgccaatgtatggaaatttttcactgatttgttcgattacttgcctctaacggcgctcgttgatagtcaaatattctgtctgcatggtgggttgagtcctagcattgatactttggaccatattagggcgctagatcgtttacaagaggtacctcacgaaggcccaatgtgcgacctcctttggtcagacccggacgaccgcggaggttggggcatctctccccgtggtgccggttatacctttggacaagacatctcagaaactttcaatcacagcaatggtctgacgctggtatcgagggcgcatcaattggtcatggaagggtataactggtgtcacgatagaaacgttgtaaccatattcagcgcccccaactattgctatagatgtggcaatcaagctgccattatggaattagacgatgctcttaaatattcattcttacagttcgatccggcaccgagacgtggcgagcctcacgtgacccgcagaactccagactatttcctttaa

SEQ ID NO: 1038 - DNA, 2058 bp, Psylliodes chrysocephala
atgcagatattcgttaagaccctgacagggaaaactatcactctcgaggttgaaccatccgacactattgaaaatgtcaaagccaagatccaggataaggaaggaatccccccagaccagcaaaggttgatctttgccggtaaacaattagaagatggcagaacattatctgactataatatccagaaagagtcgactctccatttggtacttagacttcgtggtggtatgcagatcttcgtcaaaactctgactggaaagaccattactctggaagtagaaccttcagacactattgagaatgttaaggctaaaatacaagacaaagaaggtatcccaccagaccaacaaagattgatcttcgcaggaaaacagctagaagacgggcgtactctatctgattacaacatccagaaggagtctaccctgcatttggtgcttagacttcgtggtggtatgcaaatcttcgtcaaaactttgactggtaaaacaatcaccttagaagttgaggcatcagacaccattgaaaacgtcaaagccaagatccaggataaggaaggcatcccaccagaccaacagaggttgatctttgccggtaaacaattagaagatggtagaacattatctgactacaatatccagaaagagtcgactctccatttggtacttagacttcgtggtggtatgcagatctttgtcaaaacactaactggaaagaccatcactcttgaagtagagccatctgatactattgaaaacgttaaagctaaaattcaagataaagaaggtatcccaccagaccagcaaagattgatcttcgcaggaaaacagctagaagacgggcgtactctatctgattacaacatacagaaagagtctaccctgcatttggtgcttagacttcgtggtggtatgcaaatcttcgtcaaaactttgactggtaaaacaatcacattagaagttgaggcatcagacaccattgaaaatgtcaaagccaagatccaggataaggaaggcatcccaccagaccaacagaggttgatctttgctggtaaacagttagaagacggcagaacattatctgactataatatccaaaaagagtctactctccatttggtacttagacttcgcggtggtatgcaaatcttcgtcaaaactctgactggaaagaccatcactctagaagtcgaaccatcagacaccattgagaacgtcaaagccaagatccaggataaggaaggaattcccccagaccagcaaagattgatcttcgctggtaaacagctagaagatggacgcactctctcagactacaatatccagaaagagtctactctccatttggtactcagacttcgtggtggtatgcagatcttcgtgaaaactctgactggaaagaccatcactcttgaagtagagccatctgatactattgaaaacgttaaagctaagattcaagataaagaaggtatcccaccagaccagcaaaggttgatatttgccggtaaacaattagaagacggtagaactttatctgactacaatatccagaaagagtccactctccatttggtacttagacttcgtggtggtatgcagatcttcgtcaaaactttgactggtaaaacaatcacgttagaagtcgaaccgtctgatactatagaaaatgttaaagccaaaatccaagataaagaaggtattcccccagaccagcaaagattgatatttgcaggcaaacaactagaagatgggcgtactctatctgattacaatatccagaaggagtctaccctccatttagtgcttagacttagaggcggtatgcagatattcgtcaaaaccttgactggaaagaccatcactctagaagtcgaaccatcagacaccattgagaacgtcaaagccaaaattcaagataaggagggcatcccaccagatcagcaaagattgatctttgctggtaaacaattggaagatggcagaacattatctgactacaacatccaaaaagaatcaactttacatttagtactccgtcttagaggaggacaatag

SEQ ID NO: 1039 - DNA, 1623 bp, Psylliodes chrysocephala
atgatgcaaccacaaatattattactcaaagaaggtaccgattcatcacaaggtaaacctcaactgatttcaaatataaatgcttgccaaaatgttgtggacgccatacgaacaactttggggcctagaggaatggataaacttattgtcggaagcggaggtgcagcgactatttccaatgatggagctactatcttaaaattattggacataattcacccagctgcaaaaaccttagtagatatagcaaagtctcaagatgctgaagtaggtgatggtacaacttctgtagttttactagctggagaatttttgagacagatcaaaccatatgttgaagaaggtgtacatccacgaattatcataaaagcagtacgtaaagcaactcaaatttgtttagaaaaaataagttctcttgctgttaaaattaataagtcaaatgctgatgaatttagatctttactagagaaatgtgctgcaacagcaatgagttcaaaattgatcaaccaacagagatctttcttttcaaagatggtggtagatgctgtcttacttcttgatgagttattaccattaaatatgattggtataaaaaaagttcagggaggtggtcttgaagagtcagttctagtagctggagttgctttcaagaaaactttttcttatgctggttttgaaatgcagccaaaaatatacaaagattgcaaaattgctttattaaatattgaattggaacttaaagctgaaagagataatgcagaaattcgtttaaccagtgtaaaggagtatcaaaaagttgttgatgcagaatggaacatattgtacaacaaactccaaaaaatccatgaatctggtgctaatgctgttttatccaaacttcccattggtgatgtagccactcaatattttgctgatcgagatatgttctgtgctggtagggtaggagaagatgatatgaaaagaaccctaaaagcatgtggtggtgctgtaatgaccactgttaatgatctaaatgattcagtactaggtaaatgtcagctttttgaagaaaaacaaataggaggtgagagatacaatttctttaaaggatgtcctaatgctaaaacttgtacattactcttaagaggaggatctgaacaatttctcgaagaaactgaaagatctttacatgatgccatcatgattgtccgtagaactatcaagaatgactcagttgtagcaggaggaggagcaattgaaatggaattatcaaaattattaagagatcattcaagaactatagcaggaaaagaacaactccttattggggctattgctaaagctttggagataatcccaagacagttatgtgataatgcaggttttgatgctacaaacatactaaataagttaagacagaagcatgcccagaataacccttggtatggtgttgatattgccaaagaagacattattgacaactttgaagcttgtgtttgggaaccagccattgtcaaggttaatgctttaacggcagctgcagaagctacctgtctaatactttctgtggacgagactatcaagaatcagaaatctgaagctccaccacaaatgggagggcgtggtatgggaagacccatgtaa

SEQ ID NO: 1040 - DNA, 12180 bp, Psylliodes chrysocephala
atgtttagaattttctcccgttttaatgctctatttgttagacctcacatcagaggtgctattcgagaatatcagacacatttaattcaacgagtaaaagatgatattgaggctcttcatgaaaagtttaaagttcaatatccccaaagtaatagtgcaaaaataagcaaagttagagatttacctcctgttgctggatctattgtgtgggctaaacaaattgatcatcaactaacaacatacttaagacgtgttgaagatgttttaggtaaaggttgggaaaatcacattgaaggccaaaaactaaaagcagatggagacagtttccgtctaaaactaaacacgcaagaaatattcgacgattgggcccgtaacgtacaacagcgcaatcttggagtatctggaagaatttttaccattgaagcagtgagatctagaagtggcagaggcaatattttaaaattgaaagttaactttctaccagaaattattacattagccaaagaagtgcgtaatttgaaatgtctaggatttagagttcctctggccattgttaacaaagcacatcaagcgaaccaactttatccatttgctatatcgcttatagaaagtgtcagaacctatgagatgactttagaaaagattgaagataaggctagcattatcccccttgtcgctggtatgagaaaagaagttcagcaagtcattgcagaaggtatccaactagtttgggagagctacaaactagatccctatgtccagcgtctatcagatcttgtcgttagtttccaagaaagagttgaagaactagtttttgttggtgaacagttagaagttgatgtaaggtcgctagaaacttgtccttattcagctaatacattcgctgatatattatccaagattcaacatgccgtggatgatctttcattaaaacagtattcaaacttacatatttgggttagtcggttagatgaggaagttgaaaaaaatctcgctaggcgtctgcaagcaggtgtcgaagcttggacagaaactttaagtggacagaaaaaagaaattgatcacagcatggatacagacgctccagcacaaccaacacacaagcctggaggggatcctcagattcaaacaatgatacatgaagttcgtattacaaatcaaacaatgtatttgtatccaagtatagaagaggccagattcctaattatgcagcaattattcgcttggcaagctattgttacgtctcagcaacgtcttcagagtagtagatatcaagttggcgtggataagccagttacagaaacctacagaaatattttaaccaagttaccagcaggtccgcaacctctaactaacgcttatagcgccatatcttcaaaaattaaagaggttcaaagttatgtaaatgaatggttaacctaccaatctttatgggatctacaagctgacaatctttatggaaagttaggagaagatattagcaaatggatggagtgtttaaatgatataaaaaaaacgcgtacaacttttgacacatcagatactcgtcgagaattcgggcctatcatcattgatttcgccaaagttcaaagcaaagtctctttaaaatatgattcttggcacaaagataccttaggtaaattcggaagtcttttgagcaacgaaatgacttcattccactctaatgtttccaaatctcgatctgacttagaactgcaaagcattgaagcagcaagcacttcagatgcagtctgtttcataacgtatgttcagcaattaaaacgtagtatgaaagcttgggagaaacaagtagacatttacaaagaaggtcaaagaatattggagcgtcaacgatttcagttccctacaaactggttacatgttgaaaatttagaaggggaatggggagcattcaacgaaatcatcaagagaaaagattctagcatccaaacacaagttgctagtcttcaacaaaaaattgtgtctgaagataaagctgttgaaagtagaaccaatgatttcttggttgattgggaaagaagtaaacccgtcgaaggtcatcttagaccagatgacgctctttctcaactacaactatttgaaagtaaattctcccgactaaaagaagaacgtgataatgttgcaaaagcaaaagaagctcttgaattgcaagatccaggcggtattagtaccagtgaagacagaatgcaagttgtttatgaagagctacaggatttgagaggagtgtggtctgagttgtcaagaatttggcagcaaattgatgaaactagggaaaagccttggttatctattcaacctagaaaattaaggcagcaattggaccaattgtccacccaactcaaagaattaccagccaggcttagacaatatgcttcctatgaatatgttaaaaaaactctccaaacttacacaaaagttaatatgttaattgttgaattaaaatctgatgctcttaaagaacgtcattggaaacaactaatgaaacaattgagagtaaactgggtcctttctgatttaaccctcggtcaagtatgggatgttaatcttcaaaaaaatgaagcaatcgttaaggatatcatattggtggcacaaggagaaatggctcttgaagagttcttgaaacaagttagagaatcttggcagaactacgaattggacttaatcaattatcaaaataaatgcaaactgattagaggatgggatgatctatttaataaagtaaaagaacatattaattctgtagcagctatgaagttatctccgtactacaaggtgtttgaggaagaagctttaacttgggaagaaaaattaaaccgtattaacgctctttttgatgtgtggattgatgtgcaaagaagatgggtatatttagaaggaattttctctggaagtgcggacattaagacacttctgccagtagaaacatctcgattccaaagtataagttctgagttcttagggttgatgaagaaggtaagcaaaagtcctatggtcatggatgttttaaatattccaggagtacaacgggccctagaaagattagcagaccttctaggaaagattcaaaaagctctaggagagtatttggaacgagaacgtacatcttttccacgtttctactttgtaggagatgaagatctattggagatcattggtaacagcaagaatgttgcaaggctgcaaaagcatttcaaaaaaatgtttgcgggcgtagcttccatactcttaaatgacaacaatacaattataactggtattgcatctagggaaggagaagaagtagtttttaactcaccagtttctactgttgatcatccaaaaattaatgaatggcttagtatggttgagaaagaaatgcgagttacattagcttcaaatttaacacaagctgtacaagacatcaaacagtttaaagatgaaattgactcaaaggcctacatggaatgggttgataaataccaagcccaaattgttgtacttgctgctcagattctatggagtgaggatgttgaagcagctcttgtgaaaatgaacagtgaaccacagaaaggtgtcctagaaaaggtacttcaacaagttgaaagtactcttaatgtcctagcagattctgttcttcaagaacaacctcaacttagaaggaagaagttagaacacttaattaatgaatttgttcataagagaacggtaacaagaagacttattgctaatggtgtttgtagtaacaaagcttttgaatggttatgtgaaatgagattctactttgatcccaggcaaacagaggttcttaagcaactgacaatacacatggctaatgcaagattctattatggatttgaatatcttggtgttcaagatagacttgtacagacacctctaacagatagatgctatttaaccatgactcaagccttggaagccagattaggaggatcacctttcggtcccgctggtacgggtaagacagaatcagttaaagctctcggaaaccaattgggtcgtttcgttcttgtatttaactgtgatgaaacattcgattttcaagctatgggcagaattttcgttggtttatgtcaggtaggcgcatggggttgctttgatgaattcaacagattggaggagagaatgttatctgcagtttcccaacaaatacaaaccatccaagaagctttgaaatctcagaaagaagctgcagcagaaggaactgctactggtagtataagcgttgaacttgttggcaagcaagtaaaagtatcaccagatatggctatattcattacaatgaatcctggttatgcagggcgttctaatttaccagataaccttaagaaattattcagatctctggctatgaccactcccgacagacaacttatcgctgaagtcatgttgttctctcaaggatttagacaagcagaaaaattagcctccaaaattgtacctttcttcagattgtgtgatgaacaactatcaaaccaatctcactatgactttggactgagagcattgaaatcagtacttatatcagctggaaatgttaaaagagacagaatacaaagaattaaagaaggtatgactcagagaggcgaaactaacatagacgaggctaatatagccgaaaatttacctgaacaagaaatattaatacagtctgtttgtgaaactatggtacctaaattagttgctgaagatattccacttttgtttagcttattgaacgatgtatttccgaatgttcagtataccagagcggaaatgcaaggccttaaggatgaaattagaaaagtttgtgctgaagaatatcttgtttgcggcgaaggagatgaaagaggatcagcttggatggaaaaagtgctccaactataccaaatttccaatctcaatcacggtttaatgatggtaggtcctagtggttctggtaagagttcagcttggcgagtattactcaaagctctcgaaagattcgaagggaccgaaggggttgctcatgtaattgacccaaaggcaataagtaaagaggctttgtacggtgttttggaccctaataccagagaatggaccgatggactttttacacatatattgagaaaaatcatagacaatgttagaggtgaaattaacaaacgccaatggattatctttgatggtgatgtagatccagaatgggtagaaaacttaaattcagtgcttgacgacaacaaactattgactcttcccaatggtgaacgtctttcgctacctcccaatgttagagttatgtttgaggtgcaagatttaaaatacgcaacattagctactgtctctcgttgtggtatggtatggttttcagaagatgttctatctactgaaatgatatttgaaaactacgttctgcgattgaagaacattccgcttgaagaaagcgaagaaggtttcggcaagaaatcagacatgaaagaagatatgttatccccaactcttcaattacaactcgatgttgttaatttgttacaacccttcttagcaccagatggtcttgtggtgcgttgtttagaatatgccatggaacaagaacatatcatggattttactcggttaagagctttaagttctttattttctatgttgaaccaagcagtgaggaacgttttacaatacaaccatatgcacccagattttcctctctctaatgattatctcgagaaatatattccgaaatgtctaatttactccatcttatggagttttgcgggagatgctaaacttaaagttagatcagaattaggagattttactcgttcagtatccaccattcctttaccaccagacaatagcatgccaattattgattatgaagttaccattgaaggagaatggtcattatggtcaaacaaagttccacaaattgaagttgaaacccataaagttgcttcccccgatattgtagtacctaccttggatactgtaagacatgaatctttgttgtatacttggttggccgagcacaaaccaatagtgttatgtggtccacctggttctggtaagacaatgactttattctctgctttgagagcactacctgatatggaagttgttggtttgaacttctcttctgctacaactccagaattattgctaaaaacttttgaccactactgtgaatatagaaaaacacctaacggtgtagttttatcgccaattcagctgggtaaatggctagttctattctgcgatgaaataaatttaccagacatggatacctatggcactcaacgtgtaatcatgttcctgcgccaaatagttgaacaaaagggcttctaccgtgcctcagatcaatcttgggtttccttagaacgcattcaatttgtaggtgcttgcaatcctcctacagaccctggaagaaaacctctttctcatcgtttcctcagacatgtaccagtcatttatgtggattatcctggagaaacctctttaaagcaaatttatggtactttcactagagccatgttgaggttggctccaggtttaaaaggttatgcgaatcctttgacaaatgctatggttgaattttacctagcgtctcaagacagatttactcaagatatgcaaccccattatgtttattcccctcgagagatgacaagatgggtaagaggaatatgcgaggctatcagaccattagataatctctctgtagagggattagtaaggctttgggcgcatgaagctctacgtctattccaagatagacttgttgaagacacagaaagacgttggaccaacgaaaatatcgacgctgtcgccttaaaacatttcccatcagcgaattgtgaacgtgcattggaacgacctattttatacagtaattggttgtctaaagattacgttcctgttggaagagagcagttaagggaatacgttaaagcaaggctgaaagtattttatgaagaagagcttgatgtgcccttagtactatttgatgaagtattagatcatgtattaagaatagacagaattttcagacagcctcaagggcatttacttctgattggtgtctctggagctggaaaaactaccctctctagatttgtagcttggatgaatggattatccatcttccagatcaaagttcacaataaatatacagctgaagattttgatgaagatttaagatcagttttgagaagaagcggttgcaaacacgagaagatttcattcattttagatgaatctaatatgttagattccagtttcttggaaaggatgaatactcttttagctaacggtgaagttcctgggttgtttgaaggagatgaatacacaactttaatgacacaatgtaaggaaggagctcaaagagaaggactaatgttggattcaaatgacgaactttataaatggtttactcaacaagtaatgcgaaatttgcatgtagtttttaccatgaatccatctactgatggtttgaaagacagagccgccacatcccctgctttattcaacagatgtgtcctaaactggtttggtgattggtcagatggagccctcttccaggttggaaaagaattcacgaatcgtttggaccttgacaaacaaagctggagatgtccggacttcttccctgcagcttgcaatcatgtttctgcttcacccaatcatagagaagctgttatcaatgcttgcgtctacgttcatcaaactcttcacaaagctaacagtagactggttaaaagaggaagtcgtactatggcgatcacgcctaggcattatttagactttattcatcatcttgtaaaattatataatgaaaaacgatccgatttggaagagcaacaacttcatctcaatgttggtttaaataagattgcagaaactgtggaacaggtggaagaaatgcaaaagagtttggcggtaaaatcgcaagaattgcaagctaaaaatgaggcagctaatgccaagcttagacaaatggtcaaagatcagcaagaagccgaaaagaagaaggttcaaagtcaagaaatccagcaacaacttgcgcaacagactgttcatatccaacagaagagatccgaagtaatggctgatttagaacaagtcgaacctgctgttattgaagcccaacaagctgttaaatctatcaagaaacaacaactggtagaaattcgtacaatgtcaaatcctcccgcccttgtaaaactcgccttagaatcaatttgtcttttactcggagaaaatgccagtgactggaaatcaattcgggctgtcatcatgagagataattttattaatagtatcgtcaatttcaacactgaagacatcagtgatgaagtaagagaaaaaatgaagagccgctatttgagcaatccagattacaacatcgataaaatctaccatgccagtaacgcttgtggcccactcgtcaagtgggcatgcgctcaagttcagtacgccgatatgttgaagaaagtagaacccttacgagaggaacttagatcacttgaacaacaagctgaaaccaaccaaaaacgtggtgaagacgtcaaagctcttattagtcaattggagcaaagtattgcatcttataaagaagaatatgcacaacttattgcgcaagctcaagccattaaaactgatttggagaatgtacaagctaaagttgacagatccattgcacttcttaagtcgcttgtaattgaaagagagaggtgggaagctagcagtgaaactttccgatcccaaatgtctactattattggtgacgtcttattatctgccgcttttattgcatatggtggatacttcgatcaacattaccgtcagaatctattcagtacttggtgtcaacacttgacgcaagcaagtattcaatacagagctgatatagcaagaacagaatacttgtctaatcctgatgaaaggcttagatggcaagccaatgctttgccatctgatgatttgtgtactgagaatgctattatgttgaagagattcaacagatatcctttgattattgatccatcaggacaagccactgaatttataatgaatgaatttaaggataagaagataaccaaaactagctttttagatgattccttcagaaaaaatcttgaatcagcattacgttttggaaatccactgctggttcaagatgtcgagaactatgatgccatattaaatccagtgctcaacagagagttaaggagaacgggtggtcgtgtattgatcacccttggtgaccaagatatcgacttatcgccttcctttgtcatattcttatcaactagagatcccaccgttgaatttcctccagatatttgctctagagtaacatttgttaacttcactgttaccagaagttctttgcagagtcaatgcttaaaccaagtacttaaagcagaacgaccagatattgatgctaaacgttctgatctactaaaactgcaaggtgaattccaccttagattaaggcaactggaaaaatctcttttacaggcattgaacgacgctaaaggaaaaattttggatgatgatagcgttattactactttagagactcttaaacaagaagcagctgaaattggacaaaaagttgaagagactgataaggttatttcagaaattgagactgtttctcaacaatacttgccattgtctcaagcttgcagtaatacgtactttactatggacagtctcaatcaaatacacttcctctatcaatactctttgaagatgttccttgacgtttttgcttcggtgctacataacaattcgaaacttgatggtatctcagattatcaagctagacttaatgttatcaccagtaacctattttctgttgtttatgaacgtgtagccaggggaatgctccacaacgatcgcatgacttttgccatcttactctgcagaattcatctgaagggacaactctctgaacccaacctggaccaagaatttaatttcttcctaaggggcaaagaaggcgtttttaatagttctggttctacaatcgttgacggattaaatagcgaccaacaagaagcaatcactagactatctaccaagctacccacattcagaaaactaccaaacgaccaacaagaagcaatcactagactatctaccaagctacccacattcagaaaactaccaaacgaaataaaagaaatgccagaatttggggcctggttacaacaaagcagtcccgaacaagctgttccacaattgtggattgaagaaaaacaactaagtgcaatcggtagaggaatgtaccaactcttggtaatccaagcgttccgaccagatcgagtaatagctgcagctcaaagctttgtagcagctgttcttggaccagacttcatgtatttagctgagaaagaattggactttgctacgtgtattgaaaaagaaatcaggtcaaatgtgcccgctctgttgtgttctgtacctggatttgatgcttccggtcgtgttgatgatttggcggctgaactaaacaaacaaatatcaagcatagctattggatctgcagaaggatttaatcaggctgatagagctattaatatggcttgcaaaactggaagatgggtaatgcttaaaaacgtacatttggcaccccaatggcttgttcaacttgagaagaaactacattctttacaaccacatgcgaacttcagattattccttaccatggaaattaatcccaaacttcctgtgaacctacttagagcaggaagaatatttgtatttgaacctcctccgggtattagggccaatttattgagaactttcagtacagttccagctagtagaatgatgaaagcacccaatgagagagcaagattatacttcctattggcttggttccatgctattgtacaagaaagactgcgttactgcccactaggttgggctaaatattatgaatttagtgaatcagatttacgtgttgcctgtgatactttagatacttggattgatacgactgctatgggaagaactaatttacctccagaaaaagtaccctgggatgctttggtcacacttctttctcaatcaatctatggtggtaaaatcgataacgactttgaccagagacttttacattcctttttgaataaattattcacacccaaaagctttgaaagtgattttgcactggtagcaaatattgacaatggtcctggaggaaatagacacattactatgcctgatggaaccagaagagaccatttcttgaaatggattgaaagccttgcagatcgtcaaacaccagcctggttggggttgcctaataatgctgaaaaggtacttctaacaacaagaggcactgaccttatagctaaattactcaagatgcaacagttggaagacgatgatgaattggcatattccattgatgacagctcaccaacagatcctgctcaggtcgatgggcgtccatcttggatgaaaacattgcacaatagtggtgctacttgggttaatttactgcccacttcattacagactctgagaagaactgtggagaatatcaaagatcctctttacagatattttgaaagagaagtcaattcagcttcaaaacttcttacagatgttttgcatgatcttaatgacgtacttttgatctgtcaaggagacaagaaacaaacgaactaccatcgtactatgttgtctgaactggtcagaggaattattcctaagaattggcatcgttatacaatacctaaaggttgtactgtaatgcaatggatcaccgactttagtcaaagaattaaacagttacagaaagtatcgaaggtagtttcatcagcaggtgctaaagaattacagagcttccccgtttggctgggaggacttcttaacccagaagcttacataacagctacaagacaatgtgttgcccaggctaatagctggcctcttgaagaacttcacttggatgttaccatcacagattctaatgataaagattctgttccacatgactgttttgcagttgttggaattaaattacaaggagcccaatgccgaaataatcaattgttactcacatccagcatcatgatagaactcccaataacgctcttccgttgggttagaattattggagaagacaaactaaaagaaggaaaactctctttaccgctttacttaaattctactagaacagaactatta

SEQ ID NO: 1041 - DNA, 2673 bp, Psylliodes chrysocephala
atgagtaaccatcggtcgaaaaaacaaatcgagtcagattccgattctgatagtgttgatagtgccgaagaagccagaagacgtgatctcaaagaaagagatgagtttgctacacgtcttaaaaaacgcgatgaagaacgtacaagaaatatcgtacaaagttcagataaaaaagcttatgaagaagcagccaagaggctgaaattagacaatgcagagaaagagaaactcattccagaactccgtaagatttcaaggaggaaatatttggaaaaaagaaaggatgataagttacaagagttggaggctgatattgctgatgatgaatatctgtttgaagaaaaagtattaacagaaagagaaaagaaagaacgccagcataaaaaggaactattacaacttgctcaggaacatgaaaaagcaagagaacttgaacgaattcagaggtatcacatgcccagagatttgggtaaagactctacagcagattatattgaagttgatgaacttgaaaaagtacctcaatccgaacagaaaaaatgggaaaaagaccagatggcttctgctgtttttaagtttggtgctaaagatgtcaagaaaaaggatgattatgagttgctgttggaagatcagattgattttattcaagccttgcaaatgccaggggtcattgaaaaaaaggaaaaagagttaactgaagtagagaagaaaaagttgagtattgaagaaactaagaagagtttaccaatatttccatttaaagatgatctgattcaggcaattagagaacatcaggtattaatcattgagggagaaacaggatctggaaaaactacacaaattcctcagtatctacatgaagctggattcactgaagatggaaaaaagattggctgtacacaaccacgtcgagtagcagccatgtctgtagcatcaagagtagcacaagaaatgggtgtaaaattgggcaatgaagttggatatgccattagatttgaagattgcacttccgaaagaacagttataaaatatatgacggatggtacactacaccgagaatttttatcagaacctgatctgcagtcttacagtgtgatgattattgatgaagctcatgaaagaactttacatactgatatattgttcggtttggtaaaagatattgcgagatttagacctgaattgaagctgttaatatctagtgcaacattggatgttaccaagttttcggaattttttgatgatgcacctgtataccaaattccaggtcgtagatttcctgtagatatttactatactaaagctccagaagcagattatgtagatgcctgtgttgtttccgtacttcaaatacatgtaactcaacctcttggtgacattttggtttttttgactggtcaagatgaaattgaaacctgtcacgaacttttacaagatagagtaagacgtttaggttctaaagttaaggaattattaatacttcccttatatgctaaccttccgagtgatatgcaagctaaaatcttcgaaccaactccccctggtgctagaaaggtggtacttgctactaacatagctgaaacttcattaacgattgataacatcatttatgtcatcgatccaggatttgctaaacagaaccatttcaattccagaacaggaatggaaagtttgatgatagttcccatatctaaagcttcagctaaccagagagctggacgagctggcagagtagcagccggtaaatgttttcggttatacactgcttggtcttacaaacatgaactggaagataatacagtaccggaaattcaaagaattaacttaggaaatgctgttttaatgttgaaagcattgggaatcaatgatttggtgcacttcgattttttggacccacctccgcatgagaccctagttttagctttggaacaattgtatgcgttaggggcattaaatcatcatggagaattgacgaaactagggaggagaatggctgaattaccagttgatccaatgatggcaaaaatggttttagcatctgaaaagtacaaatgtgcagaagaaatagtttcaataggagcaatgttgtcagttaacggagcaatattttacagaccgaaagacaaaataatacatgcagatactgctaggaaaaattttaatcactcgggaggtgaccatttaagccttctcaatgtttataaccagtggcgcgattctgattattccttacagtggtgttatgaaaattttatacagtatagatcaatgaaaagagcacgtgacgttagagagcaactggtcaacctaatggcaagagtagaaattgaaatgttgtccagcattgaagacatagacaatgttcgcaaagcgataactgcaggttacttttatcacatagctagattttcaaaaggcggaagttacaaaactgttaaacacaaccaaagtgttaccatacatccaaacagttctctctttgaatctttgcccagatgggttttgtatcatgagttggtttttactacgaaagaatttatgaggcaagttattgaaattgaaagtaaatggttattagaagtagctcctcattattataaatcaaaagaactagaagatacaacaaatagaaaaatgcctaagactataggcagaagtaaaatgactgattag

SEQ ID NO: 1042 - DNA, 1371 bp, Psylliodes chrysocephala
atgaaggtagaagaggtaaaaagcaccgtaaaaactcaaagaataagtgcccatagccacattaaaggtttaggtttggatgacgctggtttcgcaattcaatctgcggccggcttggttggacaagagcaggccagagaggctgccggggtagttgtagatatgataaagagtaaaaaaatggctggtagagctgttctgttagctggtcctcctggtacaggtaaaacggctattgctttagctattgctcaagaacttggaaataaagtaccattttgtcccatggttggttcagaagtatacagctccgaaattaagaagactgaagtactcatggaaaatttccgaagggctattggacttagaattcgagaaaccaaagaggtctatgaaggggaagttagtgagctcacacctgtagagacagaaaatccagcaggagggtatggtaaaactgttagtcatgttgtaattggtttgagaactgctaagggtagtaaacaattgaagctggatcctagcatctatgaagctctacaaaaagagaaagttgaggttggagatgttatttacattgaagctacaagtggagctgtcaaaagacaaggaagatctgatgcatatgccactgaatttgacttggaagctgaagaatatgttccccttccaaaaggagatgtacataagaagaaagaagtagttcaggatgttactttacatgatttggatgctgctaatgctaaaccacaaggaggtcaagatgtattatccatgatgggacaactattaaaaccaaagaagactgaaattacagacaaattaaggaaagaaattaacaaaattgttgacaaatatattgatcagggtatagcggaattggtacctggtgtactttttattgatgaagttcatatgttagatctagaaacatttacttatcttcatagagctttagaaagtgccatagcacctattgtaatttttgcaacaaatagagggcgttgtcttattagaggaacagatgacattttctcttcacatggtataccattagatcttttggatagattgctgattattcgaacaattccttatggtagatctgatatggaacaaattttgaaactaagggccaccacagaaggtttagaaattgaatcagatgccatcgcaatattaggagaaattggtacaaaagctactttgagatatgcagtacagttgttgacaccctctcatttgacagctaaaatcaatggaagacataatataatccaaagcgatattgaagaagttggttcattattccttgatgcaaaatcatctgctaaaattctgactgacaacaaggagaagttcatgacttaa

SEQ ID NO: 1043 - DNA, 2196 bp, Psylliodes chrysocephala
atgacgtcaattatcaaactgcaggtcttatctggggccaaagacgaatcgcccccatgttacctacttcaagtagacgatgtacgaatattactagattgcggctgggatgagaagtttgatatggaatttattaaagaaattaaaagacacatccatacgatagatgctgtattaatttcttatcctgataattatcacttaggagctttaccatacgttgtggggaagctcggtttaaattgtccaatatattcgacaataccagtgtacaaaatgggccaaatgttcatgtatgatctctatcagtcgcaatataatatgaaagagttctgtatattttcactggatgatgtagatgttacttttgagaagtttattcaattgaaatacaaccaaacgatgcctttaaaaggtaagggatatggtttaacagtcacacctttacctgccggtcatatgattggaggaacaatttggaaaatccagaaagtaggcgaggaagatattgtatattgtaacgattttaaccataaaaaggagcggcacttaaacggttgtgaattagaaaaattacaacgaccatctttacttataactgatgcattcaatgctagctatcaacaagcaagaagaagggctagagatgaaaaattaatgacaaacatccttcaaaccttaaggaaccacgggaacgtgctgatagcagtcgatacggccggcagagtcctagaactggcacacatgttggaccagctttggagaaacaaagaatccggtcttctagcttactctctggcattcctaaacaatgtgagctacaacgtagtcgaattcgctaaatcgcaaatcgaatggatgagtgataaactcatgagaagcttcgagggtgctagaaacaatccatttcagttcaaacatttacaattgtgtcacagtttggtcgagttgaacaaagtgccgagtcccaaggtcgtgttggccagctcacctgatttagaaagtgggttttccagggagttgttcttgcaatggtgttctaaccataataacagtattatattaactacaaggacgtcaccgggaactctagctagagatctaatagacaacggaggtggaagaaacatcgatttaacagtagaaagacgggtgagattagaaggacaagaactcgacgattacgaaagaagacaaaggtctagaagtgataaaattgacaatgaggacgcggattcagattcggactctgacatcgagatgtcggtaatctcgaaggggaagcacgacatcgtgatcaagcaggaaggtaaaatatcgacgggatttttcaaggttaccaaaaaaatgtacccgatgtatccgttccacgaggaaaagattaagtgcgacgaatacggcgagatcgtcaaacccgaggattacaaattggccgaagtaatacccgaaggcgaagacaataaggaaaatatcgtgataaagaaagaagaggaggaaattactgaaattacggaacaaccgacgaaatgcatcgtgctgcaaaggacggttcaagttaactgtcaagtccagtacatcgatttcgagggtagatcagacggtgaatcgctgatgaagattttgacgcaactgaaacccaggagagtgattgtggtgcgcggcacggaagaaaatacggccgtcatcgagaagcattgcttggagaacatgcaggggcgagtgtttacgccctctaggggcgaaatagtcgacgctacgagcgaaacgcacatctaccaagttaggttgactgacgctctagtgtcgcagttgagtttccaaaaggcgaaagaagcagaagtggcttggttgagcgctcacatcatgctgagggaaagccaggcggacgccagacgaataaacgttgatgacgaagaaatggaagtggtagacgaagaaacgagaattctaacccttgagcctttacccgaaggttcgccgcacgatcctgtgttcataaacgagttaaaacttgccgagtttaaacaagttttaggaaggaatagtattaattcggaattttctgggggtactttgtggtgctgtaatggtactatagcagtgagaaaggtggagaatggtaaaatgatgttggaaggaatagtattaattcggaattttctgggggtactttgtggtgctgtaatggtactatag

SEQ ID NO: 1044 - DNA, 2286 bp, Psylliodes chrysocephala
atgcctcctttggaggtaacatccaacacaaacaatgaagaacctggcccaataaatccagttgtgggtataatttatccaccaccagaggttagaaatatcgttgataaaacagccagcttcgttgctagaaatggaccagaatttgaagctcgtatcagacaaaatgaacttggaaatcctaagtttaatttcttgaatggtggagatccttaccatgcatactatcagcacaaagttaaggattttagggaaggaaaaggtcaagagccatctcctggtttaagtctagcagtttctaagctttctgtaagtgcttcagcacaacagaagcaacaagaaatattgaaacaagtagaacagccttttgtgcctaaagatccaccacaagattttgaatttattgcagacccaccatctatttcagctctagatttggacattgttaagctcactgctcagtttgtagctagaaatggtagagcatttttgacccagttaatgaacagggaacagagaaattttcagtttgattttctgagacctcagcattctttgtttcagtatttcactaaactgttggaacaatatactaaggttcttattcctccaaaaagtatgcaacagcgtcttagggatgaagcaaaaagtgctaaagctgtactggaacaggtaaaatatcgtgcagagtggttgagatatcaggaacaacaaaaagcaaaagaagaggagattcttgaacgagaaagagtggcctatgctcaaattgactggcacgattttgtggtggttgaaacagtagactaccaaccatttgaaattgggaacttcccacctcctaccacaccagaagaggtcggcgccaggatattaatacaagaaagaattgaagatggagaagacattgaaatgcaactggaaagcgatgatgacgatgatactccaaatgctgaggaaggtttgagtaccatgcaggataaaactaagcgcaaaggaggtgatgataatcgcgttcaggatatggaggaagaaagttctgatgaagatgaaaatgaaggcaagacacctagagcacctcccccgccgtcaattcaaccccctctaccacctgctccagataaagtgcttgtgaagaaatatgatcctaaacaagccgttaaagtcgcaagacctacagtaggagacgattatctagtctctcccatcactggtgagaaaattccagctagcaaggtccaggaacacatgcgcatcgggcttttggatccccgttgggtggaacagcgggacaaacaaattacagacaagatgaaccaagatacggtttatgcagccggtagcgccatcgatgcatctcttaaactcctcgccgaaagacgtaccgatattttcggtgtcggagatgaagaaactgctattggtaaaaagattggagaagaggatgtcagaaaagacgagaaagtgacatgggatgggcatacgagcagcgtggaagcagcgacaagagccgcgagggctaatattactttagaggaacaaattcatcaaatacacaaagtaaaaggtctacttcctgacgaagagaaagaaaaaattggtcccaaaaatattggatctaagaagataaacattcagagtattattactacaaaacctcctaatccacctgttcagcccccaaagccgccagtatctcttatacaaacccctgctccacaaatgattccagttccaactcaggctgcgatgatggctccacagccacctataatgatgatgcctgctcctcccatgcctcccataagaccaccacctcttatgatgcccggaccaccgccgatgggtggctttcctgtaggaccaatgcctggaccaccgatgggtcctggtatgaacatgccccctatgaaacatcctaatgatggaccatctgaggatgaacctagtaataagaagttaagaaacgaggattcactcattcccgaaaatgtgttcttgtctagaaatccaagccaagtgtcgataaaagtttcgattccacatatgccggaaaagtcagaatggagattaactggacaaatgatgtcttggacttttcctttaggagaatctgtggcaaacttgaaagccaaattacaggaagaaacgaatatgcctcccgccaaacaaaagttattctttgatggaatgtttttcaaggattccaacacattggcctattataatgttactccaggcgctgttatccaattgcagatcaaggaaagaggtggaaggaaaaaataa

SEQ ID NO: 1045 - DNA, 999 bp, Psylliodes chrysocephala
atgcctagttcagacgtaacgacaactaaagttatagtccatccattggtcttacttagcgtagtggatcatttcaatcgtatgggaaaaatcggtaaccaaaaacgcgtcgtcggtgtcttactcggttgttggagggctaaaggagtcttggatgtttcgaatagtttcgcagttccttttgatgaggatgacaaagatcaatctgtgtggtttttggaccatgattacttagaaaatatgtacggcatgtttaaaaaagtcaatgctagagaacgtgtagtgggctggtaccacaccggacccaaattacaccaaaacgacattgctattaatgaactagtaagaagatactgtccaaattcagtattggtaattattgatgccaaaccaaaagacttaggccttcccacagaagcgtatcaagccgttgaggaagtacatgatgatggttcaccaacatccaaaacttttgaacacgtaccaagcgaaattggagcagaagaggctgaagaagtgggtgtagaacatttattacgtgatatcaaagatactactgttggcacactttctcaaagaattacaaatcaattgttgggtctgaagggactgcattcacagttgaaagacattagagactatttgttaaatgtttgtgacaatacgctacctattaatcatcaaattatctatcagttacaagatattttcaatttgttgcctgatataaaccaagatgcttttaacaattcattttatgttaaaaacaatgatcagatgcttgtagtctacttagcagctctggttagatccatagtggcattgcataatttaatcaataacaaactgacaaacaaagatgctgaggagggtaagaaagaagagaagaaggatagtaaggataaagataaggacagtaaggataaggatagtaaagataaagataaggaaaagggagaaaaggataaggatgcaaagaaggatgagaagaaaaagtag

SEQ ID NO: 1046 - DNA, 1653 bp, Psylliodes chrysocephala
atgtttggaggaggacgtgctcccattttagttttgagccagaatactaaacgagaatcgggccggaaagttcaggtggagaacatcaatgccggaaagcaaattgcagatgtcattcgaacatgtctggggcctcaggccatgttaaaaatgcttatggacccaatgggtggaatcgttatgaccaacgatggaaatgcaattcttcgtgaaattacagtgcaacatccagctgcaaagagcatgatagaaatagccagaacccaagatgaagaggtaggagatggtacaacatctgtaatagttctagctggtgaaatgttagctgcagctgaacaatttcttgaacaacaaatacaccctacagttataattcgacaatatagacaagctcttgaagacatggttctatttttagaagggcctttaagtgttcctgttgacagaaatgataaaaaggcccttgcccaagtagttaaaggatgtgttggtaccaaatttttatgcagatggtctgatctggcagttggtattgctctagatgcagtaagtacagtattacttgaagaaaatggcagaacagaagtggatattaaaagatatgccaaagtagaaaaaatcccagggggttcagtggaagaatcaaaaatcttaaagggcgttatgctcaacaaagatgttactcatcctaaaatgaaaagggtagttaagaatccgagaattatacttttggattgtgctttagaatataaaaagggcgaatctcaaactaacgtggaaatcagtgcagaaacagattttacaaaactccttgagcttgaagaggaacatgttaagcgccaatgtgatgaaatcatagcttttaagccagacgttgtctttacagaaaagggtgtttcagatctagcccaacactttttattaaaagctggaatcagtgctgtgagacgtgttaggaaatctgacaataacagaattgccagagcatgtggtggtacaattgtgaatcgaacagaagaattacaagagacagatgttggtaccggagctggtctctttgaaattaaaaaaataggcgatgagtacttctgttttgtcgatgaatgtaaaaatccaaaggcttgcactattttgctccgaggagctagtaaagacatccttaatgaaattgaaagaaatctccaagatgcccttcaagttgcaagaaacatagttctctcaccccgtctagtgccaggaggtggtgctattgaaatggccatagctcaacgtctaatgcaaaaagcaacacatggaccttacagagctcttgcacatgcactagaaattattcctagaactttagctcagaactgtggagctaacacaatcagaaccttgacagctttgagggcaaaacatgctaaccatactgatgctgagaaaccttgtacttggggtatagatggagaaactggcgagattgttgacatggagactaaaggattgtgggaaccactttcagtgaaactacaaacttacaaaacggctattgaaactgctattcttctattgcgtatcgacggtattgtgtctggatccaaaaagaagggtgacaaggaaccacctacacctagccaagtacaacaacaagacgcaagagaagcagattga

SEQ ID NO: 1047 - DNA, 705 bp, Psylliodes chrysocephala
atgatgatgcaaacagaaatgaatgcttattatcctgactattctacagctccaatccaacgacaaattaacccctatgctgataatggagggagtgttgtagcgatagcaggaaatgatttcgtagttgtgggagctgatactcgtctcagttcaggtttttcaatttacacaagaaaccaaaataaattatttcctatgtccgatacaactgtattaggttgtgcaggatgttggtgcgacactttaactttaacccgaattttgaaatctcgtatgcagatgtaccagcaggaacataacaaacaaatgtctacaacagcatgtgcacagatgttatccaccatgctgtattataagagatttttcccttactatatatccaatatacttgttggattggataatgaaggaaaaggttgtgtttatagctatgatccaattgggcattgtgaaaaggccacctacagagcaggtggctctgcaggtgcattacttcaacctcttttggacaaccagattggacaaaaaaatctggtgaaaccatcatctgaagatctttctcaagagaaagctcttgctatattgaaagatgtattcattgctgctgcagagagagacatctatactggagatagtgttcttatcaatattattacaaaggatggaactaaagtagaaacttttgaattaagaaaagattaa

SEQ ID NO: 1048 - DNA, 876 bp, Psylliodes chrysocephala
atgtttccagaaatacccagaccttttaatatgacgtacaaatgttattccgttgcgatgttcccaggaaatgaaagacaagatgtcgaacggggaggaaaaattattatgcctccatcagctctagagcaattaacgaggctaaacatcaactatcctatgttatttaagcttgtaaataaaaaaacaaatcgtactacacactgtggtgtgttagaattcgtcgctgatgaaggaaaagtatatcttcccttatggatgatgcataatttggtcctttctgagggcgatttggttcaaatggaaagcatttcgcttccagttggaactttttccaaatttcaacctttgaatcctgattttttggatattactaatccgaaagctgttttggagaattgtttaagatcttatgcttgtcttacgactggggacgttatagctgttaaatataatcaaaaggcttatgagctgtgtgttttggaaacaaagcctgggaatgctataagtatcatagaatgcgacatgaatgtggaattcgcagccccagtgggctacaaggaaccggaaagatttaaaaaagaagaagaggaaatgtctatcgatcctgctgacttaatgccagaaccatcaggttttgtagcattcagaggcgccgggaatcgtctggatggcaaaaaacgtaaagattcttcttcgagcgacagtcacgtatctaaaccaacttacgttaagggaatccccgattacgattacgagatcggcaccttgaatttcatcagaagaacactgaagacgaaagagaaagaaaatgatgataatgaggagttcaaggcgttcagtggaacaggatttagcttaagagctagacagtaa

SEQ ID NO: 1049 - DNA, 1623 bp, Psylliodes chrysocephala
atgtcgacatttccaggatctatcgcctttgatgaatatgggcgcccctttataattttaagggaccaagacaggcaaaaaagattaaccggaatcgatgcattgaagtcacatattttggctgcaagtcagattgctcacacagttagtacttctttaggaccaaagggtttggacaagatgatggtgtcacctgacggagaagttacggtgaccaatgatggcgctactattttgaaaatgatggatgttgagcatcaagtagctaaattgttggttcagttatcccagtctcaggatgatgaaattggagatggaacaacgggagttgtagttctagcaggagctcttctagaacaagcaggtactctattagatcgtggtattcacccaattagaatcgctgatggttttgaactcgcctgtcagacagctgtagagcatttggaaaaaattgccgaagtatttccagtttctgctgaaaatactgagcctctagttaaagttgcaatgaccacattaggatctaaaatcattaataaatgtcacagacaaatggcagaaatcgcagttaatgctgttttagctgtggctgatttagaacaaaaagatgttaattttgaattaatcaaagttgaaggaaaggtcggtggtaaattagaagacacaacaatggtccgtggcgtagtcatagacaaaacaatgtctcatccccaaatgccaaaagagcttagaaatgtcaaactggccattctcacctgcccctttgaaccaccaaagcccaaaaccaaacataagttggatgttgccagtgtagaggattacaaagaattgaggcagtatgaacaagacaagttcaaagaaatcgttagtctggttaagaacgccggcgccacattggccatctgtcaatggggttttgatgatgaagccaaccatttgcttttgcaacaggagttgccggccgtcagatgggtgggcggtcccgaaatagaacttatcgctatcgcgaccggcggtaggattgtgccgcgatttgaggaacttagtcctgaaaaacttggttatgcaggtttggtaagggaaatatcctttggtaccaccaaagataagatgatggtgatagaagaatgcaagaattcccgtgccgtgactattctagttagaggcggtaatcaaatgctggtagctgaggctaagaggagtctacacgatgcgttatgtgtcgttaggagtttagtacaggaaccaagagtagtttatggtggaggtgcagcggagatcgcctgcagtttggcagtagcagcccaagctgatcaactggcaactttggagcaatacgcataccgcggcttcgccgaagctttagaaagcatcccgttggctctcgccgacaatagcggtctttctgccatccacaccttaggagaaatcaaggctaaacagtccgccaccggagatccagccttgggcgtggattgcatgaacaccggcaacatcaacatgcgtgagcaacatgttactgaatctgttaaatctaagcggcaacaattgctgttggccacgcagttggtgaagatgattttgaagatcgatgatgtacgtcagcccggctctggttaa

SEQ ID NO: 1050 - DNA, 342 bp, Psylliodes chrysocephala
atggccactgctatggacgtcgattctgaagaaatcgaattaccaacttctagtagctcgaagggagagaagaaacgatttgaagttaaaaagtggaatgccgttgcactttgggcttgggatattgttgtggacaactgtgctatttgccgcaatcatataatggatttatgtattgaatgtcaagctaatcaagcttctgccactagcgaagaatgtacagtagcctggggagtatgtaatcatgcctttcactttcattgcatatcgagatggttgaagacgagacaagtgtgtcctttagacaatagagaatgggaattccaaaagtatggtcactag

SEQ ID NO: 1051 - DNA, 1605 bp, Psylliodes chrysocephala
atggtgtccctaaacccagtaagaattcttaaacaagaagcagaagaagaaagagctgaaattgctcgcttgagcagttttgttggtgccattgctataggagatttggttagaagtaccttggggccgaagggaatggataaaattttagtatccagcggacgaagtgcaggacacgtagaagtaactaatgatggagctactatattaaaatctgttggtgtagataatccagcagcgaaaattcttgttgacatgtcaaaagtacaggatgatgaagttggagatggcaccacatcagttacagttttggcatctgaattgttaaaagaggcagaaaggttagttgaacagaaaattcatcctcagactataattgctggatggagaaaagcagttgatgctgcaagaaaggccttattagatgcttccaaagacaatagtgctaacctggaagcattcaaagaagatctgatgaatatagcaaggaccacattaagttcaaaaatcctctcacaacacaaggaacactttgccaaacttactgtagatgcagtattgagattaaagggttctgctgaactgcaatccatccagctgattaaaaaaactggaggtactttgcaagattcttttttggatgagggtttccttttagataaacggcctggtgttcatcagcccaagagagtagaaaatgcaagaattttgattgccaatacacccatggacactgacaaaattaaagtatttgggtcacacattaaagtcgactctatggcaaaagtagcagagctggaatctgcagagaaggacaaaatgaaagataaagttaacaaaatcttgaaacacaatgcaaatgtattcattaatagacaacttatttacaactatcctgaacagctgtttgctgatgctggagtaatggctattgagcatgcagattttgatggtattgaaagattagcacttgttacaggaggagaaatagtctcaacttttgaccacccagagcttgtcaaattaggcacttgcaacttaatcgaacaaattatgattggagaagatactcttctacgttttagtggagttgctctaggagaagcttgtaccatagtcattcgtggagctaccagacaaatcattgaagaagcagaccgttccatacacgatgctctttgtgtacttgctgcaaccgtcaaagaaagtagaatcgtttatggtggtggatgtagtgagacattgatggctactgctgtgactaaagctgctgccaacactccaggaaaagaagcagttgccatggaagccttcgccagggctttacttcaactacctaccattatcgctgataatgcaggttatgattctgcacagctgataagtgaactaaaagctgctcacaacagtggccttaacactatgggactcaacatggacaaaggagaggtgggagatatgaaaactttgggaatcacagaatcttttgttgtaaagaggcaagtgttggtgtctgctgcagaggcagctgaaatgattcttcgtgttgatgatattatcaaggcagcgcctagaaggaggacagaagacagagggatgtgctag

SEQ ID NO: 1052 - DNA, 843 bp, Psylliodes chrysocephala
atgtttaggaatcaatatgacagtgatgtgacggtctggagcccccagggacgtctccaccaagtagaatatgccatggaagctgttaacctaggttcagcaacagtaggtctcaaaagtgataattatgccgttataattgctttaaaaagagcttcttcggaactctcggcgtaccagaagaaaattatcaatatcgacgatcatatcggtataactatatctggacttacagccgatgctagaattttgagtagatacatgaggaacgaatgtttaaattataagtactcattggatgcttatatgcccctcaacaggctgattagtatcttaggtaataaaatgcaacattgcacccaacggtacgaccgtagaccattcggcgtcggcctactcgtcgcaggtttcgatgatactggtgctcatatttaccaaacctgtccctcagctaacttctacaactgcaaagccatgtctatcggggctagatctcaaagtgctaggacttacttggagaagaagctcgatgaattatcttcagcctctttggaagagttgattaaacatggtttgagggctttgagggatactttacctccagaggtagacctaaccaccaaaaacgtctcaataggctatgtaggcaaaggtcaaaacttcaagatcttagaagaggaagaaactgctccctacctctcgctcattgaaggtgaagaacgtcgcggcggtggaggcggaggcatcgctgacgctcctgcagatccgttgagagagggggaagcgggggacgacggtcccagagacccaatcccagcggtcgccatggatacgacggagtaa

SEQ ID NO: 1053 - DNA, 2568 bp, Psylliodes chrysocephala
atgggtttaaagcctggagatgaatcggaaccaatggaaattacttttaatgatgatgacctaccctatgaagaagaaattttgcgaaatccatattccgtgaaacattggttgcggtatatagatcataaaaaatcggccccgaataacggagttaacattatttttgaaagagctttaaaacagttaccaggatcttataaactgtggtacaactacttacgaaccagaagaaaccaaatcaaaagcaaatgtataacggatccgggttatgaagaagtcaataacgctttcgaacgatctttagtgtttatgcataaaatgcctaggatatggatggattattgcacatttttgacggatcagtgtaaaattaccagaactagaaaagtattcgaccgagctcttagagctttacctgttacgcagcacaatagaatttggcctttgtatttgaaattcgtacagaaacatgatattcaagaaacggctgtaagagtgtttcgaagatatatgaaattgtgcccagaaaacgcagaggaatacatagactacctatcaaatatagaaagattagacgaagctgcaatgctcatggcaaaaatagtcaacgacgaaaatttcgtttcgcaacaaggaaaatccaaacatcagctgtggaacgagctttgcgaactcatctctaaaaaccccgagaaagttcattctttaaacgtcgatgcgatcatcaggggcggcttaaggcgatatactgatcagttaggtcatttgtggaattctttggctaattattacgtgagaagcggtttattcgagagggctagagatatatatgaagaggcgattcagactgtcacgaccgttagagatttcactcaggtttttgacgcttacgctcaattcgaggagcttagtttaagtaaacgtatggaggaagtggcgacgaagcaaaatccgtcagaagacgatgatacggaactggaattgagactggccagattcgaatatctgatggagcgcagattgttgcttttgaattcggttttgttgcgccagaatcctcataacgtacaggaatggcacaaacgagtacaactttatgaaggcaaaccgcacgaaataattaacacgtacactgaagccgtccaaactgtggaaccgaaattggccgtgggcaaattgcacacgctttgggtggatttcgccaaattttacgaaaccaacgggcaaatcgaggaggctcgactcattttcgaaaaggcctcgcaagtgtcgtacgtcaaggtcgacgatttggccaccgtgtggtgcgaatggacggaaatggagatcagaaacgagaattacgacgaagcgctgaggctaatgcagagggcaacggtaatgcccagtcgcaaagtggcatatcacgacgattcagaaacggtccaaagtcgtttgtacaaatccctaaaagtttggtcaatgtacgccgatttggaagaaagtttcggcacgttcaaatcctgcaaagccatctacgacaggatcatcgaattaaaaatcgccacgccacaaataatcatcaattacggcgtctttttggaggaaaacaactatttcgaggaggctttcagggcatacgaaaaaggtatatcgttgttcaaatggccgaacgtgtacgatatttggaacacttacttaacgaagtttttgaaacgatacggtggtacgaaactggaacgagctcgggatttgttcgaacagtgtttagatgggtgtccgccgcaatttgctaaacatctgtacttgctgtacgccaaattagaagaggaacacggaatggcccggcacgccatggctgtttacgaaagatctacaacagcggttccggaaaacgagatgttcgatattttcaacatttatatcaaaagagccgccgaaatttacggtatacctaagacgcgacaaatttatgaaaaggccatcgaagtactgccggaggataaaacaagagaaatgtgccttcgattcgccgatatggaaaccaaattgggcgaaatcgatagagcgcgagcgatatacgctcattgcagtcaaatttgcgatccgcgaataacggcggagttttggcagatctggaaagaattcgaggtgaggcacggcaacgaggataccatgcgagaaatgttgaggatcaagcgcagcgtccaagctgtctacaatacacaggtgaacatgatgtcggcacaaatgttgagctccgcgggcagcatgagcggcaccattgccgatttagcgcccggtgtaaaagacggtatgcgattgttagaggccaaagctgcagaaatggcggggattccgcagagctcgaccaaacccgggaatattatgttcgtcagaggggaaacccagggcgctaataaggatagagtcgttaatcccgatgaaattgatatcggaagcgatgatgacgatgatgaggaggaagaggatgatatacaggtcgaaaagcagaacgtgccgtcggaagtgttcggcagtttgaagaagaatcagcagggaaatgatgaggatgatgaagattga

SEQ ID NO: 1054 - DNA, 1155 bp, Psylliodes chrysocephala
atggctaacggacccatagctgagcgaaacagagatgcaacaatatatgttggtggtctagacgataaagtctcagaatctttattatgggagctctttgtccaagcagggcctttagtaaatgtacatatgcccaaggatcgtgtaaccatgatgcaccagggttacggctttgtagaattcatgggcgaagaagatgcggattacgctataaaaataatgaacatgataaagttatatggaaagccaataagggttaataaggcatctgcacatcaaaaaaatttagatgtgggagctaatatcttcataggaaatttagaccctgaagtagatgaaaagttgctatatgatacattttcagcctttggggtaatattgcagacaccaaagataatgagagatcctgagactggcaactccaaagggtttgctttcataaactttgcaagttttgaagcatctgatgcttcaattgaggccatgaatggtcagtatctctgtaacagaccaatttctgtatcatatgcatttaagaaagactcaaaaggtgaaagacatggatctgcagcagaacgtcttctagcagcacaaaatccattgtctcaagctgacagacctcatcaattgtttgccgatgcaccacccataggaatgatgccaatgaccatagcacctccaccaccacctttaatcacaggaatgatgccacctcctccacctactcctggaggcatgccaccacctcctcccccagttccaccaccaaattctttcccatccggaatacctccacctcctttaccaccttctcaaccgccacttccacccggagctccgcccaacctcgccgcaacaggcggatccgggccaagaccccctatgcctggaggcatgcctcgcatgcctccgccacctccatggacgggaggaccttctggaaatgtacctatgcctccagggccacctacttcagctgcatctggaggatttggcgggatgtttccacctccaccgcctcctggaggaaggccacctccgcctaattggaggccgccccctcctccacctcctggttttggtggggtgcgaccaccattcccacctagaggaccgcctccaccaccattcccacctagaggaccgcctccacca

SEQ ID NO: 1055 - DNA, 774 bp, Psylliodes chrysocephala
atgggtcgtgtaattcgggcacaacgtaaaggtgcgggatccgtattcaaatcccatacaaaaaggaggaaaggagcaccaaaactgcgttatttagatttctcagaacgacatggttacatcaagggggtagttaaagatatccttcatgacccaggtcgcggtgccccgttggctgttgtacatttcagagacccttacaagttccaaactagaaaggagctgttcattgctcccgaaggaatgtacacaggacaatttttatactgtggaaagaaagctaacctccaaattggaaatgtactacctgtaggaactatgcctgaaggtaccattgtgtgtaatttggaagaaaaaactggtgaccgtggtcgattggcccgtgcatcaggcaactatgcaacagtaattgcacacaaccatgatacaagaaaaactagggttaagttgccatcaggagccaagaaggtcattccatccaacaacagggctatggttggtatcgttgctggaggcggtcgtatcgacaaacccatattgaaagccggtcgtgcttaccacaaatacaaggtgaagcgtaactgctggcccaaggttcgtggtgttgctatgaaccccgtcgagcatcctcacggaggtggtaaccatcaacacatcggtaaggcttctactgtcaagagaggaacgtcggccggtcgtaaagtcggtctcatcgccgcccgcaggacaggtcgtatcaggggaggcaaagtcgatgccaagaaagaggattag

SEQ ID NO: 1056 - DNA, 411 bp, Psylliodes chrysocephala
atggctcgtaccaagcaaacggctcgtaaatctacaggaggtaaagcacctcgaaaacaattggccactaaggcggctcgtaagagcgcaccggctaccggtggtgttaaaaaaccacatcgttacaggcctggtacggtggctcttcgagaaattcgtcgttaccaaaagagtaccgaattgttgattagaaaattacctttccaacggttagtacgtgaaattgcccaagattttaaaactgatttaagatttcagagttctgcagtgatggcgcttcaagaagccagcgaagcctacttggtaggtttattcgaagacactaacttgtgtgccattcacgccaaacgagtaacaattatgcccaaagatatacaattggcaagaagaattcgtggagaacgcgcctaa

SEQ ID NO: 1057 - DNA, 1602 bp, Psylliodes chrysocephala
atggctattagtttattgaatccaaaagccgaggttgctagggctgcccaagctttagctgttaatattactgcggcaaaagggatttcagatgttatgaaatcgaacttgggtcctaagggtacaatgaaaatgttggtctctggtgccggtgacatcaaaattaccaaagatggaaatgtactcttacatgaaatgcagattcaacatcctactgcatctttaatcgcccgtgcttctactgcccaagatgatatgactggtgatgggactacatctacagttttagttataggagagcttctcaaacaagcagatatatacatagccgaaggtctgcacccaagaatacttactgaaggattcgacaaagccagagtaaaagctttagaagttctggagaaaataaagattcccgtggagattaataaggaaatattaactgatgtttgtaagacaagtttgagaactaagttgcatcaaaatttggctgatctcctcacagatgtttgtgtggatgcagttttggctatcagacagcctgacaaacccgttgatctacacatgattgaactgatggaaatgcaacataagacagaaacagatacccaattggttaaaggtttggtcctcgatcacggttctcgtcaccccgatatgccgaaaagtctgaagaattgttacatactgacgtgcaacgttagcatggaatacgaaaaaagcgaagtcaattcgggtttcttctacaaaaccgcagaagagagagaaaagttggtttcggccgaacgagaatttatcgaacaaagggttaagaaagttgtcgaattgaagaaatctctttgcaacggtacagataagacgttcgttgtcattaatcaaaaaggcattgaccccatgagcttggacatgctcgccaaggaaggaataatcgctcttagaagagctaaaagacgtaacatggggcgcttggctttggcgtgcggcggtatagccatgaacagtttcgatgatttacaggaatctcatctcggacgtgccggacacgtttatgaacacgttttgggcgagaacaactacacgttcgtcgaggattgcaaagtgccccagtcggttactattttgatgaaaggacccaacaagcacacactgctgcagatcaaggacgccgttagggacggattgagtgccatcaacaatactatcgaagataaagcggttattccaggtggtggtgccttcgaagtgactgccaacaaggaactgttggcctacaaagacgagatcaaaggcaaagctcgtctgggcgtggcagcttatgccgaagctcttttggtgattccaaaaacgttggctgttaattccggtttcgatgcacaggacaccatcgttaagctccaggaagaggcacgtttgaatccggaaccgatcggtttggatttaacgtccggggaacccatcaaccccaaagattctggcatttatgacaactacgtggtcaagaagcaaattatgaattcgtgttcgatcatagccagcaacctgttactcgtcgacgagattatgagggcgggaatgagtagcttgaagtgttcatttatttaa

SEQ ID NO: 1058 - DNA, 3126 bp, Psylliodes chrysocephala
atgtctagtgctggaatcgcagacagctccatcgatccaccagcaaaaaagcggaagcttgactcgaaactagctacccccgaaatggcgaattgtgaagcatcaggatcctccaatgtcggagacatcgacgagggattgtactccagacagctgtacgtattgggacacgatgctatgcgccgcatggccaacagtgatgtactcgtatcaggattaggaggtttgggtgtcgaagtagctaaaaatgtgatcctcggtggtgtcaaatcagtgactctgcatgacgatgctctttgcaccgtgcaggatttatcgtcccaattttatctaacggaatccgatgtaggcaaaaaccgcgctgaagcttgctgcaagcagctttcagaacttaacacttacgtcccgaccaaagcttacacggggcccttagatgagaaaatcataaagaaattcagggttgtggttttaactacgagtactcgtgccgaacagatacgtatcagcgaaataactcacgctaatgatattgctttaatcatcgctgatacgaaaggtctttttgctcaggttttctgcgattttggtaaatctttctccgtggtggacgtaaacggtgaaacaccggtatctacgatgatagcagacatctccagtgataaagacagcgttgtaacttgcatagacgacacgagacacggtatggaagaaggagactatgtaactttctctgaaatacaaggtatgactgaattaaaccactgtaaaccaataaaaatcaaagtattaggcccttacacgttcagcattggtgataccactaatttcacaaaatacgtacgtggcggtatcgtttctcaagtcaagatgccgaaagaattgaatttcaaacctttaaaagaatccttacagaatcctgaattcgttataaccgattatgctaagtttgatcaccctgtgcagttacacttggcttatacaactctgcacaagtatgtagaaaagacaggcagattgcctaaaccttggaacaatgatgatgcttctcagttcatcactttagctaaatctttggccgtgaacgggtctacagatgcagaagttaatacagatattttggaagtgttttcgaaagtgtgtgctggggaattgaaccctattaatgctacgatcgggggcatcgtggctcaggaggttatgaaggcttcttctgggaagttccatcccatttatcaatggttgtacttcgatgccattgagtgtttgcctcaagagaaaactgaaattaccgaggaactagcggctcctactggtagcagatatgatggacagattgctgtgtttggaaaggatttccagaaaagattgggcgaactcaagtatttcgtggtcggcgctggagccatcggctgcgaattattgaaaaacttcgctatggtcggtctgggttctagaggcggtcaaataactgtcaccgatatggatctgatcgaaaaatctaatctgaacagacaatttttgtttagacccagcaacgtacagcaatccaagtcggccactgctgccaaggtaataaaaaaaatgaacccagaagtcaacatcatagctcacgagaaccgggtgggccccgaaacagaaaacgtctacaatgacgactttttcgaggctctagacggcgtagccaacgctttagacaacgtcgacgccagaatatacatggacagacggtgcgtctactaccgcaaacccctactggaatccggtacgttaggcaccaaaggtaacacgcaggtcgtggtaccgttcctctccgagtcttacagctcatcccaagatcccccagagaagagcattccgatatgtaccctgaagaacttccccaacgctatagaacacactctacaatgggccagagacaatttcgaaggcttgttcaagcagaacgccgaaaacgcttcgcaatatctcaccgatccggatttcatcgatagaaccctcaaattacccggcgtccaaccgctggaagtattggaatccgtcaaagcggctctggtcgacgaaagaccgaaagatttcgacgattgcctggcctgggctcgattgcactgggaagaacagtacgccaatcagatcaaacagttgctgttcaatttcccgccggatcagttgaccagcaccggccaactgttctggtcggggccaaagagatgtccagagccgttggagttcgacgtctgcactgatttgcatttggattacgtcttggcgacggctaatttgaaggcgcaagtttacggaattcccaccagtagggatagatgtcacgccaagcatgtgctcagcaaagttgatgtgccgaagttcgtgccgaaatcgggcgtcaagatcgccgtgaccgattcacagatggccatgaacggcaacaacgttgatctagatcgcgtgactcaaataagagaggagctgccctcggttgcggagttgagcggattgcgtctgacgcctctcgagttcgagaaggacgacgattccaatttccacatggattttatagtggccgcgtccaacttgagagccgccaattacaagatacccgccgccgataggcacaagtcaaagttgatcgctggcaagataattccggccatagcgaccaccacgtccgtcgtagccggtctggtgtgcctcgagttatataagttggccagaagcactaagagcttgacgccgttcaagaatggcttcgtaaacttggcgttgccgttcttcggtttctcggagccgatcgccgcgcctaagatggactattgcggcaatcagtggacgctgtgggatagattcgaggtacagggcgagatgacgttgagcgagttcttggagtatttcaaggagaagcacggtttggagattacgatgctgtcgcaaggcgtgtgcatgctgtactcatttttcatggccaaagccaaggctcaagaacggttaggcctcacgatgtccgaagtggtcagaagggtgtccaaaaagaagatcgaaccgcacgtcaaagcgctcgtattcgagttgtgctgtaacgacgccgacggcgaagacgtcgaagttccttacgtgaaatacaacttgtgttga

SEQ ID NO: 1059 - DNA, 1305 bp, Psylliodes chrysocephala
atggccgatgctgatgatctattagattacgaagatgaggaaaatccagaacagaccacaactgaaactaccacaacagaggttcaaaagaaaggtgtgaaagggacgtacgtctcaattcacagctcaggttttcgagattttcttttaaaaccagaaatcctcagagctatcgtagattgtggttttgaacacccttctgaagttcagcatgagtgcattcctcaggctgttattggcatggacattctttgccaagcaaaaagtggtatgggtaaaaccgccgtattcgtattagccactctccaacaactagacccgaccgaaaatgccgtctacgtcctcgtcatgtgccatacgcgtgagttggctttccaaattagcaaagaatacgaacgtttcagtaaatacatgctcaacatcaaggtcggtgtatttttcggaggtctgcccattcaaaaagacgaggaagtattaaaagccagctgtccccatattgtcgttggcacgcctggacgtattttggctcttgtcagatctaagaaactcaatctcaagcatttaaagcattttattcttgatgagtgcgataaaatgttggaactattagatatgagacgcgacgtccaagaaatataccgtaacactccgcacggcaaacaagtaatgatgttcagtgcgaccctcagcaaagaaatccggccagtttgcaagaaattcatgcaagatcccatggaagtgtacgttgatgacgaagccaaattgacccttcacggtttacagcagcattatgtaaaactaaaagagaacgaaaagaataaaaagttgtttgagttactagatgtcttggaatttaaccaggtcgttatatttgtaaagtcggtgcaaaggtgtgtagccttagcgcaattgttaacagagcaaaactttccagcaattggaattcacagaggcatggaccagaaagagagattgtctcggtatgagcagtttaaagatttccaaaagagaattttggtagcaaccaatcttttcggacgcggtatggatattgaaagagtaaatattgtattcaactacgatatgcccgaagattcggatacctacctacacagagtagctagagctggtcgattcggtaccaaaggattagccattacgttcgtttctgaagaaggagatgctaaaattcttaacgaagtacaagacagatttgatgtgaatattactgaactacctgatgagatcgatttaagttcatatagtaagtatacaaccatttataaagcgggtgaaaagaactaa

SEQ ID NO: 1060 - DNA, 1473 bp, Psylliodes chrysocephala
atgggagttgttgaaacagatgttgaaatgaaaaacgccgacagtcctggaggattggaagctggagatagcaaaaaagacactgacatgcaaagtgtaatagaaattcgagaacatgcaagacagattgaaaaagccgtaagcagcaaggaaaatcgatttattttaagagttttgcgttgtttgcccaacactagacgaaagcttaatggagtagttctcagaagtcttataaaccaaatatatcctgtagccgagagagacgtcctacttggttttactgaagaggctgcaactgaacttgacactacgcaatctagagctagatcagcttcaaaaactcctgttccagaagttgatgcttatattaacttgttaattttggttcgtttgattgacactaataaactaccagaagcagaacgttgttctcaagcactcatgaataaaattactagtcaaaatcgccgttccatagatcttgtagcagctaagtgctacttttatcactcaagggtttctgaacttactgataaacttgattcaattagaggttttctacattctcgtcttcgtactgctactcttagaaatgattttgaaggacaagctgtacttataaattgcttattgagaaactatttgcattattcattatatgatcaagctgacaagttagtaagtaaatgtgtctttcctgaaacggctagtaataatgaatgggccagatttttgtattatttgggtcgaattaaagctgctagattagaatacagtgtagcccataagcaccttgttcaagccatgagaaaagcacctcagaatgctgcaataggttttagacaaactgttcagaaactaactgttgtagttgaattactattgggagatataccagagagacaaatatttaggcaagccagcatgaggcattcccttgcaccttactttcagttgactcaggcggtaagaatgggaaatttgcagagatttggagaagttttggaaaactttggaccacaatttagacaagaccatacttttactttaattctacgtctccgtcacaatgtcataaagacggctataagatctattggtctgtcttattctagaatttctcctcaagatatagctaaaaaacttggtcttgattcagctgaagatgcagaatttattgtggcaaaagccattcgtgatggggtaattgaggctactctagatcctcaaggtggtttcatgagaagtaaagagagtacagatatttactgtacaaaggaaccacaacttgcttttcatcagagaatatcattttgcttagatttgcataatcaaagtgtgaaagctatgagatatcctccaaaagcctatggaaaggagttagaatctgctgaagaaagaagggaaagggaacaacaagatttagaattagcaaaagaaatggcagaagaagatgatgatggcttcccttaa

SEQ ID NO: 1061 - DNA, 1833 bp, Psylliodes chrysocephala
atgcgaagtaaccatcaagctctccctgtttctaccatcttgaaatccaaaaccgaaatagaagatgaacccaagaaaaaatctagggaagactggcgtaaggcgaaagaattggaagaggctcgtaaagctggtacagcgcctgcagcagtcgatgaagaaggtaaagacatcaaccctcatattccccagtacatttcaacggctccttggtactatggaaccgctgggcccactttaaaacatcagagaccccaagaggacaaacagagggaattttccgggttagatgattggtataagagaggagtagatacatcaaaaatagttacaaaatatagaaaaggtgcttgtgaaaattgtggagcaatgactcatataaagaaggattgtatggatagacctagaaaagtaggtgcgaaattttcaggagcaaatatagcaccggatgagtttactcaaaaaaatttggcattgagttttgatggtaaaagagatagatggagtggatatgatccttcagagcataaagctgtcatagaagagtttcaaatagtagaagaagcgaaacgacaattaaaggcagacaaattaaatgcaaatgaatcatccgaagatgaagaaaaggacgaagataaatatgtagacgaagttgacatgcctggtacaaaagtagacagtaaacaaagaattactgtcagaaatttaagaataagagaagacactgcgaaatatttaagaaatttagaccctgcttcagcttattatgatccaaaaacaagatcaatgagagagaatccgaatcctgaaagagatgaaacatatcatggtgaaaactttgtgcgtttctctggtgacacaacgaatcacgcaagagctcaactatttgcttgggaagctcacgaaaaaggtgtagatgttcatctactagcagagcccactaaattggagttactgcaaaaagaatacgaaaagaaaaaagatgaagttaaatctaatattcagagtacggttttggagaaatatgggggccaggagcatttggaagctccacctaaaagtttattgttagctcagactgaacagtatgtggaatattcaagggctggaagagtcattaaaggagccgaaaaagaagttattctatctaaatatgaagaagatgtttatataaataaccacacttcagtttggggttctcattggagaggaggacagtggggatatcggtgttgccattctttcattaaaaattcgtactgtttgggagaagcaggaaaatccgttaatgtacaacccatagtggaatcgatttccaatgaagaggaaattggaaaacctgttggagatgtgcaagaaaaggaaaagagcaaagaaaaggacgaggaaagtgaagaaagcgattcgagcagttcgtcagaagataattcaaaagtgaaagcgcagaaaaaattaaagaaaaaattgaagaaacagaaaaagaaggaaaggaagcaaaagagaaagggaaaaataaaagaaaaggatgaagaaagtgaagaaagcgattcgagcagttcgtcagatgacgacaattcaaaagcgaaagcccagaaaaaactaaagaaaaaactgaagaaacagaaaaataaagaaagaaagcagaaaagaaaggaaaatgaaaaggaaaagaaaaaatcttccgtgttactggacgatccagaaattattctggatgataggaaaagaccttataacagtatgtttgaggctaagaaacccacagaagatgatatggaggaatattttaaaaagagaagaagagatgaagatcccatgaaccagtttttgtaa

SEQ ID NO: 1062 - DNA, 615 bp, Psylliodes chrysocephala
cgagatcattggcataaacgaagggccaccggaggcaagaggaagcctcttcgcaagaagaggaagttcgaattaggccgtccggcggccaacacgaaactaggaaccagaaggatccattatgttcgtacgaggggaggcaacttgaagtaccgcgccctaagattagacaccggaaacttttcttggggtagcgaaggtactgcccgtcaaacacgtattatcgatgtcgtttacaacgctagtaataacgaattggtccgtaccaagacgttggtaaagaatgctattgttgtcattgacgccaccccgttcaggcaatggtacgaaaatcactacatcttaccattgggacgcaagaagggtgccaaaatgacgcctgaagaggaggagattttcaataaaaagcgtagcaaaaaagtacagaagaagtacgagactaggcaaaaaaccgctaaagtagaacccgcgatcgaagaacagttccacaccggaagattgttggcatgccttgcatctaggcccggacaatgcggcagggccgatggttatgtcctcgaaggaaaggaacttgaattctacatgcgtaaaattaagtctaagaaagctaaataa

SEQ ID NO: 1063 - DNA, 936 bp, Psylliodes chrysocephala
atggatagacttcttcgtctcggcggcggaatgccaggtttgagtcaagcaccgccaccttccgatgcccccgttgtagacacagcggagcaagtatatatttcatctttagctttacttaaaatgttgaaacatggtcgtgctggggtaccaatggaagtaatgggacttatgttaggtgaatttgtggatgactacacagtccgtgtaatagatgtttttgcaatgcctcagactggtactggggtcagtgtagaagcagttgatccagtatttcaagctaaaatgttggatatgttgaggcaaactggtaggccagaaatggtagtgggatggtatcactctcatccaggttttggatgctggttgtcaggagttgatattaacacacaacagagttttgaagcactttctgagagggctgttgcagtggtagtagacccaatacaatcagttaaaggaaaagtcgtcattgatgcatttaggttgatcaatcccaacatgatggttttgggacaagaacctcgccaaacaacatctaatttaggacacctgcagaaaccttcagtgcaagcactgatccatggtttaaatcgccattattattctataagtattaattacaggaaaaacgaacttgagcaaaaaatgctgcttaatctacataaaaagtcctggatggacggtctaactttagctgactattcagagaactgcagtgttaatgaaaaaactgttgctgacatgttggaattagctaagaactacaataaggcattagaagatgaagaaaaaatgacaccagagcaacttgcaataaagaatgtgggtaaacaagatccaaaaaggcatttagaagaaaaagttgacatattaatgactaacaatattgtacaatgtttgggagctatgttagatacggttgtctttaaatga

SEQ ID NO: 1064 - DNA, 1215 bp, Psylliodes chrysocephala
atgacggtaattaataagatggaggtggatggggccctcaaaggtgaaggatttagatcatattatatcaccaaaattgaagagttacagcttattgtagctgaaaaaagtcaaaatcttcgcaggttacaagctcaaaggaatgaacttaatgctaaagttcgtatgcttagagaagaactgatgcttcttcaagaacagggaagctatgttggtgaagttgtaaaacccatggacaagaaaaaagtacttgtcaaagtacaccctgaaggaaaatttgttgttgatatcgataaaaacattgacattaatgatgtcacaccaaattgtagagtagcccttagaaatgaatcatacacattgcataagattttacccaataaggttgacccattagtatcacttatgatggtagaaaaagtacctgattctacatacgaaatggttggaggtttagataaacaaattaaagaaatcaaagaggttattgagctgccagtaaagcatccagagctttttgatgctttgggtattgcccaacccaagggtgtattgttgtatggccctccaggaactggaaaaactctgttggccagagcagtagctcatcatacagaatgtacattcattcgagtatctggttcagaattggttcaaaaattcattggagagggctccagaatggtcagggagctcttcgttatggccagagagcatgcaccttccatcattttcatggacgaaattgattctataggatcttctcgtattgaatctggctctggtggtgattctgaagtccaaagaaccatgttggagttgttaaatcagcttgatggttttgaagcaaccaaaaacattaaagtcatcatggctaccaacagaatagacattcttgatcctgctttgcttagacctggaagaattgacagaaaaattgagttccctccaccgaacgaagaagccagattggacattttgaaaattcattcgagaaaaatgaatctaactagaggtatcaatttaaggaaaatcgctgaattaatgccaggtgctagcggggctgaagttaagggtgtttgcacagaggcgggtatgtacgctttgagggagagaagggttcatgtgacacaagaagattttgaaatggccgttgctaaagttatgcaaaaagattctgaaaagaacatgtctatcaaaaaattgtggaaataa

SEQ ID NO: 1065 - DNA, 666 bp, Psylliodes chrysocephala
atgcctatactttacagtgttatctgtcggggtagtactgtcttagttaaatatgcaacatgcgctggaaattttggtgaagttacagaacaaattatagcaaaaattccgcctcacaatgataaacttacctattctcatggaaactatctttttcactacgttttagaaaatcgtattctgtacatgtgcataacagatgatgaatttgagagaagtcgagcatttttatttctcaatgaaattaaaagacggtttcaagctacttatggagctagtgctgatacagctattgcttatgcaatgaattcagaattttccacaatattggctacagaaatgaaacattattccgaatctcacgatcttgatacaatatccagggtccacagtgaattagatgaattgaagaatattatggttaaaaatattgataatattgcaatgagaggtgaaagactagaacttctggtcaacaaagcagataatctaaataatggatcgatgacatttaggaccacaagtagaaacctagctcgttcgttattttggaaaaacatcaaactctacgttattattggtgtcgtcgtaactgtgattatttatattattatttccatatcttgtggtgggttgctttggcagggatgtttgtcacacaaatag

SEQ ID NO: 1066 - DNA, 729 bp, Psylliodes chrysocephala
atgtttcttacgagaagtgaatacgatagaggagtaaatactttttctccagaagggcgattatttcaagtcgaatatgccattgaagcgattaaactgggatcaaccgctattggaatatgcacaagcgagggtgtcgttttagcagttgaaaaacgtataacttcccctctgatggaacccactactatcgagaagattgtagaagtcgacaaacatattggatgtgctgtttcaggtcttatggcagattcacgtaccatgatcgacagagctagaatagaatgccaaaaccactggttcgtttacaatgaaaatattagcattgaatcatgtgcacagggtgtttcaaatttagcaatccagtttggcgattcagatgatgacggtgctgcaatgtccagaccttttggagtggctattttgtttgctggtattgacgagaaaggacctcagctataccatatggatccatcgggtacttttgttcagtttgatgcaaaagccatcgggtccggttcagaaggagcgcaacagagtctacaagaagtataccatcgcagtatgactttggaggaagcgacgactgcagcgttgaccattctcaagcaggttatggaagaaaaattgaattctgcgaatgtagaagtcatgacaatgactccaaaagactttttccacatgtttactaaggatcaagtggaagaggtaatttctaaattgtcttaa

SEQ ID NO: 1067 - DNA, 1158 bp, Psylliodes chrysocephala
atgacagagtactggttaatttctgccccaggtgacaagacttgtcagcaaacatgggacacaatgaataacttgactagtaaacagaatagcttgtcgacaaattataaatttcagatcccagatttaaaggttggtactctcgatcaactagtcggtctttctgatgacttgggcaaattggatgggttcgtggagcaagttactagaaaggttgctcagtacctcggcgaggtactcgaagatcagagagacaagttgcaggagaacttgatggctaataacaccgatttgccaagttatttaaccagatttcaatgggacatcgccaaatacccgatcaagcaatccctgcgaaacattgccgatataataagtaaacaagttggccaaatcgacgctgatctcaagaccaagtcgtcagcgtacaataatttaaagggaagtcttcagaatttggagaagaaacaaactggaagtttgctaacacgtaacttggcagacctagtcaagaaagaacattttattttagattcggattatttgcagactttgctggtcatcgttccaaagtctcaattcaatgaatggaacgctacttacgaaaaaattacagatatgattgtaccgcgctcgtcagagctcattactcaagatcacgaatacggtctattcaccgtttcgctcttcaaaaaggtcgttgaagaatttaagttgcacgcaagagaaaagaagtttattgtcagagatttcacttataacgaggaggaactggcagctggtaaaaatgaaattaccaaactcgttactgataaaaaaaagcaatttggaccgttggtgaggtggttgaaagtcaacttcagcgaatgcttttgtgcttggatacatgtaaaggcgttaagggtgtttgttgagtccgtattaagatatgggctaccagtcaattttcaagctatcctaatccatccaaataagaagacactgaaacgtttacgagatgtgttaaatcaactctatggtcatctagacagtagcgctgctctttccggacccaatgttgatagcgtagacattccaggcttaggttttggccaatcagaatattacccgtacgtgtactacaaactgaacgtcgatatgatagaatcgaagatctaa

SEQ ID NO: 1068 - DNA, 1677 bp, Psylliodes chrysocephala
atgtcgatattagctagtcctctatcagtagccggttcaagaaccaccggagcctcagttcgtactcaaaatgtcatggcagcatctacaattgccaatgtagtaaaaagctcattgggtccagtaggattagataaaatgttggttgatgatattggagatgtgaccgtaacaaacgatggagccactattctgcgacttttggaagtagagcatcctgctgctagagttttagttgaattagcccagttacaagatgaagaagtcggtgatggcaccacatccgttgtaataatagctgcagaattacttaaaaatgctgatgagcttgttaaacaaaaaattcatcctacttctatcatcagtggttatagattggcttgtaaggaggcttgtcggtatattcaagatcatttaaccataccagtagaggaattggggaaggagtgtattataaatgtcgccaagacatctatgagctcaaaaatcattggagctgatgccgatattttctcacaaatcgtcgttgatgccgctaccgccatcaaagtaacagattcgaagggtaatgccatgtaccccatcaaagctgtcaacgtccttaaagcgcacggtaagagcgctagggagagctttttggttgccggatacgctcttaattgtacagtcgccagccaggccatgcccaagaagatccttaacgccaaaatcgcctgtttagatttttctttgcagaaggctaagatgaagatgggtgtacaagtcttgatcaccgatcccaatcacctggaagggatccgctccagggagctggacatcaccaaggagcgcatccagaagatcctggcgacgggagtgaacgtcatcctatgttccgggggtattgacgatctgtgtctcaagtattttgtagaaaacggcgccatgggggtgcgtagggttaaaaaagctgatttgaaacgtatcgctaaagctacgggcgccgcttttgtcacttcactcagcaacatggaaggggacgaaacattcgatgccaatatggtcggcgaggcagctgaggtcgtacaagaaagaatatccgatgacgaacttatcattattaaaggccccaaagcccgcacagccgcttcaatcatccttcgcggacccaacgacttttactgtgacgaaatggagcgctcagtgcacgacgcactctgcgtcgtcaaacgcgtcctcgaatcaaaaagcgtcgtcgtgggaggcggtagcgtcgaagcggcattgtcaatctatctggagaactttgcaacaacgctcagctccagggagcaacttgccatcgctgaattcgccagaagcttgctggtaattcccaagacgttggccgttaacgctgcccaagacgcgactgatctagtggccaagttgagggcataccagaactccagccagaccaaaaaggaccatgcacatttgaagtacgtcggattggatcttattgaaggtaccgtacgggataacagaaaagctggagtcttggaaccgactatgtcaaagatcaaatctttgaaattcgctactgaagccgcgattaccatcttgagaatcgatgatatgataaaattggatgccgaacagaagggcggtggtaaaagttaccatgacgccatggatagcggagaattatatgattaa

SEQ ID NO: 1069 - DNA, 765 bp, Psylliodes chrysocephala
atgtttaatccattagaaagtgcaccaccttggtggcataacggtccagttccaggtgctttttacaattttccaggcactcaaagaattcctgctgccaacccgataacccatactcaatctcctgtaactacatcaacttctataatagctattacttatgataaaggtgtattaattgctggagatttagtcgcctcttatggatctttagccaggtacagaaattgtcccagggtaattgaagttaatcctaatataatattaggagctggtggagattatgcagattttcagtacgtgaaaagctttattgagcagaaaataattgatgaagactgtttagatgatggtttaaaaatgaaaccaaaatctctgtattgttggcttacaagaatcatgtatcaacgtagaagtaaacttgaccccttctggaataatcttgtagtaggaggactgcaggatggtgtacctttcttgggaaccatagataaacttggcacagcttacacagataaagttatttgtactgggtatggagctcacattgctctccctattcttcgggatgctcttgataagaaaaccaacttgaatctgaatgacgccaaagctcttataaagcggtgcatggaagtgcttttttacagagatgcaagaagttttccaaaatatcagttaggtattattgataaggatgatggcgtgaaaattgagggaccacttacagttgaagaaaattggaatattgcttacatgacgtaa

SEQ ID NO: 1070 - DNA, 2124 bp, Psylliodes chrysocephala
atgttatttgttgtgtcaaaagtaaacaaaatggaattttcaaaagaacccaattttgatatgttaacagctaaggattttacaccagaaaaatacgttaagaaactatctcaaaactatgtgggcggttccgagttacaaaatcttcgcagaaaaattaaatcgctttccgaagaaaccagtagtaacttaaagaaaaatgtttacgaaaattatgtacagttcattgaaaccgcaaaagaaatatcccatttggagagcgaaatgtatcagctttcttacttactttcagaacagaaatctttgcttagtgctctatctactacatcaattttagaagatatgcaaccgattaacattgatagagataataaagtgaatgagaaagatttcgaagaagaaaataaacaaaaattagctgccattttagaaaaagtagagggatgtaaagaattgctagaagttcctggaaggacttttttatatgaaggagatttacttgaaattgatcccacagaaaatacatctttaaagactgttcatgtgtatttatttacagatggttttatgataactaacaggaattctaacagtcgaggtcttatgaagtatgtctatgaaattatgtacgacctaagcagcctagctgtggtgaatgtaagagacttgggaaatgtcaaacatgcctttaaacttctaatttttcctgacactagagtgtttcagtgttcttccaactctaataaaaaagaatggttggataaattcgatcaagctaagaaaacaaggctagctcaggaacagcaaaaacgagaatcaattactgaaaaatccccatctcgctcagcatctattgagtcgcccacttataacccatttgaagaagatatgggtaccattcacccggaatggtttttagatattcctgaagaacttgacgtttgtgtagcccaaagacattttgaagaagccttgtctttattacagaaagccaaagattatataaatcagactgcttcttccagtgagaaacatgatcacgttctcattgatattcaaagaaaggtggaacaaagacagaacagtctaactgaagtgctaatgaaagaactagaagttaatcctgacaaatctctgcaaggtggtttgagagcagcacgtagagctgttaggttgctgaatcaattaggaagggaaactcaatcatgcaacctgtttctgaaattgtgcagtagtatgttgagaactcaatgtaaacgagtaaaacgagaaggttcgaccacaacttatataagacatttatctagtgtagtttttactaatatgtgtcacatgtctgatgagtttttacgagcctttcccgattcgccagcttgtgcttcagcttatgttgtgtgggccagcaatgaactgttacaatttacaacccatttgattaaacaagtttttatgcctcagacttccctggcaactatcacagaatgcataattttggtcagaacacagtgtgaaaggttatacggttatgggatcgacctctgttatcagttagatggcgctttgaggtcgtcgctaatgaaagctttaagagatgctcgagataaacttatcgattctataaaattgcgagccctagatgacaaatggattcccatgaacttacattccaaatcgtctttaggacgttgcatacaagaacacgcccaaatggggttgaatttggaaagctacgtttcaggtgatacttggttgcaattgacagcaagtacattatcgtttacaaaaatgtttctaagcttattgaacgactgtatgaaattaaaaaccacagaattaatgtatactatcgatgaaactctatataacgtctttgaagcacaaataagacataatgaaaatgctctcagaactgaattaaatcaagaacaacgaacatttcttacgaaaaacgccgaatttttgttggtcaatttgatagaagttgcgcaaaagaaatacaaggaaaatgttggttatgaatgccagactctacaaaaattgcgtaaggaatatgttgcactgcagaagggtgtatcgcctacatcaagaagtacaaagaccaaatattcttcagaatttatttaa

SEQ ID NO: 1071 - DNA, 3837 bp, Psylliodes chrysocephala
atgaatgaattagagaagttagaatatctctctttggtttccaaggtttgtacagaattagataatcatctcggaatgaacgataaagatttagctgaattcattatacatctctctgaaaagaacaatactttagaaacattcaagaaggctctcttagaaaatggagcagagttttcagactcatttatttctaacttgctgcgaattattcaacacatgaagccaaaaaaggctgccaacaaagaagaggctctacatattgagaaagaaggactagcgtttaaatttcccggtctggcaatacccaatgaagcccaaaagccattatttttggaagagaaagatgaaaaacctttggaaaaagaaaaagttgaagaagtagatatagtagctgatatgatgaaacagtttgaagccgatgctccttctcaaaagcaaaccaccaccagagacagatctagaagcgcaagtgttgaaagaaaaccaaagaaaagatccagaagcagatctagaacaagaagaaggtctagatcaagggaaggaaactctagaagagataaaactgataagaggcatcgaagtaggtccagagatgaccgtaaaaaacgtagaaaagatagaagtagttccaaaactagagagaggagtggatcaagggatagaagagagtcagggagatctagagatacagataaaagggaaagaaatagatcgagagataggagagatagaagtagatcaagagataggagagatagaagtagatcaagagataggagagatagaagtaagtctagagatacagataaaagggagagaaatagatcaagagataggagagatagaagtagatctagagatagaggaagaagagatgggagtagatctaggactaacagaagggaaagaagttctgagaagaaatttaaaagtgaaaaagataatcctgaatttgaagaagatcctactccaggaaagatttataatggaaaagtgtcgaatatcgttccatttggatgttttgttcagttggaaggcttgaaaagaagatgggagggtctagttcatatttctcaactgagagctgaaggcagagtcacaaatgtttcagaagtagtcgctagagggggcaaagtaaaggtaaaagtattgacaataacaggccaaaaagtttccctttccatgaaagatgtctgccagatgacaggaaaagatttgaacccccactcccatgcacctgacgaaagagaagacaaagacagaaaccctgacagaccgatgaacaatagcacatcagttctaagactgccggtcagcatagatgaaggtgaagaggactctaggaagcgagtaacaagaatttccagcccagaaaggtgggaaatcaaacagatgatctcatctggatgtatagataaaagtgagctgcctgaatttgatgaagaaactggtttgctgcctaaagaggaagatggagaggctgatattgagattgaattggttgaagatgaacctccatttttgcaaggccacggtagagccgtccacgaccttagtccagtgaggatagtcaaaaatcctgatggatctctagcccaagccgccatgatgcaatccgctctcgccaaagaacgcagggaacaaaaaatgattcaaagagaacaagaagtcgattcacaaccatccggtaagaacaaaaattggattgatccacttcccgaagacgaaaccagactgatggcgaggggaataggcctgcaaagccaggatttgcccgagtggaaaaagcacgtcattggtggtaaaaagtcgtctttcggcaaaaaaaccaatctgacgataatcgaacagcgccagtctcttcctatctacaagctcaaagaagaattacgaaaagccgttacggacaatcaaattttgatcgtgatcggcgaaacgggttctggtaagacgacgcagatcactcagtatttggctgaagccggtttcacagccaggggaaaaataggatgtactcagccaagaagagtggccgccatgtcggtggctaagcgagtagcggaggagtttggatgtagattgggacaggaagtcggatataccatcagattcgaagattgtactagccctgagacgatgatcaagtacatgacagacggtatgttgcttagagaatgccttatggacttagatctcaaaaattactcggtgattatgttggacgaggctcacgaacgtaccatccacaccgacgtcctattcggtcttctgaaacaagctgtcttgaaacgcgaagaactcaaattgatcgtcacctcggcaacgctggacgccgtcaaattctcgcagtacttcttcaaggcgccgatattcacgatacccggcagaacgtttccggtcgaagttttgtacaccaaagaaccggaaactgattatttggacgccagcttgatcaccgtgatgcagatacacctgagggaaccgcctggcgatattttactgtttttgaccgggcaggaggagatcgatacagcctgcgagattctgtatgaaagaatgaagagtctaggtcccgatgtacctgaactaatcatcctacccgtgtattccgcgttaccatcagaaatgcaaactaggatatttgaaccggcaccgccgggtagccgaaaggtcgttatagctacaaatattgccgaaacgtctctaacaattgacgggatttattatgtcgtcgatccgggattcgtcaaacagaaagtttataattccaaaaccggaatggattcgctcgtagttacacccatttcgcaggcgcaagcgaaacaacgcgcaggccgtgcaggtagaaccggtcctggaaaatgctacaggctgtacaccgaaagggcgtaccgcgacgaaatgttgccgacgccggtgcccgaaatccaacgtacaaatttagcgacgacggtgctccagctgaaaactatgggcataaacgatctgcttcatttcgatttcatggatgctccgcctgtagaatctctaataatggcgctggaacagttgcattcgttatcggccctagacgatgaaggactgttgactagattgggtagaaggatggcggaattcccgctggaacccaatctatcaaagatgctcataatgtcggtggcgcttcaatgttccgacgaaattttgaccatagtgagcatgttgtccgttcaaaacgtattctaccggccgaaagacaagcaagcgctggccgatcaaaagaaggcgaaattcaatcaaccggaaggcgatcatttaacgctgttggcggtttacaacagttggaagaacaacaaattttcgaacgcttggtgttacgaaaatttcgtacaaatcagaacgttgaagagggcacaggatgtcaggaaacagttgctcggtatcatggacaggcataaattggacgtggtgtctgccgaaagaaataccgtcagggtgcagaaggctatttgttcaggtttctttaggaacgctgggaaaaaggatcctcaggaaggttacaggactttggtggacagtcaagtggtatacattcatccttctagtgctttattcaatcggcaacctgaatgggtgatttaccacgaattggtccagacgacgaaggagtacatgagagaagtgacgactatcgatccgaaatggctggttgagttcgcgcctgcgttcttcaagttctccgatcctacgaagttgagtaaattcaaaaagaatcaacggttggagcctttgtacaacaaatacgaagagcccaacgcgtggaggatatcgagagtcaggaggagaaggaattaa

SEQ ID NO: 1072 - DNA, 1254 bp, Psylliodes chrysocephala
atgacctcaaaaagaaaaaatgaaaaaaatatacttgctaaagttaatttccctctttataccattaaaatgctatcttcaaggcatgtaattgtaggtggaggtggtggatcttcaaagacgggggttgaaaacggttttgaaatatatgaaatttttcatgacggacaaaaatttggcgctaaagaagttacaagacatgaaactggtggaaatgtagttatgaactgctgtgtatttaatgacaaaaaaaattcctatttggtagctggtcaagaaagtcactgtcaattatataaagttaacacaaaattagtagaacaagttaaagtggagaacattggaaatgatatacatattaaacaaagaaatacaaatttaaaacctaaagaacaagtagataataataaaaatgttaaaaaagaattatactatactcttaatcctatggacagtgtacagacagattttaatggttctgaaccattatctagagtagttagaattaattatgatggaaaagtattagcaactggaggcactgatggcgatgtaagactgtggaagtttcccagtttacaacccctcttcattctaaaaggccataagaaagaaatagatgatgtagactttagtagacatgacaattatgttatttcaattgctaaagatggtttaggaatattgtgggattgtaaaacgggaaatgaaagatcaaaactgacatggaaacatccagaaggatcaaagtatctgtataaaagatgtaggtttggtgttattgaagaacaaaaaaataaatcagcattatatatgattgctaacgcagtcaatcctaaacacaagtctttccttcaacaatggatacctgaggagaatgacttgaaaaaatattcagaatttgatgaaactcttgcaaccttggcagtgcgagatgatggcagatttgttgcagttggtaccatgtttagtggatctatttctatccatgttgcctttagtttacagaaaatattaactgttgctggtgctcattccatgtttgtgactggtcttgaattcctatcgagtataaatacgaatcattccataagtagcgtagcggaggctgccgtactatcaatttctgtagataatcgattgtgcatacacacagtgccgtacagacggactataccactgtggattggaattatgttattagttcttacattatttcttacttttctgttatgtgcatacctaggtttgtga

SEQ ID NO: 1073 - DNA, 1308 bp, Psylliodes chrysocephala
aaagaatgcatagaatgggcaaaagaagaaagaagaacgctcttgcgccagaggaaagggagaaatgtagctggcgcagggctattcgaaagagctcaatctgtaccttcccaacatgacaagttgttgaaactaaacagagacgatgaagaagatgatgaaaatatcgtcaataaagaacaagatatccttaacctgggtgagaagtacaaaaaggagggcaaggctaaggaactagcggagctcataaaggctactaggccttttttgagtctaattagtaaagcgaaggctgctaaattagttagatcgttagttgactactttttggatctagaagctggtattggtatcgaggtccaactttgtaaagaatgcatagaatgggcaaaagaagaaagaagaacgttcttgcgccaatccctggaagcccgacttattgccctttatttcgatactggaatgtacgccgaagccctacatttagaatccacattgttaaaggaattaaaaaagcttgatgacaaaaatttgttggtggaagttcagcttctcgaaagcaaaacatatcatgctttgagtaatttaccgaaagcccgagccgctttaacctcggcacgaacaacagccaatgctatatattgccctccaaaaatgcaggctgctttggacttgcaatctggtgtcctacatgcagccgatgagaaagacttcaaaactgcatactcatatttctatgaggcattcgaaggtttcgatagtgtcgagtcccccaaggctctaactgctcttaagtacatgcttctgtccaaaattatgattaacagtcctgaagatgtccagcaaattgttagtggaaaattggctattaaatatgctggacaagatattgatgcaatgaaagcagttgcacaagctgcccacaaaaggtccctcgcagattttcaacttgccgtaaaacaattcaaacacgaactagaagacgatgttattgtaagagcacacttaggtaccctttatgacaatatgttggaacaaaatttatgtaggatcatcgagccgtactctagagtccaagtagattatatagccaaaactattaaacttccagtcttgcaagtagagaaaaaattatcacagatgattttagatgccaagtttcacggaattttggatcagggtgaaggtgtcctgatagtatttgaagaaactcccgtagacaagacctatgaaatggctctggaaacgatacagagcatgagcaaagtagtagatactctttatcaaaaggcgaaaaaattgtcatag

SEQ ID NO: 1074 - DNA, 1755 bp, Psylliodes chrysocephala
atggcatcgcgatcgaaaaaaggatcaacgccgtcggctgtacaacggccggcgagcccgctgagtcccacaagacactccagattgcaggaaaaagccgatctacaaaatttgaatgaccgtctggccgggtacatcgatagagtaagatttttagaaggtgaaaataacaggttgacgagggaaattcaatccacccaagaaaccgtcaccagggaagtttctaacatcaaatctatgtacgatcatgaattgtcggatgctagaaaactcctagacgaaacccatcgtgaaaaagcgcgtttggaaattgatgttaagcgacttttagaagaaaatgatgaactgaaagctgatttaggtaagaggaacaaggagttgcaattagccgaaagttctgttagaatctatgaaactagatgtaacgaatcgcagctcaaagctaatcaggcaattgctgatgctaagaaagctatcgccgatgctaaagaactcgaaaaagaacgggacaagttaaggaaacttcttgaagcaacacgtaaacagttggaacaggaatctttggctagagtagatgtcgagaataaaaatcaaagtcttagggaagaactatccttcaatgatcaggtgcaccagcaagagctgacagaaacccgcacccgccgtcaagtcgaaatcagcgaaatcgatggcagactcgccgaaaagtacgaagccaagctccaagaagccctacaagatctcagggatcaatacgaatctcagatggccaacaatcgccacgaaatcgagttgctctatgagcagaagatcaaaaacttgcaggcggccaacgatagaaaccagaattccgcttccgctgctctcgacgagttgagacaaaccaggacgagaatcgacacgatatcgtcgaggatgcaggatttggagaaccaaaacgccggcctggccgccagagcaagggacttggagaagttgctggagaatgaacgaatgcgtcatgctgaagatctagctctattggaaagagagctccaaagacttagggaagaaacagcaaaccaacttcaagaataccaagatcttatggacatcaaagtatctcttgatttggagattgcggcctatcgcaaacttctggaatccgaagaagcgcgtcttaatattactcccagcggtcttgaagtagcccagcacagtcaacgcagctcctcccagcgccgcactcccatcagggcgggcgctaaaagaaaacgtactctgctagaagagagccaggaatccagcttatcggatttcagcataaacagttcatcgaaaggcgacattgaggtagcagacgtcgatgccgatggacatttcatcaggttacacaacaagagtaaccaggaagttccactcggtggctggcaggtgatcaggcgtgtcggcgaagaggagactgtttttaaattccataggtcgcttaaattggaaggcaacggttacgtgacgatttggagttccgatcaaaataaggaccacgaaccacccagcaatctcgttatgaaaggacaaaaatggattgtcggcgacaacatgaccactctagtattgaacaacagcggagaagaaattgcaatttcagaaagggtaaagaggcagatttcgagcgcgcatttaagacacagagaacgatcggggggctacctttccgaagaactccaccaccagcagggcgacccacagggtgacgaaaagtgtcggctgatgtga

SEQ ID NO: 1075 - DNA, 2412 bp, Psylliodes chrysocephala
atggctgatactaaaagccccgatgatttagctacagcgattctccgtaaaaaggatcgtccaaataggcttttagtagaagaggctgtaaatgatgataactcagttgttgctttatcacaagcgaaaatggacgagttgcagctcttcagaggcgatacagtactgctgaaaggcaaacgtaggaaagaaactgtctgtatagtactatcagatgaaacttgtagcgatgaaaaaattcgcatgaacagaaatgttagaaataatttaagagttagattatctgatgtcgtttcaattcaaccttgcccagatgttaagtatggtaaaagaatccacgttcttcccatagatgatactgttgaagggcttactggaaatttgttcgaagtatacttaaaaccctacttcctggaagcgtacagaccaattcacaaggacgacgtgtttatcgtacgcggcggcatgagagccgttgaatttaaggtagtcgagactgatccggccccttattgtatagtcgctccggatacggtcatccattgcgatggggatccgattaagagagaagaggaggaggaggccctcaacgccgtaggttacgatgacattggagggtgtagaaagcaattggcacaaattaaggagatggtagagttgcctttgaggcatcccagtttgtttaaggctatcggtgtgaaaccaccacgcggtatccttctgtacggtcctccgggtaccggtaaaactctgatagctcgagctgtagccaacgaaacgggagccttcttcttcctgatcaacggtccggaaatcatgagcaaactggccggcgaatccgaaagcaatctccgcaaagccttcgaggaagcggacaaaaactcgccggctatcatattcatcgacgagttggatgcgatcgcgccaaaacgagaaaaaacgcatggagaggtggagcgtcgtatcgtgtcgcaattgttgacgctgatggacggcatgaagaagagttcgcacgtaatcgtgatggcggctactaatagaccgaattcgattgatccggctttacgtcgtttcggtagattcgatagggaaatcgatatcggaattcctgatgctactggtcgattggaggtgttgagaattcacaccaagaatatgaagttagctgacgatgtggatttggaacagattgctgctgaaactcacggtcatgttggtgccgatttggcatcgctgtgctcagaagccgccctacaacaaattagagaaaaaatggacctcatagaccttgaagatgatcaaatcgacgccgaggtcctaaactcgctcgctgtaacaatggagaacttccgttacgccatgaccaagagcagcccgagtgctttgcgcgaaactgtcgtcgaagtaccaaacattacttgggacgatatcggcgggctggccaacgttaaaaaggagttacaggaattggtgcagtaccctgtcgaacatcccgacaagttcctcaagttcggtatgcagccgtctagaggcgtgctgttctatggcccaccgggttgcggtaaaactcttttggccaaggccatagcgaacgagtgccaggccaatttcatatccgtaaagggaccggaattgttgacgatgtggtttggagagtcagaagccaatgtcagagatattttcgataaagctagatctgcggcgccttgtgtgctgttcttcgacgagttggattccatcgctaagagtagaggtgggaacgttggagatgcaggcggtgctgcggatagggtgattaaccaaattttgacggaaatggacggcatgggagccaaaaagaacgtgttcataatcggtgctactaacagaccagatattatcgatcccgcaatattacgtcccggccgtttggatcaactgatctacatcccattgccagatgaaaaatccagggaagcgatcttcaaggcgaacttgaggaaatcgcctgtagctaaagacgtggatctcgtttacattgccaaagttactcacggattctccggtgccgatttgacggagatatgtcagagagcatgcaagctcgccattagacagtgcatcgaagctgaaatcaggagggagcgggagagagcattgactcccaacgtagctatggacttggacgacgacgacccagtcccagaaataactcgggcccacttcgaagaggcgatgcgcttcgccagacgctccgtgtcagataacgacataaggaagtacgaaatgttcgcgcaaacgctacaacagtctcgaggttttggcacaaacttccgcttcccgacggcgcagggcgggccccaggctccgggaggcacgggcggcgaccaggccaacttccaggacgatcctgaagacgacctctatagttag

SEQ ID NO: 1076 - DNA, 825 bp, Psylliodes chrysocephala
atgggtgaccaattcgactgtgcacttgatttgatgaggcgtttgcctcctcaacaaattgaaaagaacttgagtgacttaatagatttagtaccaagtttatgtgaagatctcctttcgtctgtagatcaacctttaaaaattgctaaagacaaggattctgggaaagatttcctcttatgcgattataatagagatggagattcttacaggtcaccttggtctaacacctattatcccccattggaggatggttctatgccatccgaaaggttaagaaaattagaattagatgcaaatcatgcatttgatcaatatagagaaatgtattttgaaggtggtgtatcttcagtttatttttgggacttagaccatggttttgcaggtgtaattctaataaagaaaactggggatggtagtaaaaaaataaaaggatgttgggactccttacatgtagtagaagttcaagaaaaaagttctggaagaaattcacactacaaaatgacttcaactgccatgttgtggctacagaccaacaaacaaggatctggaacaatgaatttgggtggcagtctaaccagacaaattgagcaagatgcagctgtcaacgaaatcaatcctcacatcgccaacattggtcgcatggtagaagatatggaaaacaaaattcggaacacacttaacgaaatttactttagcaaaactaaggatatcgtgaacagcttgaggtcagtccaacctctgacagaaagtcgccagcaacaagcacttaaacaagatttagcggcggccctccagcgtagacaaaacaaatctgagaactga

SEQ ID NO: 1077 - DNA, 4179 bp, Psylliodes chrysocephala
atggaacgtccacctcgtaacgaaccccctgtggaacctgtaaatggggtggtacaaccattagttcatccacctccagatagcccagggcgcgtcacaaaccaactgcaatttttgcagaaaaccgtactaaaggctgtgtggaagcatcagtttgcatggcctttccagcaacctgtcgacgctagaaaactcaacttgcccgactaccacagaataatcaaacaaccaatggacctgggaacaataaagaagcgcttagagaacaactattattggtcgggcaaagagtgcatacaggacttcaacacaatgttcacaaattgttatgtgtacaacaaacctggagaagatgtggttgtaatggcccaaacattggagaaagtgtttttgaccaaagtggctgatatgccaaaggaggaatttgtagtcgaaagtcctatcaaagggacaaaaggaaagaagggccgaggaagttccggcggcccaggtaccccctcgacaccggtggtggcggcggttccgccaccaacaccaacggcaactggtagaggcaggccgcctgctactgtttcatctacaagtgcgactccagttgccactaccacaggatcatcaggtttaccattgggtacccaagctccagctacagtaccaggcagcacagcaacaaccacgatagcacctgcaactaccaataatagctctctggcttcccagcagcttactacttcagttggatccacacacggagctggagctcctttggccaattccttagactctagtggagtgctacctggaaatgtaatacctccggcacaaccagcaaaggtaaaaaaaggcgtgaagagaaaggccgacacaacaactcctgcgaccgcctatgattatccgaccgcattagaatcgaaatctgcgaaaatttcaacgcgcagggaatcaggaaggcaaattaaaaagcccacacgaccagaaattgactgccatgtaccccaacccgcctcgcacaaacctaaagacaaattacctgagtccatcaaagcctgtaatgagatcctaatagaattgttttccaaaaaacattcgagttatgcttggcctttctatcaaccagtagatgcagaactacttggcttgcacgactatcacgacatcataaagagaccaatggactttggtactgtcaaacaaaaaatggacaacagagagtaccgcaccccgcaggattttgcctctgatgttagactgatttttagtaattgttacaagtacaatccttctgaccacgacgtggtcgctatggcacggaagctgcaggatgtgtttgaagttaaatatgcaaaaattcccgatgagccagtgaatcggatagggccaagtgtgaacaatgtacctgtcaaatcggaatctagtagttcagggtctagttcagaatcttctagtgaatctgaagattcggaggaagagagaacaaacaaaaagttaaaactgcttgaaaaagagttaacgatgatgcaagagaaaatgaaaaagttggtagaagagagctcaaagcggaaaaaggagaaaaagaaaaacaaggtgaaaaagaagccgggtggcgtgtccaccgccgcgtcggcgagcacgttacctaacagcagcagtggcctcggtaagccctctgggcacggagccctaaagtcaaacaacaattcgatcgcggacagcgttgacgacagcatcgccagtgttgtgtcaggggcggatctgaagatgtcgggtgtgggatccaatgcctctgtggagtcgcatcatccagcgggtggcgcgcagggtacgggggcgcaacatcccaccaacaagtccctcaacatgcatcacaacatggcggcagctggcgccaacgcttccgcccaggctaaaacacctaagagcaaaggattacgcggaaacaaaccgactgctgcaacaaatgcggcgcctaacaagagggtaaaggcaaacaataaagccggtgctggtaggaagaagaacgcggttcagccgcctccaatgcagtttgattctgaagacgaggacaatgctaaaccgatgtcttatgatgaaaaacgccaactgtcattagatattaacaaattacctggcgacaaactggggagagttgtacatataatccaatcaagagagccatccttgagggattctaacccagatgaaattgaaatagattttgaaacattgaaaccttccactttgagagaattggaaagttatgtcgcatcgtgcctccgtaaaaagccacgtaagccttactacaaaaaagtggcaggcaaatccaaagatgaacaaatagcggaaaaaaagcaggaactagaaaaaagactaattgatgttaatgacaaaattggcaattccaagaaggcgcctaaaaaagatgaatcaaacaaagtggatccaacaggtgccggtggtccctctggtcgcctctcctctagttccagcagctccgactcggatagcagtagcagcagtttatcttcgagttctagtgattccagtgacagcgaagcaggtggtacgacgaataggccgccaaagaagaaggggaataaaaagagtccaaacgtatctgtaggaaataccacaaatacgagtatacagaaaccaccgcaatcaacaacagcagcaccagcaacgacacaagcatctgccatcccaacggttaatgctaatgttactgttacggctaatgctaacgttaatattacgcctaaggcaaagatacctccaccaactacaacaaacaacagtagtactactgttccaccaatcgtgattccaccagcagcaccacaaccggtaccgccaacagttaatgccaatgctaaacaacaacttgttaatgttacttccgcaccgcctctagtgccgcctatcagcatcaaaccaaccgtaatcaatactgttgaaaaattgaccatagttaatcctttacctcctactataacacccacagctgttccgcaacctccgaaatcggtggctttaccaactccttcacctgataaacctaaaattgtatcacctcttggtacttacacagatcctatagagcaaagtttagcaagtttagagcatgatattaagcagaatgatcccatggaaactatagctgtatctactgtgcaaatacctacaactactctgagtaatcctattgtatcccatcctcacttaaaccttaatcctaatgtcacccatcctattttacagcctagttctatcagcatggatttgaaaactccagtgaccatgagtggtttaggggctggaaatatgttacatcatggtatgggcatgccaatggatagtgatattccaagtttaatacctcctcaagctagtatgctgcatgcgcagaataatggttttggcatgaaacatgatttcgacatgtccatgaataataatggaatatcttcgatgggtttaccaatggagatgtcgatatcctcaatgtttgatccgttacctcaacatttaagtaatcagctacttattaaaaacgatccaacacaagatcgcctagatggtttaggcggtcttcttaatgataaaaagaatatacctctaacctccaaatctatgagccaaacctttggatttaagactgacaaaactgatcataatgttaaaaatgccagttcttggtcgagtctagcaaaaggaaagagtccgcaaaataacacacccggtgacagtagtaaacagcaagtaatggatagttttaaggcgttccagaataaggcgaaagaaaaggcagatagggaaaagcagaggttagaaaacttgaaaatgaagagacagcaaagagaacaggccgagagggaaagaatgagagttgaaactgaaagaaggagggaaagagaagaagaagatgctttagaaaaagcgaggaaagctgtagcggagcagcaacagccagtatcaaatcagagggtggaagagttgcgttcgtctcctggagaaggtagtacttcgccgggttctttaagttcgggttcggaaaggatatcggaaagagagaggcagagattgcaggaacaagaacgaagaagaagagaagtgatggcaaataagatagatatgaatatgcaaagtgatttaatggctgctttcgagggttcgttatga

SEQ ID NO: 1078 - DNA, 1212 bp, Psylliodes chrysocephala
atgtctttatccacagctcgccctttagtgagcgtttacaatgagaaatcggaagaagtaaaaggcagcggcgtagctctgcccgctgtcttcaaggccccaatcagaccagatgtcgtcaatttcgttcatcagcaggtctcaatgaaccatcgccagccctacagcgtcagcgacaaagctggtcaccaaacctcggccgagtcctgggggaccggtcgcgccgtggcccgtataccccgtgtacgcggcggcggtacccaccgatcgggccagggagccttcggcaacatgtgtcgcggcggtcgcatgttcgcgcccaccaagccgtggcgccgctggcacagacgcgtcaacgtcaaccagcgtcgctacgcgctggcgtcggccgtcgccgccagcggcgtgcccgccctggtcatgagcaagggccacgtggtcgatcagatacccgagctgccgttggtcgtcagcgataaggtgcaggagatgcgcaagaccaaggaggccgtgcagttcctgaggaggatcaaggcttgggctgacatccaaaaggtttacaagagccagcggttccgtgctggtaaaggaaaaatgcgtaacaggagacgtatccaacgtaaaggacctctaatcgtttactacaaagatcaaggtcttcgtcaagctttccgtaacatccctggcattgatctaatcagtgttcaaaagttgaacttgctgaaactggctcctggtggtcacgtaggtcggtttatcatctggaccgaatccgctttccagcgtttagacaaattgttcggtacatggaagaacccgtcgaccgaaaagaagggttacaatttgccccagcccaagatgtccaacaccgatttgtctaggttgttgaaagctgacgagattagagctgttcttagggctcctcagaagaaggtggtacgtcgtgttcgtcgtctcaatcctttgaccaacactaaggctatgcttaaattgaacccgtatgctgctgtactcaagagggaagccatcttgaagaaccaaaaaaggcagttgcaaagggacgaagctttggctaagaaacgaggaatcactttgactcctgacaacgctgtaatcaggaccaggaaattgcaggaaagacgaagagctcaaattctgaaagataggaagtcgaaacccaagaaggccgcgaaagcgccggccaagcctgcc

SEQ ID NO: 1079 - DNA, 5415 bp, Psylliodes chrysocephala
atggcagattttatcgaatcggaagccgaggtgtccagcgaggaagaagaagtagatcaccgagatcgaaaaaaggctcaaaaacccaaagtagttgatagttctgacgaagatgaagaagatgatgaggaacggcttagagaagaattgaaagatcttattgatgacaatcccattgaagaaagtgatgcagaatctgatgcttctggaggggaaaaaagaaaaaaatcagatgatgaagatattgatgaccgactggaagatgaagattatgatcttcttgaagaaaatttgggagtcaaagttcaaagaaggaaattcaaacgtttacgtcgttttgaagatgaggaaagtgagggtgaagaagaacatgaccctgaacaagacagagaacaaattgccatggatatattctctgatgatgatgatgaacgaagatcggaacgcagtcatagacctgctgccgaacctgaaaatttcggtgtcggcgaagaagaagaggagggcgaatactcagatgctgatgattttatagtagacgacgatggtcgacctatagcagaaaaaaagaagaaaaagaaacctatttttactgacgcagctctgcaggaagctcaagaaactttcggtgtcgatttcgattatgatgaattttccaagtatgaccaggatgagtatgaagatgaggaagatgaagaggaagatgagtatgaggaagacgaagagggagagaaaagaaagcgtcaaaagaaaactgcaagaaagaagccaacgaaaaaatctattttcgaagtgtatgagcctagcgaacttaaaagaggtttcttcacagatcttgataatgaaattcgtaacacggatattcctgaaaggatgcaacttcgagatgttcccattactgcagttcctgatgattctatagagctggaggacgaggctgaatggatatacagacaagcattctgtaaccgaacagtatccaatgttgacgcacatctttcctctgaagccagagagaaaatgaagaaaggcccccaaactgtaggaaaaatcaaaaaggctctagattttatgagaaatcagcaattagaagtacctttcattgctttttatagaaaagaatacgttcagccagagttgaatatcaatgatctctggaaagtttataagtatgatgccaaatggtgccaacttaaaacccggaaagaaaatcttctccagctcttcgaaaagatgaggtcttatcaattagatcaactcttgaaggaccctgatgcccccattcccgaaaatatacgggtcatgaaggatatggatattgaaagacttagaaatgtccaaaatgctgaagagctcaatgatgtgcacaaccatttcattttgtattatgctcacgatctaccagcaatgcatgctgcttggagagttaaagaaagggaacgaaaaaagcacgagaaaagacaagcaagactcagattgattgctgaagctgaagaaggttctgagattccagaagaaccagaagagattgatgatgatgaaccagaggttgaagttttaaaatatgctaacagatctggcagttatgccttatgtactagagcaggattagatcctttggccaagaaatttggtttgtcaccagaacaatttgctgaaaatatgagagacaactaccaaagacatgaagttgatcaggaacatgttgaacctgcggaggtagcaaaagattttatttcacctaagtttgctaatggtgatgaagtcttgcaagctgccaaatatatggttgccttgcaaatagctagagaacccttagtgagaaaatgtgtgagggaagttttttttgaaagagccagaattaacgtttatccaaccaaaaaaggtcaaaaagtaattgacgaatctcacaattgttatagtatgaaatatgtaaaaaataagcctgtaagagatctagcgggcgatcagtttttaaaattgtgccttgctgaagaagaaaaccttcttactattacaattaatgaccacatcgaaggtaacacaactaattcgtatattgacgaagttaaacaactttacataaaagacgagtttagtaaaaacgtacaagactggaatgctttgaggatggaatgtgtggagagagccttaacgaaaagtgttttacctgatttaagaactgaattaaaaaggactttgttgactgaagccaaagaatttgtacttaaagcatgttgtaggaaactttataattggataaagattgcaccttactctatcacgtttcccgatgatgacgaggatgattgggatacgtcaaaaggcgtgagagttatgggtgtggcatatgtaccagaatacacagtttctgcttttgcttgtatagcagctccggatggtgatattactgattatttgagattgcctcacatattaaaaaggaaaaatagttttagaacagaagagaaattattgaaggaagcagatctgcaagccataaaaaactttatctacctgaaaaaacctcatgttataacaattgggggcgaatccagagaagcccttatgatcgccgacgatcttagatcagtaatcaaagaactcgttgaatctgatcaatttcccgttattaaggttgaagttgtcgataacgaattggccaaagtgtatgccaattccaataaaggtcagactgattttagagattatcctgagctcttgagacaggccatttcattagctagaaggatgcaggatccgcttgttgaatattctcagttgtgcaatggtgatgaagaaattttgagtttgagattccatcctttacaggaacaaataggaaaagacgaactcatagaagctttatgcctcgaatttgttaatagaaccaacgaagttggtgttgatatcaatctagctgtgcaacaagctcacaaaagtagccttgtccaattcatttgtggccttggtcctcgtaaaggacaagctttgctcaaagtcctcaagcagaccaatcaaagattggaaaacaggactcaattggttacaacgtgtcacatggggcccaaagtatttattaattgttccggttttataaaaatcgatacaaatagtctgggagatagtacagaggcgtatgtggaaatattggatggatctcgtgtacacccagaaacctacgaatgggcacggaaaatggctgtagatgccttggaatatgatgatgacgaaggtgctaatccagcgggagccttagaggaaatccttgaggcacctgagagattaaaagatctggatcttgatgcatttgctgaagaattagagagacaaggattcggtaataagagcattaccctgtacgacattagggcggaattaaattgcagatacaaagatttgaggcagtccttccattcggcaaatccagaagaattatttgatatgcttaccaaagaaaccccagagactttctatataggaaaattggtcacagcctcagttataggcatcgcaaggaaaaaacctaagcctgaccagttagatcaggctaatcctgtacgtaacgatgaaacgggtctttggcagtgtcctttctgtttgaaaaacgattttcctgaattgtcggatgtgtggaaccattttgatgccggggcgtgtccaggtcaagctactggagtcaaacttagattagacaatggtatattaggttatatttacataaaaaatattagtgataagccggtggcaaatccagaagaaagagtaggtgtcggacaactgattcattgtcgtataataaaaatagatgttgaaaggttcagcgtcgattgtacttcgaaatctagcgatctcttagacaaaaaacatgaatggagacctccaagagatccgcattatgacgtggaacgcgaagacaaagacaatagattggaggccgacaagaaaaaagaaaaacagcgaatgacgtacattaagagggtcatagtgcatcctgctttccataatatttcctatgcggaagcagaaaagtgtatggtcaatatggaccaaggtgaagtcattgtaagaccttctagtaaaggtgctgatcatctgacaattacttggaaagttgcggatggaatttatcaacatattgatatcagggaggaaggaaaagtgaatgctttttcactaggtaaatctttatggataggaaacgaagaatttgaagacttagatgaaataatagccagacacgtcactccgatgtcgtcgcatgctagagatttactctattttagatactacaaagactttgaaggtggtcataaagataaggctgaggaattcctgaaagaagaaaaaaagaaaaactcttcaaaaattcattatgtaattagtgcagctaagaatatcccaggaaaattcctactctcctacttacctagaactaaagttagacacgaatatgtaaccgtcactcctgaaggatttagattcaggcaacagatgtttgactctgttacgtcgctctttaagtggttcaaggagcatttcagggaacctcccccaggtggtctaacccctggcacacctaggttgtcttccggtagaactccttacggaagtggcacaccatcgttcagtatgagcactgaagctatacaaagagttgctcaaaacttgccgagtcacatggtccaagcactgtctgcagcaacaaatcaaactccacactatcctcatactcctggaggttacggtgccaattacattaatacaccatatacacccagtggtcaaacaccgtacatgactccattccaaactccgcatacacaacaaacgccgcgctacggtcaacaaactccatcgcagcacattcccagcactgctcctccaaatttgaacaatcccttccttcacccgggagccgcaacgccttcccaaagaacgccgagttacagaaacatggccagtcaaagtccgatgataccgcaaagtcccgttccgagtccgggatctcaaagctcgtacagcagtcacatgagtcatcatacaagagcaagctatgcagaatcgttgagatttcaacctccagaatcgccgagaaattatacagggggtagtagaggttcgtatcctgatggaagatatggcggaaataatagtgaatctatggattggcagaaggcggccgaagcttgggctgctaggtcaagatcaactcccagaagcgaaggccgtaacactccgaggtctatgggccaaagaactcctcgttacgacatgtccgaaagcgatcgatctagaatgaagagtattagtagcaagagtcccagatccgcgaggtcaactccacgcactaacacttctccgcactctatgtctctaggcgacgccacccctctgtatgacgaaagtatttaa

SEQ ID NO: 1080 - DNA, 2415 bp, Psylliodes chrysocephala
  misc_feature (2218)..(2218): n is a, c, g, or t
atgccagagactaaagacaaagactctgcaacacgttctccagaacgaaagagacgtagatcgaaatctcctgagcgtaaagaaagaaaatcttcaaaaagaaaagatcgcgatggtaaacgttcacaagacgatgactacaatccaaaagactatcctcgatactatggagaggatcggccaaatagtgatagttactggaataaatatcctaggaaggataacacaaaagtcggtcaacgatattatgacccacctgaaaatgataaaacattcgaaaaagaaaagaacgtgcaagaaaaacatgtttcaaacaaggaagagactgttgataaatcagtaattaaaccgagagaaagaaaaactgtagatatgttaacttctcgaacgggaggtgcttatattccaccagcaaaacttcgaatgatgcaggctagtattactgataaatcatcagctgcttaccaacgaattgcttgggaagcacttaagaaatctgtacatggttatattaataagattaacacctctaatatcggtataatagccagggaaatcttacatgaaaatatagttagaggtagaggtttactctgtaagtcaataatacaagctcaagcagcttctccaacctttactaatgtctatgcagctctggttgctgttattaattcaaagtttcctaatataggagagcttttattgaaaaggctggtgctacagtttaaaagaggctacaaacagaacaataaatccatctgtatatctgctacaactttcgtagctcatttggttaaccaaagagtggcccatgagattttggcccttgaaattttaactttattagttgaaacaccaacagatgattctgtagaagtggccatatcttttctaaaagaatgtggacaaaaacttacagaagtttctagtagaggtataactgccatatttgaaatgttgaggaatattttgcatgaaggacaactagaaaagagaatacagtacatgattgaagttatgtttcaaattagaaaggatggatttaaagatcatgcagctgtgacagaagaacttgatttggttgaagaggaagatcagtttactcatcttattatgttggatgatgtgaaggaggccaatgctgaagatatattaaacgttttcaaatttgatgaggattatgaagaaaacgaaggtaaatacaaaacattgagtaaagaaattttgggaagcgatagtgaatcaggatctggctctgaaggatcagatgatgaatcagacgaagagggggaagaggaagtaaaagattctggaactattattgacaacacagaaactaatctaatagctcttagaaggacgatatatttgacaatacaatctagtttagattttgaggagtgtgcacataagctattgaaaatggaattgaagcctggacaggaaattgagttgtgtcatatgttcctggattgctgtgcagaacaaagaacatacgaaaaattctatggactgttagcccaaagattctgtcaaatcaacaaaatatacattgaaccctttcaacaaatatttagagacacatatgcaaccacacacagattagatgctaataggttgagaaatgtgagcaaattttttgcacatttgctgtttacggatgctataaattggcaagttcttgacataatgaaattaaacgaagaagataccaatagttctagtaggatttttatcaaaatcttgtttcaagagttggctgaatatatgggattgggaaaattaaacgcaagactgaaagatgagactcttcaagaacatttttctggtttgtttcctagagacaatcctaaaaacaccagattttccattaacttctttacatccattggtttgggaggcctgacggatgaacttagagaacatttgaaaaatattccaaaaataatggaagcgaagatggcaataggaaaagaagaaagcgaagacagcagtggctcaagtagttccagtggtgaagaaagtagcggggatagcagtgcagaatccagttcagaggaagaggatgaaaaggcgaagaaaaagaaaacgcgtgatactaatgttaaatctctagaatcttcaaaatcacaaagaactgaaagaattaatggagggggatacagagaggacaaagaaaaatatagaaataaggaaaaacaaagatattctgaaaaanaaacgagaaagataaaaatccttcaaaagcagatcgtagtaataaagaagacagaaggaaagattacaatgaaaatagagaaaagacaaaaaaatattatgaagtggacaaagataaaaggaaaagggatggagataaaacggaaagaaaaaacaaagactatgaatgggttaaaagtagatatgaggataatataa

SEQ ID NO: 1081 - DNA, 1782 bp, Psylliodes chrysocephala
atggcgttgaagaatcaagttggtctaaaaattatgaatgaggtgataaaacacaaaccaactaaaaaaaatggacctgctgttacacagcctcatggtgctgttgaatggcgtatcttggttgtagatcagcttgcaatgcgaatggtttctgcttgttgtaaaatgcatgatatatcagctgagggtattacattggtggaagatattttgaaaaaaagggaaccattgactactatggaagctgtttatttgattacacctagtgaaaaatctgttcatgcccttatgaatgattttgaatctcccaggcctatgtacagaggcgcgcatgtctttttcacagaggcatgtccagatgaactatttaacaaattaagccaccaccctgcagctaaatatataaaatctttaaaagaaatcaacatagctttcataccagcagagtcacaggtattttcactcgattcaccagatacttttcaatgcagttacgatccatcatttgctgctgcaagaaacgcgaatatggaaagaatggcggaacaaatcgccacgctttgcgcgactttaggggaatacccacatgtcagatataggaccgattgggaacgaaatgtggaactggcgcaacttattcaacaaaaattggatgcctacaaagcagatgagcccaccatgggagaaggacccgaaaaagccagatctcagttgttgattttagatcgtggttttgactgcgtttctccattattgcacgagctcactttccaagctatggcctacgacttgcttcccattgaaaatgacgtctacaaatacgaagcatccgcgggcgttcaaaaagaagtcctcctggacgaaaacgacgaactctgggtagaactccgccaccagcatatcgccgtcgtttcccaaagcgttaccaaaaacttgaagaagtttacagattcaaaacgcatgacgcaaagcgacaaacaatcgatgaaggatttgtcgaccatgatcaagaaaatgccccaatatcagaaggagctgtccaaatacgcgacccacctccatttggccgaagactgcatgaaggcttaccaggggtacatcgacaagttgtgcaaagttgaacaggatttggccatgggcaccgacgcagaaggtgaaaaaatcaaagaccacatgcgcaatatcgtccccattcttctagatccaaaaataactaatgaatatgacaaaatgcgcatcattgccttgtacgctatgaccaagaacggaattactgaagaaaatttatcgaaacttgcgactcacgcacagataaaggacaaacaaaccattgccaacctccaactgttgggcgtcaacgtcattaacgatggagggccgagaaagaagcagtacaatgtgccgcgtaaagaaaggatcacagaacagacttatcaaatgtcaagatggacgcctgttattaaagacattatggaagattgtatcgacgataagttggatcaaaagcactacccatacttgagcggccgggcgcagactactggatatcacgcagcgccctctagcgcgcgctatggacagtggcacaaagatagaggccagcaagccgttaagaacgttccgcgcattttggtctttgtggtaggaggcatcagtttctcggaaatacgatgcgcctatgaagtgacaaacgctcagaaaaattgggaagtgatcatcggttcgtcgcacatattgaccccagaaggtttcctaagcgatctggcgacgttagccggctag

SEQ ID NO: 1082 - DNA, 2139 bp, Psylliodes chrysocephala
atgatgcaacaatatatgaaagaattggaacaagagccctttgatgcagaagaatttgtagaaaggttagcttggagaactttagctgaatcaaaaaatgatggagatgaaagtgagattaacccggctctcttatacgaatcgtttgttcaagccataaaagatctcaatttattacatgaaagacagcagaaaaagtgtgaaaaattagaagtagccgttagagaagatgaagcgacattttttcaagaaatatataatttattagaacaaaataagcaagccatggatacatttcaagaactagatggcaaaatcaatcatgttgctacaaaagttcttcatttgggtgatcaattggatagtgtcaatggtcccagatctagagttgttgatgctttaaaaataatgtctcatttaagtgaatttttatcaaacgaacctgtctcctcagctatttttacgaattgcgaatttatcgatgaagctgcagatatgattcagaagttgtatttgatatctcaagatttacctccaaaatttgaagctacaaaacggaaaatagaacgaaaatattctgatattgaaaaagccctcatagaagaatttgtagttgctatggacaatgaaaatttaacaagaatgaaagagatagctacagttctttcacagttcaagggatactctcaatgtgttgatgcttatatagatcacagtcaaatgggctgtttgtccagcaaagacgtttttattagttttctgaatctgtgtaaatacaacaatgaaattatccagaaagtttttaataatccagaacaagttatggctaaatttgtattaaacatatatcaattaaaattggtggaatacattgatgacaaactgaattctaaattaggaacttataattacttacagacattatatgaattgtattcaaagactaatcagttatcaaatgatttaagtgtgtttaatatgggaaatgataaaaattatttgagaaagttaacaactaatatttttaataaatatataaatgactatattacaatggaactcaaatgcctgaaagacagatgttcggcaaatttacaaaagtactatgagtcaaaaaatcatcaaaagaagcagattcaatctggcggtttccaagaccttagaagagatttacaagcagtgataggtacaagagcaaatattaatatagcccaaatagaaaattatggtggcgaaactttcttgtctgaggaattggctataacaattttccaagacactaaacaggcttttcaacgttgtcagttgttatcgaaaaacaatgacagagcatcaaatgcaactcaaatcttagacagactgataaatagtttacttatagagcatgtcgattatgccgtagaactaggtttgcaagctgtacctgttggggaaggatccaaaaatcctcctgtattatacttttttagtgtggtacaccaaagcaataatattacacatcttcttgaaaaacaattcatggatttagtggttccattagttgagaatacgccaaaatataatgactgcttgcaaaagaaaaaatttgttttagaagatattgaaagaaaaattaatacaggattagatagaagtttaaatgccatatctaattgggtcaaattatatctccagtcagaacaaaaaaaatccgattttaaaccggaatctgatgattttgatacagttgcttcttccgcctgcaaaaatgtacttaactatgtgaacagtattataaaagaaattaaagcaaacttagatggtaataacgttacggcgattctccaagaactaggcgttcgattacatagagtagtttacgaacatatgctacaatttcagtataatacagcaggtgccatggtggctatttgcgatttaaatgaatatagatcgtgtacaaaattactaggtcctttagttatggaactgtttgatactctacatgctttgtgcaatcttttactagtcaaacctgaaaaccttcagcaagtatgttcagaggattcgttggccaagttggaccgaacaattcttcacaactttatccagctgagaagcgattttaaagttcaaaaacagacaattctcaaagtctag

SEQ ID NO: 1083 - DNA, 813 bp, Psylliodes chrysocephala
atggattttcaaaatagacctggtggaaaaaccggaggaggtggtgttgcttcctggtccgaaacaaaccgggaccgaagagaacggttaagacaactcgctttagaaaccatcgatttacaaaaagatccctattttatgaaaaaccacttaggttcttatgaatgcaagctttgtttaaccttacacaacaacgaaggtagttatttagctcatacgcaaggaaaaaagcatcaagctaatttagctagacgagcggccaaagaagctaaagacgcaccctccctattgcaaccagagaagcctcgagtcgaacctaagaaattcgtgaaaatcggtagacctggttatagagttacgaagcagagggacccagaaaatggccaccagagtttactgtttcaaattgattatccagaaatcagtgatgtagtccttcctcgacatcgctttatgtcagcttatgaacaaaaaatagaacctccagaccgcaaatggcagtaccttttgtttgcagctgagccatatgaaaccattgcctttaaagtaccatcaagggaagtggaaaaaactgacaataagttttggactcattggaataaggatacaaagcagtttttcctgcagtttgcgttcaaaaatgagaacaaacgtactgctaatactgttgtgacaagacatcagttggtcagtggagtgccacctcctccgatgttgccagtgcctccacctcctaggcctcctatgtttaatccaattcctccaccaccacctatgatgagggctgtgatgccggtaccgcctccacgttaa

SEQ ID NO: 1084 - DNA, 402 bp, Psylliodes chrysocephala
atgtctattggtgtacctattaaagttctacatgaagccgaaggtcatattgtaacctgtgaaactattaccggcgaagtttacagaggaaaacttatagaagctgaagataatatgaattgccaaatgactcaaattactgtaacttacagagacggaagagtagcacaattagagaatgtttacattagaggatctaaaattaggtttctaatattaccagatatgttgaagaatgctcctatgttcaaaaagcaaactaaagctgggactgcaggtagagggaaatcagcaattcttcgagctcaagctcgggggagaggaaggggtcagcctcctgtgcggggtggcagaggtgcttggcaaaatcagcagggcgctccacaaggcaggggaagataa

SEQ ID NO: 1085 - DNA, 1329 bp, Psylliodes chrysocephala
atggctacaagttttacacggaccccattcttgagagccattacggcaagaggttactctgtatcagctctaccagtttctggtaatccaaacgccgaagtaaaatgtactactcttcctaacaaggtagtagttgctgctgttgataataatgcgagccttacaagagtatcaattgtatttagatcaggatccagaaatgaagaaactgacaacttgggtgtaacgcatgttttgagaactgcagcaggtttaagcactaaaaatgcttcacaatttgccattattcgtaatattcaacaagttggtgctaatttaacagctacttctgatcgtgaaactatttcttatactttagaaggtactaaagaagctgttgaacgagctttgccatttttaacagaagtagccactcaacaagaatttaggccatgggaagtttctgaattatcaaacagactattgttggatattgcaaccaggccacttcagctaagggcagttgatttgctgcacaatgctgctttcagaggtcgtggattaggcaattccctctttattcctaagccacaaattggaaaaatatcttctgaaaccttgcagcactatgttgccagcaattttttgagtggtcgcactgctgttataggatcaggaatcagtgaaagagagttggcacagtatgcaaactccttgaaaattggaaatggtgaaggtaatactagtcccagcccttacaaaggtggcgaacttagatcaaacaaaggtggaccacttgcctttgttgctgtagcaggagaaggaactgctcttaaaaacacccaagaagctcttgcttttgctgtcctacaaagagccataggtgctggaccacaaattaaatattgcacagctgacaatggcatatttagcaaggctattggaagtcctgcagatgttagttctgctgctattaatgtcagctattctgacactggtctatttggtatattactagctgcccctaccaaatctgttggcaaagttgttgaaactgctgtcaaggtgttgaaatctggttgtgtttcagatgaagatgttaacagaggtaaaaatcaactaaagacggctatacttcttgataatgagagtggagcagatattgtaaggaatactggaacacaagctgctttaactcaaagtgtatcatctgcaaagtcccttgtagctgccgtagaatcagttactaccagtgatgttcaaaatgcccttaagaaagctggaagaaacttgtcattagcatctattggaaatctatctggagtaccttacttagatgaattaaaataa

SEQ ID NO: 1086 - DNA, 333 bp, Psylliodes chrysocephala
atgagaagagctcatgctggtaattattatgagcctttaccgcaaaattcgaatgaaattgaagacgaaaatgatcgaatgactaatgaactccaagaaaaaattggggttctaaaatctttgactatagacattggaaatgaagttaaatatcaagataaacttttgagagatgtggacgatgatttagataaaactggaggctttttaggaacaacgatgaataaagtattaaaattatccaaaggtggtcagcattatatcatattgtatttgttcttgttttcaatagttgtgttctttatattgtattttgtcattaaatttaggtaa

SEQ ID NO: 1087 - DNA, 1491 bp, Psylliodes chrysocephala
atgtcttacccttcgacgttaaatgcaaaacaggcatcacgggaacatattatggctgtttccaaagattttgtatctaagcccagactcacttataaaacggtatctggtgtcaatggtccactggtaattctggaagatgtaaagtttccaaaattcaacgaaattgtccaacttagattggctgatggaactttaagatctggtcaagttttggaagtcagtgggaataaagctgtagtacaagtatttgaaggcacctcaggaattgatgccaaaaacacagtatgtgaattcactggtgatattctcagaactccagtatctgaggatatgttgggtagagtgttcaacggatctggaaaaccaattgataaaggtcccccaattttggcagaagattacttagatatccaaggtcaacctatcaacccatggtcacgtatttatcctgaagaaatgatccaaactggtatctccgccatcgacgtaatgaactccattgcccgtggccaaaaaattcccattttctcggccgctggtctgcctcacaacgaaattgctgctcaaatttgtcgacaagccggtcttgtcaaaattcccggcaaatctgtattggatgaccatgaagataactttgctattgtgtttgctgctatgggagttaacatggaaactgctaggtttttcaaacaagatttcgaagaaaatggttccatggaaaatgtatgtctgtttttgaacttggctaatgatcccactattgaaagaattattacaccacgtttggctcttacagcagctgaatttttggcctaccaatgcgaaaaacacgtcctggtcatattgactgatatgtcttcatatgctgaagctttgcgtgaggtatccgccgccagagaagaagtgcccggtcgtcgtggtttcccaggttacatgtacaccgatttggccaccatttacgaacgtgccggtcgtgtcgaaggtcgtaacggttccattacgcagattcccatcttgactatgcctaacgacgatattacccatccaattcccgatttgacaggttatattaccgagggacagatctacgtagaccgtcaattgcacaataggcaaatctatcctccagtcaatgtattgccctctttgtctcgtttgatgaaatccgccattggtgagggtatgaccaggaaagatcactctgacgtttctaaccaactgtatgcctgttacgctatcggtaaggatgtccaagctatgaaagccgtagtaggagaggaagctcttacacctgacgatctcctgtacttggaattcttaacgaaattcgaaaagaacttcatcactcagggtaactacgaaaaccgtaccgttttcgaatcattggacatcggttggcaactactccgtatcttccccaaggaaatgttgaaacgtatcccagccagtatattggccgaattctatcccagagactcgcgtcattag

SEQ ID NO: 1088 - DNA, 1176 bp, Psylliodes chrysocephala
atgaatcgtggacaagcaggaccccggatacatgttccagacgagttgcgtgaagtactgctcgaatttactataagttaccttctagagcagcccggagacgtgattaattatgcctcggaatattttacgagattaagagaggtcagaacgacggctataatttttgatcaagcaggcgatgcctcacaagaagaacttttatctccggacgagtctgtcatatcccgggacgaagaaccttccataacccgcttttccggtcgacgcaaatcggtgttcgccgaaacgtacgatcccgaagaagatgacgacgaggacgccaacaaaatcgtctatccgaaatcggacgagcaacgccaaagactgtcgtccgccgtcggcaatattttgctcttcagatcgctggacagcgaacaaatgaacgaagtattggacgccatgttcgagaggatcgtcaagaaggacgaattggtcatacggcaaggagacgacggggataatttttacgttattcaaaatggaacttaccacgttttggtcagcaccgataactcgccggagccgaaacacatccacacctacgaagacagcggcagcttcggcgaattggcgttgctgtacaacatgccgcgcgcggctaccgtaaaggccgtttcggaaggctccctctgggcgatggacagacacacgtttaggcgtatcgttctcaaatcggcgttcaaaaagaggaagatgtacgaaacgttgatagagagcgtaccgatgctcaagactttgcagccgtacgaacgtatgaatcttgccgatgcgcttgttcccagagtgttcaaagacggggacagaatcataaaacagggcgacgcggcggacggaatgtatttcgtggagcaaggccagatcatcatcagcgttttagacgatagcggcaaagaggtggagataaatcgtatcatcaagggcggctactttggcgaactagctctggttacacatcgtccgagggcggcgtcggctttttgcgacggagacgttagatgcgcatttttggacgtggaagccttcgagaggttattaggtccgtgcatggagatcatgaagcgaaacatcaccgattatgaagaacaaatgctcaagatattcggctcaaagcacaacatccgggatatccgatga

SEQ ID NO: 1089 - DNA, 2427 bp, Psylliodes chrysocephala
atgagttacatgcagtctaatcagaatagacctatgtctcaaggttatcatcaaggtcccaacgaccttccaatgcaatcctcaaaggaacaaacattgctatggcagcagaactcttacctaggagattctggtatccagtctggagctgccacacaggttccatccctgactggcaaagaggaagaagagatggatctgtttgacctggatcaaccctatcaaggattcacccaagaacaagtggatgaaatgaataaccagctgaatcatacgagatctcagagagtcagagctgcaatgtttccagaaacattggatgaaggaatagaaatcccttcaacccagtttgatccaaaccatcaaactgctgtccaacgacttgctgaaccaagtcagatgctaaaacatgcagttgttaatttgattaactaccaagatgatgctgatttagctaccagagctatccctgagttgataaaactcttaaatgatgaagaccaagttgtggtgtcccaggctgctatgatggttcaccaactttcaaagaaagaagcctctagacatgctatcatgaacagcccacagatggtagcagctttagttagagccatctcaaattctaatgatttagaaactaccaaaggcgctgttggtaccttgcacaaattatcacaccacaggcaaggtttactagctatattcaagagtggcggaatcccagctcttgttaaattgttaagttctcctgtagagagtgtattgttttatgccattactactctacataatctgttgttgcatcaggatggatcaaaaatggcagtgagacttgctggtggtctccaaaaaatggtagcactgttgcaaaggaacaatgtcaaatttttggctatcgtgactgattgcttgcaaattttggcttatggtaatcaagaaagtaaactgatcattttggcttcacaaggacccatcgaattggtcagaattatgagatcttatgattatgagaagttgctatggaccacttcaagagttttgaaggttttatcagtttgttccagtaataaaccagcaattgtagaagctggtggaatgcaagctcttgctatgcatttgggcaacccaagcaccagactggtgcaaaattgcctttggactctaagaaacttatcagatgctgctactaaggttgatggtctagaaagcttgttgcagtccttggtgcaggtaaatgtactggcttcatctgatgtcaatgttgtaacatgtgcagctggtattctttctaacttgacctgcaataaccaacgtaacaaagtgacagtttgtcaagtaggaggggtcgacgctttggtacgcactatagtcacagctggagatcgtgaagagatcacagaaccggctgtatgtgctttacgtcatttaacatccagacatgttgaatctgaaatggcacagaatgccgtcaggctcaactatgggatacaagtaattgtaaaattattgaatccaccttcacgttggccattagtgaaagcagtgattggacttataaggaatttggctttatgcccagctaatcatgctcctctaagagagcatggtgcaattcaccacttggttcagttactaatgagagctttccaagacacacaaaggcaaagggccagcgttgcgagtggcggcagccaacctccaggaacctatgcggacggagtgcgcatggaggaaatagtagagggcaccgtcggtgctttacacattttggctcgagaatctcacaatcgagccattattcggcaacaaatggttgtaccgatcttcgtgcaactgcttttcaatgatattgaaaatatacagcgtgttgcagctggagtcctatgtgagctcgctgccgataaggaaggggcggaaatgatagagaatgagggagcgactgctccattgacggagttactgcattcgagaaatgaaggggtcgctacatatgcagcggccgttttgtttagaatgagtgaagataaacctcaagattataaaaaacgattgtcaatggagttaaccaactcattgttcagagaggagaacctttggaatcccgacctgggcatggggcctgacttacaggatattttaagtccagatcaggcttatgacaacatgtatgcccaaggtccaccaagcgtccatagtagccatggtggcagaccttatcaacaacaagggtatgaccagatacccatagacatgcagggtttagagatcggctctcacggaggcggaaatggttcgacctatagcgcaatcgacgccatggacgttaccagcggagaccaagatctcaattttgataccattgatcaactccccacccctccccaagataataaccacgccgctgcttggtacgataccgacttgtaa

SEQ ID NO: 1090 - DNA, 804 bp, Psylliodes chrysocephala
atggctcgtaatgctgaaaaagcaatgacaactttagctcgttggagagcagcccaactaggagaagcagataaacataaaaagcgccgaccatatttggcttctgaatgcaaaagcttacacgcctgtgaaaaatggagaatgcaaatcataagggagatagcaaaaaaagtggcacaaatacaaaatgctggtttaggagaattcagaattagggatttaaatgatgaaattaataaattgcttagggaaaagagacattgggaagatcaaatcaaagaactgggaggtccagattatcaaagagttggacctaggatgttggatcatgaaggaaaagaggtgccaggaaatagaggttataaatattttggagctgctaaagaattgccaggtgtaagagagctttttgagcaagaaccaccccctcctcccagaaagagcagagctgaactgatgaaagacatagacgccgattactatgggtacatggacgatgatgacggcattcttattccgctggaagtaaaagctgaaaaaatagctattcaaacttctatcactgaatgggtaaataataaagagaagaatttgggagataatgaggaagtggaagaaaatatttatgctgtagaaggttcggaggatgaagaggaaacagttcaacaaattgacggatcccaacaaagattcgtcgcgcacgtaccggtcccatcgcagcaagacatagaacaagctttactgagacgacgtaaacaagagttgatggaaaagtatggcgtacaagaagatccggtttcctga

SEQ ID NO: 1091 - DNA, 645 bp, Psylliodes chrysocephala
atggctacagaagatatgcccacatttaaatgtgttttggtcggagatggtggtaccggcaaaactactttcgttaaacgtcatatgactggagaatttgaaaaaaaatatgtagccactttgggcgtggaggttcatcccctagtgttccacacaaaccgaggcaaaatccgttttaacgtatgggataccgctggtcaagaaaaattcggaggcctacgagatggatactacattcagggacagtgtgccatcataatgtttgatgtgacttccagagtaacatataaaaatgtaccaaattggcatagagaccttgtaagagtgtgcgaaaacattcctattgttttgtgtggaaacaaagttgacatcaaggatagaaaagttaaagcaaaaagtatcgttttccataggaagaagaatttgcagtattatgacatctctgctaaatcaaattacaatttcgaaaaacccttcttgtggttggcaaggaaactcattggagatcccaacttagatttcgtcgccgctccagctctactgcccccagaagtccagatggatcctcaatggcaacaacaaatcgaaaaggatctcaaagaagcatcagaaactgctctcccagatgatgacgaagatttgtaa

SEQ ID NO: 1092 - DNA, 2502 bp, Psylliodes chrysocephala
atgccgagaataatgataaaaggtggtgtctggaggaacacagaggatgaaattcttaaagctgccgtaatgaaatatggcaaaaaccaatggtctagaatagcctcattgcttcacagaaagtctgcgaagcaatgtaaagcccgttggtttgaatggttggaccccagtatcaagaaaacggaatggtctagggaggaggatgaaaaattattacatttagccaaactaatgccgactcaatggagaaccatcgcccccattatcggtaggacagcagcgcaatgtctagaacgatatgaatatttgctggatcaagcacaaaagaaagaggaaggtgaagatgcagttgacgatcctaggaagcttaaacctggggaaattgatcccaaccctgaaactaaaccagctaggccagatcctaaggatatggatgaggatgagttagaaatgctgtctgaagctagagctagattagctaacactcaaggcaagaaagccaaacgcaaggcccgcgagaagcagctggaagaagcccgacgtttggcagccttgcaaaaacgtagagaattgagagccgctggtatcgaagtaacatcaagacgcaagaaaaagcggggagtcgattacaacgcggagattccgttcgaaaaacgtccggcgatcggattctatgacacatcgaacgaggctctagacccgatggctccggatttctccaaaatgagacagcaacatttggacggggagctccgaagcgaacaagaagagagggagcgcaaaaaagacaagcagaagttgaagcaaaggaaggagaacgatataccgcaagcgatgcttcaaaaccaggaaccggcgaagaagcggtcgaaattggttttgcctgaaccgcaaatttccgatcaagagatgcatcaggttgtcaaattgggtaaagctagtgaaactgccagagaaatagccacagaaagtggaatagaaactacggatacgcttttgaatgattacatgtttaccccgcaagctgccgccactcctaggactccggcaccccaaactgacaggattctccaagaagcccaaaacatgatggcgctcacccacgttgacacgcccctcaagggcggtctaaacacgcctctacacaactcggacttcagcggagtccttcctcaagcgcaaactatcgctactcccaacacggtactagcgactcccttccgaacgactagaagcgaaggcggagctactccaggcagtaccgcgggtttcatgacgcccaaaagcggagctctcactcccgtcggcaaggccaacatgacgccttcggtacgcgataagctcaacattaatcccgaagagggtttagacgtcggaagcacacccgccgaacacagaatgttccagatgtcgatgaaagaccaactgaagatgggactgagcggtttaccgcaacccaagaacgactacgagatcgtcgtgcccgaaaacgaggaccaagaagaaccggaacaagcacaagcacaattggtggaagatcaggcggacatagacgctaggaaacaggaggaactgaaagctaaggctgcgaaagagctcgcttctcgctcgcaagtgattcagagagaattgccgagaccgcaggatgttaatctgactgtgcttcgtcctccacacgagagttactcactgaccgatcttcaaagggccgaggagttgatcaaatgcgaaatggtcacgatgctgcaatttgacaatctaaaaaatccagttcctaccataaacaaaagaacgaatatgtcgcaggcgcagcaattggcatttttggaacagcatccgtacggttcttaccgaaaggaagatttagaggtagccaaagggatgttgaagaaagagatggattatgtcaagaatggcatgagtcacggggagttgcctttagaagtctacacccaagtatgggaagaatgcctaagccaagttctttatcttccgaatcaaaccagatacactagagcgaatttggccagcaaaaaagatagattagaatccgccgaaaagcgtttggaacagaacagatcccatatggcgaaagaggccaagcgcgcggccaaaatggagaagaaattgaagattttaacaggcggttatcagtcaagagcgcaagttttgatcaaacagctgcaggatatgtatgagaatatcgatcagtctgcattggagttgaacactttcaagttcttgcaagagcaggagaagagcgccttacctagaaggatacagtctctaactgaagacgtgactagacagatggagcgcgagaaggtgcttcaaaagaaatacgcggagttccagattcaaatcaaacaattgcaagaagagtatttgacacagatgcaaagcctaccaaatgacgatgctagcaaaggagaagaggtttcttctacgaccaatgaagagacggcggtggacgaggatgatgcggaaatggatgaagattaa

SEQ ID NO: 1093 - DNA, 576 bp, Psylliodes chrysocephala
atgattaaagctattttagtgttcaataatcatggcaaacctaggctatcaaaattttatcaatactttccagaagatatgcaacaacagattattaaagaaacgtttcagttagtttcaaaaagagatgataacgtatgtaatttcttagaaggtggaagtttaatcggaggcagcgattataaattaatatacagacactacgccacattatactttgtattctgcgtggattcctctgaaagcgaattaggcattttagatctaattcaagtttttgttgaaacattagacaaatgtttcgaaaatgtatgtgaactcgatttgattttccacgtcgataaagttcattacatacttaacgaactcgttatgggtgggatggtattagaaacgaatatgaccgaaattttaacaaggatagaggatcaaaataaaatggaaaaacaagaagccggtatagctgcagctccagctcgagcggtttcagctgtaaaaaatatgaacattcctcaacagataaaggacattaagcttccagatataccgcaagctattaaagatttgaaattctga

SEQ ID NO: 1094 - DNA, 954 bp, Psylliodes chrysocephala
atgagttctgattctgaattaagcgacagtgatgtcgaacttcaagaagctctactggaaggaagattaaagcctgggttaaataaagtagagaaggtgccaaaaaaattcataaataatgtaagtggtcttaaacaaaaagttgaagaattaaaacttaatctgccttggattgaaagacttgactgtacaagttcacaagccccattagcaccagaattcgcagctcaaatgttaattcatgaagaaaaaaggagtaaccaattgaaaaataataagaaacttccccaatttagtccatctgaagacccagtacttaacgattttaaaagagaaattatgtttcaaaggcaggcacaggctacgattctagaagctatacctaaactaaaagcaatgggaatttctacgaaacgaccagatgactactttgcagaaatggcaaaaacagatgcacatatgcataaaattcgagaacaactacagaaaaaacaagaacaacaaaaaagaattgaaagagtaaaacagctaaggcaacaaagaaaagatggaaagatgttacaaattcaaacaaaattacaaaggtctcaagaaaagaaagaaatgcttgcacaggtgaagaaagtccggaaaggcgtgagcaaaaatctcgattttcttgatggtaagaataaaccttccaaaaagattattgaaaaacgcaaaatgaaagataaaaaatttggttttgggggtaaaaaaagaggtatgaagaaaaatactagagaaagcgcaggtgatattagtgaatataagagtccaggaaaaccaggcaagaaatttaaccaaaatcaaccaggacagaaatttaatcaaaatcaagcaagacagaaatttaccaataaaaataaaggaaagagtaacagaatggggaaaaatagacgaatgaaaatgaagacaaaaagcaaaaaataa

SEQ ID NO: 1095 - DNA, 3882 bp, Psylliodes chrysocephala
atgaatgaattagagaagttagaatatctctctttggtttccaaggtttgtacagaattagataatcatctcggaatgaacgataaagatttagctgaattcattatacatctctctgaaaagaacaatactttagaaacattcaagaaggctctcttagaaaatggagcagagttttcagactcatttatttctaacttgctgcgaattattcaacacatgaagccaaaaaaggctgccaacaaagaagaggctctacatattgagaaagaaggactagcgtttaaatttcccggtctggcaatacccaatgaagcccaaaagccattatttttggaagagaaagatgaaaaacctttggaaaaagaaaaagttgaagaagtagatatagtagctgatatgatgaaacagtttgaagccgatgctccttctcaaaagcaaaccaccaccagagacagatctagaagcgcaagtgttgaaagaaaaccaaagaaaagatccagaagcagatctagaacaagaagaaggtctagatcaagggaaggaaactctagaagagataaaactgataagaggcatcgaagtaggtccagagatgaccgtaaaaaacgtagaaaagatagaagtagttccaaaactagagagaggagtggatcaagggatagaagagagtcagggagatctagagatacagataaaagggaaagaaatagatcgagagataggagagatagaagtagatcaagagataggagagatagaagtagatcaagagataggagagatagaagtaagtctagagatacagataaaagggagagaaatagatcaagagataggagagatagaagtagatctagagatagaggaagaagagatgggagtagatctaggactaacagaagggaaagaagttctgagaagaaatttaaaagtgaaaaagataatcctgaatttgaagaagatcctactccaggaaagatttataatggaaaagtgtcgaatatcgttccatttggatgttttgttcagttggaaggcttgaaaagaagatgggagggtctagttcatatttctcaactgagagctgaaggcagagtcacaaatgtttcagaagtagtcgctagagggggcaaagtaaaggtaaaagtattgacaataacaggccaaaaagtttccctttccatgaaagatgtctgccagatgacaggaaaagatttgaacccccactcccatgcacctgacgaaagagaagacaaagacagaaaccctgacagaccaatgaacaatagcacatcagttctaagactgccggtcagcatagacgaaggtgaagaggactctaggaagcgagtaacaagaatttccagcccagaaaggtgggaaatcaaacaaatgatctcatctggatgtatagataaaagtgagctgcctgaatttgatgaagaaaccggtttgttgcctaaagaggaggatggagaggctgatattgagattgaattggttgaagatgaacctccatttttgcaaggccacggtagagccgtccacgaccttagtccagtgaggatagtcaaaaatcctgatggatctctagcccaagccgccatgatgcaatccgctctcgccaaagaacgcagggaacaaaaaatgattcaaagagaacaagaagtcgattcacaaccatccggtaagaacaaaaattggattgatccacttcccgaagacgaaaccagactgatggcgaggggaataggcctgcaaagccaggatttgcccgagtggaaaaagcacgtcattggtggtaaaaagtcgtctttcggcaaaaaaaccaatctgacgataatcgaacagcgccagtctcttcctatctacaagctcaaagaagaattacgaaaagccgttacggacaatcaaattttgatcgtgatcggcgaaacgggttctggtaagacgacgcagatcactcagtatttggctgaagccggtttcacagccaggggaaaaataggatgtactcagccaagaagagtggccgccatgtcggtggctaagcgagtagcggaggagtttggatgtagattgggacaggaagttggatataccatcagattcgaggattgtactagccctgagacgatgatcaagtacatgacagatggtatgttgcttagagaatgtcttatggacttagatctcaaaaattactcggtgattatgttggacgaggctcacgaacgtaccatccacaccgacgtcctattcggtcttctgaaacaagctgtcttgaaacgcgaagaactcaaattgatcgtcacctcggcaacgctggacgccgtcaaattctcgcagtacttcttcaaggcgccgatattcacgatacccggcagaacgtttccggtcgaagttttgtacaccaaagaaccggaaactgattatttggacgccagcttgatcaccgtgatgcagatacacctgagggaaccgcccggcgatattttactgtttttgaccgggcaggaggagatcgatacagcctgcgagattctgtatgaaagaatgaagagtctaggtcccgatgtacctgaactaatcatcctacccgtgtattccgcgttaccatcagaaatgcaaactaggatatttgaaccggcaccgccgggtagccgaaaggtcgttatagctacaaatattgccgaaacgtctctaacaattgacgggatttattatgtcgtcgatccgggattcgtcaaacagaaagtttataattccaaaaccggaatggattcgctcgtagttacacccatttcgcaggcgcaagcgaaacaacgcgcaggccgtgcaggtagaaccggtcctggaaaatgctacaggctgtacaccgaaagggcgtaccgcgacgaaatgttgccgacgccggtgcccgaaatccaacgtacaaatttagcgacgacggtgctccagctgaaaactatgggcataaacgatctgcttcatttcgatttcatggatgctccgcctgtagaatctctaataatggcgctggaacagttgcattcgttatcggccctagacgatgaaggactgttgactagattgggtagaaggatggcggaattcccgctggaacccaatctatcaaagatgctcataatgtcggtggcgcttcaatgttccgacgaaattttgaccatagtgagcatgctgtccgtccaaaacgtattctaccggccgaaagacaaacaagcgctggccgatcaaaagaaggcgaaattcaatcaaccggaaggcgatcatttgacgctgttggcggtgtacaacagttggaagaacaacaaattttcgaacgcttggtgttacgaaaatttcgtacaaatcagaacgttgaagagggcacaggatgtcaggaaacagttgctcggtatcatggacaggcataaattggacgtggtgtctgccgaaagaaataccgtcagggtgcagaaggctatttgttcaggtttctttaggaacgctgggaaaaaggatcctcaggaaggttacaggactttggtggacagtcaagtggtatacattcatccttctagtgctttattcaatcggcaacctgaatgggtgatttaccacgaattggtccagacgacgaaggagtacatgagagaagtgacgactatcgatccgaaatggctggttgagttcgcgcctgcgttcttcaagttctccgatcctacgaagttgagtaaattcaagaaaaatcaacgcttggagccattgtacaacaaatacgaagagcccaatgcgtggaggatatcgagggcacaggatgtcaggaaacagttgctcggtatcatggacaggcataaattggacgtggtgtcggcc

SEQ ID NO: 1096 - DNA, 1317 bp, Psylliodes chrysocephala
atgaatccaggcgccccgaattaccccatggcgtctctgtacgtcggagacttgcattccgatatcacggaggccatgctttttgaaaagttttcatcggctggccccgttctatccattcgcgtctgcagggatttgataacccgcagatctttgggctatgcctacgttaatttccaacaacctgctgacgccgaacgtgccctagacactatgaatttcgacttgatcaaaggcaggcccattcgtatcatgtggtcccaacgcgacccttctctacgaaaatccggagtcggcaacgttttcatcaagaacttggaccgatccatcgacaacaaggccatgtacgacaccttctcggccttcgggaacattctcagctgcaaagtggctcaagacgagagcggagtcagcaagggctacggtttcgtccactttgaaaccgaagaggctgccaataaatccatcgaaaaggtaaatggtatgctgttgaacggcaagaaggtctacgttggtcgattcatcccgcgcaaagaaagggaaaaggaactgggcgaaaaggccaagctcttcacgaacgtttacgtgaagaatttcggagaggacttgtccgaggagcagctgcgaacgatgttcgagaagtacggcaagataaccagctacaaaataatgagcaaggatgacggcaaatccaaagggttcggattcgtcgctttcgagagccccgaggcagccgaatcagctgtcgaggccctaaatggcaaagagttactggaaggcaagcctttgtacgtgggaagagcccagaagaaggccgagcgccaacaggagctgaagcggcgcttcgaagccctgaaaatggaacggctgaaccgctaccaaggcgtaaatctctacgtgaaaaacttggatgacaccatagacgacgaacgcctgcgcaaagaattttccccgttcggcaccatcacctcggccaaggtgatgatggaagaaggccgaagcaagggcttcggcttcgtgtgcttctcctccccggaggaggccaccaaggccgtgaccgagatgaacggccggatcgtcggcacgaaaccgctctacgtcgccctggcccaacgcaaagaggaccgcaaggcccatctgacgtcgcagtacatgcagcgcatggccaacatgcgtatgcaccaaatgggccagttcatccagccgggcggctcgagcggctacttcgtgccgaccattcaagcgacggcgccgcgtttctattgctgctgctggaaatcgtgcagccaacttcaaatacaccgccaacatgcgtaa

SEQ ID NO: 1097 - DNA, 2766 bp, Psylliodes chrysocephala
atgaccgactcaaaatattttacaactactaaaaaaggagagatctttgaattaaaatctgaactcaataatgacaaaaaggaaaagaaaaaggaggctgttaaaaaggttattgcttctatgacagttggaaaagatgtttcagcattgtttcctgatgttgttaattgtatgcagacagataatttggagctcaaaaagttggtttatttatatttgatgaattatgcgaaatctcaacctgacatggctattatggcagtgaatacatttgttaaagattgtgaagatcccaatcctcttattagagcacttgctgttagaaccatgggttgcatcagagtagataaaataactgaatacttgtgtgaacctttaagaaagtgcttgaaagatgaagatccatatgttagaaaaactgcagctgtttgtgtagccaagttatatgatatctcctcaggtttagttgaagatcaaggatttctggaacaactaaaagaattattgagcgattccaatcccatggtagtagcaaatgctgttgcggctttatctgaaataaatgaaagtagtcctactggacagccacttgttgaactaagtactaacaccataaataagctcctaactgctttaaatgaatgcactgaatggggccaagttttcattctggattcgttgtccaattatactccaagagacgaccgtgaggctcaaagtatatgtgaacgaattacgcctcgtcttgctcatgctaatgctgctgtagtcttatcagctgtaaaagttttgatcaaaatgatggaaattttagcaggcgatacagaattttgcaatacactgagcaaaaagttagcgcctcctttggtcactttattgagttcagagcctgaagtacagtatgtagcattgaggaatattaatttgattgtgcaaaagaagcccgatatcctaaagcatgagatgaaagtattttttgtgaaatacaatgatccaatctacgtaaaactagaaaaacttgatataatgatccgtttagcatcccaagtcaacatagctcaagtgcttagtgaacttaaagagtatgctactgaagttgatgtggactttgtaagaaaagctgttagagccatcggtagatgtgcaatcaaagttgaaccttctgcagaaaggtgtgttgccacattattggaccttattcagacaaaagtcaactatgtcgttcaggaagccattgtggtgattaaggatattttcaggaaatatccaaacaaatatgaaagtattatcagtacattatgcgaaaatttggatactcttgatgaaccagaagccagggctagcatggtgtggattataggagagtacgcagagagaatcgataatgctgacgaacttttggatagttttctggaaggttttggcgatgagaatgctcaagtacaacttcaattgttgactgctgtagtgaaattattcttgaaacgacctcaacacactcagggcttagttcagcacgtactaagtttagcaactcaagattctgataatcccgatttgagagacagaggttttatctattggagattattaagtaccgatcccgctgcagctaaggaagtggtgcttgcagacaagcccctcatttccgaagaaactgatctcttagaaccgacccttcttgatgaactgatttgtcacatatcatcactggctagcgtttatcacaaaccacccacagcatttgtagagggtagaagtgctggaatacgaaaaacattgccagctagacaaggttctgcagatgatagtgctagcgctccggagaccactgtcataccgaaccaagaaagtctgattggagatttactttctatggatcttaacgctcctgcaccctccatggcggctccggccgctgcgccaaccagtaatgtcgaccttcttggtggtggattagatgtcttgttgggaggaggaaatgatatcagtggtgttcccaccaccgcagctgcgccgacaaccacaggtctcctgggcgatatcttcggaataccttccgcccctaccatgtacactcctcccaaaattctttggttgcctgctgaaaaaggcaagggattggaaattcaaggtactttctccagaagatctggacagatgtcgatggatatgactttaacaaacaaggccatgcaggcaatgacaggttttgctatccagttcaacaaaaacagcttcggtatcatgccccacgctccatttagcgctcctccattacaaccaggacaaagtctcgaatattctatgcccttgaacaccacaggtccagtgcaacgcatggatccattgaccactcttcaagtggcaattaagaataacgttgacgttttttactacgcctgtcaaattccaattcaagtactattttctgaagatggaacattggataaaagagtattccttaccacttggagggacattcctggagccaacgaggtccagtatactcttaatgacgtaaaaggcaatactgacacagtctccaacaaaatgaccctcaacaacattttcactattgccaaacgtaacgtggaaggccaagatatgctgtatcaatctcttaaattgacaaataatatttgggtcctgcttgaactcaaattgcaaccaggcgttccaacggccactttgagtttgaagtcgaggtccgtagaagttgctccatacgtatttcaagcttatgaatctatcttaaagaattaa

SEQ ID NO: 1098 - DNA, 498 bp, Psylliodes chrysocephala
atgccacctaaattcgatcccacagaagtaaaatacgtttacttaagatgtgtaggaggagaagtgggcgctacttcatctttggcccctaaaattggtccactagggttgtctccaaagaaagttggtgacgatatcgctaaaggaaccgccgactggaaaggtttgaaaataaccgttcaattgaaaatccaaaatcgtcaggctacaatttctgtcgtaccatcagccgcctctcttattattaaggctgtaaaagaaccaccacgtgatagaaagaagcaaaagaacattaaacacagtggcaacattaccttcgatgaaataatcacaattgcaaagcaaatgaggccccggtctatggccaaacaactttctggttgtgtcaaggaagtattgggtaccgcacaatctgtaggttgcaccatcgatggaaaagcacctcatgacgttatagacgacgtcaatgatggttcaatagaagtaccagacgaataa

SEQ ID NO: 1099 - DNA, 1185 bp, Psylliodes chrysocephala
atgataagtatattacatcctattgaaaaggtgagtaggtatatttatacacactactggataacatatttttttataacttctagtaaaaaaatggttgaaggcaaaagagcactgattctcgttggaggatatggtacaagactgagacctctcaccttgagtagaccaaaacctcttgtagaatttgccaataaaccaatcttgttgcatcagattgaagcattagtagatgctggagtcacagaagtaattctagcagtatcatatcgtgccaaacaaatggaagaagaactaaccatagaagctacaaaactaggtgttaacataatctattctcatgagactgagcctctaggtactgcaggaccaatagccttagccaaagagcatctttccaaaagcacaaagccattttttgtacttaattcagatataatctgtgactttccatttagagaactagccaagttccatgaagatcatggtaaagaaggtacaatagtggttacaaaggtcgaagagccttctaaatatggtgtagtggtttatgataaaactaattgtatacaaagctttattgaaaagccccaggaatttatctcgaacaaaataaatgctggcttgtacattctaaaccccagtgtaatcaacagaattgaccttaaaccaacttctattgaaaaggaagttttcccaaatatggcttctgacaaacagttgtatgcatttgaattgaaagggttttggatggacgtgggtcaaccaaaagactttctgacagggatgtgcttgtatttaactcatttaagagaaactaacagccaaaaattgtataaaggccctggtgtggttgggaatgtaatagtagatccaacagcaacaattggaaacaactgtcaaagtggacctaatgttactattggcccaggggttgtaatagaagatggtgtgtgtataaaacgatcaacaattctgagaggtgcaaccatttgttctaattcatggcttgaaagctgcatagtaggatggaagtgccatgtaggtaggtgggtacgaatggaaggcagcacagttctaggcgaagacgtaattgttaaagatgagacctacataaatggaggacaagttttgccccataaaaatatagccacctcagttcctgaaccccaaattattatgtag

SEQ ID NO: 1100 - DNA, 867 bp, Psylliodes chrysocephala
atggcgtcggacggggaagaagtgataagtgaccacgaaaaagtaaaaatagtctcagatttcatcctccattcgcctccaggtgaattcaacgaagtcttcaatgacgtccggaagcttttaaataacgatgacctcctgaaagaaggagtaaccggggcattcgcccagtacaataaagaccaactcaccccagttaggatagaaaatgccgatcacttggtgctgattacagaatacaacgatttaggtaacaacagattcttcgatccccgtagtaaacaaagtttcaaatacgaacatttaagaaaagaggcttccgattaccagccctataccccagattctgctacggagccttggcgggctgccctagatgcggagtttgtccaatacacgaggaaccattacaaggacggcgtttgcagcgtcgtggggcgcaaccaaggtggtgctattacacttacagcttgcatagaagatcaccagtttcaacctaagaatttttggaacggtaggtggaggtctcagtggtctgttagcttaacggatgagtctacggccgaagtaagaggtgtgttgaaggttcaagtccattattatgaagaaggaaatgtccagctggtaagcactaaagaaataaaagaaactattccggtttccaatgaaactcaaacagcaaaagaaatcatccaagtgattgagaatgccgaaaacctgtaccagacggccatctctgagaattatcaaaccatgtctgacaccacattcaaggcgctcaggagactcctgcctgtcaccaggacaaaaatcgattggaacaaaattgtatcttacagtattggcaaagaactaaaaacgcaatga

SEQ ID NO: 1101 - DNA, 3861 bp, Psylliodes chrysocephala
atggggcgatgtgccaaaaacctagcaaaaatgtgcctaaagtactttgttctagttttaatacttagtgttagcatacatgctcaagacaatagtgatagtacggggagcgttgataatactgacaataacggacaagataacacaggtgatgtagaaagtataaatgtcgatacgggggtagttaaagcagttccggatggaactgattcaaaacctataccggttgaggaagggataaatgcaatttcgccaacaaacccgaactatgaagaacccgtagaagttttaacagatattgttagcgatactaacacttcaaagcccaactggacttaccagaaaaaaagtaaaagcgggagatatattacttattacggcgcagattatgatcccatgacatccgacactgcccctcctgatagtgaccaacgaggaggtattccatataccataactgaaacaaggctagcagaaatccgaaaacatttcatgtacccatttttcgacaaaggcggcaatgctgacaatgaaggagattatcagaaagagatccagtcttcgacgcctcaagtccacaagaatttaaacttccaactgccatttttcggttttagatataattacaccagagtttctattaacggttatttggaattcagtgaccctccaccaaattttgattatccattagtttttcctgtcaaagaatggcccaagaaaaatgatccttcatttattggtattttcttcagtaaatgtaagatcggaaaccttcgtgatggtgacattgatcaaagaaaaccaggtgtttacttcagattagaacgagatcttcgagtaagacaagacagaatgggagtagaattacgggaaagattaaagtgggatataagagaaggagtaattggttcccatacatttgatcccaaacatgcaatttttataacctggaagaacatttcgttcaacggaggatacgccaacgctgtatatcaaaccaacacctttcaaatggtccttgccaccgatgaagtcttcacttatgccatttttaactatctcaacttagactggactagtcacactgaagctggaggtgatacaagaaaaggagaaggtggtgtaccagcttacgttggttttaatgctggcaatggaacacgcagttttgaatatttaccatacagtcaagcatctgttattagagatttaacagctactggttggggaaacaacttccagggaagacatattttccgtatagatgagaatatcttactaggttcttgtaataaagatattgacggtgcaaatctacctctacagttcgcacctgagagcggtaacatgctgggaggaaccgttgtgaatataacaggtccctgtttcaatcttaacgacagaattagatgtaaatttgatgtttccgacgaagttgttggacatgtcgttgacagaaatagagctatttgtgtgcagcctctattatactctgaaggatgggttaatctacaaattgctgttaactcagaagctttcaagtggaaaggaaaatattatgttgaatcaccatctagtgcaactcaaaaaattttcttcaaagacatgaaataccatgaaaaatctccgagcgaaattagaatcacttgggaaagacaaaatttgactagtaacgataatgcaaatattcggatttctttatggggttacagagaaactacaatgagaccgacgtttgtttacatcggagaaattgctgaaaatattcaaaacactggagaatacacaatagttccttctcagtacagaacaagggctaatcaatttttgactgatattaagtttggttttctacaaattaatttgactgaatccataaaggtcaatacatacacaacttccaaccaaaatatagatatcactccagtggtttggagtcgaccaattcccttgggttggtacttcggatttcaatgggaaaatttgtatggtagaaattggcccaaatatctctgcgacgaatggttaagaacagacaggtaccttaaaaatttcgctcatgaacttcctcagtgtccttgtacagtacaacaggctttagcagataaaggaagatatatgccagatttcgattgcgataaggattcaaatcccatatgttattacaataatcaagctctacattgtgtcaaaactggatctccaacattggaaggctcagaacaacaatgttgctacgacaaaaacggataccttatgttatcttacgaccaacaatggggatccagtcctcgccgttgtcataatcttggtaaaatgccttataacgaagctacgaaagtcccaactctatcccaatggtttaacgacgtagttcccaaatatctttgctgtttatggcaagaagaacaagcagtaggttgcgaaactttaagatttgaaagaagaccaacgcaagattgtgtggcctatcaagcaccgggcatagctggagtttatggtgacccacatgtcgttactttcgatgacgtagagtatacttttaatggcaaaggagaattttctttggtaaaatcagttactaaattagataatttagaagtacaaggtagatttgaacaaatggaccctaatgcttacggtgaagtcagagctacacagttgacatcaattgttgctaaaggaaacaacactatctctgtggagattagaagaaggcctttggattctaggtggagataccgattggatgtaatagctgataatagaaggttatattttgacaggccttccttgaagttccaacattttcaaggtgtaactatttataccccaacttatatactgaatcagtctgaagtgttgattatgtttgataacggagccggtgttgaagtattagataatcaaggttacatgagtgcaagagtctttttaccatggtcatttataaacaaaacagttggtttatttggaaactggagtttcaacaaagaagatgactttgctttaccagacggcactaaggctgctgtagtaagtaatattaacgatatggaaagagtgtacaatgacttcggttcaaaatggatgttggatgacgtattagatccacaaaaaggacgcgcattgttctatagagagttcggacgaagttcttctacatataataataaaactttcaaaccacagtttttaatgatgccggaagacattatacctgcaaatagatcagttcagattgatagaacataccaaatatgttcaacaaggatgtacgaatgttactatgattatgctatgacgttaaatagagatgtagcgcactttacgcaaaattataaatcaacaatttatcaactaaaggatattgcccgtactaaagtgccatcttgcggagttttggaaacaccaagatttggccggaagagtaccttcttgtttgtgcctggtaccaaagtaacatatgaatgtattcaagattttgtattggtaggagatcagagaagagaatgtactgctgagggtacttggaatacaccggattatggatatacatactgtttacgtcagcaggaatattcgcaaaggcaggcaggaattacatcaggaataataatgatagtccttatacctttaatcctgcttttcgtctacttggcgtataggtttttaaagaaaaaacagaaggaaaaagaagaaactcagcatcaagcgttaatgtaccaagaacaaaaaaggaaagctcaagaagcagctacacgaaaaataactgaagctgaggagtataattctgaagaagacgataataacagtaacctcacaagtacaggagcgaaggaaacaaatatttattaa

SEQ ID NO: 1102 - DNA, 318 bp, Psylliodes chrysocephala
atgcgttacgtggctgcttacttattggccgttttgggcggaaaagcctctccaaatgccgctgatcttgaaaaaattcttggttcagtaggagttgaagccgagggtgaaaaacttaaaaaagtcatcggcgaacgtaatggaatgtgcgttgaagaacttatcactcaaggtcgtgaaaaattgagttccctgcccgttggtggaggtgcacctgcagctgctgttgcttcagctgccccagctgctgccgcagagcagaagaaagaagccaaggtagaagaaaagaaagatgaatcagaatcagaggatgatgat

SEQ ID NO: 1103 - DNA, 2733 bp, Psylliodes chrysocephala
atgatgactgatcgttttggactaaaatgggaccccaaaaatttagaaattagaaccatgtcggtcgaaaaaacactggagccccttgttttgcaagttactactcttgtaaatactaaggggcccagtaaaaagaaaaaggggaaatctaaacgtgccaatgctttggttagtactgtagaaaaagccactgaaaattttattgagaaaggtgaacaaattgcttatgaaaacccagacattacagacgaaatgttagctgctgttgatgaggtgaagaaaacaggtactgctatgagcatagctgccagggagttttctgaagatccttgctcatccttaaaaaggggaaatatggttcgtgcagctagaaaccttttatcagctgtgacacgtctgttaattctcgctgacatggtagatgttcacctcttgctcaagtccttacatgtagttgaagatgatttagaaaaactgaaaaatgcttcaagccacggggaacttcttgacaatattaaagcctttggccaaaatgccaatgaactgatgaaccaggcagctaaaagacaacaggaattgaaagatcctcagctacgtgatgatttggcagctgctagagctgtacttaagaaacattccactatgcttttaactgcttctaaggtttatgtgcgccaccctgaattggcagctgctaaggccaatagggattatgttttaaagcaagtttgtgaggctgtcaatactattaatgatgttgcacagggtagaacacctcaacctgcttctggaccttatgatggtcctggagagcttgcagctgcattagatgatttcgatgatcatatggtaatggaacctcttgcttacaatgaggttcatacaagaccatcactggaagaacgcttggagagcattattagtggtgctgccttaatggcagactcaagttgtaccagagatgaaagacgagaacgtattgtagctgaatgcaatgctgttaggcaagctcttcaagatttactttcagaatacataacaaatattggcaataaagacaaaagtgagagtcttaacagggctattgacaatatgggcagaaagacccgtgacctcagaagacagctcagaaaagccgtagttgatcatgtttctgacagtttcttggaaaccaacgtacctctattggttctaataaaagcagctcaaaacggcaatgaaaaagaagtagaggaatatgcggtcgtctttactgaacattccaataaacttgtagaagtagctaacctcgtctgcagcatgtcaaacaatgaagatggtgtcaaaatggttcgatatgcagctgctcagatagacaatctttgcccggaagtaataaacgcagctagaatcttagctgccagacctcgcagtaaagttgctcaagagaatatggaagcttttaaacaatcttgggaacaccaagtacgaattttgacagaagctgttgatgatatcactactattgatgactttttggctgtttccgagaaccatattcttgaagatgttaataaatgcgtcctagcacttcaagaaggtgaggctgatacattagatcgcactgctagcggaatcaagggtagatctaacagggtatgcaatgttgtaacagccgaaatggataactatgaaccttgcatttataccaaacgtgttctggaagcagttaaagtgctgaacgatcaagtaatgcccaagtttactcaaagagtacaggttgcagtacaagcgcttggtaacagtccaccaaaggaagttgatgaaaatgacttcattgatgcttctagattagtttatgatggagttagagagataagaagagctgtgcttatgaatagggctgatgaggatttagatcctgaagatgtcgaacttgatgaaaattacttgattgaaactagaagtaaatcgagtgcccacactggtgaacatggcgtagatgaatatccggatattagtggcattacaactgctagggaagctatggggaagatgcccgaagaggataaacagaagattttacagcaagtagaattctttagaagtgaaaaactcaaatttgaccgtgaagttgccaaatgggacgatactggaaatgacattatcgttcttgccaaacatatgtgcatgattatgatggaaatgacagattttacaaggggtcgaggtcctctgaaaacaaccatggacgttataaacgccgctaaaaagatttcagaagctggtaccaaattagataaactaactcgccaaattgcagaacaatgcccagaaagttcaactaagaaagatcttcttgcttatctacaacgtattgctctttactgtcatcaaatgaacattacgtctaaggttaaggctgacgtgcagaatattagtggagaacttattgtttcagggcttgatagtgctacatcattgattcaagctgctaagaatttaatgaacgccgtagttcttaccgttaaagcttcatacgttgcttctaccaaatatccacgacaagggactgtagctgtaagtatttctcctattgtcgtgtggaagatgaaggctccagagaagaaacctctagtgagacccgaaaaacccgaggaagtccgtgccaaagtgcgcaaaggttcacaaaagaaagttcaaaatccaatacatgctctatccgaattccaaagtcccacggaatccgtgtaa

SEQ ID NO: 1104 - DNA, 1014 bp, Psylliodes chrysocephala
acaactactactcctcaatttggacttccaacgagcaaaccaggtactacaactttatcttcacttcttggatctgcaccagctgctgttgctgctactacagtttctacaggattaggttttggttctactattggtgcaacaactgcaactcttgctcctactacagtttctacaggattaggttttggttctactattggtgcaacaactgcaactcttgctcctactacagtttctacaacaactgctactcctgctacaggtgcttctctcttcggtagtacgtctacaagtgttgctacaattgctccaggtttgggtttgtcaacagcagcacctacagctttttctacagcagcatccaccgctttaagtactaccacagtagctccaacttattcaactactacacttccatctactggttccttgactttcggtcaattggaagactctataaacaaatggacgatcgatttagaagaacaaggcaaattcttcatcaaccaagcaaagcaacttaatgcatgggactctctgcttattaccaacggagagaagattcttaatttgaatggcagtattgagcgggttaagcaacaacaacagcagttggatcaagaactagatttcgtattggcacaacagaaagaattggaagagctaattacacctttggaaaaggaattgttggaaattcctgtcactgatatagataggaatcaaatgtatcaattctcagaaattattgactctcagttgaaacaaatgtcagatgatttgaaggaaattatcgaaaatattaatgaatctaacaagaatgaagaaatatcaaatcctattacccaaatcagtcgaatactgaatgcccatatgaattctctacaatggttagatagaaatacatcccaaattagctcacatctcgaacaaattagcaagattcaggatacaaatagacgaaattttactcaaaatcattcattcaataataattcatttaatatgtaa

SEQ ID NO: 1105 - DNA, 570 bp, Psylliodes chrysocephala
atgtggattgtgaactggttctacgacgtcctttcgtctcttggcctgctcaacaagcacgccaagcttctgttcctcggtctcgacaatgccggaaagacgaccctcctgcacatgctaaagaacgaccgcgttgccgttttgcagcccacgctccaccctacctctgaggagcttgccattggcaacgtccgcttcaccacattcgatctcggtggccatccccaagcccgccgcatctggagagactacttccccgaggtcaatggtgtcgtgttcctcgtcgacgccaaggacgaggagcgattcgccgaggccaaagccgagctcgacgccctgctcgccatggaggagctcgccaaggtcccctttgtcatcctcggaaacaagatcgatcaccccagcgcggtccccgaggacagacttcgtcacgagctcggcctttaccagacgactggcaagggcaaggtgcctctggagggcatccgcccgatcgaggtattcatgtgctcggtagtcatgcgccagggctacggtgacggcattcgctggctgtcccagtacgtctaa

SEQ ID NO: 1106 - DNA, 564 bp, Psylliodes chrysocephala
atggatcccatcgcagtcctagaaaagcgtatcgaggccctagaattacaagtttttccattaggagaccattctcaaatttcaaataaaacccaaactattaccgacttattgtcggaaactcaaacaatgatcaaatcagccctacattgtcgggaatcgatcacttcaatgttgcaacatttagtaatcattaatgattatttgaaccctgccggcgatgctgacgagttagaagtggaagcaaaacgacaatgtttgcttgaattgtatcctgaattgaaagacactgtacaaaccattagtactctagagtctctgttgccctttattgattctattaacatctctaaagtagtcgaattttctggaaaattggaagaaatagctttaagtaaccttaaactttatggagaatgtcgagatataactaaaaaagtactggtagctctacaaaattataatgatatatctaactctataaaattactattttctcagttggatactgctatatcaaatctggagaatgctttacaacttagagttgttagtgaggaatga

SEQ ID NO: 1107 - DNA, 1752 bp, Psylliodes chrysocephala
atgaataacgcaaaattacaagaagtttacagtgatttaaccttgtacactacccccgataaatttttcctcgagcccaaaactggtgatgaacttatggtgatagagagagcttctgaaaatatagtatgtttcaaaaataatcatagacatttgatccctgcagctaatagcagaaaagatttttgtggtcttattggtatagtacatctactagcatgtccatatctagttgtagctgttcaaagagaattagtgggttatatagcgggttgtgcagtttggagactggttaaagctgaattaattccatttagaagtgcattgcatttacctccagaaaaacaagctgataatgaaatatatttagctatggtagagtctgtattatctacccctttcctatatttttgttatgattatgatcttacacattccttacaacgattacatggaataagtcctgatttctggaaccaatcaatatgggatagagctgatcaaagatttgtttggaatggaaacttattaactccatttaagggcttgtatattcaaaaattttgcttacctttaattcatggttttatttccataaacttctgtgttataaatggccacagtttgaactggtcaattgtatctcgtagaagtgttcagcgtgctggtaccagattacatagaagaggcatagacaaagatggaaatgttgctaattttgttgaaactgaacagattgttgaatatcaaggggaccatgcaagttttgtacaaataagaggttcaattccactattttggcatcaaaatcctgatttacgttacaagcctcctcccaccctattagaagttgatccacaagatcatcattccacttgtttaagacatatgaatgatttgatgaccatgtatggaaaagttgtttgtgtgaatcttgttgatcaaaaaggagctgaagggaatatggaaatagctttccaaaatgctataaacaatatgtcgtctccttccattcgttatgagtattttgatttccatgcagaatgcagaaaaatgagatgggataggttatcaattcttatagataggctgtctcatgatcaggatgaaatgggtttcttcttattactaagagatggttcattaagttctttacaagatggcgtttttagaactaattgcattgactgcttagatagaactaatgttgtgcaaagtatgttggctcatagaaatcttgaaagcgttctaaaaaaattacagattcttcaacaaaaccaaacactggattatcaatattcctttgagcttctttttaagaatgtttgggctgataatgcagatataattagtacccagtactcaggtacaggtgcattaaaaactgattttaccagaactggaaaacgtaccaaaatgggattgcttcaagatggcctaaattctcttattagatactacaaaaataatctaacagatggataccggcaagattctattgacttgttcttgggtaatggaaaaccaatttcaccgctacatatagataagggttggagatatgtaacttatccatctgtattgttaattgctgtagccatgtttgtagcttgtgcagtcaccccttctgagtattcaacggattccctattgtttttgttattctggggatccatggtatatgctacattgcatacgattctcaaatatggatcggaatttgtggacaaacccagactcacacagtcctag

SEQ ID NO: 1108 - DNA, 1767 bp, Psylliodes chrysocephala
atgcctcctactattcaacagaataatcaaaatgctacaaatggagtagaaaaaagaccagtgaaaacaatagaaaaaaggtccgatctgttgtgcaaagttaaatattgtaatacgttaccagatattccgtttgatttaaaatttatatcatatccattcgaatcaataaggtttattcaatacaatccaacatcattagaacgtaattacaaatatgaggtattaactgaacacgatttaggtgttaatatagaccttattaataaggatatatatgccattggttcaggagttactttagatccagcagatgaaaagttattagaagaagatattttgacgcctcaagattctaagagatcacgccaccatgctaaatcagtatcatggcttagaagaactgagtatatctctacagaacagaccagatttcaacctcaaaccatggacaaagtggaagcaaaagttggttacagtattaaaaagtcacttaacaatgaaactttgtatatggacagagattctcaaattaaagccattgaaaaaacattcgatgatactaaattggttatcgataagcattatagcaaaccgaatgttgtaccagttgatattttgcctgtatatgcagattttagcttatggaaatatccttgtgctcaagttattttcgactctgatccatccccgagtggcaaacaaacgcctgcccagattgaggagatgtctcaagctatgatcagaggtgtgatggacgaaagtggagaacaattcgtggcatatttcctacctacagaagaaactcttcaaaaacgtcgagaagatttcatcaaacaaatcccgtatcaagacgacgaggaatacgaatataaaatggcgagagaatacaattggaatgtcaaaagtaaagccagcaagggatacgaagaaaattacttcttcgtcgttcgtcccgacggaatctactataacgaattggagaccagagtcagacttagtaagagaagacagaaaatcggtcaagctcccagcaacactaggcttatcgttaaacatagggttatggatgcaaacgagttcaggatgcaaagatacagggagaaacaacttgaaccaccaggtgaagaagatgaggaaatggaaattgatgaaccgaagtacgacgatactgttcaagaacaagaaaatgagattgaggttgaatcagatcaagaaaagactaaagatgtaagcaatactggaaacaagcaacgtaaagctttttcaagatccagatccaattcgtcggctagatctgataagtcaagatctagatctaggtcaacttcttcttctaaatctaataagtccagatctagatcaaagtccaggtcaaaatctaggtctagatcaaaatccaggtctaagtctagatcaaaatccaggtcaaagtctagatcaaagtccagatctcgttctagatcatcctcgaagagcgcatctagatctaggtcggtgtctaaatcttcttcgaactctcgatcaccttctagatcaaagtcgagatctgtggcaagaagtcgatcagtttccaggtctaaaagcaggtcgagatcaaaaagcagatcgaggtctaaaagcaggtcgaagtctaaaagcagatcgaggtctaagagtaggtcgagatctaaaagcagatcgagatctaagagcaagtcgaggtctaaaagcaggtcgaggtctaaatctggatctaggtctggctcatcttctgattctgagtaa

SEQ ID NO: 1109 - DNA, 1170 bp, Psylliodes chrysocephala
atgccgattgaaaatttggaagatcaaggactggagaaaaatccagacttagggcttgcccattgtaagtttctcttgagcctaccggaatacaggaatgacagaagtgtacattcgaaaatcaccgaagcaatcaagaaagatgatatggccccatggtacgaattgatttgtaaagatgctggatggaaattagatgcggctttgttgaagaccctgaaagctaaaaatgacgaaaagatcaagcttttggatgaagctatcgaagatgctgaaaagaatttgggagaaatggaagtaagggaagcctacttgaggaaatccgaatattatagtagaattggagataaagacaacgctgtaattacatttagacaaacttatgataaaactgtgtctctcgggcatcgcttagatatcatctttcatctcattagaattggtttgttctttatggatcacgaccttataacaagaaatatcgataaagcaaagactttaatagaagagggtggagattgggatagaagaaatcgtttgaaagtatatcaaggtgcttactgcatgtcagtgcgagattttaaaactgctgccaacttattcttggacactgtcagtacttttacctcatatgagcttatggattacaaagcttttgtcagatataccgtttatacttcaataataagcctaccaaggaatcaacttagagataaagtggtgaaagggtctgaaattctagaagtgctacattctgaaccatttgttaaagattacttattttctttatataactgccagtatgctgaatttttcacaaatctcgctgaagttgagagtatattgagaaaagattatttcttgaatccacattaccgctactatgtcagagaaatgaaaatatcagcctacactcaactcttagaatcatacagatctcttactttgcaatacatggctgaggcttttggtgtcaccatggaatatattgatgaagaactgtctaccttcatagctgctgggcggttgcattgcaaaatcgatagagtcggaggtattgtggagacaaacaggccagacttgaagaatgctcagtttacctctgttgtcaaacaaggcgatttgttacttaatagagttcagaacttgtccagagttcttaatatttag

SEQ ID NO: 1110 - DNA, 15819 bp, Psylliodes chrysocephala
atggaggaaataacctcgggtttagatcccgatgaattgatggatctagatgaacctgaaggttctgatttagaggatgatgaagaagaccttatcgatgatcatatttcgtcaccatttattttatcttctgccccagaatctactgcaaactctgttgcctcatctccaattagtgaagattgtcatccaccttttaattttacaggaaagcctcttaatgttaaacggggcagaggaagacctagacgagaaggaggtaagcctactgcacctcgaagttcacgaggaggtatgtcaagtgtatctagagtgagaaaacctagacctccgggtttttcaagaagaggtgctttgggaagtagaagtataaggcaggtagataggtcggattatgagttatctctctttactccatcaccaattgaggataacgggtttctggacccagaaacgggttcaatcatctattctgatagagaaaaatatattccatcaatagaagatccgccatattttccggaacactggccaggaaaagtttgtgccttgtgtaatttaggagagagaagtcaattgggacaaggagaactgttaagattgaattgtccagatggattctccccacataaggtcgccgctgaacaaatattagaaagagccttgcaagctcccgataaagaagctggcgacaaaagtcctaaaggtcctgtaacgtgcagaagacaaaaaagttttaataaatgtagacacccttccatgaccagcgaatacattgacgaattgactattattggatataatgaagtacctgatgtatctagcttgtttgaactaaatgggcaattttatattcaccgaaactgcgctttatggtctcaaggagttaccaaagcagaaaattcagctttgttgaatgtcggccctgttgtcctgcaaaattcttccaaaaagtgttcgttctgtaaccattacggagcaagcctcgcttgcaataaggacgaatgtaataaaatctatcactttccttgcgcaactgcttctggtgcctttcaagaaatttcatcttcagcgactttgtgcagcgatcactttgggcaagttgcgctgcttaataacgcatctccatgtttgacatgtggaagcatgggggacattgcaaatttaatgttttgttctggttgtggcgcccattaccatggaatttgtgtcggtttggctcaattaccaggagtacgatctggttggcaatgtcgaaaatgccgatgttgtcaagtttgccgcgtggtgggggacgaatcaaaattgatgtcgtgcgaacagtgtgataaagtttaccacgctggctgccaaagacccattgttacttcaattccaaaatatggctggaaatgtcggtgttgcagagtatgtggagattgtggtgcaaggactcccggggctggcttatcctcaagatggcatgcccactatacagtctgtgattcttgctaccaacaaagaaacaaaggattttcttgtcctttgtgccacaaagcttatcgcgcccatgcgcatagagaaatggttcagtgtttcagttgcaaaaagttcgtccatggcacttgtgacgccgatgcagacgttaatacctacaatcaaaagaaagatatgaatcctgaatatgaatatgtatgccttcactgtaaacatagtactgcgcgccaaataacttctaaaagagcaagcatagatgattcatatgatatttccgtttcccgcgattctctatacgatgatacttcggaatttgatctcccgtcgccagatgaattcgctcgaaatatgggattgggaaaaggaaaaccttacaatgctagtaagatagctaaaaaacgacttagtttcactgttaacagcgttggtagaccaaagggtactggaaaagtaccaccgggaaagatgggatttatgaaacgatcccgattaacagatttcaaccgaaaacgaggacacaaagctaaaatgaggggcattttcggagttcccggtgttggacttcaacgaccgatttcggatggaaagaatgacgaagaaccgggcgtagagaatcgattggtactttgttccgccaaagataagttcactttgacacaggatatatgcgttatgtgtggagcgttcggtactgatcaagaagggtgtttgattggatgcgtccaatgtgggcagtgttatcacccgtattgtattaatgtaaaagtcacgaaagtgatactacaaaaaggttggagatgtttggattgtacagtttgcgaaggttgcggtcaacgcaacgatgaagcccgtttgatactttgcgatgactgtgacgtctcgtttcatatttattgcatggaccctcctttagattacgttccgcacggaaattggaaatgtaaatggtgtgccatatgcctgtcctgtggatctaccgatccaggttttaactgtacgtggatgaatagtaccactcaatgtggaccttgcgcttcgcatattaattgcccgagttgcaatgacccttacagtgaaggtgacctcatcattcagtgtgttcaatgcgaacgatggctacacggttcgtgcgattacataaagagcgaagaagatgccgaaaaatgcgctgaagaaggttataattgtattttgtgtcggccaagagacgtaccgcctccgcatttaataccgccaccaattacgcctaagcctccgacgccaacgaaaagtcctgaagttggaaggagtacaagtttttatatggacggagtttatctcagcgaattcggaaataatctaataaaatctttggctttagaatatcatggatctaggaaaaagcggaagaaaattcctaccgttcaggataaagaagctggtatcatggctacaattgagtcggttgttgcaggtggaaatattggtcctaccaatttggacgacagtgcgaaactcgagttagtagacattaaagacgaaccacaggaactttacaaggaaggtatgacgtggaccaaagaagacggtccgcctccagaaggtttcgcagttgttaccatggaaaatggtgtgaacgtcctgcgacgtaagagacaacgtaatcttcaaaagctcggcatcggcggtttcttagttagaatgcgcggtattagaaccggtcaagataacgatgacatcgatcaatctgtcggtcaatctggatcaattaccaatgaaatttcaacaccgttacctggagacggcgataagcctagaaggaaagcgattaggagaaaacctaaaaataaattggccgaaacatttccgacttatcttcaagaagcgtttttcggaaaggatcttatggatgtggtcgaatgcaaaaaggaagttgacagttatagcagtgaagacgaaaaatctgatagttattataaatctattaatttatcacaggatgaattgatagcagtcgctgctgtctcaggaaaaaatgaacgactggaaaatatcaataaagattatacaaaagaaatgaaagttaacgccctaaaagaagaagaagatgacgacaatacggaggatttgaaagatgttcttgctttaccaggcgatttactggatacagatttagttaacagtattatggaagatgatgaagaacttactaaaaataccgcgtcgctagaaggtttagattcgaacttacaagatgaatctgaattgacagatactttgggcagttctggaaattcaaaggaaaccaaagatgaattgagcgatattcttggtccacatttcaatcttgattctatttcaaatattaatagtaaagatgtagaagatatttttaagggtgtactgactgacgagtctcaagaatcgcaagagagcagcaatttttctttgcaaggcaatagtatttttactaataatagcagccaacaaagcattgctcagcattccattataaatcaaccagttagaccgaaaaccttgcctaatgttaatcacgttaacctcaattcgcctgttagttttccaccaccatcaccgtaccattcagaatatagcaatagtccacaatttagtccagcatttactgaatcgcccagcgcttgggtgggtgtaactgaaactccggaaattgatagtacgaatgtaggagtaccttcgacgtataatcaacgttcttctgaaaaaatgaaagctgatgagagtttgggcaatggagccaccatttccgctgtcctatatgccaacataaatcacccagaatggaagaaagagttcccgaattggtcagataggtacaaacatataataaaaaaatggagaacgttaactcaagaacagaaagcaccttttcttcaacacgcaagagacaatcgtagtcagctaagaatgaaaaaagctcaacagtcacagacctccaaggactctacctctgctaccacgccccccaatgtgaccaagccgcttcatgccgccccagccctagtgaccaccctccaggcagtaacacagcagaccgtgggggtttccatagcccccacggctcccgtttcagaggatcaagaaaaaattgcgcttcaacaaaaatccgctagggaagctgagcaggaaaggcagtggaagcaacttcaggctttgagacagcagcagactcaacaacagcaaaatattatacacgaacagcgtgtacaagacaattgtacagctattgcaagagtgcaacgccagatatccacagatccgactcaacagtttttgacagaacaacaaagtcctcttcaagtcaatactcctcaagaactaagtccgtctaccactccgacgactccaagtccaaggcagttcctcggcattaagtctccaacatttcctgttccttcccccgtatcgcagagctctgtccgatctaccactcctttgcaatctcctcatgacatttcacaacccggtaccccagatggtaacgatccttttattcaatcacccactattcctaaacctaactttcaacctaggttacctaatgatccatttgctcaacaaccagctacgcctagaccgcagttcggactttcaaggccacaattacagaacttcggaggcgccatccgaactgaccaacaagaccttaatatcaatcgtcagttgagggacttattacagcggcaacaagtgaagaagttagatgaaataccgggaaaacttcaacagcagagggtatggcatccggtggaacagcaacaagaaaacgaggcttctataacggcacctacttctacctcagcagttagtactgtggcttccatgtcggatgcaacgtttcgtcaaccgttacctcctagtatcgtgaaaccgagactagcactttcattagctggaaggacggcacccagtgctgtgagagtaagccagttggatcctagaatgcaaggattggatccgaggatgagattaattctgcagcatcaacaacaaagattagctaccggaattcaacagcaattcattcgtttcacctctaacgcacgtcccactacggtagaacaatatgaacaacttctacaaagtaataatcctggtcaaattcattctgacgaacaagtcatacctcgaatgcctcttaatcaagcgagcgttatacagagaccacaaatctctcagtctgctccgacaagcacgccaacaatctctaatacaactgaaaataaccccagcgaagaaggaattccggataatgttacagcggagttagaaaaattagagcaagaaacaggtaccatggttgaacttcagggtgttagtgacatattaggtggactggacgatgacgacgaacttttggctgagatgggtgcagattttaatatcttagagtatgccgatccggaattggaagctctcacgggtggtaaaacgaacatcctggatttggaactagaagaagaaccagttaaaaaagaaaaagtagtagcaccaaatgcaaaggaagccccttctaattctatctccgctaaaagcgatgcgaacgttgaaactaaaattgagaataatgtgcaaaaatccattccaaaaccagttcaaaatccgttacctccatcatcgtctcatcaaattattcagcagcaaaatattgctcaacatactacttcgatgcaggctcaacagcaaccaccacatccacagcaacaagcacctcatccacagcaacaagcgccacattcacaacaacaagcacctcatccacaacaacaagtacctcatccacaacaacaacaacaacaagtacctgtacaatcaactatacagattcaacagattcatcagcaaatggtccatcaagtacaacaagctgctgctcaaggtagaccaatgcctccaggatcaaaaatgcaaacaaccgacgggtttgtaggtattgtcatggcaaataacaccgtacaattgcaaattccccaaaattaccaacaaagattactcgtgttgcagcagttacaaaatcagaaattacaaatgaggattggaggcaagccatctagagcggctttgcaggttggtcagaaccaactttctgtaggtctgaattcgggtccacctcgaatgacagtaccggctccaccgcccccacctccgccatatcctggtccaccgccgccttatcctggaaacgcgaatcagcaccagcaggagcagcctcttttattggaagacttacttgagcaagaaaaacgggaacaggagaaacttcaaaatcagccttctaatcaagaagtatcatcttccacgggcaatgaaagcgaatcggcactattgagcgatcaagatttcgaacgtctcaaagcggacgttttcaacagcacccctgtaaacagtatatcatccgtaaatcaaggaaatgctggccaaacgtctcaatcttggcaacagcagttagcaccaactcgacaagcgcctacaccagcgccgccgccgcagcccacaatggaaattactactagagttcagatgttcaatccaaatttaatacctgcacctccgcttccacctgagaatattattactgagcaagataagcagacccagttgttgtacgagcagtggttaaatcatcagcataacgctttggctcaacaactgcattattatgaaactgaagtacaaaaacttcgaaaaagtagaaagtctttaaatagtaaacagcggcaacttagaaaatctggaaatcagttaacggatacggatgcagcggaacttcaaaggatatccgctgaacaagcgatcctccaaaaacatttggaatcgagtagaaaacagagccgtcaacatggaatgctgatccaggaatatcgcaacaagcatcctgtgattaagcagaggaccggatcagaccaaattcagtcgccgttgggaccgccggcgtcgtctcccattcaacaaccaagtacttctttgtctccgatgttgtcgccatctgtatcaccgatgactcaaaatagttcgcctctgaatagtcctggacctctgattccctcgtctccaggacacgttcaaaatcttttacaaagtcctaatagtatatccgctaccaatatgtctcctctacaatcaatgcaggcttctccaatgcaatcttcgcctttacaatcttcgcctaggataggtacacctcattctcaaagtgaagaaagtcctggcccaatacaatccccatcacaagtatgtcttccgccaccgatgccaagaatgacttctcctcagcacagaagagtggtaacaagtcctgttggtatgtcacagatgagatttataaacaacacagtattgcaacaacgcgttcgtatgcaatcgccaattccaaatttccaacaaaagcctggaacgccgtctccattaaatagtccaacgtcgcaacagataaatgttaatcaactacaaattcaaaaacagcttcagcaacaaacgattttgcagcaacaacagttgcatcaacaaactttggataccaaccttgtcgatcccaatgctcttcattctcaaagaacaacgcagctgttacaacacaggaatttcattaggcaacaagttactcagcaacaaattataggtcagccacaaactttaactcctcaacaacatcagataatgttgcagcagcaaaaacagttagctcaacagcaacaacagcaaatcgctcaaatgaacgcagctagacttcaacagcagcagcaacaacaacagcagcagcaaaataatccccctcattcaccgatgcccccaaagagtccaatgattatgtcgccgcattcaatgcctcattctccgatgcaaatgccaccgaaaagtccaatggtatcttttagttctagtcaaccgaatccgaattcccctgctgctagaagtccagcatttcatcaaggaatgaatcaaccgacgagtcccataacccatggactcaatcaacctcccagttcgcctatgcctaggagtcctatgatcaatcaaacacaatcgccgcatatgaggaggccgcctagtgctagtaatagtccggcgatgcctgaaagacctcacagcgttgaaaatgcttcacctagaatgtcgtattcgatagaccatttaatgcaagacaatctgcacagtcaaaatcgatataccgattctgcaaatctttataattctgacatgaataatgagaacagcattagagaatctttatcgagtggtggaggaaatccaaataacccttgtaatcccatacctcttccacccgaaattccaagatatcgttatttcaaacttgggctacgaggaggagcgcctatgtggggttttggaagaggtgccaaaaggttacctacacctcccaacgtacctaacaaacctgatgagaaagttacaaatcaagaaagcttaatacagaaattgaaaaaggaatcgcacttaagtaaagtatcgattcttaaaagaaaaggttctacgtcatcgatgggaaaaatggggtctttagtaagctccgattacaacgacttagacgacagttcttcaacgccgcccgtaactcctcctttagcgtcgacgagtagaggtacgctaccaaaaattacttctaaaaaaactatggaacatcagggccaaaaagagtctgtaatcgttatgcacagtcctgataataaacaattagagatgatggactatgatgacgatacgaatacagttctatcagctgaagtatctctaagttctgttgcacaaaatgacgacgatatggtggagattgagactctttcgcaacaggacctcgccgaaggattggctagtcctttggaatccgatcaaatagctgaagattttcttctatttcccggtaatatggtagtcgatttatcaggcggaggacattattccgaaaaggaagacgaagaggaacaaaacgatgacgaatttaatgaagaaaacatgcatatcgttatacgcagtcccaccaccagcgacgatgaatttatcatgcaaagtaaaggaaagaaatacaacgttgatgtacatcacgatgaacgagatgataatctcgaatcaccggaacaagaagaatacacagaaccgtctgaaatagtaaacgatatgatgactaattacgaagaatctgacgtgatgcttacagatcaaaacagcagcactcccgaagattctatttcgacgaaagaagacttcgaggagctaatcgatgaaggttcgcgcaaaaataatataaccaaacatgatatgccgtcaaagcatatacaagaatttcataaatacacagggatgtttaattatcccaaaaatgatacacacagtatgcggccgcagccgaataaaattccgacgacgtctaaaaaacttccacagaaaatatctttggttactggacctattgtacatacgctgcctcccgtcagtaaatccaacgctgataaaattataattactcaaaattcgaatgtgttaaacacttctcaagcttctaaagttaccagcatcattttaactcacaattctgccatgaggaggaatattctaaatgtgccgaaaatagttagctccgtttctccagcaataactattgttagcgccagtacttcccaaatggcttcgatattgccatccaagtttactgtaccggttataagcgctagcgcagtccgtcagctttccaacgttaaagttatagataaaccatcgtcctcgtctttatcgatttcgactagagataacgcccttccaaaaaagatattcgaagatgattcagtttctccagatagttcaaattgtggcgatgaaaaatcgaaagattcgtttgacgataaaaccaactctcaagaacccaaatctatgttcatgaaaaccgataatttaaatactttacctgttatgtcaagaaatatggaatttaagtcgaaaaattacactgaccagccgaaaaaagtcgagcatcttcaagtcatgaatttagcgacaaaagattttgctcaaaagcaaagaatacctagtcctttaatatcgaaaacttctccgcctgtaattatacataatacaccggagctgaagatgacggcgcaagtaattcaagaaacgcagacgcgtatgaaaatcactgctactacagaccatttagatcattacgacggatctgttgacgatcaaaaatccgtcgtaatatccataccatcaccaacgccttctcaagaacaaatgctagacaatatagcgttgcaagctctggaaaatcgtagaagggaattcgattcgatagaagatgtgttagatatgattgaaaatataactgctgaaccaccttcgattctagaagaaaatactagagtccgaaacacggacaataacagtaagattgaaataaaagataataatgatatgaaggagaaacctgtcacaaagtcggaaacgttaaatttatcgtcgaattccaaatcttcaattgtgcctcaattatctccactgtcccaaccaaccgatttgactacgaatatggctaatgcatcacagcaactcagaactctattatcatcattacaaaccacttcaacatcggctccgacaaacgtagaatctgtggtaaaaaattttggacacaaaattagcagtagtacatcttctgctagtcaaccgattgtcgcatctagagttatacaacaagccggtagacattcgcctgtcattacgaatgttagtacagttatagttcctaattttaaacaaaaaatcaccgttacgtccgcaagtacgtctagaagtagtccggtgaaacaagtaagcaattccgctgtaattacgtctactctaaattatttgccaagcagaactgtaggtggtatacagttgatgccagatcatcccaaattgccacctgtaacgagcgtacagcaaattaattctgtgacttcgtctcaacaggctactgctatgcaaaaaaacgcacctaatgctgatattaaaaagccttcattgaccctaacggcgatgttacaaaatcaacctgctgctaatatgatgactaaaccttcgtctgacacaataacggctgccagtcttctgggatcacctatcagtttgccgaaaactggatttactacgtctttagtacaggctcaaccgagtgtagtagttccaaatacatcaacaacaattgtaacattgcagaaccagatatccacggtgggtaccgccgctaaaaccactgacacgatcacagcagcaagtttgctaggtacgtcgataaatattacgaaaacgggatttacaactgctttactgcaagcccagcccaatccgtgcgttacttctctatcttctaacgttacaagctctgcagccctatcgaactccagcaatatcataactagttcgacgcataaagttccaacttctactacgaatttattgcatacgcaattaaccaaagttgtaagaagcaaatcagttgatgatgtaaaagacgtaataatgaagcaagaagatgttaaattatctcataacgaaagtttaaatattttggaagacagtaaagcatctgttttagggaatagtggttgtaaattatccacaatccccacgcctgttataaataaaactgaagattcgcaaaacgttttactgaagaaactacttcagaataccgcttgtgccagcactcagtctcctccacctagttcgactagtacgactaccactgtcgccaacattcctaaacctccgatacgagaaacgtctttcgtttccaatccgaatgtcgaacaacccgtttcccaagcaaattcgtctccgattgtaacttcgcaacaaatgaatttaaagaaatttatgcctactaacaggagtactagtaaagatgaattattatccccgcaaacgcctcgatcagtaaataacaatcaagatttaaatatacaaatgccggcgatagttaaaaaagaagtaataccgcctccgcaatcgagtccccttttgatgccgctagaagtcaagaaagaattcatcgacgaatcgtctcagcactcggaagtttcggatcacagtcgatcggatgttccaattaaagaagaactagaatctatagacaatacagtcgaaaaagttttgttagataaagaagaaataaagaagcaaaaacggcgaatgtatcaacaaaaaaggagacaaaaccagattcttaataaggaattagctggtcaaccaaagaaacgccctcggaagaattctaaaatcgaagaagattacgatacttatatcgatggggtgctagcgcaattaagacagttgcctcctataaccgtttctgaaccggtgctgaatcgtaattttggtgtagtacctctcttcggttcaggtgatatgtctaaaattggaacaaaagactattcaattcagttcggggaattagtcggtaattatggatatagcgaattgccgacgttctcggacttctattcgaccaaaccctatggcgatttggatccgattccagagaaatcaccgtcgtcaactcagagaggtttctatgaccaagaatttccgttaatcagattcgatactgacgaacataaaaaattcgatatgttctgcagagaagatacgcctgattccatactgagcagttcgtcgcctgaatgcgtattaaacgaaccgcattctaaatttatcggattcaaactgatcactgatagtgaagatgaggaggaagaaaccggcaaagaaatgttatctcgcgggagattatctccggtcgtgcctatgattagacctgttcccattaagctgaaacctgttggtggattgtacgttaaagaaaatcctaatgagaataaggaaaatattcaagattccgtaaacgtcttaactaaatctaaattcgataataagcagtcaccgccgtcgaacgattctggacatgtcacagtgacgttaacactgacatcttcggcggcagaagatataatgggcgttttaagagatttggcgaacattttacacattcctgctccaactagttaccaaattgtagaaagaacgacttctccgcctagtcaaaagttaggcttatatagaactaaagggaaagatggcaaagaaggagctcccatcgacatccagagcattcttaatggtgctacgaaattctgtaaacattgtgatgtaatcatcttaagtaacattatcagaaggaaagtctctgatttgcccttcctcgctaaagactccgatctccttagtgacggtgaagaattgttcttttgcagctccacgtgttatatgcaattcgctttgatgcatagatcgccttcaatctccgaaggcaaggctgccgaaattataaatcatttatctcaaaaggacaatttggaggcgaaacaaaagttgccgatgatggaatctttagacaataaatcgataatagctcaaagattgacttttggaatgaaggatgtgaaacgggaatttgaaccgatggacacgaataatccgtttagctattttgctcgttctggcattaaacagcctagtttctttgatggtgtctcgtacaagccggcgcctgtgaaaatgtacaaaaatattaaatataaattgtgggctcccggttgccttcagccaaatcagaagcataaaataccaactgataaggaaattatggaattgttatatagaatgcagattactgttgcaccttcagttatgccagaagattttagacgatgtttgttttgtcaaggaattggtgacggagttgcagacggtccagcaagacttcttaacttcgacgtagacaagtgggttcatttgaattgcggcctttggtcggacggtgtttatgaaacggtcaacggagcgctggtgaatgtagaaaatgcattgcagtcgggttccggtgcttattgtatacattgtaataattccggtgctactataagatgttttaaaaaccgatgctccagcgtctaccacttgaattgcgctgtcaaagataattgcgtattttacaaaaacaaaaccgtttattgtaaaacgcacgcgccgaaaaacgaaaaggacaacgaactcaccacgctgtcagtgtctcgaagggtttatatcgatagggatgaaaataaacaagtggctgcggtcatgcatcattcagactctactgatctattacgagtcggtagtttgatatttttaaatgtcggtcaactgttgccgcaccagctacagaatttccacactcctaattatatttatccgataggatacaagatcatcagattctattggagcatgagacaattaaataagcgttgcaaatacatttgttccatacacgaattgtgtggaagacctgaatttagagttatcattcaagagccgtctgaagaagatctcgaattcagcgatgctacaccgaaaggtgcgtggcaaaaaatcttggacgaagtttcgaatcttcgtaaagaaaatggctgtttacacatgtttacgaaattcgcaacaggagaggatcttttcggtctaaccgagccagcgatcgttagagtgttagaaagtatgcccggcattgaaacgttgtctgattataaatttaaatacggccggaatcccatgttagagttgccgttagcgattaatccatctggagcggctagaaccgaaccgagattgaggagtcagctgcattggaagaggcctcatacccaacgtaccacgggtggattttcggttagaccaatgttcggaccgtcactatctgtaccttcttttagcacacagactttgggagagttggcctgtccgtatagcaagcaatttgtacactctaagagttcgcagtacaaaaaaatgaagcaagaatggaggaataatgtgtatttggcaagatcaaaaattcaagggctgggtctctatgctgccagagatttggagaaacataccatggttattgaatatataggagaaattataaggtctgagttagcagaaagtagagaaaagcagtatgaagccaagaatcgtggaatatatatgtttagactagacgaagaacgagtagtagacgctaccttatgtggtggtttggcaagatatataaatcattcctgtaatccgaattgtgtagcagaggcagtagaggttgatagagatattcgaatcattattttctcgaaacggagaatattacgtggagaagagttggcatatgattacaagttcgatatcgaggatgaccaaaacaagatatcttgcatgtgtggcgctcccaactgtcgcaaatggatgaattaa

SEQ ID NO: 1111 - DNA, 4503 bp, Psylliodes chrysocephala
atggaagattctgctcaagacagaagatctagcaggcgatccaaaggggatacttcttacaaagcaaaagcattcgaaaaattcaaacagctgaagaaagggattaaaaacaagtacgaagttgatgatattgataatgtttatgaagttgttgaagaaaaagagtacgtaaaagaagttttatcaagatacgaagatgattggattgtcgatgatgatggcagcggctatgttgaggatggcagggacatttttgatgatgacatggacttgcagtccatcgctcaagcatctaataaaggaaaaggtactaaaagaaaaagcaaaaacttgtctgaaaacgcaggaaaagggaaattgcagcaaatgctgtccagtatgccaacaaagaaaaaaacggagacaaaaatcgacgatgatgatgaaatgttatcagaaattcttggggaaattgattcaccttcaacaagcgttgctaaacccaaaatcaaagaatattcagttctggctaaaaaattagctgctaaaaattatatgaaaaacttctcacaaccgataaaaaaacgtgccatagaaagaaaatcattaccaacaacagagactcccgaaaagaattcaaccccattaaaagaggtgactgctaatgtagaacaacctacaaaacaaattttagagccagtacatgcaaaaataaatcaagccgcaagtccagtggtggacaataataaaaaatttgatgaaactctatcagatcaattcactgaagatatttcctttgatgatttcaatgaaactcctactaaaatcaccgaaacgcaaataatagacactgaaatgactcaagaggagtttgatgatgatttcgatgtcacactgattgaagaagtcgaatctaagttatctgctgccggtgagaagcttgctgacaacattcaggcagattttgagactgaatgggagaatttctcaaataccagcgttaatgtcgatagtaataaccaaaatttgttggacaaaactgatatacctctggaagaagttgatggacaaaaggtatttagatttttttggtgggacgcctacgaagaccccgtacatcaaaaaggatccgttttcttatttggtaggacttattgcgaaaaaacgaagagttttatgagttgttgcgttgccgtacggaacatcgataggagaatcttcgtcctacccagaccgttcgaactcgacaacgatggtcaaccaaccgacaacgccgttacgattaaaaacgtttatgacgaatttaacaacaccattttgaaaccattgggagtgaaatcgtttagaacaaaaccaactatgaagaagtacgcttttaatcccaatataccgagcgaatccgaatatatggaagttagatatgccgcgtcagaaccgcgaatcgacgttgaaaatttaccgaaaaaaatccgcactttttcgaaaattttcggtactaacacgagcttcttagagacgctctttttggatcgcaaaatcaaaggtccttgctggttggacatatcgaatcccgtgccggtatccaaccctgtaagctggtgcaaattcgaagtaaactgtatgaaaatcgtcgaccttaaattaactcctagcgaaaaaccgcttcctccaccgcctcttgtcgtggcgaccattaatatgaggagctgcattaacaggaggaccggtacgctcgagctggttatgctgtcctgtttggcgcataacgagtacgaggtggataaacagcctccagatccgccatttcaacagcatttttgcgtttttacccgtcccagcaaaatcaaaggtccttgctggttggacatatcgaatccagtgccggtatccaaccctgtaagctggtgcaaattcgaagtaaactgtatgaaaatcgtcgaccttaaattaactcctagcgaaaaaccgctttctccaccgcctcttgtcgtggcaactattaatatgaggagctgcattaacaggaggaccggcacgctcgagctggttatgctgtcctgtttggcgcataacgagtacgaggtggataaacagcctccagatccgccatttcaacagcatttttgcgtttttacccgtcccagtgaccaaccacttccatccgacatccacaacgctctcggcaaatacaaagctaccaaagtccaaaaaatggactccgagaaaggcatgctcaacttcttcgtcaacaaattcacagaaatcgatcctgatctcatagttggccacgatttgcagggctaccaaatcaacgtgctcgtcaacagattgttgacgttgaacaacgtgagtttcaacaaattgggacggctgaagaggaccgataagaaggcgttggagaagagtttgtttgccggccgattggtgtgcgatatgaaagtgtccgccaaagaactgatcaaatctcgatcgtacgatttggaaaccctctgccaggtcgtgctgaaattaaacgacaaccaacgaatcgaattagagccggaagatataccgaaaatgttcaaaacgtccgacgatattttgaaactgatctcgttcacgatgcaggacaccatgtacataataaagatgatgtacggcttgaacgtgataccgctggcgctgcagatcaccaatatagccggtaacgtcatgtcgaggactttgatgggcggtcgatccgaaagaaacgaattcctattgctgcacgctttctccgaaaaaggattcatattgcccgataaggagtacaagaagaaaattccgggtcagaagggttccaagaagaaacctacttacgccggaggtttggtcctggatcccaaggtaggtttctacgacaagctcatcctcctcatggacttcaattccttatatcccagtataattcaggaatacaatatatgctttaccacattacctgtcacagaggaagacgataatctgtacttaccggacagcagtctgccgcctggcattttaccgacagaaatcagaaaactagtagagagtcgacgtcaagtcaaaggtctgatgaagagaccggatctatctaatgatctgcgagtgcagtacgatatcaggcagatggctctgaagttgacagctaactccatgtacggttgtttgggtttcgcgaattccaggttctacgccaaaaatttggccgctttggtcacgcagaaaggtcgagaaatcttgaccaacaccagggatatgatcgagaaaatgagctacaatgtcgtgtacggagataccgacagtattatgattaatactaatattttggagtatgaacaggtattcaaaatcggcgtgaaaatcaaacaggaagtcaacaaactgtacaaacaagtcgagttggacatagacggcgtgttcaaatatttgctgctattgaaaaagaagaaatacgccgctatatctctagcgaaagacaaaaatggcggtctcgtcaccaccaaagagtacaaaggtttggacatagttcgcagggattggtcccaactgtcctgcgaggctggcaaatacgttttggatcagatattgagcgatcagtctccggatgacagaatagaaaacattcacgagtatttgaggaaaattcgtgccgatttggaagaaggcaaagtaccaatacctctattagtgataaccaagcagcttactaaagaacctcacatgtacccggataaagcttctttgccgcacgttcaggtggcgctgaggtataacaaaaacagcggcggtcatttcagaagcggcgacactgttccttacgtaatttgcgaagatgggactaggaataatgctatacaacgtgcctatcacgttgacgaaatgaaaaataaccccgttttgaaaatagactataattattatctgggacagcagattcatcctgtcgtgactagaatttgtgaacctatagagggtaccgattcttaccaaatagccgaatgtttagggatggatttgaagaacttaaaaaaaccgcagaaacaatcaacagatcagatcgtgggagagaatatatgtaggccggaaatcaaatttaggaatgtggatacattcaagttcgtttgttacgtgtgcaaacaggaaaacattgtagacggtccgttggtcggcgcgacaccgtttttagaaaaatgccaaaacgccgattgcaaatcgagacccatcgactacttaccctgtatccagaaccaagtcactttgtctattcgttcctatataaagaagtactacaaaagtgtaatgatttgcgaggacccggcttgcaccaacgaaaccaggaaattaccgctgcgattcgttagaaagtatcccttatgtaatgtctgcaaaaagggcgtcctgttcaaggtgtacaatgagcagcaattatacaaccaactcgcttattttcagcatattttcgatttggggaaactcctcagaaaacctgtgatggacagagaaaccgagtccggctatcacgct

SEQ ID NO: 1112 - DNA, 1398 bp, Psylliodes chrysocephala
atggctgctgcagcggctgctaaaatcgccgaagtccgagagacgacacgcgtggaaagaattggggcccactctcatatcagaggattaggtttagacgacagtctagaagccagacatgtttcccaaggtatggtgggtcaagtttctgctaggagagcagtgggaatcgtccttcatatggtacgtgaaggcagaattgctggtagagcagtcttattggcaggacagccagggactggcaaaacggctatagcaacagctttggcgcatgctttgggacaagacacgccgtttaccagtatggcaggatctgaaatatattcgttggaaatgagcaaaactgaagctataacgcaagctatcagaaaaagtattggtgttagaatcaaagaggaaagcgaaatcatcgaaggagaagtcgtcgaagtgagcatcgacagaccagctacgggggtcggcacgaaagttggaaaattaattttgaaaaccaccgatatggagaccgtttatgacctgggcggtaaaatgatcgatagtattttaaaggaaaaagtccaatcgggcgacgtcataaccatcgataaagccacgggaaaaattacgcgattgggtagatctttcgccagagccagagattacgacgcgacaggtcaacagaccaggttcgttcaatgccccgaaggggaattgcaaaaaaggaaggaagtcgtgcatacggtgacgcttcacgagatcgacgtcatcaatagtcgtacgcacggatttctcgccctattttcaggcgacaccggcgaaattaaaccggaagtaagagaacaaattaacggaaaagtggcggaatggcgggaagagggcaaagcggaaataataccgggtgtcctttttatcgatgaggttcacatgttggatatcgaatgcttctcgtttctaaatagagcgctcgaaaatgaaatgtctccgatcgtcataatggctaccaatcgaggcatcaccaaaatcagaggtaccacttataaatctccgcacggtattcccctagatttgttggacagaaccatcatcgtaccgactcaaccctacgacgagaaggaattgagggaaattttgagcatccgatgcgaagaagaagactgtcaaatgtcggacaacgctttggccgttttaacgaggatctgcaaggagacttcgttgcgatacggtatgcaattgattatgacatctagcttgatagctagaaaacgtaaagctcacgaagtcgatgttgaagacataaagagagcttacacactgttttacgacgaaggaagatccgtgcaattcctcagagagtaccaacaagaattcatgtttaacgatcttgatgacaaagatgacatggaggtggaaacgaattga

SEQ ID NO: 1113 - DNA, 1125 bp, Psylliodes chrysocephala
atggctctgagaacctacggagataagccaataagtttccaactggaggaaaatggggaatactattgtgttggatccgaggttggaaactatctgcgactattcagaggatctctatataaaaaataccctggaatgtttagaagatctataactaatgaagaaagaagaagattaatcgaacttggtttgagccagcacgtattggccagcagtgtatctctacttagagctggtgaagttgaagatatcattgatggaaatgatgataagtgttccagatacaaagcggtatctgtgcacacttcagaacctccgatgccaagagagagcaaatcgaagaagaacatgcaatgggtaccgtctctacccaactccagtcatctggatgccgttcctcaagccacgcctatcaacagaaacagagtggccgccaaaaaggttagaacgtttcctctatgtttggacgatacggatccacaattgaacatcgaaaacgcgtgccaggcagaggtattggtacctataaggctcgatatggaaatcgagggacagaaactcagagatacttttacttggaacaaaaatgagagtttgattacacctgaacaattcgctgaagtactttgcgatgatctcgatttgaatccattgacgttcgtgccggctatcgcccaagcgatcagacaacaactcgaggcttttcccgccgatccgccgagcattatcgaagagtctagcgatcaaagggtgatcgttaaattgaatatacacgtcggtaatacgtcgcttgtcgatcaggtcgaatgggatatgagcgagaagcagaacaatcccgaggatttcgcgctcaaactttgcgccgaattgggtttgggcggtgagttcgtgactgcgattgcttattctataagggggcaattgtcgtggcatcagaggacttacgcgttcagcgaagcgccgcttcctatggtcgaggtgccgttcaggaatccgagcgaatcggaccaatgggcgccgtttttggagaccttaaccgacgccgaaatggagaagaaaatcagagatcaggacaggaatacgcgcagaatcagacgattggcgaatactacgccgggttggtag

SEQ ID NO: 1114 - DNA, 309 bp, Psylliodes chrysocephala
caagtggaactcgccttatgggatacggcgggccaggaggactacgaccgcctgcggcccctttcctacccggacacggacgtgattttaatgtgtttctcggtcgactcgcccgactccctagaaaacatcccggaaaagtggacgccggaggtgaaacatttttgtccgaacgtgccaattatcctggtaggcaataagaaggatctgcgtaacgatcccactaccattaacgaactgaaaaaaatgaagcaggagcctgtcaagccgcaagacggtcggtcgatggccgaaaagataaacgccttc

SEQ ID NO: 1115 - DNA, 4008 bp, Psylliodes chrysocephala
atgaatacatcttcctacattcaacgaatggacgcaacacaaaatcaagtacaaaaaatggaattggcctctagaaatatcgataattcattattactcgacaataattctcctaggctactagattttatgaacctacacccacaaagcggttctactgcaagtggctttgctgaccatgattatccaactttaagtggagggccccacattattaacaatatgactcaaatcaaatgtattaatagtgtgccattaccttcagaaatagttgatcattttgcacgggtccaatgtcactgtatgatgggcttattttctgaaataaacagagcttggttaactgtggatagtgatatttatgtctggacttatgaagagaataccgatttagcttattttgatggaataagtgaaactattgtctgtgttggcctggttaaacctaaggttggagttttccatgctttcattaaatatctacttattttggcaacatctgttgatattgttgtattaggtgttactttcactgaaaatccaggtgacaatagtgatgaaattcaactgataccagatcctgtatttacactaccaactgatggttctacagtcacaataataaatagcactgaagatggacgtatattttatggcacaaaagaaggaaacttatttgaaatcacctatcaagctgaaagtggttggtttggtaaaagatgtaaaaaaattaatttatcaacaagcacattgtcctttttggttccttcatttttaaatgcagcattaagtgacgtagatggcattatccaaatttcgattgatgacagtagacatgttctatatattcttacagaaaaaggatcaatagaagtttgtgatttaggagaaaaaggaaattcattttcaagagttagtaaaatgtctcaaggaactttggttaaccaagcaatgaatactgttaaaactttagatagtcaaaacttccgtccaattgtcagcatatctgccattgaagcttctgaatcagccaatttaaatctggtagcagtttctcaaacgggagtgagattttatctgacagttgttagtttgtcaaatcaacaacccaatcaaagaccttatacattaacactagctcatgtgagactgcctcctggttattctgcaaacattactgtgagaccaaggtcggtgcatgtgtcccactatagagacaggaatttggtgttgatatctacagtaaatgaaaaagatgttctgtggtgtatgagttctgatttatttccgtttagtcagacattgatggaagcgtactcggctgtaaatttagatggtccagctttggctatatcagaggtgcgaaatatcaatcccctacaaatacacgatttacatgaagcccctccattggtcgtcagacaacatgcagaacctccgaagaaatatgtagtactaacttcgcatagtgttcaaattttcataaaattgagaccagttgatttgcttaaacaaattttaaaagatagccacggtcaagatactggagcattgaaagctttcttcaccattcaaaaggaagatcaagcttgtgctaccagtttgatactggcttctttggaaaatgaggacaacatggaagtagcagaatatgcaacgagagctttctttttgtttggaggcgaacctaagctggcacacggaaatatttattctggtcaatctgtatttgcaccgcccataatttctactccagctccacatcaatatcagcaacaacagtttcaatctcagcaatatcatagtttttcacaaactatgtctcctacaggctctgcatatgatttatccagtccatttattttttcgcctaaacacaatggtctttacttgtacttaagcagaatattgagaccgatttggaatagaagaacagttgataaactttgtttagatggcaaaactataacgaccaacagtacagtaagtagtgaagattgcattttcattttaaataatttgtcggcgcttcataacttcttgatgcgcaatacacaattatcaacattaaacaccagtcaaagccaaaatcccaatacattcaacaatacttctttaaatatgacaaggttgaaccacaccattcaagatgctcaattggaagaaaggatgtcattaaatgccctcaagatctttgtatgtcactgttgccaaatattaggtctatggagaattctatgcgaacatcaattccattcattaattgctactttaccggagaatgaacagcacattcttcaaaatacgacgtttaaagatttatttttatataggcatgacatatgttcattgctgatcacaactttggttaacagttatttgggagataacgcttcggttgattctattagtaacaaattaagggaagtttgcccacaattgtataaaaccgaggatgccgctttttcaaaggcagttgaaatattaaaaatgactcgaacgatacaaaatagtgacgagaaagaagaaatgattcactccgctctacagatttgcaagtcaattggtccatctatcaatatcactgatatatgtagagagttcacaaatctgaaggcttacaaagccattactgaattgtgcgcgcatttcggaaagaaaatagatcccaataaaattgccgaaagttattacaattcagaagacaacagtggagatcaagaaggttacaattattatcaaagaagattggaaatttacagacatatattaaatatgctagatactctttataacgaacagagccagactcaatcattaagtccaaattctgatcgcgcttgttcaactaatcagtcaatcttattagatggtgtagaacaatcccaaattggatatgtggtgaagcaagtaataagcgacattttggaaactcccgatgaaattatgcacattgcactttacgattggttaatattcaaaaatatgacaggagatttaataaatatacaaaatacatcgttggagacatatttgaaacgaacgtcagttcaaaatcctaataacgtcgaagctatggaccttttgtggaaatattatgaaagttgtgacaatcacgctgctgctgctaaaatattaaataatcttgcgtcacgaagtggtatcaatgttccattaaaagaaaggctttcctatctagctagagctataatgtgtatgcgaagcgataagataggctatgcgccctatctcggagtattcttaagagacttagaagataaaatggaagtagcgaaagtacaagaacaaattctgaacgccataacgaatctgcaaggtcaaatacctaattctcaagacgcgattaatgcccttaactctggtttatatgaaatttcacagctttacgagaactttgcagaaccttttaaactgttggaatgccagctcgcgattatagaatgcgctggttacacagaccaagtgttagttgaatcgatttggcagcaaattttaactgacgaattgaagaaaacctttggaaccggtacagataaagtatgccaacttttgaacaaagtcaaacaattggcgaaacagtatgcccagtccacaaactgctttccattaagttacatcgtttatgagttagaaattgtaaatgcaaaactgaagggggacaaacaacttgtacccactgcactggagagtatgaatattccttttgaaagtctgatcaacgtttacaacagtttgaatacgatatcagtaaatgaccacttctggcagttagaagagaacgaatttcatctatctgaagcaacgtctgcgttgataaattgcttcctcagcaatcacgaaagttataacagcattgaaaagaggagaataacttcactatgccaagatacagtagttgcattactatctaatttatacagcaaacctaatactgaaaccttagttaataagttaagaaatatacaagctagactgtcaagaatttaa

SEQ ID NO: 1116 - DNA, 4218 bp, Psylliodes chrysocephala
atgaccgaatttactttaggatatcgagaagtaattccagatcaaacagttttcgaaaattggcgagaaataacgttgactacaggcggtacacaaagtactcttcaagatataaaagtagctgaaagagcaaatggtttttgttatgaagactccacaaagcaccatactaggaacagattcatctactggagaattaattatgatgtactagaattagtagaacatagtttggatgtaaaccttacagccaatagagttagatacagattcatcgatacgcctattctagatggtgtttctattcacgaaacgtatgaaaacatcatagttttagtccctacagtttgtagtgtacatcgtttgatatttcctcatcccgataggtttcatagacaggatgaattattaggcatccatccagatttagcttcaccttcgatattttctaaagcatcgccagttgatgctagaaatccaaatactttttatgttttcatcaatccaagcactgccaacgaccaactaccgaacatagccagttcgtatttattgcccgaaacggaagaagcctttttcatattggcatatccttcaacggaacttttactgatcaaacagaatccagatagcggtcaagtcgtgtgtaccgagctcaaaggcgaatccttggttcctagatttttcgcgggtatagcggaaaaatttcgacaaagaaattcggatagtgacactatcgtaagtctgttattttatattgttgattacgaaacgtacgtattgacgttaaccagagatgcccatttgaaattttggtcctgtagcaagggtcagtgcgttgctgtcatcgacgttcgcgaaaaaaccgcagataactcaaaagatcgtgttcaaggcgccatattgaggaaagcagtggatggaaatagttctgaaagtacattagcagtgtttttaaactttgcaagcggttgtcaattccacgttttaaatcccgttattaaaggacaagaaattacaatcgaccgagtggcgactgtttattcacccgagaacgaccttatagattttgctcttcaaaccaatcgtttgtggtctttatggagatccgaagatggcgatagtgtcgtatatacggcttcgctaccgttgtgcaagcaatcgggtacttttaagtcgaccagttggacgccggtgattttggaaactatccctgacgccaatcaagctcccgctaatgatggcgattccgattcaagacagatttatttgcaacatattttccatcctggaaggtttcccttgcatattatcagtaaagcgttatcgatttacaaaagatcaacaattttgtcagatgcccaaatatcagcatcggcgttaaaacaaagaatatgtttagcggttgataacgaaatacagaatatgctgaacggagaaaacgtcaacgatgatgaatatatcgattgcgctgattggtgctggcaaaaattttattcttgttgcgttcaataccacatcgcgagtctaaagccgttgggattgatgctcttaccgtccgtatctggcgcggtatttttgaaaaaatctgctttttcgtttttaagacctcttgacggattagagcacatgactctttgtaacgaagaattatacagagatcagttcgtcaatttttcaatgttatcagaagttttagatttagatgcggcagaggatgttatgaatttgtttaaagtaatagtttatctagaccaacaaatcagcgagacgtttaatcaagctttcgaaaaggaattatttaatcttcaagcgccagatgttgtaatggatggtttgttggagaagattcatagcgaaatggattctcagttttcctctcacattttggaaatgattaacgacattagcgacttgtacaaggccatgcacaaagtcctcgaattgttgagatacgaaagcactttagccaatcccgataacgatataaatccggcagccatgtaccatttcagttcgttactcggaacttctgtggtggctgaaagtcttagacagcaaactaaagtcagatttctaatatgccgtaatttgctgttggtgtgcaacgtcttattgaaagaaaaaactttggattggggagttctggaagcggttcgttctgtttgtatgcccgatatcgttgtacttacccaagccagttttgtggtactgtggctaagcggtttgtcaacgcttgtaaatatgccagtcagcgagtcatcattgaacagactgaacccgttaaaattggctcccgtacttaatttgagaccgaccagcacttgtacgtctttgttagagttatttatttgttcgtctggtggacaagaagctagaaaatcgttcgctagagtgtcttgcagcgacgaagctctagcgcattggcatttatcgctgttgccgtatttgaaccacgtcagacacataatctggcccataagcggcggtacggttttagctgaatggctcttggctagcggccaacatgtgtggctccaacagtacgtacgactcttaagcaattggtgcgaatggaacagttgtaccagaaacttcttattagcaacagcatttcttaccactggggaattttacaaagctgaagatttattcgaaacagccgcaaagggtgtttttagtgacgggtttttgcaagaaaggatactaaaaggtatggatgaaagtccatctaaggctttcgtgaattattacttgaaggtcattcaattgttcgagttgcacaaggctagagattgcgttataagcgtagctaatacagcgctgagtatcgtggaacctgatgatccgttggcggccacgctgtattccataaaattcaaacaccacttggcgctcaaacactacgaactcgcgttcgattcgttgtactccaatcccgacgccgaacggaaaaaagacaatttgagagacctggtcaaaactttattagacgaaaagaaactagacactctattgaatttcacttacggcagcatggacgagttcttcgctaacatactcttaaccagagctagagccaccgattcggtcaacaatgttttctacgattttctgtattcctatcagatcaaaaggggaccgctttcctatcgtttagccgcgagcgtgatgtacgaacaagcgttccgactgaaccacgcgaacaacatcgacgcgttggaaaaacaagtgaaatgttatttggcggctaagaatgttttgcatttgtgtcaacccgaacatgcttgggtagttagacctgcggatcccgacgatgaagacgaagaagtcgttttgcaacctttggccggatcgaatcgagaaatgcgagtatttaagctaagaaagcaagtcgaagtggtggatattgagactatacaaaaagaacttatcttctcgagtgccaaattgaaattagctagatttaataccagtactccgattaatataaccagtcctgtggaattagtaacgttattaaatacctctggattatttaaaactgcttttgacatttgtacaacgttctctttggcgtattctcctgtgttcgaaacgctgaccaaacaatgcgtactgttgagcgaggaggataaccccaacgcttggaattggttggtagagaatgatttgcaagatcttccggtgaatcgtgaatccgcgtccgatgtcatttggcagttccttcaggattgtttggaaaaatacgaagaacccaaaatgaccacattacattgcgtggtcgctaagaagataattaatatgaggatatatttgcctcattggcttgtagcttcgtataagatgcgtaatccatcagaattgttgcgattgctgcatacgtctggacggttagaggaagcagtggaattgactaacgaatatattctatcagcgatggggtacggtaaagaatttttcggatttacgcaacctctggctccgacttcgccagctttttgccttccggtgtacgccatccagcggctgatagacgaattaaacatacaaaatgtcaagaatgttgaacgaccatttattcaagaatacaataatttgaagtcgctgtttacgaaatacttggaaaccgcaaccagagtgtccaatcagatgtgccagactaaattaagttccggttctttaaaaactaacgctcccatgataggtataagataa

SEQ ID NO: 1117 - DNA, 2718 bp, Psylliodes chrysocephala
atggaagtgtccgatgaaaatatacaaactttaagcagatacctacaagagacactaaatccggacataaatgttagaagaccagctgaaaaattcctggaaggagtagaagtaaatcagaattatccattgctgttgttgaatttggtccacaaaccggaagcagacatgactattagagtagccggagctgtggcttttaaaaattatataaaaagaaattggtttgtggaggaagatcaaacggatcgtatacatgcaactgatcgtttagcaatcaagaatctgattgttacgttaatgttgagttctccagaatctattcagaagcagttaagtgatgctataagcataatcggaaaaactgattttccattaaaatggcctgaactcataactcaaatggtagaaaaattttccacaggtgattttaatgttataaacggagttttaagaacagcacattctctgtttaaaaaatatagatacgaattcaagtcaaacgagttatggacggaaataaagtacgttttgcaaaaaatagctcaacctttaacggatctattagtggccactataaatttatcgcaaacccacacaaacgatgtgaatgctttgaaagtaatctatagctctttggtgttgatttgcaaagtattctattcgttgaatttccaagatctcccggaatttttcgaggataatattcagatttggatgacgaatttccacactcttctcactgtcgaagtgccaagtttacaaaagaatgatagtgatgaagctggtgtaatagaacaactaaaatcacaagtttgtgataatgtggctctatacgctcaaaaatatgacgaagagttccaaccgtatttgccgcagttcgttacagacgtttggagccttttagttgcaactggcttgcaacccaaatacgatttgctcgtttcgaatgctctacaatttctatcatctgtagccgaacgaaatcaatacagacatttgttcgaggatgacaacgttttgagcagcatatgcgaaaaagttattataccaaatatggaattcaggacatccgatgaggaattattcgaagacaaccccgaagagtatacaagaagagatatcgaaggttctgatattgatacacgtagacgagccgcttgtgacttagtaaatacgctgagtcaaaactttgaaaagcgtataattgaaattttcggtcaatatttacaagtgatgttgggaaaatatacggaaaatcccaagcagttttggagaagcaaagatgctgctctatatttggtgacttcattggttagtagagggtctactcaaaaacacggtgtaacacagaccagccaactcgttaacattacgcaattttgtcaacagcacattttaccagaattggaacgacctgatgtcaacgaactacctgtactgaaagcggatgccataaaatacgtaatgacattcagatcggtcttacccagcgatctcgtggtgtctaccttaccccagttgataagacatattccaagcgagagcgcagtagttcacacgtacgccgcttgcactctagagaagattcttattttaagaaccaacaatcaaccgatcgttacaggtgcacaattagagccgctagctactgaccttctacgcaatttgtttggcgtgttgcaacagccagtttccgaagaaaacgagtacattatgaaagctatgatgagaacgttcgcgaccttacaggaaagggtgattccgtttttgggtgtggctctgccgaaattgacagaaaaattgcagatggtggcaaagaatccctccaaaccccatttcaaccattatctgttcgaaagcttctcgttagccatcaaaatcgtttgcaaagcaaatccgggcgctgttacgtctttcgaagatattctttttccgattttccaagggattttgcagcaggacattcaagagtttatcccgtacgtatttcaaatactgtctttattgatggaaaatacgccacagggaacaatcccggagccctacatgcagctgttgccgtgcctgttggcgccgatattgtgggacagacctgccaatgttagtccattggttagactgctgactgcattcgctactcaagctgctccacaaattgtggcgcaagataaattgagcggatttttgggagttttccaaaaactgatagcgtcgaaatccaacgatcacgaaggattttacctcatgcagggtctgattcaacatttaccgatggaggctctcgctccgtatcataagcagatctttttccttctgttccaaaggctgtcgtccagcaaaactactaaatatgtgataaatctgatagtattcttttgtttgtacatggttaaatactcaccgaacgatctggtatcgttaatagatggaattcaaacgcaaatgttcggcatggtgctggaaaaactacttatagccgaactgcaaaaaattgcgggcgatgtcgaaaggaaaatcgtcgcaatcggcgtgatcaaactgttatgcgaatgtcccgaaatgtatacaggaacgtaccaaaaatactggcctcaactgttacaggtaaaaaaaaaaacaaaatataatacgtttaaacttcctttatttggctcgcacccttgttacaatatatttcctattggtgtgacaaatatcttatttccacacttgtaa

SEQ ID NO: 1118 - DNA, 948 bp, Psylliodes chrysocephala
atggatcagatgcttcctagtccgggtttcagcatacccagtattggcacacctcttcatcaaccagaagaagaccaattaattttaccaaatgctcttcaacaacagcaacaacaaaaccaactccctactagcagttcgcaagtccctccattagcccctatgggtggtacaacacctactctcggtcttggtatgggccatgctatgtctatgcctcataccaaatacgtaacaggctttactttgcctatgagttctatgacacctcaaacaccacaacacaccatgatgagtcctatggttaatttgggtggttctggaccaacaggttctggtgtgacacccaccatgggaccctcgacaccttcgccaatgactcccatgacccctcattcagcagatccaggcataattccacaattacaaaacatcgtgtcaactgtaaacctcagctgcaaattggacttgaaaaaaattgccctacacgcaagaaatgcggaatataatcccaaacgtttcgctgccgtcatcatgaggattcgagagccgcgtacaacagctctgattttttcttcgggtaaaatggtgtgcacgggagcaaaaagtgaagaagattccaggctggctgctagaaaatacgcccggatcatccaaaaactgggattccccgccaaattcttggatttcaagatacagaacatggtcggaagttgtgatgttaagtttcctataaggttggaaggactcgtgttgactcatagttctttcagtagttacgaacctgaattgtttcccggacttatttatcgtatggtgaaaccaaggattgtacttttaatattcgtgtctggtaaagtagtactgacgggcgctaaaataaggcaagaaatatacgaagcgttcgataatatatatccgattttgaagagttttaaaaagcagtga

SEQ ID NO: 1119 - DNA, 477 bp, Psylliodes chrysocephala
atggctgcaattcgtcccatgtctcgcctccttttctccaggtctctacaaaccactgcaagaagaggatatgcagaccaaatgaattttacctttgctgctggaaaccaggtcttttacaatgcaatgtctgttaaacaagtagatgttccatccttctcaggtagttttggtatcttacctgcgcatgttcctactcttgctgttctcaaacctggagtagttaccgtttatgaagacagtggcaaagttaataaaatatttgtatccagtggaacagtcacaatcaatgatgactcatcagttcagattttagcagaagaagctcatcctgtagaaaatttagatgttaatgcagccagagatatccgcactaaagctcaaagtcagttatcatcagcaggcacagatcaggctagagctgaagccgccattgccattgaagtaggagaagcgttggtaaaggctgctgaatag

SEQ ID NO: 1120 - DNA, 984 bp, Psylliodes chrysocephala
atgagtggtgatggtaaacaacaagaacatttcgatacgttattcctatcgatcgcgcaacatcatccccaagggcctacgcagcttttggatacttttgtgaactttttaagtagaaaaactgactttttcactggagcgaaagaaggagagtgggaaaagttggtgttgaacactttcaaaaaatacgaaaaattgagcagggaaaatcacgaggcggaactaaaagaaaaacgggaacaagaagcccgtaaaaaagcggcggctgccaaaaaagcacaagccgaaaccgttaaacctgctcaaattacagaactgacagaggaagaggctgctaagcttcaagctgagcttgatgctaagaataacgtctcttctgctagttcttcgagcacgcctgtaccaactcctccggccccccaaaagattgaggaagacgaggacgaatctgaaaagggcaaattgctgcctaacaaaggaaatggatgcgatctagagaagtatacctggactcaaaatttaggcgacattgagttacgggtacctttaaatgcgagcttcagagtaaaacagaaggatctgattgtgaatatgacgaagaaacacttgacttgcggcattaagggtcaaccgccgatcatagacgatgattttctacacgaaatcaagttggaggagtccagttgggtgatagaggatgggaaaatgttgctattcacttttgaaaaggtgaacaagatgaactggtggagcaaaatagtgaagtccgatcctgagattagcacgaaaaaaatcaacccggaaccgtcgaagttgagcgatttggacggagaaaccagaggcatggtggaaaaaatgatgtacgatcaaagacagaaggagctgggtctccccactagcgacgaacagaagaaacaagacgttttgaagaagttcatggaacagcatccggaaatggacttttccaaatgcaaattcaactaa

SEQ ID NO: 1121 - DNA, 483 bp, Psylliodes chrysocephala
atgatacagtctcctagtggagttgtgcatggatatccgggaacatctattctacagtggagccccgataagaagcacagtgatcgagagagatggatttgcatttatcctgcttatattaacagtaaaaaaaccatagcccaaggaaggaaaattaacaaagaaaagtgtgtggaaaatcccacccatcaagaaataagggacgtattagtcgcagctggtttaaaggttggtgtagaaaataaattgtacagcagagaaaaaagcaaggagctgttgtatcgcggtagaatacgggttcagttgaaaaacgatgataacagtttgtgcaatcccaatttccctactagagacagtcttatgttacatttaggggacatgattcccaaacttaaaagtagactgaataagggaagtggagacccccagccgcaagtcactggcagcgccaagggaaagggaaaaggcaaaggaaggcgatga

SEQ ID NO: 1122 - DNA, 2280 bp, Psylliodes chrysocephala
atgatggaggacccagaacctactaagcgacaaaaaatgcccaaagtggccaaagttaaaaataaggcacctgctgaaatccaaatcacagcagaacagctactcagagaagcaaaagaaagagatttagaaatccttcctccgcctccaaagcaaaaaatttctgatccagcagaattggccgattatcaattaagaaggagaaagcagtttgaagacaacatcagaaagaacagagcagttatttcaaattggatcaaatatgcccagtgggaggaatcgcaaaaggagatacagagggctaggtcaatatgggagagagcccttgatgttgaccacagaaatattaccatttggttgaaatataccgaaatggaaatgagaaatagacaagtaaaccatgcaagaaatttatgggacagggctactgtgcttttgcctagggtaaatcaattttggtataaatacacttatatggaagaaatgttggaaaacgttgcaggagctagggccgtatttgaaagatggatggattggcaacctgatgagcaagcttggcagacctatattaatttcgagctgagatataaagaaattgatagagcaagacaaatttatgagagatttgtcataactcatccagaagtcaaacactggatcaaatatgcccgttttgaagaaaaccatggcttcatccattctgcaagacaaatttacgaacgagcagtacagttttatggagatgattatatggacgaaaagctgtacatagcttttgctaaatttgaagaaaaccagaaagaacacgacagagcccgagttgtatacaaatatgccttggatcacataccaaaagatcaaactaaggaactttacaagacttacacgatccacgaaaagaaatatggagacaggagtggcattgaagaggtcataatgtccaagaggaaattgcaatatgaacaggaaattttacagaatcctacaaactatgatgcctggtttgattatctaagattagtagaaggcgaaggtgacattgatgttactagggagacatatgaaagagccatagctaatattcctccatcaaaaaacaaacaattttggaggagatacatctatttgtggatcaactatgctttatttgaagaacttgaagctaaagattatgaaagaacacgacaggtttacaaagcttgtctggaagttctacctcacaaaatattcactttctcaaagatttggctgctttttgctcaattcgaaatacgccagaaaaatttaacctccgccagaaagatcctgggcatgtctataggaatgtgtcccagagacaagctatttcgaggttacatagatatagaaatacaacttagggaatttgacagatgcagaaagctctatgaaaaattcttagaattcggtccggaaaattgcgtcacttggatgaaatttgcggaattagaaacgttgttaggcgatgcagacagagctagaggtatatacgagctagctattaaccaaaccagattggacatgccagaattgttgtggaaagcctacatagatttcgaaatttcccaggatgaacccaataatgcgagaagaatctacgaaaggctgctagaaagaacttcacatgtcaaagtatggctatcttatgccaaatttgaattgaacaatcaaaccgacgatgacctgaatatacagcttgctagaaggattttcgaaaaatctaatgaaaccctaaaaaatttcccagaaaaagaatctagagtgttgctattagaaaactggagggaatttgaaaatgcttatggcgatgatgatagtaaggaaaaagttaacgccaaaatgccgaggaggatcaaaaagagacagaaagtcatcgatgaagatggtgttgagcaaggatgggaagaggtattcgactacatattcccagaggacgaggccagtagacccaacttgaaattgcttgctgcagccaagaactggaagaaaaccgcagatgaaactgaagaaactatcgaaagcagacctgcgatttctactagtagccaaagagtacgggaaaaattgatggcatctgccaaaaactggaaaaacaagcaaaacgagactgacaataaggagaacgaaagtgaaagggataatgaggatagccaagtccaccaagaagatgaagcgagcaaagatgtagaacagaaagaagatacaagaagcgaagatcgagatagtaaaagtgagggtgaagatggcgatgaatcatcttag

SEQ ID NO: 1123 - DNA, 1431 bp, Psylliodes chrysocephala
atgggaattaaatttttggaagttattaagcccttctgcagtatactgccagaaatagcgaagcccgaaagaaaaatccaatttagggagaaagttttatggacagcaataacgttatttatcttcttagtatgttgtcagatacccctttttggaatcatgagctcagactcggcggatcctttctactggattcgtgtcattctggcttcaaacagaggtacccttatggaattgggtatttcaccaattgtgacgtctggtttgatcatgcagcttctggctggagcgaagatcattgaagttggtgatactcctaaagacagagccttatttaatggtgctcaaaaattgtttggcatggtaatcacagttggtcaagccatcgtatacgtaatgacaggcatgtacggagatcctgccgaaattggagccggagtatgccttctcatcatcatccaactcttcgtagcgggtcttattgtacttttgctcgacgaactcctccaaaagggttatggtcttggttcaggtatttcactcttcatcgctacaaacatttgcgaaaccatcatctggaaagccttctcgccggctacggtcaacaccggaagaggaactgaattcgaaggagccgtcatcgcgttattccacttactcactactagacaagacaaaatcagaggattacgtgaagctttctacagacaaaatctacctaatcttatgaacctcttatccactgttctcgtttttgctatagtgatatacttccaaggatttagagtggatttaccaatcaagagtgcaagatatcgtggacagcattccagttatccaattaaacttttttacacctcaaacattcctattatcctgcagtcggctttagtgtcgaatttgtacgttatatctcagatgttggcagtgaaattccatgggaactttttgattaatctgttaggagtttgggctgatgtaggtggcggcggtccagctagatcctaccccattggcgggttgtgttactatttatctccaccagaaagtgttagtcacattctcgaagatcccgttcacgcatgcctttatatcgttttcatgttgggatcatgtgctttcttctcgaagacgtggattgaagtatctggaagttccgctaaagacgtagctaagcaacttaaggaacaacagatggtgatgagaggtcacagggataactcgatgattcacgagttgaatcgttacattcccactgccgccgcgtttggtggattgtgtattggagctctttcggtgctcgctgatttccttggagccatcggaagtggtactggtattttattggcagtaacgatcatctaccaatacttcgagatattcgttaaagaacaaagcgagatgggaggcatgggagccttactcttttag

SEQ ID NO: 1124 - DNA, 486 bp, Psylliodes chrysocephala
atggctatggctacatctccttcagtggatttaagttcctatagagaccaacattttaagggcactcgagccgaacaagacaaactattaagactttcaacaactttatacgtaggaaatttatctttttatacaactgaagaacagatttatgaactgtttaccaaatgtggtgatattagacgtattgtgatgggcctggataaatacaagaaaactccatgtggattctgttttgtagaatactataatagagaggatgcagaaaattgtttaagatatataaatggtaccagacttgatgacagaattgtaaggacagattgggatgcaggttttctagaggggagacagtatggaagaggcaaaactgggggacaggtgagagatgaatacagaactgattatgattctggtcgaggaggatatggcaaaataattcaacaaaaaattggaggattagatacacaaggatttctgcgttaa

SEQ ID NO: 1125 - DNA, 921 bp, Psylliodes chrysocephala
atggctgccacagtagggcgaatttgtggagtaggtcttttaaaaccgagtaatttgacgacaattagccagaaaagttcatattccacggccaaagactggacatggggcaaaaaagcgcttttagggagcttaggtttggtggcaggtggtacaggagccatactatttgctctcgaccaatctgttaaggcttcggatctagaattacatccaccaaagaatatttggagtcatacagggcttttcagcgcctttgatcatgccagcataagacgaggatatgaagtatataaacaggtgtgcgcagcatgccactcgatgcgtttcatcgcctaccgtaatttggtaggcgtatcgcacacagagttggaagcgaaggctgaagccgaggagcaaatggtagaagacggaccagacgaccaaggcaacatgttcaaacgtcctggaaagctatcggactatttccctagtccttatcccaacgaggaagccgcccgtgcagccaacaatggtgcttaccctccggatttgagttacatcgtctctgctagacatggaggagaagattatattttcgctcttctaactgggtactgcgacgcccctgctggtgtcgttcttcgagaaggtcaatactacaacccgtacttccccggcggcgccatttccatggcgcaagcgctgtacaatgaggtcattgagtatcaagatggcaccccacccactgccagccaaatagccaaggacgtgtccacgttcttgaaatggaccgccgagcccgagcacgacgacaggaagaaaatgctgatcaaagctatcggcatcttcaccttccttatcgccacgtgttactatatcaaaaaattgaagttctcttcgctgaagacgcgcaagatcgaattcaggcccaaagaataa

SEQ ID NO: 1126 - DNA, 1716 bp, Psylliodes chrysocephala
atgttatcgttactacagtactctggaagcagtgatgaggatggcgacacaagcctgaacacagcgaaaaaatcaacaagtgatcccgaaaccaaaattaacccaaaatattctttcaaatcacagcttgcagtatgtgctgctccagaagtagtacctactggtctggatgctgatcaaatgcatattaatttggacacaacagagttatcatataatcccaaatttgatgtattatttgcaccaatactaggccccgtaaatccatttaagactcaacagcaatcagtggacagaaatatgttgtcgggccacattgagcaagctcatgttagtgaatttcaatttgaaaatcaaagaagaacatttactagttatggttatgctctagatccctctataacaaatgatggacaaataaaagttgttggttctacagaagagggtaaggatgtcgatagtgttaaaactgtatttgaaacctccaaaataaggccattagataaacgaaaacgaaagaaaaatgatgatcctggtgatgttgatggttttttgggaccttggggtggttttgtagatgaacagaaggttgccaaacctacagaagaagaacaagctgagttagatgaaataacatccaagaaaaataaaaagggtaaacctaatgaagacaaacctattgaagaaaaatcagtgctgcacattaaagatgcagttgactaccaaggtcggtcctttcttcacgctccacaagatgttggggtcaatctcaggtcagattctcctccagaaaagtgttttctaccaaaatcccatattcatacctggacaggtcattcaaaaggtattgctgctattcgtttgtttccaagaactggtcacctcttattgtctgctggaatggattgccgcattaaaatttgggaggtttataatgaaaggcgatgtattagaacttattatggacatagacaggctgttagagatattaattttaataattctgggaaacagtttctttctgctggatatgatagatatatcaaattatgggacacagaaactggccaggttgtatcacgttttacaagtagaaaaatcccttattgtgttaagtttaatcctgacaaaaataaacaacatttatttgtcgctggtacttctgataagaaaattatttgctgggatacaagatctggtgatattgtacaagagtatgataggcatttaggagctgtgaatagtattacttttgttgatgaaaatagaaggtttgtgacgacctctgatgataagtcattgagagtgtgggaatgggatattcctgttgacatgaagtatattgctgatccaactatgcacagtatgccttcagttacacctgcaccaaatggaaaatggttggcctgtcaaagtatggataacaaaatagtgatattttcggccatgaataggtttaaaataaaccgaaaaaaaaccttcacagggcatatggttgctggttatgcatgttctttagatttttctcctgatatgagttacataacatcgggagatgcagatggtaaagtgtacatatgggactggaaatcaactaagctgtttaaaaaatggaaggctcatgacaatgtctgcattggtgttttgtggcatcctcatgagcccagtaaattgatatctgcaggatgggacggacttattaagtattgggattaa

SEQ ID NO: 1127 - DNA, 807 bp, Psylliodes chrysocephala
atggtgcagaaaaagcccaagaagaaggtgggaaagaaggtagccgcagctcctttggcagtcaaaaaagtcgagccgaaaaaagaagtcaatcccttattcgaaaagagacccaggaattttggaataggtcaagacatccaaccccctagggacttatcgaggttcgtgaaatggcccaaatacatccgcatccaaaggcagaaagccgtcttgcagaaacgtttgaaagtgccgccgccgatcaaccagttctcccaaaccatcgacaaacaaacagccacccaattattcaaagtgttggagaaataccgaccggaaaccgccttgcagaaaaagaaccgactgaaggccaaagccgaagctaaagtggccaaaaaggaagaggccccgaccaaaagacccaacaccttaagagccggtactaacacagtcaccaagttgattgaacagaaaaaagcccaattggtggtcatcgcccatgacgtagaccctattgaattggtgctcttccttcccgccctgtgcagaaaaatgggagtcccctactgcatagtcaagggcaaagccaggttagggctgctggtcaggcgtaaaacttgtgcgactgtcgcccttacccaagtcgattccggagacaggtcgaacttcaacaaactcctggaggtcgtcaagaccaacttcaacgaccgcgccgatgagatcaggaggcactggggaggcggtatcctcggttccaaatccgctgcccgtattgctaaattggaaagggccaaggccagggaactcgcccagaagcagggttaa

SEQ ID NO: 1128 - DNA, 1002 bp, Psylliodes chrysocephala
atggcaaccctaattaaagatgttactttgcaagaaaacattccaacaaatatacttttcgaaaaacatattgattttattaaagaatatggccaaaaagaaagtagcttcgaatatggtatgactgattatttaagggtttctggtatgtactggggcctaacagctttagaattaatgaatgcctcaccgccacatagcatagaagagattttagagtatataaaaaagtgtcaagatgccgaaactggtggaataagtgcatgtgttaaccacgaccctcatattcttcacaccttaagtgcagttcaaattctttgtatctacgacagtctaaaagccattgatgtggaaggagttgtgaaatatataaaaaaattacagttgcctgatggtagttttatgggtgataaatggggcgaaatagataccagattctcgttttgtgctgttgcaacattgtcattattaaatagaatggatgctatcgatgttaacaaggctgttgattttgtagcttcatgtaaaaattttgatggtggttttggttcaagaccactttctgaaagccatgcaggcttaatttattgctgtgttggatttctatctgttacaaataggttagacattgtagatcgtgatacccttgcttggtggttatgtgagagacaattaccctctggtggtttgaatggtcgtccagaaaaattaccagatgtttgctattcatggtgggtgttatcatctctaacaatcttaggaagattacattggattgatggcaatgctttgaaaaaatttgtcttggcttgtcaggacactgaaactgggggttttgctgatcgacctggagatattcctgatccttttcatactttatttggtattacagcactttctttgttaggccatgatactgttcaaaaagttaatcccacatattgtatgccacagcaagttattgatagactacaactgaagcctcaagtattaggagactaa

SEQ ID NO: 1129 - DNA, 2676 bp, Psylliodes chrysocephala
atgaaccaggaaaccttacaactaatccaaatactagaaaaaacagtttcacccgataaaaatgaattggaacaagcctcaagttttctcgagcaagcgtcacaaacgaatctactagaatttataaagaccttatcagatatactacgtcatggtggaaacagtccagtcgccagaatggcggctggtttgcaacttaaaaatcagcttacatcaaaagatccagccattaaattgacataccaacaacgctggctccttttttcagaagaagtcagaaattatataaagaaaaatgtcgttggggcacttggaactgaaaccaatcgaccttcttcagccgcccagtgtgttgcatacatagccgtaacagaactgccccaaagacaatggcccgacctcatagcgacgcttgtcagcaatgtctgtcaaggcaattctacagaaatgcaaaaagaagccactttagaagcaattggttacatttgtcaagaaattgactccgacgtcctagttactcagtcaaacgacatattgacagcgatagttcatggtatgcgatcatcagagcctagcaatcatgtacgtttggcggcaacgcaggctttactcaattcactggagttcactaaggccaattttgatcagccctcggaaaggaattatattatggaggttgtgtgtgaagctacccaatcaccggattcacaaatcaaagtagcggctttgcaatgtttagttaaaattatgtctctgtactaccaacacatggaaccttacatggcaccggcactattcccgattacgttggaggccatgaaatcagaaaatgatgctgtagctttgcaaggtatagaattctggtcgaatgttagtgatgaagaagtcgatttggccatcgaagatacggaagctactgaggctggcaggccacccacacgagtttccagacattacgcaaaaggcgccctacagtacattattcccattctccttcaaaagcttactaaacaggaagagttagacgacgaagacgattggaatcctagcaaagctgccggtgtttgtctcatgcttctcgccacatgttgcgaagatgaaatagttccacacgtgctgccatttattaaagaaaatattaaatccgacaactggcgtttccgggatgcttctctaatggctttcggttcgattttaggcggattggaaaataacactttgagacctcttgttgaacaggcaatgccaactttaatagaactaatgtacgacagcagcgtaattgtgagagacactgcagcgtggacgttcggaagaatatgcgaaattattcccgaagcggcgatcaacgaaactttccttaaaccccttctggagagtctaataaccggtcttaaggcagaacctcgtgttgccgctaacgtttgttgggcattctccggtttggttgaagcagcttacgaggccgccgatgtcaatgaggaaaccggcgctccggatacttacgttttgtcacaatatttcgaatttattatacagagattgcttgaaactacagatagacccgacggagcacaagcgaacttaagaccagcagcctacgaggctctgatggagatggtgaaaaattcgcctaaagattgttacgtcactgtgcaaaaaaccacgatggttattctcgaaagactgcagcaggtattgcagatggagacacatatatccagccacaatgacagatcgcagtttaacgatctccagagtcttttgtgcggtacgctgcagtcggttttgagaaaagtcacaccagaggacgctcctcacatctctgatgccataatgactgctatgttgaccatgtttaattccaattcgtgcaaaagcggggtgattcaaggggtccaagaagacgctcttatggccgtctcaacgctggtggaggtcttaggagagaacttcataaaatacatggacgccttcaaaccattcctttacattggattaaaaaaccatcaagagtaccaagtgtgcggtaccgcagtcggtctaaccggggacattttcagagccctgaaactcaaagtacttccgtattgcgacgaaatcatgacgctactcttggagaatcttagagatcagtccgttcatcgcagcgtcaaaccacaaatactgtccgtattcggagatataggtctcagcatcggttccgaattcaagaaatacctagacgtcgtcttgtccactttagcgcaagcgtcccaggcccaagtcgatcgcaacgatttcgatatggttgattatctcaacgagctcagagagggcgtattagacgcgtacaccggtatcatccaaggattaaaaggagatggaccgactccgaatccggatgttctaattctcgaaccacacattccatttatagttcagtttatcaccgtcgtggcgcaagacactgaacattctgatggcaccgtagcagtagccgccggtatcgtaggagatatgtgcaccgctttcggggctcccatggttcaacttttggatttggaacccatcaatgaaatgttggcacaaggcagacgcagcagagtcaacaggactaagactctagcaacttgggctacgaaagaattgaagaaactgaagctggcgactaccactgctgccgctgctagctga

SEQ ID NO: 1130 - DNA, 1251 bp, Psylliodes chrysocephala
atggaaactattttagaacaacaacgacgttaccatgaagaaaaagaaagactaattgatgcaatggtcaaagaaatgcttcataaaaagaatacatatagagaagccataaactcagaccaccgtcaaaaatatctcctggatcgatatatgacttctacggaaagacttatagatctctatgaagacaaagatggtcagcgtaaagctgaggttgcagctcttacaggaccaaatgagtttaatgaattttacaacaggctgaagcagattaaagatttttacaggagacacccaaatgagataagtgttccaatgtcagtagaatttgatgaatttgcaaaagctagagaaaatcctaatgaagatatggctaatttcgtagaattcactgatgaagaaggttatggaaaatatttagatctgcatgaatgctatgaaaaatatataaatctgaagggaatagagaaactcgactacattacttacttgggcatgtttgatcaactgtatgacattcctaaagaaagaaaaactggtgaatacagaaaatacctgttatgtctcattgaatatctaacttggtttgttcaacgtattagacctttaatggatcttgatgctgatttagaagaacaaattgatcaggttttgtctaattgggatactggtactgttccaggatggccaaaagaaactggttctgctttaacaaatgttggggcccatttggatctttctgcattttcaagttgggaagaattagcttctttaggcttggatagattaaaatctgcccttatggcattgggactcaaatgtggagggactttggaagaaagagctcaaaggttattttcaaccaaaggaaagggttcactggatccctcacttatgacaaagaatagtaaaaataggattactaaagaaaaagaaatctcaagacacagagaattgggtacattagaagctcaaatttacaggttggctgacctagtctcagctcagagagcagccactaaagaaaatgttcaaaggaaacaagctcgtacagatggtgaacgtgatgacagtgaaaatgaagaaagtgaagatgacagtcctgatgaaggagatgatgatgtaccttataatcctaaaaatcttccacttggttgggatggaaaagtaagtgttcacatgggtccgacaatatttgtgagattaatcttatttttttttattttccatcaatataaatataaaatgtga

SEQ ID NO: 1131 - DNA, 639 bp, Psylliodes chrysocephala
atgacgataggaaaaaataataaaatgatccagcacataaactatagggtccgaataacattgcaggactctaggacgtttattggcacttttaaagcatttgataaacatatgaatatgattcttggagattgtgaagaatttcgtaaaataaaaccaaaaaattcaaaagttgaaagagaagaaaagcgagtgttagggtttgttttattaagaggagagagcatagtgtctttaactgtagaaggccctcctccaccagaagaaggacttcctagggtacctattcccggagcagcaccaggtccaggtattggaagagctggaggtaggggaatgcctccaggtatgacaggtgtccctgtaggtcttcaaggacctgtaagaggagtaggtggcccatctcaacaggtaatgacgcctggaggtaggggacaagtctcagcaccaccacaaatgaaccaaggtccacctagaatgggtgggccaccacctggcatgatgggtccacctcctggtatgatgggaatgccgcctcaaatgggaatgggacgtggtggaccgcctccaatgggtatgagaggacctccacctggtatgatgagagggggaccacctggacctccgagaccctattaa

SEQ ID NO: 1132 - DNA, 1290 bp, Psylliodes chrysocephala
atgcgggattctgtatgcgaaataccgaatcacagccgcatactaccccgatacttctgggatactttattacacatttctaacaagcttcagtgcggtgcagtcgttatcatgaatattgaagagtacgttatgttatggtatatatctaataaaaagaaaaaacttaaaagaagacgaactctgtgggttcatcctatggtagaattaagggaagctaagggaacatataatttacttcatcaagatttattacaagacactacaaagttttttaattattatcgaatgtctccacaatcatttgaagagttgcacaacattttaaaaagtgaattaaccaagcaagatactacaatgcgtagaagtattcaatcaagagaacggttatctataacattaaggtacatagcgactggatgttctctaactgatttacattacacctacagagtgggaatttcaacagcaagtgaaataatacagcacacatgcaagctaatttggaccaaaatgaaagagcaatgtatgccaaagcccacaagagaaaactggttggaaatagcacatggtttttttcgaaacgccaattttccccattgcgtgggtactattgacggtaaacatattcgagtgataaaaccacaacaaagtggatctttgtattttaattataaacattttttttcaattcaactcttggcaatgtgcgattcaaactattgttttacgtttgtggatattggggattacggcaaaaacagtgattcaagtatttttaaaaattcggatctttacaaaaagttatcgacaaaaaaactaaaccttcctgatcccgactttttaccagaaaaggatgactgtaaaatcccctatgttattattggagacgaagcgtttggcttatcgtttaatgtaatgcgtccatatggtggaaaatttttgccaatacagaaaagaatttataattacagactatctagagcacgaaggtatattgaatgtactttcgggatttttgctaacaagtggagaatattccatcgtcctcttaacgtgtctattgagtttgctgaagatatagtgaaagcctgtactgtacttcacaactttgtgcgaatacgcgatggatacagacacgaggatacgttatcctacgaaggagtttatgacaatgaagtcgcggctaccgaggcataccctgctagaccagcaattgttatccgtgactattttgctgagtattttatgactactcatgcattaccttggcaaaataactttatttaa

SEQ ID NO: 1133 - DNA, 15819 bp, Psylliodes chrysocephala; identical to SEQ ID NO: 1110

SEQ ID NO: 1134 - DNA, 900 bp, Meligethes aeneus
agcaaatattcagattcgtcaaggagaaaagatgaatcaagcaaatattcagattcgtcaaggagaaaagatgaatcaagcaaatattcagattcgtcaagaagaaaagatgaaaagaggtctcgaagcagatcaaggaacagacacaaaaagtctaaaaacagacgcgattctcatagcagcagcagctcggattcatccaacagcagtagcagcagtagttcagataacagtttaaaattattggagaaattaaaggaagaacgtctaaagcaagtagatgccaaaaagaagcaaaaagagttgcttaaagccacagaaacagcaggggaaaaaagattgagacggttgttaaaaaagcaagcgaaagaaagaagcagaaaggagaaaatgggctgggacaatgaatatttgcactacaccaacagtgataacccctttggagatggcaatctactctctacttttgtgtggaacaaaaaattgtccaaagaaggcctcacaggggtcagtcatgaagaattggagactagaaataggttcaaacaggaagaaaacaaaagggagctggaaaaggttaagaagaggaggttggagagggaattggaaaggcagaaaagggaggaggaaatgggaatgttgcagaggagcaaagaggcagcacaatttgaagagtgggagaggcaagaggataactttcacttggaacaagccagactaagatcacatataagaatacaagatggcagagccaaacccatagacctcctcgccaaatacataagcgccgaggaggaggtggacgcggtggaaatgcacgagccgtacacctacctcaacgggctgcacatcaaggacctggaggacctcgtcgaggacatcaaggtgtacaaggaactc

SEQ ID NO: 1135 - DNA, 1224 bp, Meligethes aeneus
atggataatttagaagcaaatattatggacaagtccatgagatcagtgtttgtggggaatattccttatgaggccacagaagaaaaactaaaggatatattcggggaagtgggtcaagttttatcatttaaacttgtatttgatcgtgaaacaggcaaacccaagggatatggtttctgtgaatacagagaccaagaaaccgccttgagtgcaatgagaaatctgaatggttatgaaatcggcggtagaaatctcagggttgataatgcttgtacagaaaaatccagaatggaaatgcagaacttgttgaatcaacctcctgttgagaatccttatggagaaccgattcaagctgaaaaagcccctgaggctataagtaaagctgttgccagtttacctccagaacagatgtttgagttgatgaagcaaatgaaacaaaccatacaaaacaatccaactgaagccagacaaatgcttctgcaaaaccctcaattagcttacgctctactccaagctcaagtggtaatgaaaataatcgacccccactcagcagtgactctactgcacccttcaaaccaagtaccgcaaactttgatgcctggagataagataccgcacattcccataaaccaaagttacgcgacgcctttaccgacccctgtacaggctcccaggcaggattttcaacctgtaccacctccgattatgcatcaaaacaatcaacctgtctttacaggtcaagatgtggacttgagatcgctggatccaaggggcggttcagatccaagactaacaagagggatgggggatcaagacatgaggactttgcctgctccattggccaatccattgcctccggtgggcgaaggatttaacagggatcccagggggtccacagccagttttccgaacgaccccaggcagcaatctcaaagggtcgaccccaggcaaaaaaatataccacccccacaaatgccaccccaaccaatcagaccgcctccacaggcagtgccagctccgcctccagtcccatcaagggcacaaatttcccatgctgccaacagtccaaatattgggcctgctggggcgtcagaccaagaaaaggctgccctcatcatgcaagtcctccaattatccgacgagcaaattgcgatgttgccacctgaacagagaaacagtattttggtgcttaaagaacagatcgcaaaaagtgcacatcgctaa

SEQ ID NO: 1136 - DNA, 1245 bp, Meligethes aeneus
gccgtctacgttgatttgccagtcatcgtcggtttgctaataaatttgtcaaatttgatattaaaaatgtcccaaatggagcctgaacgtgaaaagggccttcaagattatagaaagaaattattggaacataaagaagtggaatctcgcttaaaagaaatgagagaacaattaaaagatttaacaaaacagtatgataagtcggagaatgatttaaaggctttgcagagtatgggccaaattgtaggggaagtcttaaaacagttaactgaagaaaaattcattgtaaaggcaacaaatggtcctcgttatgtcgtggggtgccgcagacagttggacaaagctaaattaaaggcagggacccgtgtagctttggatatgaccactttaaccattatgagatacttgccaagagaagttgatccgctagtctacaacatgagtcacgaagatccaggagatgtaacttattctgctattggtggtttatcagaacaaatcagggaattgagagaagtcattgaacttcctttgttgaaccctgaattgtttatgagagttgggattactcctccaaaaggttgtttattatatggaccaccaggtactggtaaaactcttttggccagggctgtagcctctcaattagatgcaaacttccttaaagttgtatctagtgcaattgttgacaaatacattggagaatctgccaggcttatcagagaaatgtttaactatgccaaagaccatcaaccttgcattattttcatggatgaaattgatgctattggtggaagaagattctctgagggaacatctgccgatcgtgagatccaacgtaccctcatggagctgttgaaccagatggatggttttgattctcttggtcaggttaaaatgatcatggctacaaatagacctgacactttggaccctgctcttttgcgtccaggccgtttggacagaaaaattgaaattccacttcccaatgaacaggctagattggaaattcttaaaattcatgctggtcccatagccaaacatggtgaaatcgattatgaagcaattgttaagttgtctgattctttcaatggtgcagatttaaggaatgtttgtactgaggcaggtttgtttgcaatcagatcagaaagggaatatgttgttcaagaagatttcatgaaggctgtaaggaaggtggcagacaacaagaagttagaaagcaagttagattataaaccagtataa

SEQ ID NO: 1137 - DNA, 567 bp, Meligethes aeneus
gatatggtgtgcagtgtggctggcataacatcagatgccaatgtgctcacaaatgagctccgtttgataggccaaaggtatttgtttcaatatggagaatcgattccctgtgagcaattggtatcgtggttgtgtgatgtaaaacaagcttacactcagtatggtggaaaacgcccatttggagtctcaatcttgtacatgggatgggacaaacattatggatatcagttgtatcagtcagaccccagtggaaattacagtggatggaaagcaacttgcattggaaataacagtgctgctgccatatccagcttaaaacaagaatacaaggaaggagaaatgaccttaaaagatgctaaatcattggctgttaaagttttaagcaaaacactggatatgaccaaacttacttcagaaaaagttgagatgtcaactctaacaagaaaagatggcaaaacttttattaatatcctagcaggcacagaagttgaggctcttataagcgaattcgaaaaaactgaagctgcagctgctgaagcttctagaaaggaaaaagcaacagcttag

SEQ ID NO: 1138 - DNA, 2676 bp, Meligethes aeneus
atgagtgagacaaagtcagaaacaccgaaaatagagtccaaaaaggagaccgaggacgataagaatgatttgtctgaagaggacaaacagcttcaggatgagttgaatttgtgcgttgagaggcttcaggagaataatgctggtctttatatggcggcccttcaggctttgtctagtcatatcaaagcctccacaacctcaatgacttcagtaccaaaaccccttaaattcatgaagcctcactatgacaccatgaaagctatttatgaaaaaataactgatgctgaagtaaaaaaagtatgtgccgatatcatatcagtgcttgctatgacaatgggggagaatagggagtgccttaaattccgcctgaagtcagaaatgaataaaatcggcgagtggggtcatgagtatgtcagacatttggcaggagaaattgctagtgaatgggctgaaactgatttaactttcgataaaggtttaagggagaatttaattttactagcaaagcaaattgtgccttacaatatggcgcataatgctgaggctgaagcatgtgatttgctgatggaaattgaacgtttagatcttctcgacgaatatgttgatgataatatctatcctagagtttgcttgtatttaactagttgtgtgccctatgtggctgatccagaaaatacaactttattacaaactgcattgttattgttccgtaaatttaaacaatatccacaagctttaagattggctatgcagttaaatgatcattctttgattgaagacatctttattacctgtcctgatactgctgtccaaaagcagttggcctacatgctgggcagacagcaaatctacatcgaaatccccgataccactcccgaatacgaggaccttatcgaaataatggcgaattgtcacttgaacaatcatttcctgaatctggccagagagctggacataatggagccgaaaactcccgaggacgtgtacaagtcgcacctggagaacagccgaccgcaattcggcggcagtcaagtggactcggcccggcaaaacttggcggccagtttcgtgaatggtttcgtgaacgctgccttcggtcaggataaattgttgatggaggacggtaacaagtggttgtacaagaacaaagagcacggcatgttgagtgccacagcctccttgggtttggttttgttgtgggatgtcgatggtggtttaacccccatcgataaatacctgtactcttccgaggaccacatcaaatccggtgccctgttggcctgcggtatcgtcaactgcggggttagaaatgaatgcgacccggcattggctctactatccgactatgttcttcaccaaacgaacatcatgaggattggagctatagtcggtttgggtttggcttacgtcggctcgaaccgcgaggccgttttgagtttgctgttcccagtattcagcgacccgaaatccaacatggaggtcatcggtatggctgccttggcttgcggcatgatagcagtcggttctgccaacgctcaagtcaccaccaccataatgcagaccttgatggagaaatccgagactgaattgaaggacacttacgcgagatttttgccgttaggcctcggtttgtgccacttgggcaaacaggagggagtcgacaccatcatagccgctttggaggtgattccggagccgttcagatccatggcgaccaccatggtggatatttgcgcgtacgccggcaccggcaacgtactgaaagtgcagcacttgctgcacatttgctcggagcattacgaagccggggacaaagaggaagccagaggtaaccaggataagaataaggataaaacgaaggagaaggaggagaaggataaggatctgtcgtccaggcaggccatagcggtgctcggtatcgctttaataagcatgggagaagacatcgggggcgagatggcctaccgcaccttcgggcatttgctcaggtactgcgagcctgtgatcagaagagccgtaccgctagcgctcggcctcatctcggtctcgaaccccaagttgagcattctggacaccctgtcgaaattctcgcacgattccgacgccgaggttgcgcacaacgccatcttcgccatgggcttggtgggcgccggcactaacaacgcccgcttggccgccatgctcaggcagctggcgcagttccacgccaaggatcccaacaacctgttcatggtcaggattgcgcaaggattgacgcacttgggaaaaggcacgttgaccttgagcccttaccacagcgacagacagctgatgagccccgtagccgtggctggacttatggctactttggtcggatttttggacgtcaaaaatattatattgggacgttcccactaccttttgtacacattggctgctgcgatgcaacctaggatgcttgttacttttgatgaagatctcaacccattgccagtgcctgtaagagtaggtttggctgtggatgtagttggccaggctggcaaacctaaaacgattacaggcttccaaactcacaccacaccagttttactagcatttggtgagagagcagagctggcaactgaggaatacctagcattaactccgattatggaaggattcgttatccttcgaaaaaatccagactttaatccttaa

SEQ ID NO: 1139 - DNA, 990 bp, Meligethes aeneus
gacttagacagttacaattcagaaaggttcgctggaaacaccgtggtgactttggttggcaattctgaaaccatcaatgaattaccaacaaatgtttacgtgaatttggaaagtgtcaacggaaatatggattacagtgcgaattacatcattccaaataactacgatgaatacagtatagagaattcttcatcccctcaagcttcgtacttgttgaatagagatccaaacatggctgcagcttcaatcagatattgcactgaacctgaaggtccatatgcaggtggtgctgtagtgcaaaacccaggtggccacatcgcgcaatacagcggtcagcaaaactaccacatcagctacgctcagaactggactcctcagtcgcagtcagcttcagtttacaacggtccgggtcagatgctggcgcaagccgacagcacgcagttcaacggttacgccaatggcggcggaagcagtggcggcctaaacgagggggcagggacatcgtcaaacccacaggaattaatatcaccaaatagcaacagaagaagtggagtaaattgtgcgaattgtaagaccacaaatacaacgttgtggagaagaaataatcaaggggaaccagtatgtaacgcatgtggactttacttcaaacttcacggggttgtaaggccactaagtatgaagaaggagggcatccaaacaagaaaaaggagaccaaagaatacctccagctctgggccgagctcttctatagttcaccattcttctaggctgggcacacccgcacaacactacacatctccatatcctttacctacagagatacaagatggatacgaattaccccatccaatgaattattataatagggtaaatactcaaagcgagtcatatttacgtgttactccgcatgaagaggactcttctgttataacttcgacttctcaccaccaaaactaccaggatcaaatggatgaagaagatggacaatga

SEQ ID NO: 1140 - DNA, 5016 bp, Meligethes aeneus
attgaccaaaccagaaataaaagaaaaaagtcgtcatttcggaaaaaagataataaaaatgctgaaatagaacaagaagtagctccaaaattaaaaccagaaaatcctgcattaaagtccaaccctttagcaacaaccccaattacaccaggaggaaatattgtcgatatgcaaggctcaatttcacaggaaaccactgaaaaagatccaactactataaatacaaattcagaacaatcaaatttagaaaactcatctcccgtggatcaacaaattgaggatgaagaaaggttaaattcgttaaaaacgtcaaccgaagaaatagttgaatatcaattaaaatcaccaaccaatgaaaaacaagaccctgactctctagatgctaaacaaattgaggatactccggatggttatgcaaccagcgaagcaaaccaagaatacgtcaaccaaagaggaatcagattcacgcctcaacttcaagatgaagttacacttcttccttatggattggcttgcgtaagggaacttttaaggtttttgattagtctttgtaacccactagacaaacaaaacagtgatataatgattcatgttggtttgactctcttgacttgcgcatttgaagtgggatctgatagtataggaaagtattccactctattggcccttgtcaaagatgatttgtgcaggaatttattttcgctccttaacaccgaacgactatcagtcttcgcagccgaccttcaagtctcatttctcatgttcgaatcgctacgaactcacctgaaattccaactggaaaggtacctcacaaaactgatggaaatagtgatgagcgactcgcccaaggtcacctacgaacacaaggagatcgccttggacaacatcttgcagctgtggcgcgtgcccggcttcgtgaacgagctgtacttgaactacgactgcgacatgtactgcacgaacttgtacgaggacctgacgaagttgctggcgaaaaacgtcctgtcggccaccgcgggggtctatcagacgcacctgttgtccctggacgccctgctcacggtcgtcgacggtatagagttgcattgcagacacaaacaggacgactcgagcaacggtagcgactttttcaacagcagcgacggcagtttggcggctaagagaggtagaatcagggtttcggatcgcgtgcccaccatagaggagctgcatgcgaaaaagaacatcaaaaagtggcttccgcaaggcacagaatactttaattccaaaccgaaaaaaggcatccaattccttcaagaacacaacgtcctaaaacacgatctagacatcaacgaaatcgcgatgtttcttcgcgaaaaccctgctttggacaaaaaaacaatcggcgagtacatcagcaatagaaacaacctcaacattctcgaagccttcgtgaacactttcgatttcaccgacactagaatcgacgaggcgctgagaagttatctggagacctttaggctacccggggaagcaccgactatctccctgattttggagcacttttctgaacattggcataaaagcaatggggagccgtttgcggacgtggattccgcattcactttggcgtacgcggtgataatgttaaacgtcgaccagcacaatcaaaacgccaagaaacaaagtctaccgatgagtgctgccgcctttaagaagaacctgaaaggtgtcaatggtggaaacgatttcgacggcgatatgctcgacgaaatatacaacactattaaaaacgacgaaatagtgatgccggccgagcaaaccggcctggtgaaagaaaactacctatggaaagttctattgaaaaaaggccaaacgaaagacggcgtctacatccacgtgaacagcggcacctacgattccgaactctttcaattgctgtacggacccatagtggccgctctatcgttcgttttcgaaaagtccgaaatacccgggtcgtacaagaggatcctgcaaggtttcgagaagtgttcttttatatcggcgcattataatttgacgaggaatttggacatgttgttgctgagcttgagtaaattcacgatgttccataatcagcagaggttgaataatatcacgttgcaattcggtatcaataataaagcgcagttggcactgaagagcgtgttttctttgacgcatcaacatggcgatagtattaggcagggatggaagaatgttttcgacttgattttgtctttgtattgcaataatttgctgcctaaaacatacgtggaagccgaggattttatagagccgagcgggaagatcaacttaactttcgaggaggtggaaagtttgcagaagcaggataccgggttgctgagttctttgtactcgtacatggtgtctgcggaaaatttatcgaaaattccctccccggaagaacagcaatgcatcgatctggctaaagagtgcatcaaagattgcaacttggaacagttggtgaccgattccaagtttttgcacgaagaggctttgctggagttggtcggagctctgatggagcaatccagaggccccgacgtgcaaaaatccttgtacaacagctacaacgaaaacgtcacggtgttcttcctggaactgctcgtcaagatcgtgattcagaaccgcgaccgcgtcgtctcgatatggcgaacggtgcacgaccacctctacaccatcgtcatgaacgcctcggtcttcgactaccagtatctgctcgagcgggccgtgatcgggctgcttcgcgtcgccatccggctcatgcgcaacgaggagatgtcgccgatggtgctgcagtcgctgcgcatgctgctgctgctcaagagcaccacgatctgccggatctccaggcagatttccttcggcctctacgagctgctgaagacgtccgcgcagaacatccacaccaatgcggattggacgatcgtttttacgttgctggagtgcgtgggggcgggcgcgcagccgcccaagcccatagccgaagacaatcaagttgatcaaggaacgaaatccgacggcgaaaaccaactagcaagcgatgaagaagcagcggcaacgtcgacagaccgaggctacacctcggattccgagctggcaaaaagcccgaaacacgcggcggcccaaaggtcccatagcccacccggcgtaattgccgcgtcgccagtgggaactcccaacacaggcggatggattttggtcggcaacgagggggagattcagcccgtggtcggccgaactgtgcctccgacgcagtacggcctgtcgttggagaggaacttgggtccccacgacccgagcagcttgatcaaatgttgcgaaagtttggcgtttttggtcagagatgtcgctcacatcacgccgtataattttgacgtttgcgtccattgcatcaggacgtttgtcgaagctagtctacacggatgcaaacacaacaaaaaaagtcgcgagggaagaccgcgacggaaaaacccgaacaggaaacgccaggacctgtacaaatcccggaaaagcccgaccagcagtccggaggaggaggaagaagaggcgagcgacgacgacgccctacccaccggctaccatcaaatatccatccagctgctggacctgatgcacacgttgcacacgaggaccgcgcagattttcaagtggtgggccgaggagggcggcgagatcgcccaggagacgtcgctgtggacgcagggctggtgccccttactgcagggcatcgcgcggttgtgctgcgacgtccggaaaccggtcaggatgagcgccatcacgtatctgcagagggcgctgttggtgcacgatttgcagacgctgagcgggccggagtgggaggcgtgcttccacagggtgctgtttccactactgagatatctattgcaaccactcactcctaaagagcccatggctatggaggagaccaggatgagagccgcgactgttttatctaaagtttttctgcaccacctaacaccactgctatcccttccaacattcttcaatctttggctggtaatcttggactttatggagaaatacatgcacgcagacaagagcgatctgctctacgaagccataccggaatccttgaagaacatgctgctcgtaatggactccgcgaaagttttcgacgcgccggacggccacaagagtcacctttgggcggccacttgggagaagatcaacaccttcttgccgcgtatgaaggacgatttgttcagggagatcaaccagggactggcccaggaacaaatgcaactgcagcaggaaatccccacagaaaccgtagagattacaaaacctgtgcaatacaacatagaaaatgcgaccagaaccagtataattttacagccgcccaccacgggccaacagcaagtttcatcgcatttattcgctcacttaggacagatggtctcgacgccgatcggtccgtcgtacgacgcgccggcagcaccgtaccgccctctaccgccgccggtcagcatcgcgccgctggtggcgccacctctggtgtcgaactcgcctttactgccgccaaatcaaacgacgccgatcattcagccgcagccgtcttacatgtcctcgttctacgccggcgccgccaactcgacgtcgacggcgggtcacactttcccggtgctgtgcggcaacgcggcggtgttgccgccggcggcggccaccgaggtgcaacccgtctcgctgttcaccgactacgtcgtcaatccgtacaacgcggcatcgacggacctgaacgaaaacgccgccgcccaaatcggcggcggcggcgtttcgaacaacaacgggtcgacgcagaacattttccagtcggcgaattactttcagagcggaggtaataatattataccggtcgggtcggaaatactgtacggcattgatgccaccgcccccactaacaataccaataacattccagttgttacagctacagataacagggacaccagtagaagcactgaagtttag

SEQ ID NO: 1141 - DNA, 399 bp, Meligethes aeneus
tacgagctcaaagaaaacaggacgatgactccagaggtgtttggagcaatgttgtcgagtatgctctatgagaagcgtttcgggcccttcttcgtcgagcctgtgatagcagggttgcatccgacgactaatgaaccgtttatttgcaacatggatttaattgggtgtattaatcaacctgatgattttgttgtcggtggtacagcctcggcacaactttacggtatgtgtgaagctctgtgggagcctaatttaggccctgaagatttatttgaaacgactgcacaggctttaattaatgcttttgatagagatgctatttctggttggggagcaacagtttatatcattgaaaaagacaaggtgactgtaagagatatcaaaacacgtatggattaa

SEQ ID NO: 1142 - DNA, 2811 bp, Meligethes aeneus
atggaacaaaaaccagccattgatttggttttattggccgtatcttcactatacaacaatccaaatacaactgaaaaagaaagggcctcgcaatggctaggagatctacaaaaatccgtccacgcgtggacggtggcggacgaattgctgcatcacaaaagagacttggagtcgtgttacttcgctgcccaaacgatgcgctcgaaaatacagcaatcctttcacgagctacccccggaagcgcactcctctctgcgagactcccttttggagcacattgcccaaatcaacgaacaaaccaacacgatcatcgttacgcagttgtgcgtcgctttggccgatctggcgctgcagatgcccacctggccgcgggcttcgctggacttgatcaccaagttctcttccaccaacatgtggccgcttttagaaattttgactgtgttacctgaagaattagaaaatagatctgtgaggctaggcgagaacaggcgactagacgtcctgaacgacttcaaaagttgctcgacaacaattttagagtttttaaagcattgcgctaacacctacacggataactcgcaagaaaacgtgcaggtgaacattaaaatcctacggtgtttcacttcgtgggtttccgtcggcgccttcgagctctccgagttgggaaacaacatcgtgatcaacagagcgttcggtattttaacctacaaacctgagggggagaaacagactgttgggggcgcgctgcacagcgccgctactgattgcatttgcactctattgcaatgtttggaggataataataaccagcagatactggagacgtacttgtttaataacgttattaatttagaggtggcataccacatgtctgtagccaacgaagatcaggataagtccattaattactgtagggttttcaccgagttggccgagtcgtttctggaaaaaatcataatgaatagcaacaataaatcgcaacattacgcgatgaaagttctagatttagtgctaatttgcgtggggcaccacgattacgaggtagcagaaataactttcaacttgtggtacgttttgagcgaggatttataccagaaaaacaacaaggaaattaccgaaatgtttcgaccttacgtcgaacgattaataacggctctatgcagacactgtcaaatggagccggatcacgaaggtttgctggaagacggagacgattttaaagacttcaggctgaaagtatctgatctaatcaaggatgtggtgttcatagtagggtcaagcagttgtttcagacaaatgtttatcaacctgcaaacgcctggagtcacgtgggagtccagcgaagctagtctatttgttatgcaggccgtcgccaaaaatatagtacctactgagaacgaggtggttcccaaagtggtcgaagctatcctctctctgccggaaacaacgcacatttccgtgaaatacacctcggttctgctgctgggcgagctgtgcgagtggatagaaaagcacgccaacacgttggaccccatcctgaactttttggtttgctgtttgccgcagcagggcattggcgctgctgctgctatagccctgcaaaacatctgcgcgacctgcaacgatcacatgcctcgacatgttccgatcatgttgcagcttttgcatcaagttgatacgtttgccataaccaacaacgcagtcataggattacttaaaggtgtcgcctctataataggttgcatgaacccgcctgaactaaccaccgctcttagagaattatgttcgatgcaaatgaacccgatctgtcagcttatagagcaagacgtggttcctgtaaaaggcaccaaaaccgaccctgtactctggttggatcgactcagctccgtacttaggcacatctgctgcaagaacaaccaaagcgatggtcctcatccgtgcaaagaggtagttttggagatatggccgattttatcgcgcacttttgataagtacgactccgatctgcgcataatggagcgctgttgccgcagcgttcgctttatgctgcgctgcgtgagccagcaggtgcgcgagatattggagagcttggtggggcaaatagtgcgcatctactcgcacttcaagcattcgtgttttttgtatgtcggcagcattttggtcgatgagtacgccgctgatgccagctgcgtgcaagggcttttggacatgttgcacgcttttatcgagccgacttttctagttttgcaggaagagaatggtttaaggatgcatccagatactgttgatgactttttcagactgtgcgcccgttttctgcagcgcgcccccgtggcgttcctgcagtgcccttcgttggtgcacatcctgcagtgcgcacttttagcctcctctttggaccacaaagaggccaacatgtcggtgatgaagttcttctacgatttgatcaaccaggcgcagaccgaccggtccaaggccgactacaagcaacgcaaggacctcgtgcatcgcgttttagaagagtacggccagaatttggtcaacaatttgctgcacgcgtgcgtcttctacctgcactcctacatgcttagcgaggtggctgacgtgtttgtgcaattattagattttaacagagaaacaactggaaaatggctggcaaatggtttagatcagttgccggtgcaaagtaacggtggtatagttacggcaacgccgcaacaattgaaagatatacacgcatctattacgagatctgacacctcaaaatcggtaacacacgctttaaaagaattaacccgactgtaccgttag

SEQ ID NO: 1143 - DNA, 750 bp, Meligethes aeneus
gacggtttccaggtgaaaagacccggggacaaaaacgtgcgttgcaccattctcttgttgctcgactatcagccgttgcagttcaagctggaccccagattggcccggcttctgggcgtgcacacccaaaccagacccgtgatcatttccgccttgtggcagtacatcaaaacgcaccgattgcaggacgcgcacgaaagagagtacatcgtgtgcgacaagtacttggagcagattttcaactgctcgcgcatgaagttcgccgagattccgtcccgcttgaacccgctgctgcacccgccggatccgatcgtcatcaaccacgtgatttcggtcgaaggcggcgccgagagcaagcagaccgcctgctacgacatcgacgtcgaggtcgacgacacgctcaaaacgcagatgaacaacttcttgctgagcaccgcgagtcagcaggagattcaagggttggattcgaagattcacgagactgtcgacaccataaatcagctcaaaaccaacagggagttcttccttagttttgccaaggatcctcagcaattcatacacaagtggatcgtctcgcagaccagggatcttaagaccatgacagacgttgttggtaaccctgaagaggagcgcagagcagacttcttctatcaaccttgggcccaagaagcagtttgtcgttacttctacaccaaggtgcagcaaaaacgcgctgaactcgaacaggctctcggttttagaaacaattaa

SEQ ID NO: 1144 - DNA, 471 bp, Meligethes aeneus
atcaatcgtttttgttgttttttggagttcataacgatgccaaaagtgagaagaagcaaaaaatcgcctccagagggttgggagttaatagaaccaactttggacgagctggaacagaaaatgcgcgaagctgagactgaaactcatgagggaaaacgtaaaaatgagtcgctgtggccgatattcaaaatacaccatcaaaaatcgcgttatatattcgatttgttctacagaagaaaggctataagtagggagttgtacgattattgtttgaatgaaaatatagcggataaaaatttgattgcaaagtggaagaagcagggatatgaaaatttgtgttgcttgaggtgtatacaaaccagggataccaatttcgggacgaattgcatctgtagggttccgaaagggaagcttgaagagggaaggattgtggagtgtgttcactgtggatgcaggggctgttccggttag

SEQ ID NO: 1145 - DNA, 1065 bp, Meligethes aeneus
atgaattttgtgcattctgatgtcaaaacacaggggaaaaaagttagcgaagagaatatttggaataccttagaaataactaaggaaaaacggagccctccatatcacacagacattatatgggtgcagaatccattgcagcaacttattaataacgaattgcagcgagatatgccggcagctacactagacattttaggtagcatacaacatcccaataatgaggagtgtggcatcagggatgtttgggcacataacttggaggatgaatttcgaaccattagacagattgtacaaaaataccaatatgtagccatggatactgaatttcctggggttgtagcaagacctataggtgaatttagaagttctgccgattaccaatatcagatgttaagatgtaacgttgatttgctcagaatcatacaactggggctcacatttcttgacgataatggcaaaacgcctggaggctcttacaccacgtggcagtttaactttaaatttaacctgcaggaagacatgtatgcccaagacagtattgatctgctaacaaactccggtatccagttcaaaaagcacgaggatgaaggcatcgagccgctggaattcgccgaactactcatgacatcgggtatagttctgatggacaacattaaatggttgtcgtttcattcgggttacgattttggttacctgatcaagttgttaactgataacactttgccccaagatgaaaacgaattttttgatctcttgaaactgtactttcccaccatatatgatgtgaagtacctgatgaagtcttgtaagaatttaaaaggaggtttgcaagaagttgcagagcaactggaccttgaaagaataggcccccaacatcaggctggatctgattctttattgactggaatggccttttttaaaatgaaagagatgttctttgaagacacaatcgatgattcaaagttctcaggtcacttgtacggtctaggaacttcgttcgccgtgaacggaacttcaaataactacgcgaccgacaacggagacacgacaaattcctcgtga

SEQ ID NO: 1146 - DNA, 1161 bp, Meligethes aeneus
gaaggcatcattgagtcgaactgggaagaagttgttgacaactttgatgacatgaacctgaaagaggaactcttgagaggtatctatgcatacggttttgaaaaaccttccgctatccagcaaagagctattattccctgcattaagggtcatgatgtcattgcccaagcccagtctggtactggtaaaacggccaccttttccatttccatcctccagcaaatcgacacctatgtgagggaatgccaggctcttatcttggcccccacaagagaattggcccaacaaatccaaaaggttgtcattgctttgggagacttcatgtccgcgcaatgccacgcctgcatcggcggcacgaatgtcagggaagacatgaggaaattagagactggagtgcacgtggtggtgggaacccccggcagggtgttcgacatgataacgcgaagggcgctgcgcacgagccacatcaagatgttcgttctcgacgaggccgacgagatgttatcgagaggtttcaaagaccagattcacgacgtttttagaacgctaaactcggacgtgcaggtgatcctgctgtccgccactatgccgcaggacgtgctcgacgtcaccaagtcgttcatgaggaacccgatccgtatcttagtcaagaaggaggagctcaccttggagggtatcaagcagttcttcgtgttcgtcgagcgtgaagattggaagttggagactttgtgcgatttatacgacacgctgtcgatcacgcaggccgtcatcttctgcaacacgcgccgcaaggtggactggctcaccgagaacatgcacaagaaggacttcaccgtgtcggcgatgcacggagacatggagcagagggagagggacgttattatgaggcagttcaggacggggtcttcgagagtgctgatcaccacggatttgctggccagaggcatcgacgtgcagcaagtttcgttagttattaattatgatttgccatccaaccgtgaaaactacattcacaggattggtcgcggtggacgtttcgggcgtaaaggcgtggcgataaactttgtgaccgaggaggacaagcgcacgctgaaagatatcgaacaattttacaacacgaagatcgacgagatgccaatgaacgtggccgatctcatctaa

SEQ ID NO: 1147 - DNA, 669 bp, Meligethes aeneus
atgaccgcccccagtgccgccggtgatgcaagcaaaggaagaaatgtcgcctacaaggacaaaagcaaacccggagatgtcaggagttctaatattaatgccgccaaagctgtttgtgatgccatcagaacaagtttgggccccagaggaatggataaaatgatccaatcagcaaacggcgaagttacaatcacaaatgatggggcaacaatcttaaaacaaataaatgtcattcaccctgctgcaaaaatgttggtagaattgtccagagcccaagatgttgaggctggtgacggtaccaccacagtagttgttatcgcaggagctcttttaaatgcagcagaaaaactgcttagcaggggtattcaccctactgttatttcagataacttccagaaagctgctgttcatgcagtgaatatcctaaacgaaatctctatcccggtggtactaaaaaaccgcgaccaactgctgcaaagcgcctccacctcgctaaactccaaagtggtgtcgcaacaatcctcctctctggcgcccatagccgtcgacgcggtgctaaaaatcgtcgagacgggtcgcgagcaggcttgcaacctgtccgacataaaggtgatcaagcagctgggcggcaccaccgaagacaccgagctggtggacggtctggtgttc

SEQ ID NO: 1148 - DNA, 1230 bp, Meligethes aeneus
atggaggcaatggaagttattttaccagaaaaagacgaaggaagcccttcagaaacgaaagtcagcttacaagatgctgatgttgaagatttatacacaaagtataagaaattgcagcaaatgttggaatttttggaagttcaagaggagtatattaaagatgaacaaagaaacttgaaaaaggagtacttgcacgctcaagaagaggtcaagagaatccagtccgttccgctggtaatcggacaatttttagaggctgtcgatcaaaacacaggtattgttggttcaaccactggctccaattattatgtgcgcattttgtcgacaatcgacagagaattgttaaaaccatcagcaagtgttgccttgcataaacatagtaatgctttggtcgatgttttgcctcctgaagcagattcctccatcagcatgttgtcggctgatgaaaaaccagatgttcaatacagcgacattggaggtatggacatgcaaaaacaagaaatcagagaggctgttgaattgcctctgacacactttgagttgtacaagcagattggtatcgacccacccagaggtgtgttgatgtatgggccccccggttgcggtaaaaccatgttggccaaggcagtggcccaccataccacggctgctttcataagagtagtaggttcggaattcgtacagaaatatttgggcgagggccccagaatggtgcgcgacgtgttcaggctcgccaaagaaaactcgcccgccattattttcatcgacgagatcgatgccatcgccaccaaacgtttcgacgctcaaactggagcggatagggaagtgcagagaattctgctcgagttgttgaaccaaatggatggtttcgatcagactaccaacgtcaaggttatcatggctaccaacagggctgacacgttggaccctgctctattgcgtcccggccgtttggacagaaagatcgagtttccattgcctgatcgtagacagaagagattggtgttcactactattacatctaggatgaacttgtctgaagaggttgatttggaagattatgtagctagacctgacagaatctctggtgctgatataaatgctatttgccaggaagccggtatgcatgctgtaagagaaaacagatatatcgtgctaccaaaagattttgaaaaaggttacaagaataacatcaaaaaggatgaaagtgagcatgagttttacaagtaa

SEQ ID NO: 1149 - DNA, 591 bp, Meligethes aeneus
gtgggactttatcgatcgtgtcaatggtttattgaagctgttgtcatttttacaaattacgttatttatcgtgtgtttttcgtatattttaactggaataagatgtctaaaataaagctacagagttccgatggagaaacctttgaggttgagatcgaaattgcaaaatgttctgtaacaataaaaactatgttggaagatcttggaatggatgaagatgaggaggaagttgttccattaccaaatgtcaactctgctatattaagaaaggtcattcaatgggccacatatcacaaagatgaccctccaccaccagaagatgacgaaaacaaagaaaaaagaactgatgatatatcttcctgggatgcagactttttaaaagtcgaccagggaactttatttgaactaattttggctgccaactacctagacatcaaaggtttgttggatgtaacttgcaaaactgtggccaacatgataaaaggaaaagccccagaagaaatccgcaaaactttcaacataaaaaacgactttactgcctctgaggaagagcaagtcagaaaggagaacgaatggtgcgaggaaaagtaa

SEQ ID NO: 1150 - DNA, 702 bp, Meligethes aeneus
atggacgagaaagcatcatgcaaggaactagatcagtggattgagcagttaaacgattgcaagcaacttacagaaaaccaagtcaaaactttatgcgataaggccaaggaaatcctttccaaagaaagcaacgtacaggaagtaaaatgccccgtgaccgtttgcggggacgtgcacggccagttccacgacctgatggagctgttcagaataggcggacgcagccccgacacaaactaccttttcatgggtgattacgttgaccgtggttactattccgtggaaacggtcacattactggtcgccctgaaggtgcggtacaaagagagaatcacgattctcagaggcaaccacgaatccagacagatcacacaggtttacggtttttacgatgaatgtctgaggaagtacggtaacgcgaatgtctggaagtttttcacggacttgttcgattatttgccattaactgccctcgtcgatagtcagattttctgtttacatggaggcttgagccccagtatcgatactttagatcacattagagctttggatcgtctacaagaagttcctcacgagggtcctatgtgcgacctgctgtggtccgatccggacgaccgcggcggctggggcatatcgcctcgcggcgccggctacaccttcggccaggacatctccgagacgttcaaccactcgaacggcctg

SEQ ID NO: 1151 - DNA, 657 bp, Meligethes aeneus
tacaacatccaaaaggaatctaccctccatttggtactccgtctcagaggtggtatgcaaattttcgttaaaactttgaccggaaaaaccatcaccttggaagttgaaccttctgataccattgaaaatgtgaaagccaaaatccaagacaaagaaggtatccccccagatcagcaacgtttaatcttcgcaggaaagcaattggaagatggaagaaccctctcagactataacatccaaaaggaatccaccctccatttagtactccgtttgagaggtggtatgcaaatctttgtcaaaaccttgacaggaaagaccatcaccttggaagtagaaccctctgacaccatcgaaaacgttaaagctaaaatccaagataaggaaggtatcccaccagaccagcaacgtttaatctttgccggtaaacaattggaagatggtcgtaccttgtctgactacaacatccagaaagaatccaccctccatttggtactccgtttgagaggtggtatgcaaattttcgtcaaaactttgactggaaaaactatcaccttggaagttgaaccctccgataccattgagaatgttaaggctaaaatccaagataaggaaggtatcccaccagaccagcaacgtttgattttcgccggaaaacaa

SEQ ID NO: 1152 - DNA, 1443 bp, Meligethes aeneus
aacgatggggcgacaataatgaaattgttggatatcgtacacccaggtgctaagactttggttgacatagctaaatcgcaagatgctgaagttggggacggtacaacaagtgtggttttgctagcgggggagtacttaaagcaaatcaaaccgtacgctgaggaaggcgtgcaccccagaataatcataaaagctgtcaggcagtcgttgcaattgtgccttgaaaagataaatgagctctcgatcaaaataaacaaggcgaacccggaagagttccgttctttgctggagaagtgcgccgcgacggctatgagctcgaaactgatcaaccagcagcgtgatttcttctcgaagatggttgtggatgccgttctgctcctcgacacacttctacccttgaacatgattggtattaagaaagttcagggtgggggtctggaagagtccctgctcgtcgccggggtggctttcaagaaaaccttctcctatgccgggtttgagatgcaacccaaagtctacaagaactgcaaaatcgccttgttgaacatcgagttggaactgaaagctgaacgcgacaacgccgaaatcagagtcgataacgttcgggaataccagaaaattgtcgacgccgaatggaatattctgtatgaaaagttaagaaaagtccacgaatcgggcgccaatgtggttctttccaaactccctattggcgacgttgcaacgcagtacttcgcagatagggacatgttctgcgcgggccgcgtccccgacgaagacatgaagcgcaccctgaaggcgtgcggcggcgccgtgatgacgaccgcgcacgacctcaaggacgccgtgctcggcaggtgcgacctgttcgaggagcgccagatcggcggcgagcgcttcaacttcttcaacggctgcccgaacgccaagacgtgcacgttgatcctgcgcggcggcgccgagcagttcctcgaggagaccgagcgctcgctgcacgacgccatcatgatcgtccgaaggacgatcaagaacgacgcgatcgtcgcgggcggcggcgccatcgagatggagctgtcgaagatgctgcgcgaccactcgcgcaccatcgccggcaaggagcagctgctcataggggcgatcgccaagtcgatggagatcatcccgaggcagctgtgcgacaacgccggcttcgacgccaccaacatcctgaacaagctgaggcagaagcacgcgcagggccactgctggtacggcgtcgacatcagcaaggaggacgtcagcgacaatctggacgcttgcgtgtgggaaccggccattatcaagatcaacgcgctcacggcggccaccgaggccacctgcctgattctttccgtcgacgagaccatcaagaatcaaaaggcgggcgacgcacctcagatgggccgcgggatgggaaggcccatgtaa

SEQ ID NO: 1153 - DNA, 4725 bp, Meligethes aeneus
gatcctagtgcttcgataatcgattttgaggttaacattgatggggaatggtctccatggtctaacaaggttccacaaattgaagtggagactcataaagttgcatctccagatattgtggtacctactttggatacagtaaggcacgaatcccttttgtatacttggttggctgaacacaaacctcttgtactgtgtggtcctcctggttctggtaaaacaatgacactattctccgctctaagggcattacccgatatggaagtagtaggtcttaacttttcatcagccacaactccagagttgctgttaaaaactttcgatcattattgcgaatacagaaaaacacccaacggtgttgtgttagccccagtacagctcggtaaatggttggtattattctgcgacgaaatcaacttaccagatatggacaactacggaacccaacgcgtaataatgttcctacgtcaaatagtcgaacaaaaaggtttctaccgcgcttccgatcaaacctgggtatctctcgaacgtattcaatttgtgggcgcttgtaatccgcctacagatccaggcagaaagcctttatcgcacagatttcttcgtcatgtaccagtagtatacgtggattaccctggtgaaacttctttgaagcagatctacggtacttttacgagagcgatgttaaggttaacaccaggtttaagaggttattcggaaccgttgacaaacgccatggtggagttttatttggcgtcacaagacagatttactcaagatatgcagcctcactacgtgtactcacctcgtgagatgactcgatgggttagaggaatttgcgaggctatcagacctctggataatttgccagttgaaggtttggtgaggttgtgggctcatgaagccttaaggcttttccaggacaggcttgttgaagatactgaacgtcgatggaccaatgaaaacatagatgctgtggcattaaaacacttcccatccgcaaactgcgaaaacgccttggaaagaccaatactatatagtaattggttgagtaaggattacataccggtagatagagaacaattaagggagtatgtaaaggcaagacttaaggttttctatgaagaagaattggatgttcctttggtgttgttcgatgaagttctcgatcatgtactaagaattgacaggatttttaggcagccacaaggtcatttacttttgatcggggtgtctggagctggaaaaacgactctttccagattcgtagcctggatgaacggcttgagcatcttccagattaaagtacacaacaaatataccgctgaagatttcgatgaagatttaagatcagtattgagaagaagcggttgtaaagacgagaaaatcgcttttatccttgatgaatcaaacatgttggattccagtttcctggagagaatgaacactttgttggccaatggagaagttcccggattatttgagggagacgaatacacaactttaatgacgcagtgcaaggaaggcgcccaaagagaagggcttatgctggattctaacgacgagctctacaagtggtttacacaacaagttatgcgcaacttacacgttgttttcacgatgaatccatccacagacggtttgaaagacagagcggccacatccccagccttgttcaacagatgcgtattgaattggtttggagattggtctgatggcgcgctattccaagtcggaaaagagttcacaaacagactggacttggatagacccaactggaaatcacccgactttttccctgcagtttgtacgcacatttcagctacaccagtacatagggaagctgttataaacgcttgcgtttacgtgcatcaaacgttgcataaagctaacgctagattggcgaaaagaggtggaagaactatggctattactcctagacattacttggacttcatccatcattttgtcaagctccacaacgagaaacgttcggacttggaagaacaacaactccacttaaacgttggtctaagcaagattgcagaaacagtagaacaagtggaagagatgcagaaatccttagcggttaaatcgcaagaattgcaagccaaaaatgaagctgccaacgctaaactcaagcagatggttaaagatcaacaagaagccgagaagaagaaggtgcagagtcaggaaattcagcaacaattggctggacaaaccatccacattgagcaaaaacgcaccgaagtaatggcggatttggcacaagtagaaccagctgttatagacgctcaaacagccgtaaagtcgatcaaaaagcagcaattggtcgagatccgtacgatggcgaacccacctgccgttgtaaagctggccttagagtccatttgcttgttgctcggtgaaaatgcaagcgactggaagtctatcaggaccgtcatcatgcgtgataacttcatcaatactgtagtcaacaattttaacactgaggacattagcgatgatgtacgcgataaaatgaggtcccgttacctaagtaaccctgattacaacttcgaaaaagtaaaccacgccagtaacgcttgcggaccgttggtgaagtgggccttggcgcaaattcaatacgcagacatgctaaaaaaagttgaacctcttcgggaggagttgaactctctggagacgcaagctgaaacaaatcaaaagcgcggcgatgaagttaagagtcttatcgcgcaattagagcacagtatcgcttcatacaaggaagaatatgcgcaattaattgcgcaagcgcaagctataaaaactgatttggaaaatgtgcaagccaaagttgacagatctatagccctactaaaatccttggttattgaaagggaaaggtgggaggctacaagcgaaacattcagatcgcaaatgtccacaattattggagacgttttactatccgccgcattcattgcttatggtggttacttcgatcaacattaccgtcaaaacttgttcaccacatggtgtcaacatctgacacaagccaccatacagtacagacctgacattgctagaactgagtatttatcaaatccagacgaaaggttaaggtggcaagccaacgctttaccaacggacgatctgtgtactgaaaacgctataatgttaaagaggttcaataggtatcctttaataatcgatccttcagggcaagcaaccgaatatatcatgaacgaattcaaggataaaaagattaccaaaactagttttctggatgattcttttagaaagaacctggaatctgcgttacgattcggtaaccctctcttggttcaagacgtcgaaaactacgacccaattttaaaccccgttctaaacaaagaacttcgcagaactggcggtcgtgttttgatcactctcggcgatcaagacatagatttgtcaccgtctttcgtcattttcttgtccacgagagatccaaccgtcgagttcccgccggatatctgctccagagttacatttgttaactttactgtaaccagaagctcgctacaaagccaatgtttgaatcaagtactaaaagcagaacgacctgatatcgatgccaaacgttcagatctgttgaagttgcaaggggagttccatttgaggttgaggcagcttgagaagtctctattgcaagctttgaatgacgctaaaggtaaaattctggatgatgatagcgttatcactacgttggaaactcttaaacaggaagcagcagaaatcggtcaaaaagttgaagaaactgataaggttatttcggagatcgagatggtatctcaacagtacatgcctttatcacaggcttgcagtaatacatatttcaccatggattctcttaaccaagtgcatttcttgtaccagtactcccttaaaatgtttttggatatgttcagtacagtactgctaagtaatccacagttagatggagtttctgactatcaacaaaggctcaacattatcaccagagatcttttacaggtttgttatgaaagagttgcgagaggcatgatacacaacgatcgtttaacattcgctttactattgtgtcgaattcatcttaaaggagttccaagcgaaccaaatttggaccaagagttcaacttcttccttagaggtaaagaaggcgtatttacgtcatcctcaaccgattctgtggacggtttgaacaatgagcaacaagaagccttgactaggttatcattgagattgccggcgtttaaaaagttaccggagaaaatccgcgaaatgccagagtttggaaactggttgcagcaaagcacgcctgagcaatgcgtgcctggtttgtggattgaagagaaacagttgagtccgattggaacttccatgtatcaactcctggttatacaagcttttagacctgatagagttatagctgcagcttcgttgtttgttaccgctgtgttgggtgttgatttcatgcccagcgctgaaaaagaattggacttggctgcttgcgttgaaaaagaaataagatccaatgtaccagctttactgtgttccgtaccaggttttgatgcttcaagcagggttgacgatctagccgccgagataaacaaacaaatttcaagcatcgctattggttccgctgaaggctttaaccaagctgatagggctataaatatggcctgtaaaactggccgttggggtatgttgaagaacgtgccttta

SEQ ID NO: 1154 - DNA, 1950 bp, Meligethes aeneus
gaagaatgcaaaaaaagtctacctatattcccgttcagagacgaattcataaacgctgttcgcgaaaatcaagtgctaatcatagagggcgaaaccggttccggtaagaccacgcaaataccacagtacctccacgaggccggttttaccgaagatagtaaaaaaatcggttgcactcagccgagaagagttgctgccatgtcagtggcggctcgtgtagcccaggagatgcgggttaaactgggcaatgaggttgggtatgccatacgttttgaagactgtacctcggaaagaaccgtcatcaagtacatgacggatggtacgttgcatagagagtttttgtctgagccggacttgcagtcttatagcgtcatgattatcgatgaagctcatgagagaactttacataccgacattctttttggtttggttaaagatatcgcccgattcagacctgatttgaagctgctgatatccagtgcaactctggatgcgcagaagttttccgagtttttcgatggagcgccgatatttagaatacccggtagacgatttccagtcgatatctattacactaaagctcccgaagctgattacatagacgcttgtgttgtttccgtacttcaaatacatgccacacaacccctgggggatattttggtatttcttacaggtcaagaagaaatcgaaacttgccaagagctgctcaccgaccgtgtgagacgtttgggctctaaagttaaagaactcttgattctaccggtatacgctaaccttcccagcgatatgcaggcgaaaattttcgaacccacaccaccaggtgcaagaaaagtcgttttggccaccaacattgcggaaacttcgctgaccatagacaacatcatctacgttatcgatccagggtttgcaaaacaaaaccacttcaattccagaaccggcatggagagtttgatggtggttcccatatctaaagcgtcggcgaatcagagagccggcagggccggtagagtggcagccggtaaatgttttagactgtacacagcctggtcgtacaaacacgagttggaagacaatactgttcctgaaatacagagaatcaacttgggtaatgctgtattgatgttgaaagcactgggtataaacgacttggtacacttcgactttttggaccctcctccacatgaaactctagtgttggctctggaacaactgtacgctcttggagctttaaatcatcacggtgagcttacaaagctagggaggcgcatggcagaattcccagttgatccaatgatggcgaaaatgattttggcgtctgagaaatataaatgttcagaagaaatagtatcgattggagctatgctgtctgttaatggcgccatattctacagacccaaagataagatcatacatgctgatacggctagaaagaacttcaaccatcctggaggagatcatttgagtttgctcaacgtttacaaccaatggaaagattctgattattccacgcagtggtgttacgagaattttatacagtacagatccatgaaaagagctagggacgttagagaacaactcgtaggcttgatgcagagagtcgagatagagatggtttcaaatgtatccgagaccatcgatatacggaagagtataacagctgggtatttctaccacatagctagactgtcgaagggtggtaactacaagacagtgaagcacaatcaaagcgtgaccattcatccgaacagcgcgctgttcgaagagctaccacggtggctgctgtaccacgaattggtgttcaccacaaaagaatttatgaggcaggtggtcgagatcgaaagcaagtggttgctggaggtggcgccgcattattacaagcaaaaagagctcgaagatcccaccaacaagaagatgccgaaaacggtcggaagaagcacgcgcacagagtaa

SEQ ID NO: 1155 - DNA, 1371 bp, Meligethes aeneus
atgaaggttgaagaagtaaaaagtacggtgaaaacccaaaggataagtgcccacagtcacattaagggcttgggtttggacgaacgcggcttcgcgatacaattcgcagcgggtttggttggacaggagcaagttagagaggccgctggtatcgtcgtggacatgattaaaagcaagaaaatggcaggtagggctattttgttggctggaccgcctggaacaggcaaaaccgctgtggctctggcaatcgcccaggaattgggcaacaaggtgccattctgcccgatggtgggctcagaagtgttcagctccgaaatcaaaaagaccgaagttttaatggagaactttcggagagccatcgggttaagaatcagggaaacaaaggaagtctatgaaggtgaagtgagcgagttgacccctgtcgaaacagagaatcctgctggaggttatggtaaaacagtgagtcatgttataatcggtttaagaactgcaaagggcagtaaacagttgaagttggatcccagcatctacgaggctcttcagaaggagaaagttgaggttggagatgtaatttatattgaagcaaacagtggggctgttaaacgacaaggtagatctgatgcatatgcaactgaatttgatttggaggcagaagaatatgttccattacccaaaggagatgtacataaaaagaaagaagttgtgcaggacgtaactttgcacgatttagacgcagcaaacgcaaaaccgcaaggggggcaggacgtgttatcgatgatggggcaattattgaaacccaaaaaaacggaaatcaccgataaactgcgtaaggaaatcaacaaaatcgtcgacaaatacatcgaccaggggatcgcggagctggttccgggcgttttgttcatcgacgaggtccacatgctcgacattgaaaccttcacgtacctgcacagggctctggaaagcacaatagcccccatagtgattttcgctaccaatcgcggccggtgcgtgatcaggggcacggacgacatttactccccccacggcattcccctggatctcctcgaccggctgctcatcatcagaacgaagccgtaccagaggcaggagatggagcagatcctgaagctgcgcgccagcaccgaggggctcgagatcgaagctgaagctctctcgattctcggggaggttggcgtcaaggccactttaagatttgccgttcaacttttgacgcccgctttcctcaccgccaaaattaacggcagagcgaacatcacgaaagcggatgttgaggaagtcagcactttgttcttggacgccaaagcgtccgctgttattttaagcgaaaatcaatccaaatttatgaagtaa

SEQ ID NO: 1156 - DNA, 2196 bp, Meligethes aeneus
atgacttccataataaaattaactgccgtttcgggggccatggacgaatcgcccccatgttacattctacaagtagatgatgttagaattttgttagattgtggatgggatgaaaagttcgatatggagtttattaaggaagtaaaaaggcatattcatacaatcgatgcagtgcttatttcctaccctgatgtatttcatttgggcgccttaccttatttggttggtaaattgggtttaaattgtcccatatattccacaattcctgtgtataagatggggcaaatgtttatgtatgatttgtatcagtctcattacaatatgaaggagtttgatattttttcccttgacgatgttgatgccacatttgaaaagattatacagctgaaatataatcagagtgtaccacttaaaggtaaaggatatggtttaactataacaccattaccggcaggtcatatgattggtggtactatttggaaaataatgaaagttggtgaagaagacataatttacgccaacgattttaatcacaagaaggaaaggcatttaaatgggtgtgaattggagaaattgcagagaccttcattgcttattactgatgcctataatgcttcctatcaacaagctagaagaagggcgagggatgaaaagcttatgaccaatattcttcaaactctacgcaataatggaaatgttcttatagctgtagatacagctggtagagtattagaattggctcacatgttggaccaattgtggagaaataaggaatctggacttctagcttattctttggctttgtgtaataatgttagctataatgttgttgaatttgccaagtcgcaaattgaatggatgagtgacaaacttatgaggaattttgaaggggctagaaataatccatttcaatttaaacatttgcaattatgccacagtttgcatgagttggctaaagtgtcaagtccaaaagtggttttggccagttcagctgacatggaaagtggttattccagggaattatttttacagtggtgttccaatcccaataatagtttaataattacttcaaggacttctcctggaactttggcaagggaactagttgataatggaggaaatagggaaattgaaatgaatgtggaaaaaagagttaagttggaaggggctgagttggaagaatatgaaaaaaagatgaaggagttaaggaatgttaaaaaagaaagtgacaacgaatcagactctgacgacgacatcgagatgagcgttatctccaagggccgtcacgacatcgtgatcaaacaggagggcaaagtgtcgggcggttttttcaaggtcaccaaaaaacagtaccccatgtacccgttcagcgaagagaaaatcaagtgcgacgaatatggagaaataatcaagcctgaagactacaagctggcggatgtggtgcctgaggaggacaacaaggagaacattgtgatcaagaaggaggaggaggatataactgaaatcccggaaatccccacaaaatgcatcattctaaaccgtacagtccaagtaaactgccaggttcagtacatagactttgaaggcagatccgatggtgaatccctaatgaaaattttgtcacaactaagacctagaagagtggtaatcgtacgtggttctccagaaaacactaaagtcatagaaaaccattgcactgatattttgcacaccagggtttttgtgcccagcaaaggagataccattgatgccaccagcgaaacgcatatctaccaagttaggcttacggatgcgttagtttcccaactgaacttccaaaaggctaaggatgcggaagttgcatggataaacgctcagattgttttaagggagagccaattggatgctaaaaggatgacaattgataatgaacccatggaggaagaggacgactttaatgttctaaccctggaaccatacccaggcgaaattccccatgacccagtgttcataaatgaactaaaactatcagactttaaacaagtccttggcaaaaatagtattccttcagaattctcaggaggcgtgttatggtgcagtagtggcaccattgcattaagaaaagtggaaaatggcagaataatgatagaaggttgtatttcagaagattattacaaagtcagagaacttctgtacgagcaatatgctgttttatag

SEQ ID NO: 1157 - DNA, 2343 bp, Meligethes aeneus
agcattgatgttgtcatttgtcaaaacctgcgttcgtcggaaagtaaacgattaatattttgtgtagcgtttaaagaaaaactcataaaaatgcctcctttggagccaaatggagaaaaaaacgatgaaccgggaccgataaattcggtggtgggaataatttacccaccacctgaggtgagaaatattgtggataaaacagcaagttttgttgctagaaatggcccagagtttgaggctcgtatccgtcaaaatgaattgggaaaccccaagtttaatttcttgaacagtggggatccctatcatgcgtattatcaacacaaagtcaatgatttccgtgaaggaaaaggtcaagaaccagctacaaatttacctgcagcaatatcaaaactatcagttactgcatcagcacaacagaaacaacaagaaattttaaaacaagttgagcaaccatttgttccaaaagatcctccacaagaatttgagtttatagctgacccaccttccatttctgctttagatttagatatagttaagttaacagcacaatttgttgcccgtaatggcagacaattcttaacccaactcatgaacagggagcaacgtaactttcagtttgattttttaagaccccagcactctttgttccaatatttcacaaaattactggagcaatacaccaaggtacttattccaccaaaaagtatgcaacagagattaagagatgaagccaaaagtgccaggtctgttttggaacaagttaaatacagagcagaatggcaaaggtaccaggagcaacaaaaagctaaagaggaggaaatattggaaagagaaagagttgcttatgcacaaattgattggcatgactttgttgtggtcgaaactgtagattatcaaccgtttgaaatcggtaatttcccgccgccaactactccagaagaagtgggagcacgtttgcttattcaagagagaattgaagaaggagaggacattgaaatgcaacttgagagcgatgatgaggaatctgcaccacccactgatgaaggtttaagtcatatgcaagacaggacgcacggtcgcaaaggtagagatgataatcgcgtacaagacatggaagaggatagttccgatgaggactctcgcggaccatcaaagccttctcagccttcaattcaaccaccaatgccgccaatacctgataaggttgtcgtcaagaaatatgatcccaaacaagctgttaaagtcaccagaccaaccgtgggtgatgactttttggtatcgcctatcaccggcgagaaaatccccgccagcaaagtgcaggagcacatgcgcatcggcctgctggatccaaggtgggtcgagcaaagagacaagcaggtgatggacaagatgaaccaggaaaccgtctacgccgccggttctgcaattgacgctagtctgaaattgttggccgaaagacgtaccgatattttcggtgtgggcgacgaagaaaccgccatcggtaagaaaatcggcgaagaggacgttcgcaaggacgaaagggtcacctgggacggacacacgtccagcgtcgaggcggccaccagagccgcccgcgccaacatcactttggaagagcaaatccaccagatacacaaggttaagggcctgttgcccgacgaggagaaggaaaaaatcgggcccaagaatgtaatgggtcagtctaaaaacgctaaaggcaataaaggacagcaaatgcaaaatcaacaaaaacccccgcagatgcctcccatgcccactcaacccaccatacagctacaagtggcccctcaaccaataatagcaccccaacctcaaattatgatgatgccagctcctcccatggctcaaatgagacctccaccattgatgatggctgctccaccaccaatgggcggatttgtgactcaattgccaccgcaaatggctccccctatgaacatgccccacaagcatccaaatgaagggcccttggaagaagaaccatccaataagaagatgaggaatgaggattcccttgtgccagaggaagtgtttttggcgcgcaatccgagtcctgtgtccatcaaagtggcgatccctgtaatcccggacaaacccgaatggaaactcacaggtcaaatggttagttacactttgcccctgtcagagagtgtttcaaatcttaaggttaagattcaagaggaaaccaacatggctcctgccaaacaaaagttgttctttgatggaatgttctttaaagattcaaacacgttggcatattacaatattacacagggagcagttattcagcttcaagtaaaaactcgtggtggaaagaagtaa

SEQ ID NO: 1158 - DNA, 1011 bp, Meligethes aeneus
gaagttgtcatcgtcgccatttgtcagatttatttgttaaaaatgccgagtcaagaggtgacaacaactaaagtggtggttcaccctttagttttattgagtgtcgtggaccattttaatcgtatgggcaaaattggcaaccaaaaacgtgtggttggtgttcttttaggttgctggcgggctaaaggtgtcctagatgtttccaacagttttgcagttccttttgatgaagatgacaaagataagtcagtgtggtttctggaccacgattacctagaaaacatgtatggaatgttcaaaaaggtgaacgcacgtgaacgggtagtcggttggtatcacacagggccaaaattgaaccagaatgacattcaaataaacgaactgatcagaaggtattgtccaaattcggtattagtaattattgatgcgaaacctaaggatctcggtcttcccactgaagcctaccaggctgtagaagaggtacacgatgatggttcaccaacatcgaagacttttgagcatgttcctagtgaaattggggcagaagaggctgaagaagttggtgttgagcatttgctaagagatattaaggataccacagtgggtacattgtctcaaagaataacgaatcaattgttgggggtgaaggggctgcattgtcagctgagagaaattagagactatctcatacaagttagtgaagaaaagttgcctattaatcatcagattatctatcagctgcaagatatcttcaatcttttgcctgatattaatcaggagaactttaataaagcattttatgttaaaaacaacgatcagatgttggttgtgtatttggcagcaatggtgagatctattgtagctttacacaatcttattaacaataaattaacaaataaagatgctgaagaaggaaaaaaagaagaagccaaaaaggataaagatagcaaagacaaagaaaaggaaaaggagaaagataaggatgctaagaaggatgaaaagaaaaaataa

SEQ ID NO: 1159 - DNA, 525 bp, Meligethes aeneus
atgtttggtggtggccgtgctcctattgttgttttaagcaataacacaaagcgtgagagtggaagaaaagttcagctggagaatataaatgccggaaagcaaatcgccgacgtgataaggacatgtttggggccacaagccatgctgaaaatgttgatggacccgatggggggtatcgtgatgacgaacgacggtaacgccatcttgcgtgagattactgtacaacacccggccgcgaaaagtatgatcgaaatcgcacgcacacaagacgaagaagtgggcgacggtaccacttcagtcatcgtactggccggggaaatgttagtggccgccgaacaatttttagagcaacagatgcaccccacagtcatcatcagggagtacaagaaagctttagaagacattgttacgttgttagaggggcccttaagtgtgcctgtggacaggaacgataaggcggccgttgcgcaggtcgttaggggttgcatcggcaccaaattcatctccaagtggggggatttggcg

SEQ ID NO: 1160 - DNA, 708 bp, Meligethes aeneus
atgtctttaagtatggaaggtattcgtcctcactaccctgattactcgaatgcgcccatgcagcgtcatttcagcccatacgccgacaacggagggagcgttgttgcgatagccggagatgactttgtagttatcggagccgatactcgtttgagtgctggcttctcaatttacaccagagatcaaaacaagttgtttcctctgtcgaaaaccactgttttgggttgcgctggttgttggtgtgacaccttaaccctaactcgcattctgacctctcgcatgcagatgtaccagcaggagcacaacaaaacaatgtccacggtggcttgcgctcaaatgttgtccaccatgttgtactacaagaggtttttcccctactacatttccaacgtcttggttgggttggataacgagggaaaaggctgcgtttacagctacgatcccattggacattgcgagaaggccacctacaaagccggaggttctgcaggggctctgttgcagccccttttggataaccagattggtttgaagaatatggagataatcggggattcaaagctgacgattgagaaagctaccaatatcattaaggatgtttttatttctgcagccgagagggacatttacactggggatagtgttattattaacataattaccaaggagggaattaaggatgataagtttgagttgaggaaggattag

SEQ ID NO: 1161 - DNA, 903 bp, Meligethes aeneus
atgtttcagtttgggttcaacatgtttcccgagctacccaggccctttaacgtaacatacaaatgctattcagtggctatgttacctggcaatgaacggcaggatgtcgaaaggggtggaaaaattataatgcccccatcagctttagaacagctgacaaggttgaatattaattacccaatgttgtttaagctggtcaataagaaaacaaatcgtacaactcactgtggtgtccttgagtttgtggccgatgaaggaaaggtttatttaccactatggatgatgcataatatggtgttggacgaaggagattttgtacaaatggaaagtgtttctttacctgtgggaacgttttccaaatttcaacccttatctccagaatttttggacattaccaacccaaaagcggttttggaaaactgtttaagatcatttgcgtgcctaacgtcgggagatatcatagctgtgaaatataattcaaaagtttatgaattatgtgtactggaaacaaagcctggtgatgccataagcattattgagtgtgatatgaatgttgaatttgaagccccggtgggttacaaagagcccgaacatgttaaaaaagaggacgaagacatgcaaatcgatccttcggaattaatgcccgaacccgcaggtttcatagcatttaaaggggcgggcaatagacttgacggtaaaaaaagaaaagattccacgtcaagcgactcgacgatgttgccgaccaaaaccgcctatgttaggggaatccccgattatgattacgaaattggtacgttgaaatttataagaaggaattttaaaccggccagcaaagagagtgcagaaaatatcgattttaaagcgttcagcggcaacggattcagtctcaaaggtagaaagtaa

SEQ ID NO: 1162 - DNA, 666 bp, Meligethes aeneus
gaagacaccgtcctcgtcagaggcgtggtgatcgacaagaccatgtcgcactcgcagatgcccaaagagttgaagaacgtcaaaatggccatcttgacctgcccgttcgagcccccgaaacccaagaccaagcacaagttggacgtcaccagcgtggaggagttcaaggagttgcggcagtacgagcaggacaaattcaaggaaatggttgatttggtcaagaaggctggcgcaaatttggccatttgtcaatggggttttgacgatgaagccaatcatttactgtactcgcaaggtttaccagctgtcagatgggtcggcggtccggagatcgaactgatcgccatagcgacgggcggcaggatcgtcccgcgcttcgaggagctcacccccgacaagctgggttcggcggggctcgtgcgcgagctggccttcggcaccaccaaagacaagatgctggtgatcgaggactgctccaactctcgcgccgtcaccatcctggtgcgcggcggcaaccagatgctggtggccgaggccaagaggtctctgcacgacgccttgtgcgtcgtcaggagcctggttctggaaccgagggttgtttacggcgggggcgcggcggaaatcgcttgcagcttggccgtggccgccgaagctgatcagctggct

SEQ ID NO: 1163 - DNA, 339 bp, Meligethes aeneus
atggcaagtgcgatggacgtggacgttgatgaagttgaaatgcccaccagcagctcaaaaggcgaaaaaaagcgttttgaagtcaaaaagtggaatgccgttgctttatgggcttgggacattgttgtggataattgcgctatttgccgcaatcatataatggatttgtgtatagaatgtcaggcaaatcaggcctctgccacttcagaggaatgcactgtagcttggggcgtttgtaatcacgcctttcattttcactgtatttcaagatggttaaagactcggcaagtttgcccgttggataatagagaatgggaatttcagaagtatgggcattaa

SEQ ID NO: 1164 - DNA, 681 bp, Meligethes aeneus
atggatacggataaaataaaggtgtttggtagtcatattaaggtggattccatggctaaaatcgccgaattagaatcggctgaaaaggagaaaatgaaggagaaggtcgataagatactgaaacacaaaccgacggtgtttattaaccggcagttgatctacaactacccggagcagttgtttgccgatgcgggggttatggccatcgaacatgccgattttgacggtattgagcgattagctttggtgacaggaggcgagatagcttcgatgtttgataaccccggggatatcaaattggggacttgcgatttgattgagcaaattatgatcggggaggatattttgctgcgtttttcgggtgttgctttgggggaagcttgcactgtggtgattagaggcgcgactcaacagattatagacgaagctgatcgtagtatccacgatgcactttgtgtgctagctgcaactgtaaaagagagccgcgttgtttacggtggcggttgcagcgagactttgatggcctgcgcggtgcgcaaagccgccgccagtactccgggcaaggaggccgtagctatggaggcttacgccagggcgttgctgcagctgcccaccatcatagccgacaacgctggctacgattcggcgcagctggtgtcggagttggtggctgcgcacaac

SEQ ID NO: 1165 - DNA, 837 bp, Meligethes aeneus
atgttcagaaaccaatacgacagcgatgtcacggtgtggagcccccagggccgcctccaccaagtcgaatacgccatggaggccgtaaatctgggctctgcaacagttggccttaaaagcaaaactcacgctgtcctgatagccctcaaaagggcctcctccgaattgtcggcctaccagaaaaaggtgatcaacatcgatgaacatattggaatcaccatttccggtttaactgcagatgcaaggattttgagcagatacatgaggactgagtgtttgaattacaagtattctcatgatactgtgttgcccttaaataggcttatttccactttggggaataagatgcaggtttgcacgcagagatatgatagaaggccctatggggttggattgttggttgctggttttgacgataaaggtgctcatatctaccaaacttgcccatctgcaaactactacgattgcaaggccatgtccattggtgctagatctcaaagtgccaggacttacttggagaaaaaaatcgacgaactccataatgctcctctggaagatttgattaaacatggtttaagggcgttgagagatacccttcccccagaggtggatttgaacaccaaaaatgtttctattggatttgtgggcgacaaacagccgtttaaaatcctggatgaggatgaaaccgctcccttcttggctttgattgaaggagaagagagacgtggaggtggtgggggcccacctgatgcagctgcagctcctttgagggatgaggcgggggaccaggatgccccgagggaaccggttccacaagtggccatggatacagattga

SEQ ID NO: 1166 - DNA, 2550 bp, Meligethes aeneus
atgccgattaaaaatgcagatgaaccaatggaaattgtttttactgatgatgatttaccctatgaagaggaaatattaagaaacccatactcggttaaacattggttgcgttacatagatcataagaaaaagtctcccaaacatggcgttaatataatttatgaaagggctttaaaagaattgccaggttcttataaattatggtataactacttgaggactcgtagaaagcaggttaagcctcgttgcctgacagaccctttgtatgaagaagtaaataatgcatttgaaagagctttagtatttatgcacaaaatgccaagaatatggatggattattgtacatttttaacagaccaaggaaaaataagtagaactcgaaaggtatttgacagagctctacgtgccttaccagtgacccagcatcataggatttggcctctttatttgggttttattaagaaacatgacattcctgaaactgctgttagggtgtttagaagatatttgaaattatccccagaaaatgcagaagaatatgtagagtatttaactgagatagggaggctggatgagtcttcattggtattggccaaaatcgttaatgatgaaaattttttttctcagcaaggaaaatccaaacatcagctttggaatgaattatgtgaactaatttccaaaaaccctgatgaagtaagatctcttaatgtagatgctattataagaggtggtttgagaaggtacacagatcagctgggacatttgtggaattccctggctaattactatgttaggagtggattatttgatagagcacgggatatttatgaagaagccattcaaactgtatctacagtacgtgattttactcaggtatttgatgcctatgcacaatttgaagaattaagtttgagtaaaaggatggaagaaatagccaaactttcaagtccttctgaaggtgatgatattgatttggagttaaggctagcgcgatttgaaaatttaatggaaagaaggttattacttttaaattcagttttattaaggcagaacccacacaatgttcaggaatggcataaaagagtgcagttgtatgaaggaaaaccccatgaaattattaatacttatactgaagcagtacaaacagttgacccaaaattggctgttgggaaactacacacattatgggttgagtttgcaaaattttatgaaagcaatgtccaaattgatgatgcaagattgatttttgaaaaggggacccaagttccctatgtaaaagtagatgatttagcaaatgtgtggtgcgaatggactgaaatggaaattcgtaatgaaaattatgatgatgcattaaagttaatgcacaaggcaacagtaatgccagctaaaaaagtagcttaccatgatgacacagagtctgtgcaagcaagactgtataaatctttaaaagtttggtctatgtatgctgatttggaagaaagttttggaacctataaatcctgtaaggctgtttatgacagaattattgatttaaaaattgccactccacaaatcattattaattatggggtatttttggaagaaaataactattttgaggaagcatttcgcgcttatgaaaaaggtatatcattgtttaaatggccaaatgtttatgatatttggaatacatatttgacaaagtttttgaaaagatatggtggtagtaagttggagagagcgcgcgatttgtttgaacaatgccttgaaaattgtccagcacaatttgccaaaacgctatatttactgtatgcaaaattggaagaagaacatggtatggcaaggcatgctatggcagtttatgaaagggcaacaaatgctgtccttcctgaagaaatgtttgaagtatttaatatttatattaaaagagcagcagaaatttatggaatacccaaaacaaggcagatttatgaaaaggctattgaggttttgccagaagacagaacaagagaaatgtgtatacgattttcagatatggaaacaaagttgggcgaaatagatagggctagagccatttatgctcattgcagtcaaatttgtgatccaagggttaccactgaattctggcagatatggaaagaatttgaggttcgccatggaaatgaagatacaatgagagaaatgttaaggattaaacgaagtatacaagccatgtataacacgcaagtcaatatgatgtcagcacaaatgttaagctcttcaagtagtgtgtctggaacagttgctgatttagctccaggtgtaaaggatggaatgaggcttttagaggcaaaggctgttgaaatgacagggtcatctgctggttccagacctggaaacataatgtttgtgaggggtgaaacccaaggcaatcacaaagataaggttatcaatcctgatgaaattgatataggcaatgaagatgatgaagacaatgatgatgaaaaggaagctgaagaaataccagttgaaaagcaaagtatcccattagaagtttttggaagtttaaaaaacaaaagtaaagaaaattag

SEQ ID NO: 1167 - DNA, 1149 bp, Meligethes aeneus
atggcgaatggtccaattgcagaacggaatcgagacgctacaatttacgttgggggtttagatgacaaagtttccgaatcattattatgggagctttttgtgcaagccggacccttagtgaatgttcacatgcctaaagacagagttacaatgatgcaccagggttacgggtttgtagaatttatgggagaagaagatgcagattatgctataaaaattatgaacatgataaagctgtatggaaaaccgataagggttaataaagcatcagcccatcaaaagaatctggatgtgggagcaaacatatttataggaaatttggatgcagaagtggatgaaaagttattgtatgatactttttccgcgtttggagtcatattacaaactccaaagataatgagggatcctgaaacgggcaactccaaaggttttgcttttattaattttgcaagttttgaagcctctgatgcatctatagaagctatgaatgggcaatatctgtgtaaccgaccaatttctgtatcatatgcattcaaaaaagattctaaaggagaacggcatggttctgctgccgagagattattggctgcccagaacccattatctcaagctgatagacctcatcaactgtttgctgatgctccaccaatgggtatgatgcctcctggaatgtcaatggcaccaccaccacccccagtattgataatgccgcccccacctccaacccctacaaatatgcaacctccaccaccacctcctgttccccctccagcagcgtttccctctggaatacccccacctcccctcccaccatctcaacccccactccctccaggtgcacctccattaccgccaatggcaggagcaggcattcccccttcaggccgtccccctctccctcctatgcctcccacctcaactcgcgccctacagcctccatggcaagcgggtggaattccacctccacccccaggtccccccagtggagcaggacctgttcctccattcccaggaatgtttccacctcctcctccacctggaggaaggccaccgccgcccaactggcgccctccaccaccgaattttgtcggtagaccaccgtttcccccaagaggtccacctccacctcctcccagttttgagggttaa

SEQ ID NO: 1168 - DNA, 774 bp, Meligethes aeneus
atgggacgtgtaattcgtgcgcaacgtaagggtgcgggatccgtcttcaaatcccacacgaaaaaaaggaagggagcccccaagctccgctacttggatttcagcgaacgtcatggatacatcaagggggtggtaaaggagatcatccacgaccccggtcgcggcgcccccttggccatggtcaacttcagggacccctacaagttccagaccaggaaggagcttttcattgccccagaaggcatgtacaccggacagtttgtttactgtggaaagaaagccaacttgcaaatcggtaacgttttgccaattggagccatgcctgaaggtaccatcgtgtgcaacttggaagagaaaactggtgaccgtggtcgtttggcccgtgcatctggtaactatgccaccgtaattgcccacaaccacgacacaaaaaaaactagggttaagttgccatctggagcaaaaaaagtcattccctccaacaacagagccatggttggtattgtagctggtgggggtcgtattgacaagccaatcttgaaggctggtcgtgcctaccacaaatacaaggttaagcgtaactgctggcctaaggtgagaggtgtgtgcatgaaccccgttgagcatcctcacggaggtggtaaccatcaacatattggtaaggcttcgacggtcaagaggggaaccagcgctggtcgtaaagtcggtctcatcgctgcccgcagaaccggtcgtattcgtggtggaaaggttgagacaaagaaagaagattag

SEQ ID NO: 1169 - DNA, 411 bp, Meligethes aeneus
atggcacgtaccaagcaaactgcccgtaaatccactggtggaaaagctccacgtaaacagttggcaaccaaagccgcacgtaaaagtgcaccagccaccggaggtgtcaagaaaccacatcgttacaggcctggaacagtagctcttcgtgagatccgtcgttaccagaaaagtaccgaattgctcatcaggaaattgcctttccaacgtttggttcgtgaaatcgctcaagatttcaaaactgacttgcgtttccagagctccgccgtcatggcattgcaagaagccagcgaagcatacttggtcggtcttttcgaagataccaacttgtgcgccatccacgccaagcgtgtaaccatcatgcctaaagacatccaattggcaagacgtattcgtggagaacgtgcttaa

SEQ ID NO: 1170 - DNA, 786 bp, Meligethes aeneus
catgatgccctccttggccagcatgtccaagctcatggggtcgatgcccttctggttgatcaccgcgaagctcttgtcggtgccggcgcagagcttcttcttgagctcgaccaccttgcgcacgcgctgcatgatgaagtcgcgctccgccgtcaccatcttctcgcgctcctcggccgttttgtagaagaagcccgagttcacttcgctcttctcgtactccatgctcacgttgcaggtgaggatgtacgcgtttttcagctgtttgggcatgtcggggtggcggcacccgtggtccatcacgatacctttgaccaaagaagtgtcagcttcagttttgtgctgcatctccatcaactcaaccatgtgcaagtcgacgggtttgtcgccctgcttgatggccaaaatcccgtcgacgcacacctcggccagaacgtcggccaacttccggtgcaccttggtcctcaagctggtcttgcacacgtccatcaggctctctctggacgcctcgacggggatcttgatcttctccaagacctccagcgccttggctctggctttgtcgaagccctcggccaggatcctcgggtgcaaaccttcggatatgtagatgtcggcctgcttgaggagctcgccgatcaccaggacggtggaggtggtgccgtcgcctgtcatgtcgtcctgcgcggtggaagccctggctatcaaggaggcggtagggtgctggatttgcatctcgtgcagcaagacgttgccgtccttggtgattttgatgtcgcccgcgcc

SEQ ID NO: 1171 - DNA, 2736 bp, Meligethes aeneus
atgtctagtgctgaaatcgtagatagttccgtcgatccccctgccaagaagaggaagctagaattgtcatcgttttcctcagacatggcgaataatggagccgaaggatcgtcacaagccggtgacattgatgaggggctatattctcgtcaactttatgttttgggacacgatgctatgcgacgcatggcttccagtgatgttcttatatccggtttggggggattaggagtagagattgcaaaaaacgttattcttggaggtgtaaagtcagtgactttacatgacgaggcagtttgtactatttctgatttatcatcacaattttatttcaatgaatcggatgttggtaaaaacagagccaaagcttgttgtaaatcattatctgaattaaacacttatgttccaacaacagcatacactggtaaattagatgaatcatacatcttaaaatttagagttattgttttaacaactagtagcttaaaagaacagttgcttattagtaaaataacacattctaataatatagccttgattattgctgatactcgtgggctatttgctcaagttttctgtgactttggagaatcatttactgttgtggatataaatggggaacctcctgtatccgccatggttgctgatatatcatcagaaaaagaagctattgttacatgcattgatgatactagacatggcatggaagatggggattacattacattttcagaagttaaaggaataactgaattaaataactgcaaccctattaaaattaaagtgttaggtccatacacatttgtaattggagacacaaccaaattttctaaatatgagcatggtggaattgccactcaagttaaaatgcctaaggttgtaaattttaaatcacttactgaatccttggaaaatcctgatttcataataagtgattttgctaaatttgatagccctacacagttacatcttgccttccaggcattgcatgaatttattgaaacacattctagaaccccaacaccttggagcccaagtgatgcttcagaattcctaaatattgcaaagtcaattaataaacaaaatattgaaattgattccaaattacttgaactattttctaaaatttcttctggagatttaaaccctatgaatgccactattggtggaattgtggcccaagaagtaatgaaggcatgctctgggaagtttcatccaatttatcaatggttatattttgatgccattgaatgtttagagtcagatgaacccgaagaaataactgaagagttagcggagcctattggttccagatatgatgggcaaattgctgtttttggtaaaaattttcagaaagctattggtgaattaaagtatttcgtagtcggagctggagcaattggatgtgaattattgaaaaattttgcaatggttggtttaggaacccaaggaggagaaattactgtcactgatatggatcttattgaaaaatcaaatctcaaccgacaatttttatttagacctcatgatgttcaacagtcaaaatctgttacagcagcaaaggtcatcaaaaaaatgaacccagatgtaaacattgcagctcatgagaatagagttggagtggacactgaaaatgtgtatgatgataagttttttgaaagtttagacggtgttgctaatgcattggacaatgttgatgcaagaatgtatatggatcgtagatgtgtttattatcgcaaacctttacttgaatctggtactttgggcactaagggaaatacccaagtggttgtacctttcttaactgaatcatatagttcttctcaagacccaccagaaaaaagcatccccatatgtactttaaagcatttccctaatgccattgaacacactttacagtgggcaagagaaacgtttgaaggactttttaaacaaaatgcagaaaacgcatctttgtatctaaaagatcctgaatttgttgaacgcactctaaaactacctggcgttcaaccgcttgacacgttgcagtctgttaaggcagctttgattgatgaacgcccaaaatcttttgaagattgcattcattgggctagacttcattggcaagaacaatatagcaatcaaataaagcaacttttgtttaactttccgccaacacaacttacaagcactggtcagttattttggtctggtcctaaaagatgtccagatccacttgaatttgatgtaaacaattcacttcatttggactatattgtagctgcttccaatttaaaggctcaagtttatggcattcaaaccaatagagataggatgtatatatctcaaattgtaactcaagttgaggtaccggaatttgttccaaaatcaggtgtaaaaatttccgtaaccgattttcaaatgggaatgagcaatggttcaaatgttgatttggatcgggtaagccaaataagagaagaactaccgcctgctccagagtttggaactttgcgattaatgccaatagaatttgaaaaggacgacgattcaaacttccatatggacttcattgttgctgcatctaaccttcgtgccactaattacaaaattgtaccagctgatagacacaagtcaaaattaattgcagggaaaattattcctgccatagctactacaacgtccgtagtggcgggggggggggggtttttgttatttttatttttaataaaaaaaaaaaaaaaaaaaaaaaaaaaaaaa

SEQ ID NO: 1172 - DNA, 1278 bp, Meligethes aeneus
atggctgatgctgatgatcttttggattacgaagatgaggaacaaaccgaacagaccacgaccgaaacggcgggagcaggggacgccaaaaaagccgttaagggtacttacgtatccatccacagctccggttttagagattttcttcttaaacctgaaattttaagggctattgtcgattgcggttttgaacatccatcggaagtacagcatgaatgtattccacaagccgttctcggcatggacatcttgtgccaagcaaaatccggtatgggtaaaaccgccgtgttcgtgttggcaacgttgcaacaactcgagcctaccgaaaacgtggtctacgtactggtaatgtgccacacgagagagttggccttccaaatcagcaaagaatatgaacgattcagcaagtacatgtccaacatcaaagttggcgtgttctttggtgggttacctattcaaaaggatgaagagctgttaaaaaacaattgcccacacattgtggttggtactcctggcagaatattggcgttggtccgttcgaagaagttgaatctcaaacacctcaagcattttattcttgacgagtgcgacaaaatgctggaactattagatatgagaagggacgttcaagaaatatacagaaacacacctcacggaaagcaagtaatgatgttcagcgccactctcagcaaagaaattcgtcccgtctgcaagaagtttatgcaagatccaatggaagtttacgttgacgacgaagccaaacttaccctccacggtctccaacaacattacgttaaactaaaagagaacgaaaaaaacaaaaaattatttgaattgctcgatgttcttgaatttaatcaagtcgtcattttcgttaaatcagtacaaagatgcgttgcactggcccaattattgactgaacaaaatttcccagccattggaattcacagaggaatggaccagaaagaacgtttgtcaagatatgaacaatttaaagatttccaaaagagaatattagtagccacaaatctctttggtagagggatggatattgaacgtgtaaacattgtgttcaactatgacatgccagaagattctgacacctaccttcacagggttgccagagcagggcgttttggtaccaaagggttggccattacgtttgtgagtgaagaaagtgatgccaaaattctaaatgaagtgcaggataggttcgatgttaatattacagagttacctgatgaaattgatctcagctcttatattgaaggaagataa

SEQ ID NO: 1173 - DNA, 777 bp, Meligethes aeneus
ccgccaggtttggagggcggcgacagcaaaagggacacggatatacagggtgtgatggaaattcgcgagcaagcaagacaaatcgaaaaagcggtggcgaataaggaaaaccgctttattttgagggttttgaggtgcttgccgaacacgagacgtaaattgaacggtatagtgctgagaagtttgatctcgcagatatatcctttgtctgaacgggaagctttgttgtcttttgttgaagaggctgtagggtctgagattgattctcagacgagggcgagatcagcaactaaaacccccgtgtcggaagttgacttgtacatccatctcatcattctggtacgtttgattgatacaaacaaactagaagaagccttacgttgctcccaggctttaatgggtaaaatcaccagtcaaaacagacgtacttcggatcatattgccgctaaatgctatttctaccactcccgcgtcgccgaattaaccgacaaacttgatacaattcgtgcgttcctacatgcacggttaagaacagccacactgagaaatgactttgaagggcaagctgtacttataaactgcctattaagaaactatctgcattactctctatacgatcaatcagataaattggtgagcaaatgcgtttttcctgaaacagcaagtaacaatgagtgggcaagatttctgtactatttaggcagaattaaggctgccaggttggagtacagtgtggcccacaaacatttggtgcaagctatgagaaaatctccgcaa

SEQ ID NO: 1174 - DNA, 1665 bp, Meligethes aeneus
atggcaagtgctccgcaaaacttacctgtatcggagattctcaaatccaaagcagaatttgaggatgaacctaagaaaaagtcgagggaagattggaggaaagcaaaagagttagaagaagcacgtaaagcaggtacagccccagctgctgtcgatgaagaaggtaaagatattaatccgcatataccacagtacatttcatcagcaccatggtattatggaactagtgggcctacgctaaaacatcagagacctcaggaagagaaacaaaaacaattcagtaagattgatgaatggtatagcagaggagtcgataatagtaaaatagtgacaaaatatagaaaaggagcatgtgagaactgtggggctttaacccacataagaagagactgtatggaaagacccaggaaagtgggtgcaaaatattctggagcaaatatagctgcagacgagtttgtacaaaaaaatctagccttaagttttgatggtaaacgagatagatggagtggatatgacccatcagagcacaaagctgtaatagaagaattccaaaaagttgaagaagccaaaagacaattaaaagctgacaaattggatgctaatgaagatagtgaggaagaaggtgaaaaagatgaggataaatatgtggatgaagttgatatgcctggtactaaagtagatagtaagcaaaggattactgtaagaaatttaaggataagggaagatacagccaaatatttaaggaatttagatccaaattcagcttactatgaccctaaaacaagatctatgagagaaaatccaaatccaagtaaggatgatccttactctggtgaaaattttgtgagattcactggagatacaacgaaacatttaaatgcacagttgtttgcatgggatgcttacgaaaaaggtgttgatgtacacttactagcagaacccacaaaattggagcttttacaaaaagaatatgaacagaagaaagaacaatttaaaggcaaaattcaaaacaacatcctggaaaaatatggaggtgaagaacacttggatgcacctccaaaaacattacttttagctcaaacagaagactatgttgaatactcaagatcaggaaaaattgttaagggacaggaaaaagaaatcataaaatccaaatatgaagaggatgtttacattaacaaccacacatctgtatggggttcattttggaaaggtggtcattggggttataaatgttgccattccttcataaaaaattcatattgccttggagaaaatggtaaaaataaaaattcaacagaatcaatacctttggttgaagaatcaactaaagatgaagaagaaaaagaagaatccccagaagaaaaggaagcaagttcaagtaatgaagaagattcaaaattaaagaaagaaaagaggaaaaagaaaaaggacaagaagaagaaacaaaaggagaaaaagcaaaataaaaaaaaggatttgcttaaagaggctgtaaaggctgaagaacaaagccaagaaaatgctgataggttattggcaattgatgaaagaaagagaccttataacagtatgtttgaagctaaaaaacctactgaggaggaaattgaagcttactacttgaaaagaagacgagaggaagatccaatgaatcaatttatgtaa

SEQ ID NO: 1175 - DNA, 525 bp, Meligethes aeneus
accaaacttggaggaccacgtagaatccaccctgttcgtactcgcggaggaaacttgaaatacagagcattaaggttagataccggaaatttcgcatggggtagcgaaggcacagcccgcaaaacccgtatcatcgacgttgtttacaatgccagtaacaatgaattggttcgtaccaagaccttggtaaagaacgccatcgttgtcattgatgccacaccattcaggcaatggtatgaaaatcattacattttacctttgggacgcaagaagggagccaaattgactgccgatgaagaagctattttaagcaaaaaacgcagcaaaaaagtgcaaaagaaatacgaaacaagacaaaaaacatctaaagttgaacctgctattgaagaacagttccaaactggtagactattagcatgcttggcttccaggcctggacaatgtggaagggctgatggatatgttcttgaaggcaaagaacttgaattctacatgcgtaaaataaaatctaagaaagctaaataa

SEQ ID NO: 1176 - DNA, 333 bp, Meligethes aeneus
gggtttggttgttggttgtcaggggtggatattaacacgcaacaatcatttgaggctctctctgaaagggctgtggctgtcgtagtcgatcctattcagtctgttaaagggaaggttgtgattgacgcttttaggctgataaatcctaatatgatggtcttagggcaggaacccagacagaccacatcaaatttggggcatttacagaaaccttctgtgcaagccttgattcatggactaaacaggcattactactctataagtattaactacagaaagaatgagttggagcaaaaaatgctgttgaatctccataaaaaatcctggatggat

SEQ ID NO: 1177 - DNA, 1215 bp, Meligethes aeneus
atgactgtaataaataagatggatattgatgggcctcccaaaggggagggtttccggtcctactatatcaccaaaattgaagaattgcaactcattgtggctgagaaaagtcaaaatttgaggcgtctgcaagctcaaagaaacgagttaaatgctaaggttcgtatgttgagggaggagctgatgttgttgcaagaacaaggtagttatgtgggtgaagtggtaaaacccatggacaagaaaaaagttcttgttaaagttcatcccgaaggaaaattcgtcgttgatattgataaaaatattgatattaacgatgttacacccaactgcagagtggctttgaggaatgagagctacactttgcataaaattttacccaataaagttgatcccttagtttcacttatgatggttgagaaagttcctgattccacttatgaaatggtgggaggtctggacaaacaaattaaggaaatcaaagaggttattgagttgcctgtgaaacatcccgaattgtttgatgctcttggaattgcacaacctaaaggtgtactgttgtacggcccacctggtactggtaaaactctgttggctcgtgcggtggcccatcacactgagtgcacctttattcgcgtctccggttccgagttggtgcagaaattcattggcgaaggttcgcgaatggtgcgcgaactgttcgtcatggctcgcgagcacgcgccctccatcattttcatggacgaaatcgattccatcggttcttctcgcattgagtctggttcaggtggagactcagaagtacaaagaaccatgctggaacttttgaaccagttggacggttttgaggcaaccaaaaatatcaaggtgatcatggccaccaacagaatagatattttggaccctgctctcttaagacccggcagaattgaccgtaaaatcgaattccccccaccaaatgaagaagccagattggacatcctgaaaattcactcgagaaaaatgaacttaaccagaggaatcaatcttaggaaaatcgccgagctaatgcctggagctagcggagctgaagtcaagggtgtatgcactgaagcaggtatgtatgctttaagggaaagaagagttcatgttacccaggaagattttgaaatggctgtcgcaaaagtcatgcaaaaagattcagagaaaaatatgtccatcaaaaagttatggaaataa

SEQ ID NO: 1178 - DNA, 600 bp, Meligethes aeneus
atggtaaaattatattgtttaagcgtgttgcacaaaggtcccacaacagctacgtggttgaaatcggccttcgagctgcaaagcttcagcttctttcagcgcggctccgtgcaggagttcatgtcgtttttctgcaaaaccatagtggaacgaaccattccagcttccaggcaatctgtcaacgaaggagagtatttgtgtcacgtgtacgtgagaggcgataatttagctggcgttgtgataaccgatcatgagtatccatcgagagtgtcacacactttaattacaaagattttagacgagttttctgttaaatttcctgtggagagttggccccaattgcaagaaagagacgtggcgttcccacagttaaatacttacttagcgaaataccaaaatcccagtgaggcagatgcaatgactaaaatacaagaagatctggatgaaacaaagattattctacataacaccataacagctgtccttcaacgaggcgaaaaactggacgatttagtttccaaatcggaaggcctcagcatacaatcgaaggctttctataaaacggcccgaaaaacaaacagttgttgttcattcagttaa

SEQ ID NO: 1179 - DNA, 438 bp, Meligethes aeneus
cacattggatgtgctgtttctgggcttatggctgattctagaaccatgattgatagggcaagaatagaatgccaaaaccattggtttgtttacaacgaaaacatgagcgttgaatcttgtgcccaagcggtttcgaatttggccattcagttcggcgattccgacgacgacggggcggccatgtccagaccctttggagttgccattttgttcgccggaattgacgaaaagggtccccagctataccacatggacccttcgggcactttcgttcaattcgacgcgaaagcgattggttccggttcggagggagcgcagcagagccttcaggaggtttaccatcgcagcatgaccttggcggaggctaccacgtccgctttgaccatcctcaagcaggtcatggaggagaaattgaactcttccaacgtggaagtcatg

SEQ ID NO: 1180 - DNA, 1158 bp, Meligethes aeneus
atgacagagtactggctaatatcggcaccaggggacaaaacctgtcagcaaacatgggacaaaatgaacactgctaccagcaagcaaaacagcttgtctcttaactataaattccacattcccgatctcaaggttggtactttggaccaattggttggtttgtccgatgatctgggtaaactggacgcatttgttgaacaagttaccagaaaagtggcctcgtacttgggtgaagttcttgaggatcaacgggacaaacttcaggagaacttgatggccaacaacaccgacttgccaagctatctgacccgattccaatgggacatcgcgaagtacccgatcaagcagtcgcttcgcaacatcgccgacatcatcagcaaacaggtcggccagatcgacacggacttgaagaccaagtctaccgcctacaataacttgaagagcagtcttcagaacatggagaagaagcaaaccggcagcttgttgactcgcaacttggccgatttggtgaaaagggagcattttattttggattcggagtacctcaccacccttttggtgattgttcccaagagctcttttaatgaatggaacgccacatacgaaaagatcaccgatatgatcgtacccaggtccaccaatttgattatccaggacgctgagtatggactctacacggtatctttgttcaaaaaggtcgttgatgagttcaaacttcactccagagaaaagaagttcattgttagggacttcacttacaatgaggaagaattggctgccggtaaaaacgagattaccaagttggttactgataagaagaagcaatttggtcctttggtgaggtggctgaaggtgaacttcagcgaatgtttctgtgcctggattcacgtgaaagccttgagagtgtttgttgaatctgttttaagatatggtttacctgtcaatttccaagcaattttaatccatccaaataaaaagaccatgaagcgtttaagggacgttctccaccagctttacggtcatttggacagtagtgcagcgctttcaggcgtcaacgtagatagtgttgacattcccggcttaggctttggtcaatcggagtattacccttatgtttactacaaaataaacgtcgacatgatcgactcaaaagtataa

SEQ ID NO: 1181 - DNA, 804 bp, Meligethes aeneus
caccaccacggatttcgactccagcacgcgcttcacgacgcacagggcgtcgtgcaccgaacgctccatctcgtcgcagtagaagtcgttggggccgcgcaggattatagaggccgcggtgcgggcctttggctttttaataatgatcaactcatcatcgcagattctctcctgggttacttcggccgcttcaccaaccatactgctgtcgaaagtttcatcaccgtccatgttggtcaaggatgtgagataagcggctccggtggctttggcgatgcgcttgaggtcgaccttcttgaccctgcgaacggccatggcgttcttctcgacgaaatacttgaggcagaggtcgtcgatgccgccggaaaccaggacgacgttcacgcccgtcgccaggatcttctcgatgcgctccttcgtcatgtccagctcgcggttcctgatgccctccaacttgtccgggtcgctgatcaggacctgcacgcccaacttcatcttggacttttgcagcgaaaagtccaggcacgcgatcttcgcgttggcgatcttcttgggcatggcctggctggcgacggtgcagttcagcgcgtaaccctgcaccaagacgctctccctcgcacttctgccgtgcgccttgaggatgttgaccgccttgatggggtacatggcctggcctttcgggtcctggatcttgaccgcctgagcggcgtccacgaccatggtcgagaacagatcggcatcggagccgatgattttagagctcatcgaggttttggccacgtttatcaggcactcgcgccccaa

SEQ ID NO: 1182 - DNA, 774 bp, Meligethes aeneus
atgttcgatccaacatcaaatccaccacctttttggcaaaatggccctgcaccgggggctttctataatttcccaaacacgaaatccggcccaagcgacgaatttcaacattctcaggctcccataacgacagcaacgtccattgtggctataaagtacgccaccggggttataattgccggtgatttgctgggttcgtatgggtctttagcccgttacaggaattgccccagagttttgcaagtcaatgagaatattattcttggagctggcggagattacggcgatttccagtacataaaaaactttattgagcaaaaaattgttcaagaagaatgtttggatgatggttttaagctaaaaccaaaatccttgtactgttggttaacaagggttatgtacagttgtagaagcaaatttgatcccctgtggaataatttggttataggaggaattcaagatggtgaacctttcttgggtacagtagacaaactaggcactgccttcacagataaaataatctgcacagggtatggggctcacattgctgttcctttgcttagagaggctatggaaaaaaatccaaacatgtctaaagatgaagctaaagctcttgttgaaaaatccatggaagtcttgttttacagagatgccaggagtttccctaaataccaagttgctataattgaccaaaatgaaggttcggttattgaaggcccattggtggtcaaacaaaattggtctttggcccatatgatttctggatataattaa

SEQ ID NO: 1183 - DNA, 2076 bp, Meligethes aeneus
ccaacacttactctgctggcttcaacagaatttcagcccgaaaaatatgttaaggatttgtcccagaactatgtaggtggttcagagttgcaagctataagaaagaaaatacaggcgttgtcagaggatactaataataatttaaagaagaatgtatatcaaaattatggtcaatttattgatacagccaaagaaatatcccatttggagagtgaaatgtatcaattatcccatctattatctgaacaaaagtcccttttgaactctctggcatcaacttccttaatgggggataatagcaatttaactagaaacaaggaaagatctgaggagaaaattattgaggaacaaaaacagaaaactcaatcaattctagagaaagtggagggatgcaaagatgttttagatatcccaggtagaacgttcttgcatgagggagatcttttggaattagattctttagaaaataaaccaattaaaccagtgcatgtttatttatttaatgatggttttatgattacttcaagaaattccaatagtcgaggattaatgaaatataagtttgaagttatgtatgaattaggcagtttagctgtggttaatgttagagatttaggggatgttaaacatgcttttaagttgctaatatttcctgaaactagaatatttcaatgctcttcaaattcaaataagaaagattggttggataaatttgatcaagccaagaaaaaccagctttcacaggatgtccaaagacgcgaatctataatagaaagatcaccttcaagaaccactatagaatcaggcatacacagcactttaagtgaatctgaagatgacttggttattataacacatccagaatggtttttggatttgcctgaagaacttgatgtaggtgtggcacaaagacattttgaggaagctataactttgttgcagaaagggaaggattatatgtctcagttaggtttgccaaatgccaagacagaccatgttctaattgatatacaaagaaagcttgacatgcgccagtctagtttaaccgaagtcctaatgaaagaattggaaataaaccctgacaaatctttgcaaggtggtttaagggccgccagacgggcagtgagactattaaaccaattgggacgttcaacacaatcctgcgatttgttccttaagttatgcagtagcatgctaaaaatccaatgcaaaagagtaaaaagggaggggtctacaaccacatacataaggcacttgtctagtgtggtttttaccaatatgtgtcatatgactgatgaatttttaagggctttccccgagtcttcagtatgcgcatccgcttatattgtatgggcttctagcgaattgtcgtcattttccgcacattttatcaaacaagtttttgtacctcaaacatctttggctacaatcactgaatgcgtgtttctggttaaaacacaatgtgaaaggttatgtaactatggcatagatctttgctaccaactagatggggcacttttgacacctctaacaaaagctttaactgatacaagggataaattaatagattctgttaaagtaagagctttggaagataagtggataccaacgaattttcatactaaaaacggtttaagtaggtgtttgaatgaacacagagaaatgggacttcaacttgactcatatgtaactggggacatttggctacaactaactcaaaacacaatagctttcacaaaagttttcctagcgttattagaatgctgcttgagacttaaaactacagaattactttacactgtggatacagttctctatgaaatatatggtgcacaactaaaacattatgagcttacattaaaaaaggatttacaaaaagaggaaaggcagttcataattaaaaatacggaatttctcttggtaaccctctacaatttaattcaaagaaaatacacaaaatcaaacggttttgagtgtaaaacttttgccaaagtacaaattgattatgctgctttaatgaaaatttgtttagggaatagaaatataaaaactaaatactcatctgagtttttgtaa

SEQ ID NO: 1184 - DNA, 3609 bp, Meligethes aeneus
atgaatgaagttgagaagctagaatatttatctttggtttccaaagtatgtacggagctggaaaaccatttgggaatgaatgataaagacttggccgagtttatcatacatctatcagaaacacacgataccgtatcaagttttaagaaagttctaattgaaaatggggcggaattttcggattcttttgtcagcaacttgctgagaataatccagcatatgagaccaagaaaatctggtcaaaacagttcaaaggcaagttcccaacctgacgctgataaaaatgacttggcgtttaagtttcccggtctggccttgcccaatgaatcccaaaaacccatggaagaagaaaaaaagcctgctgacaagccaaaagaaaaaaaagaagataacgatgttgtagctgatttaatggcacaatttgaagctcaagccccttcaagtaataaagagggtgatagaaaaagggaaagaagcagaagtaaagaaagagatagacatagagaaggggacagaagcaaaagaaacagatcaagatccaggtcaagagagcaccatagagatagaagaaacagatctagagatagagatcgaagcaggagacataggtcaagatctagggaaagaagaaggtcaagggacagaagaagcagatcaagagaaagaaagcacgataaacatgatagagttaataataagaataagcatgaacgaagtccagaattggatgatgatccggttccaggaaaaatatacagtggcaaagtagccaatatagtgccatttggatgttttgtgcaaattgaggggttgaaaaggagatgggaggggttggtgcatatatcccaattaagggctgagggtagagttactaatgtttctgaggtcactgctagaggcaacaaagtaaaagtaaaaatcctctcagtaactggccagaaagtatctttgtcgatgaaggatgtttgccagatgagtggtaaggatttaaatccactgtcacatgctccttctgaaagggaagatagggatagaaatccggataggcccacaagtagctccactagtgtgttcagattgcctgtaggtactgatgaaggagaagaggattccaggaagaaaatcaccaaaatgtctagtccagaaagatgggaaatcaagcagatgatttcgtccggttgcatagataaaagtgaactcccagaattcgacgatgaaaccggacttttaccaaaagacgaagacggcgaagcagacattgaaatagaactggtcgaagatgaagcaccatttttgcacgggcacggtagagcaatgcacgacttaagcccagtaagaattgtcaaaaatccagacggctccttagcgcaagccgccatgatgcagtctgctttagctaaggaaagaagggaacagaaaatgcttcagagagaagcggaagtcgactctcaaccctcggggaaaaacaaaaactggattgatccgcttccagaagaggaagataaaccttctcaagcaaggggtattggcttgcaaactcaggatcttcccgaatggaaaaaacacgttattggcggtaaaaagtcttcttttggtaagaagaccaatttgactatagtcgaacaaaggcaatctttacccatctacaagcttaaggaagaattaagaaaagccgtgaccgataaccagatcctcatcgtcatcggcgagaccggttccggcaaaacgactcaaataactcagtacctcgccgaagctggctttatagcgcgcggcaaaatcggttgcacgcagccgcgtcgtgttgccgccatgtccgtcgccaaacgcgtcgccgaagagttcggttgccgcctgggccaggaagtcggctacacgatacgtttcgaagattgcaccagtccagaaacgattataaaatacatgacggacggtatgttgctcagagagtgtctcatggacttggacctcaaaggttactcggtcattatgctcgacgaggcccacgaacgcacaatacacaccgacgttctgttcggtctgctcaagcaagccgtgcaaaagcgccccgagctcaagctcatagtgacatcggcaacgctggacgccgtcaagttctcgcagtacttcttcgaggcgccgattttcacgatacccggcagaacgtttcccgtcgaggtgctctacaccaaggagccggaaaccgactacctggacgccagcctgatcaccgtgatgcagatccacctgcgggaacccccgggagacgtcctgatctttctgacgggccaagaggaaatcgacacggcctgcgaaatattgtacgaaagaatgaagtctctaggccccgatgttcccgaactcatcattcttcccgtgtattcggccttgccctcggaaatgcagacgagaatattcgatccggctccgcctggcagcagaaaagtcgtcattgctaccaacattgccgaaacttccctcaccattgacggcattttttacgtggtagatcccggtttcgtcaaacagaaagtttacaactccaaaactggaatggattcgctggttgtcaccccgatttcacaggctcaagccaaacaaagagcgggacgagcagggcgcactggtcccggcaaatgttaccgcctgtacaccgaaagggcgtaccgggacgagatgttgccaaccccggtacccgagatacagcgaaccaatctggcgaccaccgttcttcaattaaaaaccatgggcatcaacgacttgctccacttcgatttcatggacgccccgcctgtggagtcccttattatggccttggagcagttgcattccctttctgccctggacgacgagggtctcttgacgagactcggtagaaggatggccgagtttcccttggaaccaaatttatcgaagatgttgataatgtcggtggcactgcaatgttccgacgaaattctgacaatagtcagcatgctttcggtgcagaacgtgttctaccgaccgaaagacaaacaagcgctggccgatcagaaaaaggccaaattcaatcagcccgaaggcgaccacctgacgcttctggccgtttacaacagctggaagaacaataagttctccaacgcttggtgctacgaaaatttcgtgcaaattaggactcttaagagagcgcaggacgttagaaagcaactgttggggatcatggacaggcacaagttggacgttgtgtcagcagatagaaatacagttagagttcaaaaagctatatgttcagggttctttagaaatgccgccaaaaaagatcctcaagaaggttataggactctggtggacagccaggttgtttatatacatccttccagtgccctgttcaacagacaacctgagtgggtaatatatcacgagttggtgcaaaccacaaaagaatacatgagggaggtaacaacaatagatcccaaatggctggtagagtttgcacccgcattctttaaattctcagatcctacaaagttgagcaagtttaagaaaaaccaacgtttggaaccgttatacaacaaatacgaagaaccaaatgcctggagaatatcgcgtgttagaaggcgaagaaattag

SEQ ID NO: 1185 - DNA, 1263 bp, Meligethes aeneus
atggctcctacaagaaagcatatagatgatatattagctagggttaattttcctttgtacacaatacaaatgctgtcaaacagacatgttctagtcggaggcggaggaggttcttcgaaaactggcgtagcaaatggatttgaaatatttgaaatagcccatgatgggaaaaaatttattgctgaagaggtgaccagacacgaaacaggacccagtgttgttatgaattgctcatcgtacagtaacagtaaacattcctacttagtggcaggccaagaaagtcattgtcagttatacagtgttgatagtgttctagtcagagatgaagataatgtggaaaatgttggtgaaaatcacacggaagtgaggcaacgtaaagcaaaacctaaagaacaaacagacaataacagaaatgtgaaaaagagattaaagtttaatatcaagcctatggacagtgtgcagactgattttaatggacaggaacctttgttgagagttatgcggatagggcacaatggaaaaatgctggcaactggtggtacagataatacaattaaactatggaaattccctaacttagagcccctagcaacattaaaagcccacgaaaaagaaattgatgacatagattttagccatcatggtaattttttaataactgttgcaaaagacggtttggcagtattatgggatagtttaaagggtaaagaacttaacaggctggaatggaaacaacctgagggatcaaaatatttatacaaaagatgcaggtttggccttatcgaggggctggacgagaaaaggtctgctctgtacatgctggcaaatcccacaggcgtggccagaaagcaaaaatcctacctgcaacaatggttggccgaaggtggccacctgaaaaattccatcgagttcgatgaaagtttgagcgcgttggctgtgagagacgacggcagattcgtagccgtcggtacgatgttcagcgggtctgtgtccatacacgctgcatttagcttgcagaaagttttaaacatttctggggcacattccatgttcgttacgggtttagaatttttaccggtatcgcaagataatcatacagctacaagtgtagctgaagctgcagttttatcaatttctgttgataaccatgtttgcatacacacattgccatttagaaaaacaatgccagcctggattggaatactcattttagtttgtacattatttatgacttttgtattttgttcctatttacgtatataa

SEQ ID NO: 1186 - DNA, 1317 bp, Meligethes aeneus
tttcaaaattttcgttgtcttttcaaatccaaatcagacgttcacaatgatgtgtggttaaccaatatggcgggcgcgatgttgtttgaaagagcgcaatctgtttcttcgcaccacgataaacttctggaaaacctgaaacgcgaacaagaagaacgcgacgatgaagaaaacatcaaaaataaggagcaggacatcctgaatttgggcgagaagtataaaaaagagggtaaggctaaggaactcgcggaactaataaaggccacaagaccgtttttgggggaaataagcaaggccaaagctgctaaactggttagatctttggttgacttcttcttggacttggaggctggcattggtatagaagtgcaactgtgtaaagaatgcatagaatgggcaaaggaggaacgaaggactttccttcgtcagtcacttgaggcgaggttaatagccctatatttcgataccggtatgtttgcagaggctctgctgttaggatcaactctacttaaagaactcaaaaagctagatgacaagaatttgttagttgaagtgcaactgttagaaagcaaaacctatcatgctttaagcaatttacctaaagcccgtgccgctttaacttccgctcgtaccaccgccaacgcaatctattgcccccccaaaatgcaagccgcccttgatttgcaatcaggaattttgcatgctgccgacgagaaggattttaaaactgcctattcatacttttacgaagcgttcgagggttttgacagtgtcgaatcaccgaaagctctaacagccttgaaatacatgctgctctcaaaaataatgctcaacaacccggaagacgtgcaacaaattgtcagcgggaaattagcaataaagtatgccggtcgtgatattgatgccatgaaagctgtggcacaagcatctcacaaaaggtctctggctgattttcagcagggtgtcaagcagtttaagcatgagttggaagacgatgttattgtgagagcacatctgggtacattgtatgataacatgcttgaacagaatctgtgtaggattatcgagccttattcaagagttcaggttgattatgttgctaaaactattaagcttccaatgccacaagttgaaaagaagttgtcacagatgattttagatgctaaatttcatggaattttggatcaaggagaaggtgtgcttattgtatttgaagaaactccagtagataaaacatatgaaatggctttagaaacaatacagagtatgagtaaagtggtagatacactttatcagaaggctaaaaagttgtcttag

SEQ ID NO: 1187 - DNA, 699 bp, Meligethes aeneus
atgtcttcgaaatcgaaaaaaacctcgacgccggcttcgcagatgccgcagcgcccggcgagccctctcagcccaacaagacactcccgtctgcaggaaaaacacgacttgcagaacctcaacgatcgtttggccagctacatagataaagtgcggtatttggagcaggaaaactcgcgtttgaccagggaagtgcaaacttcgcaggaatgcactacgcgggagatcaccaacatcaaatccatgtacgatgtggaactcagcgacgcccggaagcttctggacgagacgcacagggaaaaagctcgcctggaaatcgacgtgaaacgtctgctggaagaaaacgacgagttaagggacgatttggcgcgcaaaagcaaagatctgatgatcgctgacaactctgcacgtatcaacgaaaccaaagccaacgagatgcagctgaagtacacccaggccaaccaggacgccaaaaaggccatcaacgatgcccgaaacttggagaaggagcgcgacaagctgcggaagcttctggacgagcaccgcaaacatctggaagaagagagtttggcacgcgtcgaaattgaaaacgcaaaccaaagtttgagggaagagctctccttcaaagatcagatccaccagcagatcctgacggagacgaggacgcgccggcaggtcgagctgagcgagatcgacggc

SEQ ID NO: 1188 - DNA, 1869 bp, Meligethes aeneus
gagggagcccccaccaagcgcgaaggggaggaggaagccttgaccgcggtcggctacgacgacatcggcggctgccgcaagcagctcgcgcagatcaaagagatggtcgagctgcctctgaggcatcccagcctgttcaaggccatcggcgtcaagccgccgagaggaattttgctgtacggcccccccggcaccggcaagactctgattgctcgcgccgttgccaacgaaaccggtgcgttcttctttttgatcaacggtcccgagattatgagcaagttggccggcgagtccgagagcaacttgcgcaaggcgttcgaggaggcggacaaaaattcgccggctattatttttatcgacgagttggacgccatcgcgccgaagagggagaaaactcatggagaggtcgaacgtcgtatcgtctcccaactcttaactctcatggacggcatgaaaaagagctcgcacgtaatcgtgatggccgccaccaatcgtccgaattcgatcgatcccgctctacgtcgtttcggacgcttcgatcgcgaaatcgacatcggcatccccgacgccaccggccgtctggaagttttacgcatccacaccaaaaacatgaagctcgccgacgacgtcgatttggagcagatcgctgccgagacgcacggccacgtgggcgccgatttggcctcgctatgctccgagagtgctctgcaacagatcagagagaagatggatttgatcgacctggaggacgatcaaatcgacgcggaagtactaaactcgctcgccgtcacgatggagaacttccgctacgcgatgacaaagagcagcccgtccgctctccgcgaaaccgtggtcgaagtacccaacgtcagctgggaagacatcggcggcctgcaaaacgtcaagaaggaactgcaggagttggtgcaataccccgtggaacaccccgacaagttcctgaagttcgggatgcagccgtcgcgcggagttctcttctacggcccgcccggttgcggtaaaacactcctggccaaggccatcgccaacgagtgccaggccaacttcatatcgatcaaagggcccgagttgctgaccatgtggttcggcgagtccgaagccaacgtcagggatattttcgataaggcgcgttcggccgctccttgcgtgctcttcttcgacgagctggattccatcgctaaatccaggggtggaaatgtcggggatgccggtggggcggctgacagagttatcaaccagattttgacggagatggacggcatgggcgccaaaaagaacgttttcatcatcggtgctaccaacagaccagatatcattgatcccgcaattttgagacctggccgtctcgaccagctgatttacatcccattgccggacgacaagtccagggaggcgatcttcaaggccaacctgagaaaatctccggtggccaaggacgtagacatgaactacatcgccaaagtaacgcacggtttctctggtgccgatctgacggaaatctgccaacgcgcttgcaaactggccatcaggcagtgcatagagtcggaaataagacgcgagcgcgaaagggccaccaaccccaacgtggcttcgatggaggtagaagaagacgatccagttccagagataacaaaagcgcactttgaagaggcgatgcgattcgccaggaggtcggtttccgataacgacattcgcaaatacgagatgttcgcgcaaactttgcaacagtcgagaggtttcggtaccaatttccgtttccccaacgctggtacagggccacaggcaccaggtggcactgccggagaccagggtaacttccaggacgaccctgaagatgacctatacagctag

SEQ ID NO: 1189 - DNA, 825 bp, Meligethes aeneus
atgggagatcaattcgattgcgctctagacttaatgcgtagacttcctccacaacaaatagaaaaaaacttatgtgatttaatagatttggttcctagtttatgtgaagatttactgtcatctgtcgaccagcccttgaaagtggctaaagataaggattcaggcaaagattatttgttgtgtgattataatagagatggcgactcatataggtctccgtggtccaacacatactacccacctctagatgatggctccatgccttctgaacgcctacgtaaattagaactcgacgccaaccatgctttcgatcaatatagggaaatgtacttcgaaggcggcgtatcgtcggtgtacttttgggatttggaccacggattcgccggcgttattctaataaaaaaaaccggcgacggcagtaaaaagatcaaggggtgctgggactccctgcatgtggtcgaagtgcaagaaaaaagttccggcaggaattcacactataaaatgacttctactgctatgttgtggctgcagaccaacaaacaggaatccggtacaatgaatttgggcggcagtcttacccgacagatggaacaagacagcgtagtgagcgagtccaacccacacatcgcgaatatagggcgcatggtcgaggatatggaaaataaaattcgcaacactctaaacgaaatctactttagcaaaactaaggacatcgtgaacagtttaaggtcggtgcagccgttgaacgagagtcgtcaacagcaggccttgaagcaggaccttgcggcagccctgcagcgccgccacaacaaatcagacaactga

SEQ ID NO: 1190 - DNA, 4119 bp, Meligethes aeneus
atgcagcaagttatggctcccactctaaataatatgggcgcaaacatgaatgatacaagagaagcaccaccccgtaatgatactccagtggatccaatcaatggggtggttcagcctcttgttaacccagctccggaaaggccaggtcgtgtcactaatcagctccaatttctacaaaaaactgtgcttaaggctgtcagcaaacatcaatttgcatggccttttgcagcacctgttgatgctaaaaaactcaatttgcctgactaccataaaataattaaacaacctatggacctgggaacaataaaaaagagactggataacaactactattggtcaggcaaagaatgcatacaagattttaacacaatgttttcaaactgttatgtgtacaataaaccaggtgaagatgtggtggttatggcacaaactttggagaaagtatttcttaccaaagtagcagatatacccaaggatgaagtagttgtggaaccaccagcaaaaggtggcaagggcaaaaagggaagaacaagtagtgggtcaggaaccggtggagctacacccacagcagggagaggaagacctccaggtgctgtctcttcaactagcgcgactccagtggcaacaacaacaggatcatcaggtctaccactaggcacacaagctcccaccacagttcctggcagtactgccacaacaacaatcacacctgcatcgacacacagctctcttcctccccaaccaatatcacagaattaccactcaaattccttagaccccttatcaacatctgttttaccaggcagtgttgtacccccttcacaacctgcaaagtcaaaaaaaggagttaaaagaaaggctgatactacaacgccgacggctaacgcttacgactacaacccaccgttggaatcaaaatcggccaaaataataaacaggagggagtcaggaagacagattaaaaaaccgatcaggcctgaactggacggtctagtaccatacaaccaggccaccatttccccaatgaccaatatgaataccgccacacctcagcatgctgcgttgaagacgaaagagaaactcagcgaagccttaaaagcgtgcaatgaaattttaaaggaactcttctccaaaaaacattcaagctacggatggccattttatcagccagtggatgcccagctattgggcttgcacgattatcacgacattatccgaaagcctatggacttgggcactgttaaacaaaaaatggacaaccgcgagtaccgtaccgcgcaagagtttgccggcgacgtgagactgatattcacaaactgttacaagtacaacccctcggatcacgatgtcgtggccatggcacgaaagctgcaggatgtatttgaagtcaaattcgccaaaattccagaagaaccagttaataggataggtggcccacccgtcaagtccgagtccagttcgtctggctccagctcggaatcttcgagcgaaacagaggattccgaggaagaaaggcggaacaaacagctcaagtctctggaaaaagagctgataatgatgcaagagaaaatgcgcaaattggtagaggagagttcaaagcgaaagaaggaaaagaaaaagcaaaaggagaaggaaaaaccaaagaagacggtagcgaacaacaacagcagcagcggcaacagtaacaacagcattggtaagggggcacacggaggaatgattaataagtctaacagcgttgtagacagcgttgacgacagcattgccagtgtggtatcgggggcagatctcaagatagttggtggtgacgcgcatcatgcaacatcaggaaagtccctcgctgcgcaccacaacgctggcgccaacgctgctgccgccccaacgactaaatcggccaagagtaaaggagtgcgcggtcccaaacccagctcggtggcttccggtttccctgctgcgaatcgcagcaaccgggcggccaaacctgcgagcaaagccggcagaaagaagcaacaagcggctccggccccgctggcgttcgattccgaggatgaagacaacgctaaaccgatgtcgtacgacgagaagcgacagctctcgttggatatcaataagctgcctggcgacaaattaggaaaagttgtacatataatccagtctcgcgagccatctctgagggattcgaatccggatgagatcgaaatcgatttcgaaacgttgaagccttcgacgttgcgtgagctcgagagctatgtcgcatcgtgcctacgtaaaaagccacataagaaagtgcaaggtaaatcaaaagatgaacaaatggcggaaaaaaaacaggagctagagaaaagactattggatgtcaatgataaaataggaactaaaaaggcacccaaaaaagaagaggcaaacaaggtggacccgacaggcgcgggcgggccttccggccggttatcgtccagttcgagcagttccgattctgacagcagcagttcgagcctgtcgagcagcagtagtgactccagcgacagcgaagcaggtacaggcaaaggtcaacctaaaaagaaagccaaaaaatcacccaaccctgcaggaaatacaacgagtatacagaaaccacctatattaccaccacaaccagcacaaccaaccgccgcaccaccaacaaacaatacaacaaatctacctgtggcgagcaacaacagtgaggtaccacctccatcttccacttccagctccatatcctccactcaatcacaaaacagcaaccatgcagcatccaacaacaaatttattaccaaccctagtccgatgccctcagttgccagtcgtaaaccttccgtcgaaaagccgcccgtctcgttggcgtcgcaaaacattgcacctcccaccgctcctcaggtgccaaaaccggtcgcccttcctaccccgtcacccgacaaacctaaacctaatatcttgtcaccgttgtctagtgcgtacacggacccgctcgaacagtccctggctaggttagagcatgacatagcaaaatccgaaccaatggaagtcaagtccgaggccctcgacttgcccggcaatctattaccaatgccgcctgtccttagcaatcccatgctaaatcccaacatcaactctaatcctaacctacaccatgctttgcagccaaatttgggcatggacatgaaacagcccattgggatgatgccaatgatgccgccgaacttgcaaatgctaggtatgcacaatcccttggaaaatgacattgcatcgctgatgcaaaacagccacccgccctacatgatgcattcccaaaacaacggaatcggtatgaagaacgaatacgacatgcacacaaacaacaacggcatttcttccatgggtctgcccatggaactctctatcccgaccatgttcgactcgcttccgctacagatgaacaacagcgggatgagaaaagatcaaaatccgcccaaaatggatgaaagaatggacctggggcacatgggtatgagcaacgacaaaaaatctcacaacatggactcccataagcagcattctcaatccttcgccgctgggtacaaacctaacaaaccagaccacaacgtaaagaatgccagttcctggtctagccttggatccaaccttggaaaaggcagttcgcctcagagtaacagccaaggcggcagcagtaaacaaacagtcatggagagcttcaaggcgttccagaacaaggcaaaagagaaggccgatcgcgagaaacagcgcttggagaatttggaaatgaagcggttgcaaagagaacaggctgaaaaggaaagaatacgcgcggaaaacgaaagaagaagggaacgtgaagaagaagatgcactggagaaagcaaggaaagcggtggctgaacaacaacagcaacaacctatacctgtacaacgagttgaagaacttagatcgtcacctggtgaaggaagcatctctcctggttcacagagttcaggttccgaaaagacggaaagggaaagacagcgattacaagaacaagaaagaagacgaaaagaagcgatggccaataaaattgacttgaatatgcaaagtgatcttatggctgcatttgaaggttcattataa

SEQ ID NO: 1191 - DNA, 555 bp, Meligethes aeneus
gaaatgaccaagaccaagcaagctgtgcaattcttgaggagaatcaaggcctggtctgacatccaaaaggtgtacaaaagccagcgcttccgcgctggtaaaggtaagatgcgtaacaggaggcgcatccagcgtaaaggaccattggtcgtgtaccatcaagaccaaggattgcgtcgcgctttccgcaacatccccggcatcgacctcatcagcgtcggcaagcttaacttgttaaaattggctcctggtggtcacgttggacgtttcgtcatctggaccgaatccgctttccagagattggacaaattgttcggcacctggaaaactccatccggcgaaaagaagggatacaacttgccgcaacccaagatggccaatacagacctttccaggttgttgaaggccgacgaaattaaacaagttctcagagctccacagaagaagattgtacgtcgccagcgtcgtctcaatccaatcagcaacactagggctatgcttcgtcttaacccgtacgctgccgttctaaaacgccaagccattctcagcggacaa

SEQ ID NO: 1192 - DNA, 3264 bp, Meligethes aeneus
atgtccgattttatccaatctgaggccgaggagagcgaggatgaagacttgacaactcatgagcgtaaaaagctcaagaaagtcaaggcaatggatagttccgaggaggaggacgatgatgatgatcgactcagagaagacttgaaagatctgatcgatgatagaccaatagaagaaagcgatggcgaagagtcggacggttccaacggcgaaaaacgcaaaaaatccgacgatgaggagtttgatgacagattggaagacgacgactatgatttgatcgaggaaaatttgggtgtcaaagtcgaaagaaagaaattcaagcgtttgaggaggatacaagatgaggagagtgataatgaagaagagcaaggggaaggacaggaccgagaccaaatagccctaaagttgttcgatgatgatgatgatgagcgtagatcggaaagatcgcatcgaacaaccgtggagcccgaccagttcggggaagaagaagacgagggtgaatacagcgacgccgacgacttcatcgtcgacgacgacggaagacccatagccgaaaagaagaagaagaagaagcccatattcagcgacgcagccttgcaagaagcccaggaaacgttcggagtggacttcgactacgacgagttctccaaatacgaacaggacgagtatgaagatgatgaagacgaagaagacgacgattacgaggaggacgacgatggcgaacgcagacgacctccgaagaaagaaagacgcaaaaagcccacgaaaaaatccatattcgaagtgtacgaacccagcgagttaaaaagaggtttcttcaccgatttggacaacgaaattcgtaacaaggacgttcccgagcgcatgcagctccgcgacgttcccataaccccggtcgcggacgattccaccgagctggacgacgaggccgaatggatttacaaacacgcattttgcaaaccaagtgtttccaatatggaagcgaatttgacgtctgaacagagggaaaaattgaaaaagggtccgcaaactgtgacgaaaattcgcaaagctctggattttatgcgaaatcagcagttggaagttccttttatcgctttttacagaaaggaatacgtccaacccgaattgaacatcaacgatttgtggaaagtttataaattcgactccaagtggtgccaactgaaatctcgcaaggagaacctgatgaaactgttcgacaaaatgcgctcgtaccagctggacgagctgatgaaaaacccggacgcgcccatccccgacacggtgcgcgtcatgaaggacagcgacatggagcgcctgaaaaacgtgcagtcggccgaagagctgaacgacgtgcacaaccacttcgctctgtactacgcgggagatctggcagcgatgcacgcggcctggcggctcaaggagaaggagaggcggcgccaggagcgcaacgaggagaggatgcgtcgaatagccgagagcgaagacggcgccgatataccggaagaaccggaagaggaagtggacgacgagccggaagaacacctaaagtacgcgaatcgttcggggtcttacaagttgtgcagcagggccggactggacacgctggccaaaaaattcgggctgactcccgaacattttgcggaaaacatgcgcgacaactatcagaggcacgaggtcgagcaggagttcaccgaacccacggaagtggccaaagagtttatttctgccaaattctcgaccattgaagaagtaattcaggccgcaaaatacatggtggcccttcaaatagccagagagccgttggtgcgcaaatgcgtgcgcgaagttttcttcgagcgcgccaaaatttccatcaaacccaccaaaaaaggtcaaaaggtcatcgacgaggcccacaattgttacagtttaaaatacgtcaaaaacaaaccagttcgcgacctagccggcgaccaattcctaaaactcacaatggcagaagaggaaaaccttctcaccattacgataaacgaaaccattgaaggcaacaccagcaactcttacatagacgaagttaaacagctttacataagagacgagttcagtaagaacgtgcaggattggaacgctctgagagtcgagtgcgtcgaaagagccttaaccaggtgcatagtcccggacttgagggtcgaactgaagaggattttgctggcggaagccaaggagttcgtgctgaaggcctgctgcaggaagttgtacaactacatcaaggtgtctccctacgagatcgagttcccggacgaggacgaggacgagtggaacacgaacaaaggcatccggacgatgggattggcctacgtgcccgactacggccagtcggcgttcgcgtgcatcagctcccccgacggcgagatcacggactacctccggctgccgcacctcctcaaacgcaagaacagctaccggcaggaggagaagatgatgaaggaggcggatttgaccgcgatgcgaaacttcattttcacgaaaaaaccgcacgtgatttgcgttggaggggagagcagggaggccttgatgatcgcagaggatttacgcggagttatatccgatctaatagaaagcgagcagtttccttgcatcaaggtggaaattattgataacgagctcgccaaagtctacgccaactcaaacaaaggtacagccgactttagggactaccctgagttactcagacaggctatatctttagcgagaaaaatgcaagaccctttgatcgaatactctcaactttgcaacggggatgaggaaattttgtcgctcaggtttcatcctttgcaagaacaaataccgaaagaagagttactggaagctctgtgtctggagttcgtcaacagaaccaacgaagtcggcgtcgacataaacttggcggtgcaacagaaccacaaagtgaatctggtgcagttcatatgcggtttggggccgagaaaggggcaagctctgattcgcgtgctgaagcagacgaatcagaggctggagaaccgcacgcaactggtgacggcgtgccacatgggccccaaagtcttcataaactgttcggggttcataaagatcgacaccaacagtctgggagattccaccgaggcatacgtcgagattctggacggtagcagggtgcacccggagacttacgagtgggcccgcaagatggcggtggacgcgttggagtacgacgacgacgagggcgccaatccggcgggggggggggggggggggggggggggg

SEQ ID NO: 1193 - DNA, 2397 bp, Meligethes aeneus
atgacgacggattccgagagaggttcccctacagctgcggctccacgcagaagcgcctcgaaatcgccagaaccaaaaaaagcaaagtacgataagaaagagaagggcgataaagatcgcaagaggagatcccacagatccagatctagatccagggatagagaccatagggacaaacatggtggaaaaaaacgttaccacgacctggacgacccttctgaagactacccaagatattatggcgaggatagaaaacagaacagtgacagatattggtccaagtacccaaagaaagacagggacgaatatgttattggtagccggtattatgatgttgaggaaaagaaggagaaaaaggaaaaagaggatgaaaataaggataaatccgtcattactccaagggaaaggaaaacagtggacttactaacatctcgaacaggtggggcttatatacctccagctaaattacgtatgatgcaggctgagataactgataaatcatcagctgcatatcaaagaattgcctgggaagctttaaaaaagtccattcatggttacatcaacaaaattaacacttccaatattggtcttattgctagagaattactgcatgaaaacattgtaagaggtagaggtttgctgtgtaaatctataatacaagcacaggcagcttccccgacgttcaccaatgtttatgcagctttagttgcagtcataaattcaaaattccccaacattggagaactgttactgaaaaggttggttttgcagtttaaaaggggtttcaagcagaacaacaagtctatctgtatatcggctgctacctttgtcgcgcatttagtaaaccaaagagtggcccacgaaattttagcattggaaattcttactttacttgttgagtcccccacagatgattcagtggaagtagcaatttcgtttttgaaggaaagtggtcaaaaactcactgaggtgtcgagtaaaggtatcaatgccatatttgagatgttgaggaatattctgcatgaaggacagttggagaagagaatacagtacatgattgaagtcatgttccaagttcggaaagatggtttcaaggatcatgctgctgttactgaagaactagatattgttgaagaggaagatcagtttactcacctaatcacattggatgatgttaaacaagctaactcagaggatatattgaatgtgtttaaatttgatgataaatatgaggaaaatgagggtaaatacaaaactttaagtaaggaaattctccagtcagacagtgaatcaggcgaatctggttcagaggggtctgaagaagactcggaagatgaagaaggtgaagaagatgaaaccaaaaatcaaaccattattgataacacagaaactaatttaatcaccttaaggagaaccatctatctcacaatacaatccagtttggattttgaggaatgtgcccataaattgatgaaaatggagatcaaacctggacaagagattgaattgtgtcacatgttccttgattgttgcgctgaacagcgtacctacgaaaaattcttcggcctcctctcgcagcgcttctgccaaataaacaagactttcatcgaaccgttccaacaaattttcaaagatacctattccacaactcacagacttgacgccaatcgattgagaaacgttagcaaattcttcgcgcatttattgttcaccgacgccatcggctgggaagtgctcgatatcatgaaattaaacgaggaagacaccaacagttccagcaggattttcatcaagattttgttccaggagttgtccgaatatatgggattagcgaagttgaataaaaggctaaaggatgaaactttacaggaatatttcgcggggctatttccgagggataacccgaagaacacgcgtttcgccatcaattttttcacgtcgatcggtttaggaggtctaacggacgagttgagggagcacttgaaaaacgtgccaaaacatctggaagtgatggctttgaaagcagattcgagcagctctagcagcagtagcagcagttccagtaacgattccagcagcagttcagattcttccgatgacgagggttccaggaagaagaaaacaaaaaaattgaaaaccccggacaaaaagaagaaacagaaagaagatgaaaaacccaaaaagaaaagcgaggataaaccgaggaacaaaccagactatagagatagaagaaacgacgacagggaaaagtttaaaaaatacagaaacaacgacgaagaaagccacagaagaagcagagaagatgcaagagaaaaatacagaggtcacgaggaaagaagaagcgaccacagagaagaataccggccgagggaacatagaggtagagatagacgttag

SEQ ID NO: 1194 - DNA, 1761 bp, Meligethes aeneus
atggcgttaaaaggacaagttgggcaaaaaattatgaacgaggtaataaagcataaaccaaagaaaaatggacccgctcatggagtggaatggagagttttggttgtggatcaacttgccatgagaatggtttcagcctgttgtaaaatgcacgatatttcagctgagggcatcacattggttgaagatataaacaagaaaagagaacccttaaacaccatggaagcaatatatctaataacaccatctgaaaaatctgttcactcactgatgaacgattttgaatcgccaagacttatgtacaaaggggcacatgtattttttactgaagcatgccctgataatttatttcaaaaattgtctcaacatccagtagtgaaatatattaaaacttgtaaagaaatcaacattgcatttataccaaatgaatcacaggtgttttctttggactgcccagaaacattccaatgcagttatgatcctgctatggaagcagccagaaatgcaaacatggagagaatggcagaacaaattgctacattgtgtgcaactctgggagaatacccttcagtaagataccgaagtgattgggaacgcaacgtggaactagcgcagatgattcagcaaaagttggatgcctataaagcggatgagcccacaatgggagaggggcctgaaaaagcgagatcgcaacttttgattcttgaccgcggcttcgactgcgtatcacccatgctgcacgaacttacattccaggcaatggcctacgatttgctgccaatcgaaaacgacgtgtacaaatatgaagcttcagcgggagtatttaaggaagtgttgctcgacgaaaacgacgagttatgggtagaattacgacatcagcatatcgctgtagtgtcgcagagtgtgacgaaaaacttgaagaaatttaccgattcaaaacgaatgacccaaagtgataaacaatcaatgaaagatctgtcacaaatgattaagaaaatgccccaatatcaaaaggagttatctaaatatgctacacacttgcatcttgctgaagactgcatgaaatcttaccaaggatatgttgacaaattatgtaaagttgaacaagacctagcaatgggtacagatgcagaaggagaaaaaattaaagaccatatgcgtaacatcgtaccgattttacttgatccaaaaataacaaacgaatatgacaaaatgagaataattgctctatatgcaatgattaaaaatggcataaccgacgaaaatttatcaaaacttgctactcatgcccaaataaaagacaaacaaactattgctaatttgcaattcttgggagttaatgttatcaatgatggtgggaaccggaaaaaaccgtattcggtgccaagaaaagagcgtattactgaacaaacgtatcaaatgtctagatggacgcctgtaattaaggatattatggaagacgctattgaagataaattagatcaaaaacactttccatttttagctggccgagcgcaaaccagtgcttaccacgccccaacaagtgctcgatatggtcattggcataaagacaaggcccagcagacagtgaaaaatgtgcccagaataattgtcttcattgttggaggcatgagtttttcagaaatcagatgtgcgtatgaggtaacaaacgcccaaaaaaattgggaggtcattattggatcctccaacattttgactccccaaagttttcttaaggatttaaacactcttacagtctag

SEQ ID NO: 1195 - DNA, 2139 bp, Meligethes aeneus
atgatgcaacaatacatgaaagagttggaacaggaaccttttgatccagatgaatttattgaaagattggcttggagaacgatgtctgaagttaaatctgacggggaggattttaacccgaatatattgcatgactcttttgtacaggcaatcaaggacttgactttgcttcaggaacaccagcaaaagaaatgcaagaaattggaggctatagtgcgagaaaatgaggctcaatttttcggcgatgttgccaagttgacgacggataacaagcaatcgatggagacttttcaagagttggatggtaaaataacgcatgtagcatcaaaagttttgcatttgggcgatcaactcgacagtgttaatggccccagggccagagttgtggaggcacaaaaattaatgacacacttaaacgagttttttaccactggccctctaacgtcatctttattcacagatcctaaacgagtagatgaggctgcagatgtaatacagaaactatttgttatttctcaagatttacccaatgaaaaatttagcggcgtacttgaaaaaataaaaagaaaatatgcggatattgaaagatctttaattgaagaatttactgatgaattaaaaagggataatgtcgatagaatgaaggaaattgctagtgttatgtaccagtttaagggatattctcgcttaattaatgaatatatcgaatatagtcaagctgggtgtctccacacaaaagaaattttctacagtcaactcttggagttgtgtagaaaaaactacgaaagaataaaggaagttttcataaatcctgaccaggttatgtccaaatttgttctaaacatttatcaactcaaaatccaggaacacattagattaaggctctctgataagttggaaacatataattatttgaagactctctatgaactattatcaaagactaaccaactgtcaaatgatttagctatggtgcatgttagcagtgacaagaattttttgaataagttaacatcaaatatttttagcaaatatattgacaattatatacaattggaattaaaatgtttgagaggtagatgttcgacgaacctacaaagatattacgactctaaaaatcaccaaaagaaacaaatacaatcaggaggatttcaggatttaagaagagacatacaggctgttataggtacaagagcgaacataaatattgcgcaaatagaaaattatggcggtgaaacttttttgtcagaggaattggctataactgtactgcaagatacaaaacatgcctttcaaaggtgtcaattgctttcaaaacctgaagacagggcgtcaaatgcaacgcaaatcttggactatttaattaactgtctacttacggaacacgtagactatgctctggaattaggtctacaggccattccagtggtggaggcggctagaactccgcccgtcatttattttttcagcgtcgtctatcaaagcaacaatataacgcatctgctcgaaaaacagttcagcgatttggtggttcccctagttataaattccgtaaaatacaacgattgcctgcaaaaaaagaaatttgtgcttgaagatatcgaaaaaaaagtcaacaacggaatagacaggtcgttgaacgccatagccgcctggattaaaatgtacttgcaggcggaacaaaagaagagcgactttaagcccgaaacggacgattttgacacagtggcgtctcctgcgtgtaaattggtgtcgcaatacatcacaagcatgattaaggaaataaaatcgaatttggacggtaataatgtcaccataattttgcaagagttggggataagattgcacagggttgtgtatgaccatttattgcaatttcagtacaacactgcaggggctatggtcgcaatctgcgatttaaacgagtatagatcctgtactaaaccgcttggactcttagtacaagaactgtttgaaactttacatgccctttgtaatttattgttggtaaaacctgaaaatctcgcccaagtttgttcggaagactcattggtaaatttggataaatcagtattaaacaatttcatccagctaagaagtgattttaaagcccaaaagcagaatattttaaaagtttaa

SEQ ID NO: 1196 - DNA, 813 bp, Meligethes aeneus
atggattttcaaaatcgtcccggtggaaaaaccggcggcggcggtgtggcgtcatggtcggaaaccaacagagaccgcagagaacgtttaagacaacttgcgttggaaactatagatcttcagaaggacccctattttatgaaaaaccatttggggtcatatgagtgtaagttgtgcttgacgctgcataataacgagggcagttacttggcgcatactcagggtaaaaagcatcaagccaatttggctagacgtgctgccaaggaggcaaaagatgcaccttcgctaatccagcctgaaaagccaagagttgaacccaagaagtttgtgaagattggtaggcctggttacagggtcaccaagcagagggatattgagaatgggcagcagagcttgctatttcagattgattatccagaaattggtgacatggtgataccacgtcatcgtttcatgtcagcctatgagcaaaaaattgagccgccagaccgcaaatggcaatacctgctattcgcagccgaaccatacgaaacgattggcttcaaagtaccgagtcgcgaggtggaaaaaaccgacacgaaattctggacgcactggaacagagacacaaagcaatttttcttgcagtttgcatttaaaaacgaagcaaaaaagagcaccaccataataacccgaccagggcacattattgctggagtgccacctcctccaatgatgccagtaccaccaccaccaaggccccccatgttcaaccccctcccccctcctcctcctatgatgggaggagtcatgcctgtaccccctccacattag

SEQ ID NO: 1197 - DNA, 405 bp, Meligethes aeneus
atgtcgatcggcgtcccaattaaagttctacatgaagccgaagggcacatagtgacctgcgagacgattaccggcgaagtttacagaggaaaattgattgaagccgaagacaacatgaattgccagatgacgcagatcaccgtcacttatagagacggcagagtcgctcagctagaaaatgtttacattagaggctcgaaaatcagattcctaattctgcccgatatgctgaaaaacgccccaatgttcaagaaacagaccaaagcgggtactgcggggcgaggaaaaagcgccatactgcgagcacaagctcggggcagagggcggggtcagcctcctattcgagggagaggtggggctccttggcaagctccgcaaggtggcgctccaggcaggggaagataa

SEQ ID NO: 1198 - DNA, 1392 bp, Meligethes aeneus
ggggagtttggttggcatccctgcaaatttaccactggaattttgacgactggattgaaggtatcaacgaagatggcaacaaatctaacaaaagccccacttcttcgtaaagccgcgacaaggggatactcaaaacttgccccagttagcggaattcccaactatgaagtcaaaacatccacccttcccaataaaactgtagttgttgctgccgataatgattcccaaattgccagggtttctataattttaagagctgggtcaagaaacgaaaccgccgaaaatttgggtattacccatttattgagaaattgtgcaggactatccaccaaaaatgccagccaatttatcattactcgcaacattcaacaagttggcgccagtttgaccgcaacctcggaccgcgaaaccatttcctacacccttgaaggtaccagatcggctgtcgaaaaagttataccatactttactgaagttgccacacaacaagttttcaagccatgggaagtcgccgagaataccggacgtttgcacctcgacattgccacccgcccattgcaggttagagcaattgatttgttgcacaaagccgctttccgtaccggtcttggtaactcgatgttcattccgaaattccacattggcaaaatttcttcggaatctttgcaacactacgtgtgcgagaacttcaccagcggccgcgccgctgtcgttggtttgggaatggacgaagccgaagtaaccaagatcgctcaatctttgcacttgggatctggggaaggtcaaacaagaccatctccatacaaaggcggtgaagtaagatccgataagggaggagatttggcctttgtcgccatcgccggcgagggtgcgtctcttgccaacgccaaggaagcgctcgctttcgccgtccttcagagggccatcggaaccggtcctcaagtgaaatggagcgcgagagataacggtctgctctcgaaggcagtcggcaacgccgaattcgccagcagcgccatcaacgcgaactactctgacaccggattgttcggcgtgttggtcgccgttcccgccaagaacgcctccagcgtcgtgcagagcacctacaagttcatgaagtgcatcaacgtgtccgaggaagacgtctccagaggcaagaatcaattgaagaccgctcttctcttggaaggagaaaatggtgccaacgctatcgaaaatcttgcaacccaagccgtactcaccggaacagcccactctgctaccagcctggctgctctagtggattccatctctgcttcagatgttcaacaagcagccaacaaagtacgatcaggaaaattgtcagttgcttctgtaggaaatctaactggagtaccatacatggacgagctttaa

SEQ ID NO: 1199 - DNA, 333 bp, Meligethes aeneus
atgagacgagctcatgctggctatggttatgagccgttatcgcaaaattctaacgagatagaggacgaaaatgatcgaatgactaatgagttaaaagacaaaattggcgttttgaaatctctatcgatagacatcggcaatgaggtgaggtaccaagataaactgcttaacgatgtcgacgacgacttggaaaggactggggggttccttgggaataccatgaatcgagtgatgcgactaacaagggggggacataactattacattatttacatgtttttgttctctatatttgtgttctttgttttatatctagtacttaagtttagataa

SEQ ID NO: 1200 - DNA, 684 bp, Meligethes aeneus
ttggttaaaatgacgactttatcacccagacaggctcaaagggaacatgttttggcggtatcccgtgacttcgtgtcccagcccagattaacttacaagacagtttctggggtaaacgggcctttggtaattttggaagacgtaaaattccctaaattctacgaaattgtgcaactgaagttggctgatggcagcattcgttcgggacaagttttagaagtaagcggttctaaagccgtagtacaagtttttgagggtacatctggaattgatgccaagcacacggtatgcgagttcaccggagatattttgcgtacctccgtgtcagaagacatgttgggacgtgttttcaacggatctggaaaacccattgacaaaggacccccaatcttggcggaggacttcttggacatccaaggtcagccgatcaacccgtggtcgcgcatctaccccgaggagatgatccagaccggcatcacggccatcgacgtgatgaactcgatcgctcgcggccaaaagatccccatcttctctgccgcggggttgccgcacaacgagatcgccgcgcagatctgccgtcaggccgggctcgtcaaggtgcccggaaaatcggtgctcgacgaccacgaggacaacttcgccatagtgttcgccgccatgggcgtcaacatggagacggcgcgc

SEQ ID NO: 1201 - DNA, 684 bp, Meligethes aeneus
atgagtcgaaaccaaagtggaaatcgcttacaagttcccaatgatttaagagaagttttattggaattcactataagttacctcctagaacaaccaggagatgttgtggcttatgcagctgattattttcaaagattacgggaaaccagaactacttccttaatctatgggggctcagggacacaggatttgatgtctcctgatgagtctacaatatcaggagaagaagaaccaccaatagaacgtttcacgtccagacgtaaatcagtattcgccgagacttacgatcccgaagaggatgacgacgatgatgacggcattaagacggtgtttcccaaatccgacgagcagaggcaaagattgtcagaagctgttcgtaacatattgttatttagatcgttggacaaagagcagatgagcgaggttttggacgccatgttcgagagaaaagttcagcaagatgaattggttattaagcagggagatgatggggacaacttttatgttatacaaagcggaatatttcatgctttggtggctagcgaaccagcccaggttccgacacacatccacacgtacgataacgccggcagttttggcgagctggctttgttgtacaacatgccacgtgccgctacaattaaagccgtcaccaccggttccttgtgggccatggatcgtcaa

SEQ ID NO: 1202 - DNA, 2424 bp, Meligethes aeneus
atgagttacatgcaggcaaaccaaaatcggccaatgggccaacaaggacactatcaacagggtcctaacgaccttccaatgccttcgtcaaaagaacaaaccctcatgtggcagcagaactcctacatgggtgactcaggcatccattctggagccgccactcaggtcccgtcgctcaccggcaaggaggacgaagagatggatctgtttgatctcgaccaaggttatggtcagggtttcacccaagaccaagtggacgagatgaacaaccagctcaaccagactcgctcgcaaagggtgcgcgccgccatgtttccggaaaccctggaagaaggcatcgagatcccctcgacccaattcgatcccggtcaccagaccgcggttcaacgtctggccgagcccagtcaaatgttgaagcatgccgtcgtcaatctgatcaactatcaggacgatgccgatctggccacacgggctattcccgagttgatcaaacttttgaacgacgaggatcaagtggtcgtgtcccaggcagccatgatggttcaccaactgtcgaagaaggaagcttccagacatgccatcatgaacagcccgcaaatggttgctgcgttggtacgcgccatctctaactctaacgatttggaaaccactaaaggcgccgtaggcactctgcacaaattgtcgcaccacaggcaaggtctactcgccatcttcaagagcggcggcatcccagccttggtgaaactcctttcatccccagtggaaagcgttctcttctacgccatcaccaccctgcacaacctgctgcttcaccaggacggatccaaaatggccgtgcgtctggcaggcggtctgcagaagatggtcgccttgttgcaacgtaacaacgtcaagtttttggccatcgtgaccgattgcctgcaaattttggcttacggcaaccaggagagcaagctgatcatcctcgcttcgcagggaccgatcgagttggtcaggatcatgaggtcctatgattatgagaagttgctgtggaccacatccagagttttgaaggttctttcggtatgttcgagcaacaaacccgcgatcgtggaggccggaggtatgcaagccctcgcgatgcacttgaccaacgcgagcgcccgtctggtgcaaaactgcctgtggacgttgaggaacttgtccgatgccgccacgaaagtggacggtttggaggccctcttgcaatcgttggtgaccgttttgggatcgcaagacgtcaatgtggtgacctgcgcggccggcattttgtccaacttaacgtgcaataatcaacggaacaaagttaccgtctgtcaagttggaggcgtcgacgccctcgtaagaacaatcgtgaacgccggcgaccgggaggagatcaccgagccggcagtgtgcgccctgcgtcacctcacttcgcgtcacgtggaatcggagatggcgcagaacgctgttcgtctgaactacggcgtccaggtgatcgtcaagctgctgaacccgccttccagatggccgctgatgaaggccgtgatcggtttgatcaggaacctggcgctctgcccggcgaaccacgcgccgctccgggagcacggcgccatccaccatttggttcagttgttgatgcgggccttccaagacactcagaggcgtgccagcgtggcaagtggtggtagcaatcaaccgggtacttatgctgacggagttcgcatggaggaaatcatagagggcactgtgggtgctttgcatatccttgccagagagtcgcataatcgtgccatcattcgacagcaaatggttgtcccaatattcgttggacttctgttcaacgacatcgaaaacatacagcgcgtcgcagccggcgttctttgcgaacttgccgccgataaagaaggcgccgaaatgatcgagcaagagggcgccacctccccactaaccgaactgctgcattcaagaaacgaaggtgttgccacctatgcggcagcggtgttgttcagaatgagcgaagacaagccgcaagactacaaaaagagactgtccatggagctgaccaactccttgttccgcgaagagaacctctggaaccccgatcttggaatcggttccgaactacaggaaattttgagtcccgagcactacgataacctgtatccacaagatcccccaagtgtacacagcagccatggcagtagaccataccaacagcaagggtatgaccagataccaatagacatgcaaggtttggagatcggttcccacggaggcggcaacggctccacctacagtgcaatagatgcgatggaagtcaccagcggtgaaccggatctcaactttgacggtatcgatcagttgcctaccccgccacaagacaacaatcaagtggccgcgtggtacgacactgacttgtaa

SEQ ID NO: 1203 - DNA, 807 bp, Meligethes aeneus
atggcgcgaaacgcagaaaaagcaatgacaactttggcacgttggagagccgcccagttgggagaaagcgaaaaacacaaaaaacgtcgcccctatttagcctctgaatgtaaaagcctctatgcttgtgaaaaatggaggatgcagattattcgggagattgccaaaaaagtggcgcaaattcagaatgctggtttgggggaattcaggatcagggatttaaatgatgagataaataagttgttgagggagaaacggcattgggaggatcagattaaggagttgggtggccctgattatcaacgtgttggaccacgtatgttggatcatgaagggaaagaagttccagggaatagggggtataaatattttggggctgctaaagagttgccaggagttcgagagttgtttgagcaagaacctccgcctcccccaagaaaaactagagctgaactcatgaaggacattgatgctgactattatgggtacatggatgacgacgatggcatcctacttccattggaaacaaaagctgaaaaaacatcaattcagaagaaagtggcagaatggaaagagaaaaaggagaacaggctaaacaaagcttcagatgatgaagatgacgaagaggatgaaaatatttatgcggtggaagaatctgatgaggaagagcaaccccaagtaatagacgggtcccagcaaagatttgttgctcatgttccagtgccgtcccagcaagaagtcgaacaggctttgttgagaagaaggaagcaagaattgttggacaaatatggggcacacgaagattag

SEQ ID NO: 1204 - DNA, 648 bp, Meligethes aeneus
atggctcaagaacaggaaatgccttcattcaaatgcgttttggtcggagacggtggcactggcaaaaccacgttcgtaaaacgtcacttgaccggtgaattcgagaagaagtacgtggccacactgggtgttgaagtgcacccgctggtgtttcacaccaacaggggggctattaggttcaacgtgtgggacaccgcgggccaagagaagttcggtggcctgcgagacggctactacattcagggacagtgtgccataatcatgttcgatgtcacatctcgtgtcacctacaagaatgtgcccaactggcacagggatctcgtgagggtttgcgaaaacatcccaatcgtgctgtgcggcaataaagtcgacataaaagatagaaaagtcaaagccaaaagcatcgttttccacagaaagaagaatctacagtactatgacatctctgccaagtcgaattacaactttgaaaagccgttcttgtggttggctagaaaactgattggcgaccccaacttggagttggttgccgcccctgctttggtgcccccagaagtgcaaatggacccccattggcagcaacaaattgaaaaggatctcaaagaggcgcaagaaacggctctgccggaagatgatgaagatttgtaa

SEQ ID NO: 1205 - DNA, 480 bp, Meligethes aeneus
atgacgagtgctataactgttggtactttaataataaaactggtgaagttggttcttaacttcattattattattatgtacagggtgggttttcaaggttacttcttaggagttggtggaacctggaatttaaatgaagaaaaaaatgcagatgctgaaattgtggcatcgggaatttttgttgggtacatcatatacactgtggtttctctgattagcttttgttttgctgcaggtgatcataaaacaacctttactgatgttttaatgaacgttgttggggttttcatgtgggtagcagttggtgcaactgctttacattactggcatggttatctggctgaacataaatataccgctataaactcagaaagacaggttggtttagtcatgggttctctatgtattataaacggggcagcgtatttggtagacagtgcactttcaattatattccttctgcagacaaaattggcataa

SEQ ID NO: 1206 - DNA, 2472 bp, Meligethes aeneus
atgccacgaattatgataaagggtggcgtttggcgcaataccgaggatgaaatccttaaagcggctgtaatgaaatatggcaaaaaccagtggtctcgaattgcttcattactacatagaaaatccgctaaacagtgtaaagcacgttggtttgagtggttagatcctagcatcaaaaaaactgaatggtcacgagaggaagatgaaaaattgttacatttggctaaacttatgccaactcaatggagaactatagccccaataattggcagaactgcagcccagtgtttagaaagatatgaatatttgcttgatcaagctcaaaaaaaggaagagggtgaagatggagctgacgatcccaggaaacttaaacctggtgaaattgatccaaatccagaaactaaacctgccagacctgatcccaaagacatggacgaagatgaacttgagatgttgtctgaagctagagccaggttagccaacactcaaggtaaaaaagcgaaaagaaaggccagagaaaagcaacttgaggaagccagaaggttggcagcactgcagaaacgtagagaattaagggcggccggtatcgaggtcaattctcgaagaaaaaagaaaagaggtgtggattataatgcagagataccctttgaaaaacgcccggccattggattttatgatacttcttcagaagctttggatccaatggccccagatttctccaaaatgagacagcaacatcttgatggagagttaagaagtgaacaagaagaaagagaacgtaaaaaggacaaggcaaaacttaaacagagaaaagaaaacgacatcccgcaggctatgttacaaaatcaagaacccgccaagaaaaggtcgaaattagttttacccgaaccgcaaatttccgaccaggaactgcaccaagtggtcaaattgggtcgtgctagcgaggtcgcaaaagaggtagctgccgaaagtggcgtggaaaccacagatgccctattaaacgactacacagtaaccccacaagctgcagctactccaaggacaccagccccacagacagacagaattcttcaagaagcccagaacatgatggcgcttactcacgtagacactccactaaaaggtggtctaaacaccccccttcacaaccccgattttagtggttcattacctcaagctctggccgttgccacgcccaacacagtcctggccacgcccttccggtcgacgagaagcgacggtggtgccactcccggaagtacaggcttcatgacgccaaagagcggagccgtggtacctgttgggggaaccataccaggcaatttcactccctcagtaagagataagctcaacataaacgctgaagaaggtattgaagttggcggaactcccgctaagaatagaatgttccagacatctttaaaagaacaattaaaaatgggtcttagcagtttaccacaaccgaaaaatgactacgaaattgttgttcctgaacaggaagacgaaaaaatgcctgaacatgctcaggagcatatggtcgaagatcaagcagacgttgatcaacgttaccaagaagaactaaaagcgaaggcagaacgcgaattggccctgcgttcgcaagtcatccagagagaatttcccagaccgcacgacgttaacttggcagtgttgcggccgccgcacgagtcctactctctaacggacctccagaaggccgaggaactaatcaaaaccgaaatggtcaccatgctgcactacgacaacctaaaaaacccgataccgaccaccaccaccaagcgatcaaacttatcgcaagcgcagcaactggcgttcctcgagcaacatccatacgaaaattataagcccgaggatttggacgttgccaaggttctgcttaagcgagaaatggacgtcgtgaagcacggcatgaaccacggggagcttccgttggatgcctacacccaggtgtgggaagagtgccttggacaagtgttgttcttaccaaatcagaataggtacactcgtgcaaatttggcaagcaaaaaagacaggcttgaatcggcagaaaaaagattggagcaaaatcgatcacacatggctaaagaagcaaaaaaagccgctaaaatggagaaaaaacttaagatcttaactggtggttatcagtctagagctcaggtcttaataaaacagttgcatgatctttttgataatatagatcaagcaaatttggagctaaatacatttaagtttttgcaagaacaagaaaagagtgctttgcccagaaggatacagtctctaactgaggatgtaaatagacaaatggaaagagaaaaagccctccaacataaatatggggaactacagtttcaaatgaaagaaattcaagatcaatactctcaaattcatttagaagttaatggaattcaagaaaatcaagaaaatatggttgaagaaagtacagaagttgaataa

SEQ ID NO: 1207 - DNA, 471 bp, Meligethes aeneus
atgcaatttatgttgttatttagccgacaaggcaaattacgtttacaaaaatggtacaatgctcatccagacaaactaaagaaaaaaattacgagggagttaatcacaacgattttggctagaaaaccaaaaatgtgcagctttttggaatggagggacctaaaaattgtctacaaaagatatgccagtttgtatttctgttgtgcaattgagcaagatgataatgagctcctaacattggaaattatacatcgatatgttgaactgttggataaatattttggaagtgtgtgtgagttggatatcatttttaactttgaaaaggcctattttatacttgatgagctactgcttggaggtgagatacaagaaaccagtaagaagaatgtcttaaaggcaatagctgctcaggatttgttacaagaggaggaaaccccccaaggattttttgatgaccacgggctcggctaa

SEQ ID NO: 1208 - DNA, 813 bp, Meligethes aeneus
atgcaccgactaaactacgcgttactgcgttgctcaataacaaaatctcacaatgggttgcgcttgtattcgaaagagcagcggcggcagactttcatatcgcgtttgtacgacaatttccgcgacgaaatggcgaagaacaaggaaatgaaagagtcgctgaagaaatttcgagaggaggcccaaaaattggagcaaagtgatgcgttgaaagctgccaggcacaaatttgagactgtagagaaggaagctagtgagggaagtaaagtgtttaaggagaagtttgatagtattaaagaaaaagtgcaaggggttgttgacgaagtgggtaaatcagatattgcaaaaaaagctggtaaaatctctgaaggtattggtaaaacaaccacctcattcacggaaaaagcacaagaaatcggcaaaacaagcgcatttcaaagcatatcgcagacagccgaagcagttaaaaaagagattgacactacaagtatggagggcagagtttatgtgagtcccacaaagttaaggaagagaacagagacatctgcagtgcaaaacgtgaagttctatgaacccaatgaggaagcaacaggcatagaactacacaaagactcaaaattctaccagtcgtggcaaagtttcaaagacaacaacccctacgttcacaaagtaatggattggaaattaaagtatgatgaaagtgataacccccttatcagagcttcaagagttctaacggaaaaagtctcagacgttgtggggggtttgttctcgaaaacggaactctcagaaaccctcacagaaatctgcaaa

SEQ ID NO: 1209 - DNA, 780 bp, Meligethes aeneus
agcgatagtgatgtcgagttacaagaggcacttgcagatggtagattaaaaccaggtctaaacattgtagatcaaaagcctaaacagtttgtaaacaacacaactggtttaaaccagaaactggaagaaataaagtcatctttgccatggattgaattacttgattgtgttaacaaacaagctccacttgcacctgaaatggcagcacagatgttggaacaagagcaaaaaagagagaatcaattaaaaaacaacaaaaagttgcaacaatttgctcccacagatgatcctgtattgaacgatttcaaaagagaaatgatgtttcacagacaagcacaagctgcagtgcaagaggctataccaaaattaaaagcaatggatattgctactaaaagaccagacgattattttgcggaaatggctaaaactgatgctcatatgcaaaaaattagagagcatttaatgcaaaaacaacagcagcaacaaaggagtgaacgggtgaagcagttgagaacacaaaggaaagaagggaaaatgatacaaatccagacgaaacttcaaagacaacaggagaaaaaggaaatgatggatcaagtaaagaaggtaagaaaagggctttccaaagatttggactttttggatggtaagaaaaataaggccatatctagaaagtcgctggaaaaaagaaaaatgagggataagaagtttggctttggtggaaaaaagaaaggtatgaaaatgaatactaaggaaagtgctgctgatataagtgagtataag

SEQ ID NO: 1210 - DNA, 3609 bp, Meligethes aeneus; identical to SEQ ID NO: 1184

SEQ ID NO: 1211 - DNA, 1506 bp, Meligethes aeneus
atgaatcccagtgccccaaattaccccatggcgtctttgtacgtcggggatttacactcagatataactgaagctatgctgtttgagaaattttccactgctggacctgtgctgtccattcgcgtatgcagagatttgattactcgtcgttctttgggatatgcatacgttaatttccagcaacctgttgacgccgaacgtgctttggatacaatgaattttgatgttatcaagggacgcccgatccgtattatgtggtcccaacgcgatccttcgctgagaaaatctggcgtaggcaatgtcttcatcaagaacctcgatcgctccatcgataacaaagctatgtacgatacattctctgcctttggtactattctcagttgcaaagtagctcaagacgagaatggcaccagcaaaggttacggttttgtccactttgaaaccgaagaggcagctaacaaatccattgaaaaagtaaatggtatgttgctcaattccaaaaaggtatacgtaggcagatttatcccacgcaaagaacgcgaaaaggaacttggagaaaaagccaaattgttcaccaacgtgtatgtcaagaactttggtgaagatctaactgaagaacagctgagaataatgttcgagaaatatggtgtcatcaccagctacaagatcatgagcaaagacgacggcaaatccaaaggttttggttttgttgcctttgagagccctgaagctgccgaaactgccgttgaggcgctaaatgcaggtaaagaattggtggagggcaagcctttgtacgttggccgcgctcagaagaaagcagaacgtcaacaggaattgaaacgtcgttttgaggcattgaaaatggagaggttgaaccgttaccagggcgtcaacttgtacgtgaagaacctcgacgacaccatcgacgacgaacgtttgagaaaggaattctccccattcggaacaatcacctcggccaaggtgatgatggaagaaggcagaagcaaaggattcggtttcgtttgcttttcttctccggaggaggccaccaaggccgtgacggaaatgaacgggcgcatcgtgggcacgaagccgctctacgtcgctttggctcaaaggaaagaggaccgaaaagcgcatttaacgtcgcagtacatgcaacgcatggccaacatgcgcatgcaccagatgggccagttcatccagcccggctctagcggctacttcgtgccgacgatccctgcgccgcagcgcttctacgccgccgcgcaaatgaaccagatccgcactagcccgcgctggcctgcgcagacgcaggtgcgcgccggcggcggccagggcggcgccgcagcgtacgccggcggccaaggccaaggcggcatgcccagcggcggcggcggcggctacagggccgccgccaggccgcccaacaaccagtcggcggccatgcgcggcaacatgaacgtgcctcggcccatcacgggcggacagcagcagcccggcggc

SEQ ID NO: 1212 - DNA, 2841 bp, Meligethes aeneus
ttcgtgtgtcaaaaacaagaggcgtttgcaaatattacaagtattactaagaaaataaaggattttagatatcacggcaaaatgaccgactcaaagtattttacaacaactaaaaagggtgaaattttcgagttaaaatccgagttgaacaatgataagaaggagaagaagaaggaggcagtcaaaaaagtgattgcatcaatgactgtgggcaaagatgtttcagctttatttccagacgttgtaaactgcatgcaaaccgataatcttgaattaaagaaactggtttatttatatttaatgaattatgcaaaatctcaacctgatatggccataatggctgtaaatacttttgtcaaggattgtgaagatccaaaccctttaataagggcgctcgcagtgcgtactatgggttgcataagagtcgacaaaataaccgaatatttgtgcgaacctttaagaaaatgcctaaaagacgaagatccgtacgtacgaaaaacagctgcagtttgtgtcgccaaactgtacgacatttcatcgggtttggttgaagaccagggtttcttggagcaacttaaagagttgctaagtgattctaaccccatggttgtcgccaatgcggtagcagctctttctgaaataaatgaaagtagtccaactggacaaccattggttgagctcagtacaagtacaataaacaaacttttgactgctttgaacgaatgtacggaatggggacaagttttcatccttgattctttgtcaaattacactcccagagatgaaagggaagctcaaagcatttgcgaaagaattaccccacgattggcccatgcaaatgctgctgtagtcctgtcagctgtcaaggttttaataaaaatgatggagatattggccggtgatgttgagttttgtaatactctgagcaaaaaattggccccacctttggttacactgctcagttctgagcctgaagttcagtatgttgctttgagaaatattaacttgattgtgcaaaagaaacctgacattttgaaacatgaaatgaaggttttcttcgtcaaatacaacgacccaatctacgtaaaactcgaaaaactcgacatcatgatccgcttggcgtctcaagccaacatcgctcaagttttgagcgagctcaaagagtacgcaaccgaggtcgatgtcgatttcgtgcgcaaagccgtgcgcgcaatcggaagatgcgctataaaagttgaaccttcagccgaaagatgcgtatcgactttgctggatttaattcaaaccaaggttaattacgttgtgcaagaagccattgtggtgattaaggatatattcagaaaatatccaaataaatacgaaagcataatatccacattatgtgaaaacctggacactctagatgagccagaggcgagagcttccatggtttggattataggcgaatatgccgaaagaattgacaacgccgacgagttattggacagctttttggaaggttttgccgacgaaaacgctcaggttcaactgcaactgcttaccgctgttgtcaagttgttcttgaagcgtccacagcacacccaaggtttagttcagcacgtgctaagtctggccacacaggactcagacaaccctgatttaagggaccgcggttttatctactggagattgttaagtacagacccggcagcagctaaagaggtcgttttggccgataaacctcttatttccgaagaaaccgatttattagaaccaacactgttggacgagctgatttgccacatttcttctttggccagcgtttaccataaaccgccgaccgcgtttgtagagggaagaagcgcaggtatacgaaagacgctaccggccagacaaggttcagctgatgaaatcggccaagaagcaaccgttattcccaaccaggaaagcattgtgggcgacctactctccatggatcttggcgctaccgccccagctgcgcccctgggcggccctgcggcaaccagtaacattgaccttttgggcggaggattggacgtcttgcttggaggcggtagttcagacatatcaacggcaggcggtgccgctccttcaaccacaggtctcttaggcgacattttcggcatctcctcctccccctccatgtacaccccaccaaaaacgtgttggctaccggcggagaaaggaaaaggcatggaaatacacggtacattctcccgcaaaaacggacaaatgtccatggacatgaccttcaccaacaaggctatgcaagctatgagtggttttgcggtacagttcaataaaaacagttttggcgtgtctccctcagggcccataactatgacccccttgcaaccagggcaatctttagagtattctttacctttaaatactacagggcctgtacaaagaatggatcctctaacaacgttacaagttgccattaaaaataatgttgacgttttctattttgcctgtcaaatgccgatacaaattttgttcactgaggatggtactctagataaaagggtctttttgacaacatggcgcgatataccatcagccaatgaagtccagtatacaataaacgatttaaatggaaacactgatacagtctccaataagatggttatgaataatatcttcaccatcgcaaaaagaaacgtggagggccaggatatgctgtatcagtccctgaagttgaccaacaacatttgggtgctattggagctcaaattgaccccaggggtcactactgcaactttgagcttgaagtccagatctgttgaagttgctccatatgtattccaagcttttgaagccgttttaaagaattgttag

SEQ ID NO: 1213 - DNA, 498 bp, Meligethes aeneus
atgccaccaaagtttgatcctactgaagttaaatacgtttacctaagatgtgttggaggagaagtaggtgcaacatcatctttggcacctaaaattggtccacttggtttgtctccaaaaaaaattggtgatgatattgccaaaggaactgctgattggaaaggtctcaaaatcaccgttcagctgaaaattcaaaatcgtcaagcagccatttccgtcgtgccttccgcagcatctcttatcataagagctcttaaagaaccaccacgtgataggaaaaagcaaaaaaatattaagcacagtggaaacattacattggatgatatcatttctatcgcaagacaaatgaaaccacgttccatggctaaacaattgtctggcacagttaaagaagttcttgggaccgctcagtctgttgggtgcacaattgatggaaagccacctcatgacctcatagacgaaataaacaatggtagtttggaaataccagaagaataa

SEQ ID NO: 1214 - DNA, 1080 bp, Meligethes aeneus
atgagggctttaattttggttggtggctacggcacaagactgagacctttaacgctaagcaggccaaaacctttggtggaattcgcaaacaagcccattttgttgcatcaaattgaagctttggtcgaagctggtgtaactgaggtaatattggctgtatcatacagagccgagcaaatggaagaagaactaactgcagaagccaccaaattaggtatatcaatagtattttcccatgagactgaaccgttaggtactgctggaccaattgctctagctaagaacattttgcagaaaagtgccaagcctttctttgtactaaactctgatattatctgcgattttccatttaaagaactggctgcttttcacaacagccatggtaaagagggtaccattgttgtgaccaaagttgaagagccctccaaatatggtgtagttgtatacgatgacggtaactgcattgaaagttttgtggagaaaccccaagaatttatttccaacaaaattaatgccggcttgtatattttgaatccaagtattttaaatagaattgaactccgtcccacttctatagagaaagaggttttccctggaatggcctctgataaggaattgtatgcctttgaattgcaaggattctggatggatgtaggccagcccaaggatttcctaactggtatgtgcttgtatctgaagcatttaagatcccagaactctgaaaaattgtacaagggaccaggtgttgttgggaacgtcctagttcacccttcagctaaaattggctcaaactgccaaattgggcctaatgtcactataggaccgggggtagtcattgaagatggtgtttgtgttaagaggtgcacaatcctaagagatgccaccataaaatccaacacttggatggaaagctgtattgtgggttggaaatgcagtgtgggaagatgggtaaggatggaaggaactacagtcttaggtgaagatgttattgtcaaagacgaaacatatattaatggtggtcaagtgttgcctcacaagaacattgccaattcagttcctgaaccacaaattataatgtaa

SEQ ID NO: 1215 - DNA, 894 bp, Meligethes aeneus
ggggagttagacgaacccaacctaaaaatggccgacggggacgatattgtaacggatcaagaaaaagtccgtatagttacggactttatattgcattcgccgcccggcgaattcaatgaggtgttcaacgatgtgcgaaagttgttgagtaacgatgatttgttaaaagacggggccggcggagctttctcgcagtacaacaaagatcaacttaccccagttaggatcgagaacgctgaccatttggttttaataaccgaatacaacgatctaggaggctgcagattcttcgatccaagatcaaaacagagcttcagatacgaccatttgcgcaaagaagcgtctgattaccaggcattcagtccggacagtgcggcggaaccttggcgcgccgcactagatgccgaatttatccattacacaagaaaccactacaaagatggagtatccagtgttgtttcaaggaaccagggaggtgttataacccttactgcctgcattgaagaccatcagtttcagcccaagaacttctggaatggcaggtggagatcgcaatggtctattttgatcaattcgggggctgccactgctgaagtcaggggcatacttaaagtccaggtgcattattatgaagaaggcaacgtccagctggtgagcacgaaggagatcaaggaatcgatttctgtaacgagtgaggcgcagacagccaaagagatcgtgcaattaattgagacagcagaaaacacttatcaaactgcgatttctgagaattaccagaccatgtcggacaccactttcaaggctttgaggaggctgttgcctgtaactcgtaccaaaattgattggaacaaaatagtatcgtacagtattggaaaagaattaaagactcaataa

SEQ ID NO: 1216 - DNA, 1743 bp, Meligethes aeneus
cctacgttgtctcaatggcaatacgatgtaatgccaaagtacatgtgttgtttgtggcaggaagaacaggctgtcggttgcgagactttgcgttttgaacgaagacccacgcaagattgcgtagcatatcaagctccaggtatagctggtatctatggcgacccccacatcatcactttcgatgattacccttacacttttaacggcaaaggagaattcgtaattctaaaaacagtttcgaagacgaacaacctggaaatccaaggccgtttcgaagaaatgccaatgaacgcatacggtgacgtcaaagccacccaactttcctccgtggttgccaaaggtaactcttcaaccatcatcgaaatccgctccagacctcgagaagccagatggcgctaccgtctggacgttctggccaacggcaaacaaatttacttcgacagaccatcgttgaaattccagcacttctccggagtcaccgtatacacacccacttacatctacaaccaatccgaagttgttgttatgtttgataacggagccggtctggaggtcatcgaaaatgatggatttttgtccgccagagtctatctaccctggagttttattaacaagactagaggcctgctgggaaactggtcattcaatcagctcgacgatttagccttaccggacggcaggatagtctccttaccgtccaaagatgaggatcaaaaaaggctgtacgacgattttggtctgaaatggatgctggacgatagcgacgtccccgatgtcggacgcgccatgttttaccgcgaattcggcaggacttcttccacctacaacaacaaaactttcgtacccgagtacaagtttaagcctgaagatatcataccggcgaatcggtccaagtttatcgaagatgcttaccaaatatgcttcacggacaacagagagtgcctctatgattattcggtgacgttgaatagagacgtggctcatttcacgagtaactacaaggcgactatattaaaaatgaaggagataagtcgggacaaaattatatcttgcggtgtcctggaaacgccccggttcggtagaaaaaatacttacctctttactccgggtacgaaggttacttatgaatgtaataccgactttattttggtgggagacccgagaagaacttgcttgccgaatggtagatgggacataccgaattacggatacactgagtgtttacgtcagcaggagtactcctctaggaacgcagctacgacttggggaataattctggcgattctcataccattaattttgttgttgctatacggggcgtggagagtttaccaaaactacatcgacaccgacgatactacgtggaagtacgaccctgcgtctcgtagggcctctagcgtgcaaaaactgaacactaaggcgcctgtggaagaatcggaggagtacgaaaccgattatgacgatgccgatgacgaggaagtcaaaccgagattaagaagcaactcgcagacgtccaagtccagcaataaacgtaggagctacgaaaaaagctacaaaaccaacgagcccataaagggtcttccagagactgattttgaggagaaaccatgggaccccgaggtcgacggcagcgttttgtcgagccccatgtcatcacccatacaaagaccgccacctttgactttaccgcagaaaaaacccaccagatatagcagtcaaagtagtactgtaacagacgtgtag

SEQ ID NO: 1217 - DNA, 2715 bp, Meligethes aeneus
atgactgaacacctagggttaaaatgggacccgaaaaacttagaaataaggacaatgtctgtggaaaggacattggaacctttggttttgcaagtaaccacactggtcaacaccaaagggcccagcaagaagaaaaaaggcaaatctaagagggcaaatgctttggtcagcactgtcgaaaaagccacagaaaatttcattgaaaagggtgaactgattgcatatgaaaatcctgatataaccagggaaatgctgaatgctgtagaagaagtcaagaaaacaggtactcaaatgagcatagccgctcgcgaattttccgaagacccttgctcatccctgaaacgcggcaacatggtccgcgcagctaggaacctgctatcagccgtaaccagactattaattctcgccgacatggtcgacgtgcacttattgctcaagtcggtccacctcgccgaagacaacctcgaaaaagtgaaaaacgcttcgagcaacaccgaactaatcgacaacatcaaaaacttcggccaaaacgtgaacgacctaatgaaccaagctgccaaacgtcaacaggaactgaaagacccgcagctgcgcgacgatttagccgccgcaagggcagtgctcaaaaaacattccaccatgctgctgacagcttcgaaggtgtacgtgcggcacccggagctggcggccgcaaaagccaacagggactacgtgctcaagcaagtgtgcgaagctgtcaacacgatcaacgacgtttgccaaggacggccgcagcagcccacgtcggggccctacgacgggcccggcgagctcgcagctgcgctcgacgacttcgacgatcacactgttatggagccgctggcctacaacgaggtccacacgagaccttctttggaagaaagactggaaagtattatcagcggggccgccttgatggcggattccagctgcaccagagatgagaggcgtgaaaaaattgtggccgagtgtaacgcggtccgtcaggctctgcaggatcttctttcggagtacatgtctaatatgggaaacaatgagaagagtgaaggtttaggcagagccattgaaaatatgggaagaaaaaccagggatttaagaaggcagctgagaaaggcagttgttgatcatatttctgacagctttttagagacgaacgctccgcttttgatcttgataaaagccgcgcagaacggcaacgaaaaagaggttgaagagtacgctctggtattccaagaacattccaataagttggtagaggtggcaaatctggtttgcagcatgtcgaacaacgaggacggcgtgaagatggtgcgctacgccgcagctcaaatcgacaatctttgcccggaagtgataaacgcggcgcgcatcctggcggcgaggccgcgcagcaaagtcgctcaagagaacatggacgcgttcaagcaatcgtgggagaaccaggtgaggatcctcaccgaagcagtggacgacataaccacgatcgacgacttcttggccgtgtcagagaaccacatcttggaggacgtgaacaagtgcgtgctggcgctgcaagagggcgacgctgagactttggacaggaccgccggcggcatcagagggcgctcgagtcgcgtctgcaacgtcgtcaccgccgagatggacaactacgagccctgcatctacaccaagcgcgtgctcgaagccgttaaagttctcaacgatcaagtgatgcccaagtttacgcagagagttcaagtggccgtgcacgcgctaagctcgaatccttcgaaggaagtggacgagaacgatttcatcgacgcctccaggttggtgtacgacggggtgagggaaattaggagggccgttttgatgaacagggccgacgaggatttggatcctgaagaggtcgagctggatgatcccactttggagaccagaagcaaatcgagtgcgcatactggagaacatggcgtggacgagtatccagacatcagcggtataaccacagctcgcgaggcgatgggaaaaatgcccgaggaagacaagcaaaaaatcctccagcaagtcgagttcttccgcagcgagaagcgcaagttcgacatggaggtggccaaatgggacgacaccggcaacgacataatcgtgctcgcaaaacacatgtgcatgattatgatggagatgacggatttcacgcgcggcagaggtccgttgaaaaccaccatggacgttatcaatgccgccaagaaaatttccgaggccggcaccaagttggacaagctgacacggcaaatcgccgatcagtgccccgaatcgtcgaccaaaaaggatctgttggcctatttgcaacgcatcgccttgtattgccatcaaatgaacatcacatcgaaagtcaaggctgatgtgcagaatatcagtggagagctcatcgtttctgggcttgacagtgccacatcccttatccaagcagcgaaaaacttaatgaacgctgtggtactaacagtgaaagcttcatacgtggcttcaacgaaatatccaaggcagggacccgttactttaccgatagtgtggaagatgaaggcgccagagaagaagcctttggtgagaccggagaagcccgaggaagttcgtgccaaagtacgcaaaggttcgcagaaaaaagtacaaaatccaattcacgctctgtcggagttccagagtcccaccgagtcagtttag

SEQ ID NO: 1218 - DNA, 1077 bp, Meligethes aeneus
atgttttcgttcggcaacagcaccagtacgccaaaaacagcgacaggttttaccttgcccacgtcgactacagccacaacttcagccggcggcttccagctgaatatcggggcgggggataacaaaacctctcaaagtaaacccggggtcactttattcgcagcccccgcagctaaaactacagctcccggagtggttttgcctagttttggggctacaactgccacatcaacaacaggtactagtgaggctccgccggcttttgatataggtgccagtacagctacattgtctacaactttcacaccaattgtagggagttcggctccaagtacagttggtttgttgtttactgggtctgcacagagcactacatcccctaagttttccagtttggctacaacaacttcagcagcacctagcctaacactagggggcactacatccactgcaggaactgctgtttccatatcagctgcagctgcaactagtgccccagcaggatctctcacatttggccagctggaagattctattaacaaatggacaattgatttagaagaacaaggtaaatttttcatcaatcaagctaaacaattaaatgcttgggattccctattgatttcaaatggtgagaaaattttgaatttaaatggaagcattgaaagagttaaacagcaacaaactcagctgaatcaagagttggattttgttttggcacaacaaaaagagttggaagagttaattgctcccttggaaaaggatttaatggatatacctgttacagatattgaccgcaatcaaatgtaccaaatgtcagaaatgatagattcacagctaaaacaaatgtcagatgacttaaaagaaatcatagaacatataaatgagtcccacaaagatgaagaaacatcaaaccctattacacaaatcagtcgcatattaaatgcccatatgaattctttgcaatggattgacactaacacagcacaaatttcaacacatttggaacaaattaataaaatgcaagatttaaatagaagaaatatgtcattaaataattcttttaaaggtttttaa

SEQ ID NO: 1219 - DNA, 582 bp, Meligethes aeneus
atgtttatatgggactggtttactggtgttttgggatatttgggcttgtggaagaaatctggcaagctactctttctggggctcgacaatgctggcaaaactacgctgttgcacatgctcaaggacgatagactagcacagcatcttcctacattacatcccacttctgaggaactgtcaataggaaatatgaggtttacaacttttgatttgggcggtcactcgcaagccaggagggtatggaaggattattttccagcggtggacgctattgtgttcttgattgacgccaacgacagatcgagattcgtcgagagcaaacaagaacttgactcgctacttacagacgaaaccttgtccaactgccccgtgctgatcctcggcaacaaaatcgatttgcccggtgcggcgtccgaagacgagctcagaaatttctacgccttgtttggacaaaccacaggaaaaggtaaagtagccaggtcagatttggcaggtcggccactggaactttttatgtgttccattttaaaaaggcaaggttatggtgaaggcttccgttggttagcacaatacatcgattga

SEQ ID NO: 1220 - DNA, 492 bp, Meligethes aeneus
ctggggtgtcagaactgtcaaaaccaagaactgtcagtgttttgtatattaattaaatttacattgaataaaaacaaaattaaacacacaaacatggatcctttggatatcctagaaaaacgtattacagctctggaactgcaagtattaccgaaaaatggcgaaattaatagcgcccaagctattacagaactattactacaaacccacaacatgttaacatcagccttgagctgcagagaggctatatcatccatattacaacacttatcgacaattaacaactacctggacccaaacaacggagaaacagaacttgaaactgaagccaagcgacaatatctactcgaatgctaccctgagataaaagaaacagtgcaagctatagccacaataggaagtctaacctcattcactgactcagcgaatatcaaaaaagttaccgagctatctcaaaaactggaagaattatcagtctcaaaccttggcatc

SEQ ID NO: 1221 - DNA, 1743 bp, Meligethes aeneus
atgtccaattcagatgtatacaacgatttgacgctgttttttacgacagaaaagttttatttacaaccaaaagccagcgatgagttgatagtgattgatagggcgtctgatgaggtgtctgtggccaaaaactgcgggcaaataccgccgaattcgtgcagccaggatttctgcggattactcggagtaataaagttggttgctggccgttacctcatcatagccacccaaagagagttagtgggtaatatagcaggacacgcagtatggcgtttagttcagataaaattgattccgtacagcagaagcatgcttcatttaaacacagaacaagctgccgataatcaagcttacataagcatggtcgagcaaattctagcgaccccaaaccattacttcagctacacctacgatttaacccacaccttgcaaagattgcacgattttggtcctgatttctggcagcaatctctacttgaaagggctgaccaaaggtttgtttggaatggctatttgctcagagagttcaaaggtctagctggtgctaaaaaattctgccttcccatagtgcatggtttcatttccattaaccagtgcgttctgaacggcgcgaatttgtcgtggattttgatttccaggaggagtgttcaaagggctggcactagattgcacagaaggggaatcgataaggacggtaatgtagccaactttgtcgagacagagcaattggtggattatcagggcgataaagctagttttgtgcaggttaggggttctataccgctgttttggcatcagaatcccgatttacgttacaaaccacccccaactttgttggaaatcgatccccaagaacacaatgccgcctgtcagaagcacttggaagctttggcggttttgtacggtaaacaggtcatggttgatttggttgaccaaaaaggatctgagggtagattggagaaggctttcaaagacaccatacacactttggcttacccttcggttaaatatgaaccatttgattttcacgctgagtgcaggaagatgcggtgggatagattgtccattttaattgataggttggctttggaccaggatgagatgggatattttctgttgttaagagatggttcgttgtccttacttcaggagggcatttttaggactaactgtatagattgcctggacagaaccaatgttgtccaaagcatgctggcacatagaaacctggaaatagtcctgaaaaaattaaatgtaatccagacaaatcaacggctggaagagcagtacactttcgagcatttattcaaaaacgtgtgggcagataatgcagacgttataagcactcaatattcgggcactggtgccctgaaaaccgattttacccgtaccggaaaacgcacaaagtttggtttgattcaagacggaataaactcgatgacgcgttattacaaaaacaacttatctgatggcgtgcgccaagatgccatagatttgtttcatggaaatgctgaagttatttcgcctcttagaatcgacaggggttggcgttacatgacattcccctctgtattactagtagctgtggcaatgtttgttgcttcggctgtactgcctgcagaatattccaccgagtctctgttgtacttgctgttttgggggtccatggtgggagcttcaggcctaaatatactcaagtatggtatcgagtttgtggataaacctagactaactcagtcctaa

SEQ ID NO: 1222 - DNA, 1632 bp, Meligethes aeneus
atgccacctacaattcaaaacgggtcaaatgccgctgaaaagcgacctgtgaaaccagcagaaaaaaggtctgatttaatttgcaaagtaaaatattgtaatacacttcccgatataccgttcgatttaaaattcatctcgtacccgtttgaaccgaccagatttattcaatataatcccacatccctggaaagaaattatagatatgaagtattaacagaacatgacttgggtgtaggaattgaccttattaataaggagatatattctgttgaatttggtgcacagctggatcctgctgacgaaaaacttttggaagaagacattctaacaccacaagattctaaaagatccagacatcatgctaaatgtgtgtcctggttacgtcgtacagagtacatttccacagaacagacaagatttcagccacaaacaatggacaaagtggaagccaaagttggttatagtattaaaaagaaccttaaaaatgagactttgtacatggatcatgactctcagataagagccattgagaaaacgtttgatgatactaaaattcccattgaaaagcattacagcaaaccaaatgtggtaccagttgaagttttaccgctatatccagatttcagtttgtggaaatatccttgtgcacaggttatttttgattctgatccagctcctgtaggcaaacaggttccagctcaaattgaagaaatgtctcaagctatgattcgtggtgtcatggatgaaagtggtgaacaatttgttgcctacttccttccaactgaagataccctagagaaacgtagacaagatttcatcaacaatgttgcatatcaagatgatgaagagtatgagtacaaaatggccagggagtacaactggaatgtcaagagtaaggctagcaagggctatgaggagaactacttctttgtggtgcgtcaggatggtatttactacaatgagttggagacaagggttaggttaagtaaaagaagacaaaaggttggtcaacctgcaagcaataccagactaattgtgaaacacagaaccatggatggcaacgaatttagaatgcagagatacagggaaagacaactagaaccacctggtgaggatgaagaagaattcgagccggaaccagaagaaatacaacagcaagatgaagaaagtcaagcgggatccgaccaagagaaagaagatgacaaagaggaaaaaggaagcagtgatggggaaagatcaagggcctcgtcaagggcatcatcaaaaagatcctcttcaagatccagatccaggtctaaatccaagtccaggtcaaaatctagatcgcggtcacggtcacgttcacgatcaaaatccaagtcaaaatccagatcaagatcaagatccaaatcgtcgtctagatcccgttcgcgctctaaatcaagatccaggtcaaggagtgcctctaaatccccatcccgttccagatccagatcaaaatccaaaagcaaatctagatcgagatccaggagcaagtcgcaaagcagatcgcgctcaagatccaaatcaaagtctcgctcgagatccagatctggatcggcgtctggatctgattctggatcgggttctggcaagtctgacagtgagtag

SEQ ID NO: 1223 - DNA, 1170 bp, Meligethes aeneus
atgccgatcgaaaacctcgaagatcagggtctagagaaaaacccggacttggagttaacgaatttcaagttcctgctcactttgccggaattccgaagcgatcgaagtgtacaccaaaaaatcagcgatgctataaagaaagacgacatggcgccatggtacgagctggtctgcaaagacgcgggttggaaactagatgcgaacctcctaaaacaactaaaaacaaagaatgaggaacaaattaagaaacttgatgaggctatcgaagatgcagagaaaaaccttggcgagggtgaggtaagggaggcttatttgaggaaagccgagtattacagtcgtattggtgataaagacaactgtgtgagcacatttagacagacctatgacaaaactgtttcactgggtcatcgtttggacattatctttcatttaattcgtattgggttgttttttatggatcacgatattattgtgcgcaacatcgataaggctaaaaccttaatcgaagaagggggcgattgggataggcgtaatcgtttaaaagtgtaccagggggcttactgcatggctgtgagggacttcaaaacggccgccactttatttttggacactgtaagcactttcacctcgtacgagttgatggattacaagcaatttgtgaggtataccgtgtacacttcgataatcagtttgcccaggaatcagctgagagataaggttgtgaagggttctgagattttggaggttttgcattctgagccttttgtgaaggattatttgttttccctgtataattgtcaatatgctgagtttttcactaatttggctgaagtcgaaagcgttctacgtaaagactacttcctaaaccctcactaccgctattacgtgagggaaatgcgaattttagcttacacacaacttctagaatcgtacagatctctaacattgcaatacatggccgaagccttcggagtttccaagcaatttatcgaccaggaattatcgactttcatcgcctcaggtaggctgcactgcaaaattgacagagttggcggtatagtagagacaaacaggcccgatttgaaaaatgcgcagttcaactctgtggttaagcaaggcgatttgcttttaaccagggttcagaaattatcgagagtaatcaacatttaa

SEQ ID NO: 1224 - DNA, 627 bp, Meligethes aeneus
aaagataccaaagatgaattaagtgatatattgggaccgcattttaatctggaggcaattcccaatatgaatagtaaagatgttgaagacatcttcaagggcgttttgactgacgaatctcaagagtcccaagagagcaacctatttccaatacaatcgaatccagttttcccgccgactccagcgcctcaaaatccaatgcctaatccgatttctatgttgaaccctgtcgttcggccgaccactttgccgaacgtaaatcaaagtgcgctgaactcgcctcacagctttcctccacaatcgccgtatcattctgaatatagcaacagtccgcagtttagtcctgcgttctctgaaccaccacccagtccatgggttggaagcgataactcggaaatggactcttcatccggacagtcgacttacaatcagcgttcttcggaaaagatgaaggcggacgaaagtttgtgtgataaggcgacaatttctgcagttctttacgcgaatgttaaacatcctgaatggaaatctgaatatcccatttggactgatagatacaagcagatactgaaaaagtggaggacactgagtcaggatcagaaagctccattcttgcaacaagccagg

SEQ ID NO: 1225 - DNA, 855 bp, Meligethes aeneus
tggctggacgtgaagaacccgcagccggtcgccaaccccgtcagctggtgccagttcgagataaactgctcgaacccgggcgacatgggcgctgcgcagagccccaagcccattccgccgccccctctggcggtcgccgccgtcaacatgcgctgcgccatcaaccccaagaccctgcagaacgagatcgtcatgatttcctgcctcacgcacaccagatacgccctggacaagcagcctcccaagccgccttttgaacaccatttttgcgtgttgacttgtccgaaaagttccatgatgcctctggactttcacaagcaactgggcaactacaaggccaccaaagtccaaaaaatggactcggaaaaggccctattaaactacttcatcaaccaattcagccgcatagaccccgacttggtcgtgggtcacgatttgcagggctaccaaatcaacgtgctcttcgacagattgaaagcgaacggcaacgccgcggccgacaaaatcggcagaatgcgccgggccgacaagttgaagaacgagcgcgttctttttgtcggtagattagtttgcgacttaaaaagatcggctaaagagttgatcaaatcgcggtcgtacgacttggacgccctctgctcggcggtgttaagagttaaggagggtttaagggtggagttggagcccgaggatgtgcccaagatgtaccaaacctcggagaatatcctcaagttggtatctttcacgatgcaggatacttcgtatatacttcaaattatgtacgacttgaacgtcatacctctggcgcttcagataactaatatcgccgggaatgttatgtcgaggactttgatgggg

SEQ ID NO: 1226 - DNA, 768 bp, Meligethes aeneus
tcattcgccagagctcgcgattacgacgccactggacagcaaacgcgtttcgtccagtgcccggaaggtgaactgcagaaacggaaggaagtagttcataccgtgacgttgcacgaaatcgacgtcatcaactccagaacgcacggatttttggctttattctccggggacaccggagaaatcaaatctgaggttagggagcaaatcaacggaaaagtggccgaatggcgcgaagaaggcaaggccgaaattataccgggtgttctatttatagacgaggtccacatgttggacatcgagtgtttttcgtttttaaatagggcgttggagaacgatatgtcccccattgttatcatggctaccaacagaggaataaccaagataagaggtactaattatacttcccctcatggtataccgctggatttgttggatagaatgattattgttcccacttctccatacaatgagaaggagatcagggagattttgagcatccgttgcgaagaagaagactgtcagatgtcggagaacgcgctgggcgtgctgacgcgcatagccaaagaaacatctttgcggtacggcatgcaactgatcatgacgtccagcctgatatcgcgcaagcgcaaggcgcaagaaatcgacgtcgaagacatcaaacgggcctaccaactgttcagcgacgattccaggtcggtgcagttcctgagggagtaccagcaagagttcatgttcaacgaacttggtgaagacacaatggataccaac

SEQ ID NO: 1227 - DNA, 1116 bp, Meligethes aeneus
atggctctaagaacttacggagataagcctataagtttccagctggaagataatggagagtattactgtgttggatctgaggttggtaattacctcagattattcagggggtctttatacaagaaataccctggtatgtacaggaggagcattacgaatgaagaaagaaagaggttaattgatttggggttatcccaacatgttttggcgagtagtgtttctttactaagagccacagaagttgaggatataattgagggaaatgatgataagtataaagctgtctcggtgcacaccagcgatccgccgctggtaagggagggcaaaacaaaaaaaaacatgcagtgggtgccatcgttgcccaattccagccatctggatgcggtaccgcaagcaacacccattaaccgcaaccgcgtggctgcaaaaaaagtacgaacttttccgctttgtttcgacgacactgaccctgaaattaacgctgaaaacgcttgtcagggggagctactggtgccgattaggttggacatggaaatcgagggtcaaaaattgcgcgacactttcacgtggaataaaaacgagagtctgatatccccagagcagtttgctgaagtattatgtgatgacttagatttgaatcctcttactttcgttcctgccatagcccaggctattagacagcaactggaggctttcccccccgaaccccctgccattatggaggagtcttgcgatcagagggttataataaagctgaacatccacgtgggtaatacttctttggtagaccaaatcgaatgggacatgagcgagaaaaaaaacaaccccgaggagtttgctttgaagttgtgcgccgaattggggttggggggggagtttgtcaccgcgattgcttattctgttcgcggtcaaatatcatggcacgccagaacctacgctttttccgaggccccattaccaacagtggaggttccgtttagatcgaccagcgaaagcgacgcatgggcgccatttttagagacgctaaccgacgccgaaatggagaaaaaaatccgcgaccaggaccgcaacacgcggcgcatccggcgcttggcaaacaccaccactgcgtggtaa

SEQ ID NO: 1228 - DNA, 624 bp, Meligethes aeneus
atgttttgctgttgttcttatagggaggacagaggcaaaggtccgatggctgctataaggaaaaaattggtgattgttggtgacggggcatgtggaaaaacgtgccttttgattgtgtttagcaaggaccagtttcctgaggtgtacgtgccgaccgtgttcgaaaattatgttgcggacatcgaagtggacggcaagcaggtcgagttggcgttgtgggatacggccggacaggaggactacgaccgtttgaggcccctttcctacccggacactgacgtcatccttatgtgcttttccgtcgattctcccgactccttagagaacataccggaaaaatggacaccggaagttaagcacttctgcccaaatgtgccaataatcttggtaggcaacaagaaagatctgcgcagcgatccgtcaaccattaacgagttaaaaaagatgaaacaggaacctgtaaaaccacaggacggccgctccatggccgaaaaaattaacgcgttcgcttacttggagtgttcggccaaaagcaaggagggcgtccgagaagttttcgagaacgccacgcgcgccgcattacaggtgaaaaagaagaagaaacatcgttgcgttttgttttga

SEQ ID NO: 1229 - DNA, 3963 bp, Meligethes aeneus
atgaacgttagttcaattatagaccaaacaatggataatactcgaatgcctcttcaaaaaatggagattgcggcgagaaacgttgatagatctttgaacatagattgttcggcaccaagattaattgatcaattgaatgtaaatgcacaaacagggtctacagccagtggtcttattgataatgattaccctttgttaaacgggatcccttttactttgaataatatgacacaaatcaagactgtgaacaatattcctcttccacctgaaattgtcgatcattttactcatattcaatgccactgcatgatgggcttgttcccagaaataaacagagcttggttaacagtggacagtgatatttatgtttggacctatgaagaaaactctgatttagcttatttcgatgggatcaacgaaaccattttgtgtgtgggattagtaaaacccaaaccaggagtttttcataatttcataaaatatttgttggttcttacgacgtcagtggatattgttgtgttgggagttacttttactgaaggggctgagggggataatgatgagatacagcttatacctgatcctgtgttcacaatttcaacagatggcgccacaatatccaccatttctggcactgactctggaagattgtttttgggttccaaggaagggaatctatttgaaatctcctaccaggctgaaagtggttggtttggaaaaagatgcaaaaaagtcaacttatcgaccagttctctttcatttctggtaccttcatttttaaatgcagcccttagcgaggaggatggcatcgctcaaattgcaatcgataacaccagaaatatactttacattttaactgaaaaaggatccattgaagtttgcgacttgggagaaaaaggaaatacgttttctagagttaccaagttatcgcaggctcaacttgtatctcaagccatgaccactgtcaaaacgttggacagccaaaatttccgccccatcgtgagcatatccgccgtggaggcatgcgactcggccaacgttaacctggtggccgtttctcaaactggcgtgcgattttacatgtccgtggtgagcttgtccaaccagctgcccaatcagcggccgtacacgttggcgcttttgcacgtgcggctgccgcccggctactcggccaacatcgcggttcgcccgaggtgcgtgcacatgagccactacagagacaggaactgcgtactggtgtccaccgtgaaggataaggacgtgttgtggtgcatcagttcggatttgttcccgttcaattccacccttatggaagcttacacgactgtcaacttggatgggcctgttttggccattgctgaggtgcgtcacgacagcccgctgcaagacccgaacttcgaagcgccccctctcgccgtgcgccagcacttcgaggcgcaaaaaaaatacgtcgttttaacgtcgcacggcgttcagatcctcgtcaagctccgcccggtcgacttgctgcggcagattctgcgggacagccgcggccacgacagcgaaaccctgaaagccttcttcatgatcctgaaggaggatcaagcgtgcgccgccagcctcatcctcgcctcattggagaacgacgagaacacggagatcgccgattgcgccaccaggtgcttcttcactttcggcggcgaaccgaaggtggcgcttctgaaccaaaccagtgcactatctggttctacaatgttttcaccaaacataatatccaccccagcccacaattaccaacaaaacatgtacaacatgcaaagccccaatctgtctcaaactcaacaatccccaaattttgaagtggtgtgcccctttgtgttttcctccaaacacaacggtttgtatttgtacctgggaagaatattacgacccgtttggaacagaagatgcgtcaataaggtttgcatcgatggaaaaaccttcacaaatgtgagcaccatctcaatcaacgattgcatctggatactgaacaacctgaccgccctgcacaacttcataacgcaaaacacgcagctctcctccgtttgcaatacctcgtcgaacgcgaacgccaacggctcgttcgcgaaccaaacgacgaacgcgacgcggtcgaccgtgacggtcagggaggcgcaactcgaggaaaggcgatcgctggacgccctgaagatcttcgcgaaccagtgctgccagctgctgggcttctggaggatcctgtgcgagcaccgcttccacgagctgatcggctcgttgcccgagaaccagcagcaggtgctgcagaacaccacgttcaaggagttgtttctctaccggcacgatatctgctcgtttttgatcgccacgctggtgaacagctatctcggcgacaacgcctcggtcgattcgatcagcaacaagttgcgggaggtctgccctcagttgtacaagtctgaagatgccgcgttttcgaaggccaacgaaatcctgaaaatgatcagaaccgtgcaaaacacggacgaaaaggaggaaatgctgatctcggccctgcaactctgcaaatccatcggggccaacataaagctgcgggaaatctcccgccaatttaccgcgctgaaagcctacaaggccgtcatcgagctgtgccactactacgcgcaaaaggtcgacccagaaaacatcgccgagcatttttacaacaacgacgacaacgccgctgatcacgagggctacggctactacaggaagagaatggaggtttacacagaagttttggccatgctggacacgatttacttcgagcagaacgaaaatcgccaggccaccttcgcagacgattgcgccgtcgattcagtgacccgtcaagtgatatcgcaagttttggactaccccgacgaaataatgcacatagcgttgtacgagtggatggtcagtaaaaacatgaccagcgacctcatcaaaatcagtcagccgtcgttggaggtgttcctcaagcgcagctcgaacaaagacaacggcaacatcgccgtcatggacctcttgtggaagtactacgagagcaacaacaaccacgcctccgccgccaagatcctcaacgggctcgcctcgcagtcggggggcgccgtcagcctgaaggaaagactgtcgtatttggcgagggccataatgtgcatgagaagcgacaaagtgggctatgcgccttgtttgggtgtgtttttgagggatctggaagacaaaatggaggtagccaaggtgcaggaacaaatcctcgatgccatcacaaatatgcaaaattccgttccgaatgcccaagaagttattaccattctgaattctggattatttgaaatatcgcagctgtatgaaaatttcgcggagcccttcaaactactagagtgccaattggcaatcatcgactgtgccggctacacagacaatgtgctgatcgagcacatttggcgtcaaattctgacgaacgagctgagaaaaagcagcggctctggcaacgacagaatggcgcaagtgctcaccaaggtcaagcatctggccaggtattatgcctcatctttgaactgctttcctttagataatattgtgtatgaattggaaatgcttaattcgaggttgaggggggacaaaaatttagtaccacaaactttggtcacgttaaatgtgccgtttgaaaaacttgtcgctgtttataataacctcataacattatcagcaaatgaccaagaatggcaaaaggaagaaaatgaattccatctatcggaagccacatcatttttaatatattatttccttgataataatgattcctttaatagcattgaaaagagaaaaattacgtcactatgccaagatgctgtagcaacattgttttccatactttacagcaaaccaaacacagaacatttagtgaatcaacttagaagcataaaagcgcaactctcaagaatttaa

SEQ ID NO: 1230 - DNA, 4173 bp, Meligethes aeneus
atgagcgagtttacgttaagttatagagaagttataccggatcaaaccgttttagattcatggaaagatataacacttagtacaggtggcactcaaagtactttgcaagatattaaagtagccgaaaaggcaaatggctattgctacgaggattccactaaaacacatactagaaatagatttattcactggcgtattaacaatgatgtgttggagttggtcgagcacagtttggatataaatttaacaggaaatagaatcagatacaaaatagttgatactcctatattagatggagtttctattcatgaaagtattgataatgttatcgtacttgtgcctactgtttgtagcatccataggcttgtttttccacatccagatagatttcatagacaggatgatttgggctcctaccctgatttggctgctccttcaatattctcaaaagcaacagctatggaagccaaaaaccccaatactttccatgtttttaataacccccacagtgcaaatgatcagttgccaaatttggcttgttcctatttatcggctgatacagaggaagctgtgtttgtccttgcctatccctccacagagatgctgttaattaaacaaaacagggaaggtcagtgcatttctatggaaatgaaaggagagtctcttatgcccaggtttttatctggactggcagaaaaattcaggcaaaaaaatagtgaagctgacaacatagtcagccttttaattatcctgttagataatgaaatgtatgcagtcacactgtgtagagatgggcatttgaagttctggtcatgcagcaggggacactgtgtggctgttattgatgttttaactgaaacaggggacactaacagggatctggtgcaaggtgcttctctaagaaaggcgttgaatggataccatacatcagaaaatactttggtagtatttatgagcttttccactggatgccagtttcacatcttaaaaccagtactgagcggccaacagatcagaatcgtgaggttaaacacgctacattcgcctgagaacgatttgatagacttcgcgctccaaccgaaccggctgtggtcggcgtggagatgtgaggacggcgactgcgcagctttttctgcgtcgctctacgctaacggcgacgagagcagcagctggacgccggtgattctggagacgctacccgacgccaaccaatacccggccgtcgacgacgagatagatcctaagcaggcttatttgcagcacatctttcatcccggcagatttcccttgcacatcatcagcaaggctttatgcatttatagtagatccaacgctctagctgatactaatttatcggcaacagctcttaaacagcgcatttgcatggcggtggaatccgaaattcgaacagtattaaatgaacaaaccgtcaacgatcaggaatatttagaatgtgcccaatggtgctggcaaaagttttattcgtgctgtgtccaatatcacgtggccggactaaaaccgctaggtctgctactacttcctgctgtttcgggagctgttttcctgaaaaaatccactttttcgttcttgcggcctttagaacctttggagcacatgaccttgtgtggcgattacatgtacaaagaccaattcgtggaatatccactattaggcgatgatttggacaacatgggcgacgttatgagcctatttcaggttatcgtttacttggaacagcaaatgagcgacattttcctgacaacgtttgaaaaagaaatggccactcttcaatcccccgatgttataatgtcaaagttactagaaaaaattcacacggaaatggacagtgagttcacaaatcaagtgtccggtatgttgggtcaatgttgcgacctctacaaggcggttcacaaagttctcgaacttctccgctatgaaaatctcaacacatgcgattctgatgttaatcctttcgcgcttcatcacttcagttctcacttgggggtgtcggttgtggccggttgcatacgtcagcaagctgtcacccggttctcgatttgccggaatttattgttgatttgcaacattcttttgtacagaaaagaattggaatggggcattttggaagccatacgatcagtttgcatgcctgaaatagttgtttttacacaagctagctacgttatgatgtggcttagcagtctgcaagggttggtgaacttacctcacgattcaagtttgcaaagacttgctccgattaaattgaacccagtttataacttgcgcaacaacagcttccaatcggtttcgcttctggatatgttcatttcgtcgtccggcggccaagaagcgcgaaaaaccttctgtcgcatcaagtattgcgacgaggatttggcacactggcatctttcgctgttgccctacttgaatcatctcaggcacattatatggccggtcggtggcagcactgttctggctgagtggttgctgagcagcggccaacacctgtggctgcaacagtacgtaagactcttgagcaattggtgcgaatggaacagctgcacaaggagcttcttgctggccgcatcctatctaacaagcggggaaaactacaaggcccaagagttgttcgagacggctgctaaaggaatatttttagataaatttttaagcgagcgcattcttaaaaatcgttctgccgacgatagccaaacaaaggcatacgttacctactacataaaagttattcaactctttgaactccacaaagctaaagattgtgccataagggttgccaatactgcgctcagcatagtggacaaagacgaccccctcatggcaaccttatattccattaagttcaagcatcatttatcattaaaacattatgaaaaagcattcgattcgttaaattctaatccggacgttgaaaggcgtaaagataacttaagagatttggtaaagtgcttgttagatgaaaaaaaactggatacattgttgaacttcacatatggaagcatggacgaatttttcaccaatatattgctgacaagagctagagctactgatgctgttaacaatatttactacgattttctttattcctatcaaattaaaagaggccctttatgtcacaggctagctgcctctgtcatgtacgaacaagccttcaggctgacacaatttaacaccactgaagctttagaaaaacaggtaaaatgttacttggctgcaaagaatattctacagctttgcgatcctaaacacgcttggatagctagacctaccgatgcggatgagagcgatgatgagattgttatagaaccaatggctggaactggaactgtagaaaatctccagaaaattaaattgcaaaggcaggtggaagtggtgaatataaacataattaaaaaagatcttattttcgcttgtgccaaattaaagttgctcagatttagttctggatcatctttgaatattaccactccccacgaattagtatcgttgctgaataatgcgggactttttaaaaccgcactgaaaatatgcattaactttaaagttccatatgaaagcgttttcgatactctcacaaaacactgcgttcttcttacggagcaagaccatccaaatgcttgggattggttggttgagaatgatcttcaagatcttccagtaaatagagactgcattgccgacgttgtctggcaattacttcaagagtgtctcagaacctatgaggaaccaaacatgacaacattgcacagtgttgttttaaggaaaattatcgggatgaaaatgtttgttccgttctggttaatggaatcatacaagaaaagaaatcctggagagctccttaagattcttcattcttccggtaggctggaggaagcggcaacaatggcgcgcgactacttatcggcagctatgggttatggtaaagagttgtatggattttcagccccgttagctcacacttcaaaacccttttgcatgccggtatacgcaattcaaaatttgatcaaggagttggagatacaaaacaaagtgaatttggaacaaccctttaaaatggaatacacttctctacaaaatctctttatggaatatctacaaacttcctcaagaatttccttcgaaatgtgtaattttaagcgtttgtcagttaaataa

SEQ ID NO: 1231 - DNA, 2910 bp, Meligethes aeneus
atggaaatctcagacgataatttacaaactcttgcgcgttatttgcaagaaacgttaaatcctgacgtaaatgtcagaagaccagccgaaaagtttttggagggtgttgaagtgaaccaaaattacccgctgttaatgcttcatttggtacataagcctgaaattgatatgacaattcgtattgctgggtcagtggcttttaaaaactatataaaaagaaattggaatgtggaggaagatcaagcagatagaattcatcaagctgacagagcagctataaaaaatttgattgtaacattaatgttaacttcaccagaatccatacaaaaacagttaagtgatgctattagtatcattggaaaaactgattttccacttaaatggccggagttgatcactcaaatggttgagaagtttgcaacaggagattttaatatcattaatggtgttctacaaactggccattctttatttaaaaaatacagatacgaatttaagtcaaatgaattgtggactgagatcaaatatgtgttggagaagttagcaaagcccctaactgatttattagtggctactgtgaatcttgcgcaaactcatgctagtgatccaaatgcgcttaaaataatttatcattctttaatgttaatttgtaaagtattttactcattgaatttccaagatttgcctgaattttttgaagacaacatgcaaacttggatgtcaaattttcataatttgttgtgtgttgatgtaaatagtttaagaacagagagtgaggaggaggcaggggtcattgagcaattaaaatcgcaagtttgcgataatattgcgctttacgcgcaaaaatatgatgaagagtttcagccctatttgccacagtttgtgactgatgtttgggggttattggtaggaacaggactccaaccaaagtatgatttgctggtttcaaatgcacttcagtttttgtccactgtggctgaaagaaatcactatagaaacttgtttgaggacaatacagttctaagtagcatttgtgaaaaagttattattccaaatatggagtttagagtttctgacgaagaactcttcgaagacaaccccgaagagtacacgcgccgcgacatcgaaggctcagacgtggacacgcgtcgccgcgccgcctgcgacctcgtcaacaccctgagcgtgcacttcgagcaacgcatcatggaaatattcggccagtacttgcaaggcatgatgggcaagtactcggaaaatccgaagcaaaactggcgcagcaaagatgccgctctctatcttgttacctcgttggtcagcagggggtccacgcagaagcacggggtcacgcagaccagccacctcgtttccataccgcagttctgtcagcagcaaattttgcccgaactcgaacgccaagacgttaatgagttgcctgtactaaaagctgacgcgataaaatacgtaatgacgttcagaagtgttttaccaaacgaaatggtagtgtccaccctacctcagttaataagacatatgacgtcagaaagcgcggtggttcacacatacgcgtcatgcgcactagaaaaaatactcatacttaaggacgccggcaataaacctcttgttacaggagctcaattagagcctctatccaacgagttactgtcaaatctttttggtgttttaacacgtccagtttctgaagaaaatgaatatgtcatgaaagcaatgatgagaactttctcaacattacaagaaagggtggttccatttttgagcgttgctttgcccaaattaacagaaaaactacaaatggttgccaaaaacccttctagaccgcattttaatcattatttgtttgaaactttttctctagctatcagaattgtgtgcaagcaaaaccaatcagctgttaaatcctttgaggatattttgttcccgatattccaaggaatcctacaagctgacattcaagagtttattccctacgttttccaactactatctctgctcatggaaaacacgccccctggtgccgtgcctgaaacgtacatgcagctgttgccatgtttgctggctccagtgttgtgggaaagaccagcaaatatttcccccttggtgcggttattaagcgcttttgcaactcaggccgcgcctcaaattgtcgggcaagataaattgggtggatttttgggagtttttcagaagctgatagcttcaaaatccaatgatcatgaaggtttccatttgatgaggtgtataatacaaaatgttccaactgaagctttacaagcctacatgaaacaagtattctttctacttttccaaaggttatcatcaagcaaaaccacaaagtttgttataaatttaattgttttcttctgtttgtatgctgttaaatattcagcaaacgatttggtcgttactattgacggaattcaggcacagatgtttggtatggttctggaaaaaatccttatcccagatttgcaaaaagttgctggcaacgttgacagaaaaattgtcgcttgtggtatcacaaagttgctgtgtgagtgtccagaaatgtacacagggacgtatcaaaaattctggccccaattattacaggcattaatcgcattctttgaaatgccagtagatgaaacaagtctcccagacgatcatttcattgaaatcgatgacactccaacattccaaacagctagtgccaaattaaactttgcaaatacacaaaaaaccgaccccttacaagctgttggtgagcctagacaatttttggcgcaaagtttagcatctttaggcagttcgcaaccaggtcgcctaccaagttatatttcaaacacaaatcaacaatcccaaaccactttgcaaggatatttgtcaaaattcggagttcaactctcctaa

SEQ ID NO: 1232 - DNA, 603 bp, Meligethes aeneus
atggcaaaagttcagctatgcaacatcactgttatggacaaccccagccagtttttgaacccttttcagttcgaaatcacgttcgagtgcattgaggaactgaaagaagatttggaatggaaaatgatttacgttggttcggcagaaagcgaggagtacgatcaagtcttagattccgtattcgtaggccccatacctgaaggaaaacacatgtttgtgtttcaagctgacccaccaaatgtatcaagaattcccgaaaacgatgctattggggttacagttgttctattaacttgttcctacagaagccaagagttcatacgagtgggatattttattaataacgaatatagcgacccagagttgaaagaaaattccccgagcccccctcagtttgataaagtgatgaggaacatattggcttctgagccgagggttacaaggtttaaaattaactgggaggagccgaatcagcaggaaaatggtcagggttcgggggaaaatcaggcacaaacatctagtgtcgaggataatagtgcatcaggacaaatacctagttttaacgagaattctaactcatgggccacaatggagtgttcatag

SEQ ID NO: 1233 - DNA, 921 bp, Meligethes aeneus
atggatcaaatgctaccaagtccagggtttagtataccaagtataggaaccccacttcatcagcctgaagaagatcaattaattcttccaaatgctttacaacagcaacaacaacaaaatttgtcacaagtccccccattggcccctatggggggactaaccccaactttaggcctaggaatgggtatgtcgatgccaactcgatatgttccaggttatggcagcagtttgcagtctcaaacgccgcaacatacgatgatgtcgcctatgataaacttaggtggtaccagtggaggtccaggggccacacctagtagtaatatggggcctgcgacacctgcaacccctgctacacctcagaccccacattcccaggatccagggattgttccccagttacaaaacattgtttctacagtaaacctaaactgcaaactggacctgaaaaaaatcgcgctgcacgccagaaacgccgaatacaaccccaagcgtttcgcggccgtcataatgcgaatccgggaacctcgaacgacagccctgatcttctcctccggcaagatggtgtgcaccggggccaaaagtgaggaagactcgcggttggccgcgcgaaagtacgcgcgtatcatccaaaagttgggttttaacgccaagtttttggattttaaaatacagaacatggtgggcagttgtgacgttaagttccccataagactggagggtttggtgttgacgcacggctcttttagctcctacgagccggagttgttccccggattgatttaccgtatggtgaaacccaggattgtgctgttaattttcgtgtccgggaaagtcgtgctaaccggcgccaaagtgagacaggaaatctacgaagcatttgataatatttatcctattttgaagagtttcaaaaaacaataa

SEQ ID NO: 1234 - DNA, 474 bp, Meligethes aeneus
atggctttaagatccgtaaccaggcttttctctcgccgtgctttaagcactaccactgttcgcggttattccgacgaaatgagcttcactttggcctccggcaaccaggtgttctacgatgccaaatcagttaagcaagtcgacgtgccgtctttctccggcagttttggtattttacccaaacatgtacccactctggctgtattgaaaccaggagtagtttctgttatcgaagatagtggtaatgttaaaaaaatattcgtttccagtggtacagtcacaatcaacgaagattcgtccgtacaaattttggcggaagaagcccatcctgtggaaagtttggaccgttctgctgcccaggaggttttaagtaaagctcagagctctatgtcgtctgcctccacagaacaagctcgtgctgaagctgccattgctattgaagtaggtgaagctcttgtcaaagctgttgaataa

SEQ ID NO: 1235 - DNA, 972 bp, Meligethes aeneus
atgagtggtgacggaaatcaaatggaaactttcgattccttatttttgtcgattgcacaacatcatccccaaggagcctcgcagcttctcgacacgtttgtgaatttcttgggaagaaaaaccgatttttttatcggcggacaggaaggagcatggcaatcgctggtgatgagcacatttaaaaaatacgagaaaataagcagggatgctcacgaggctgaacttaaactaaaaaaggaaaaagaggcagttaaaaaagctgcatctgccaaaaaacaagaagctgaagttgttaaaccagctgaaattaaggaattgactgatgctgaagctgaacagctgcaggctgagttaaacgctaaaaagggagggtctgaagctgcacctgctaaagctgaagaagggaaaggcaatgatgaagaagaggaggatgaagctgaaaaaggaaaattgaaaccaaatggtggaaatggttgtgatctggaaaaatataaatggacacagactctacaggatgttgaggttaggattccattaaacgtcaactttagggcgaaacaaaaagatctggtcgttaacctaacgaaaaaacatttaaccgtcggtgtcaaaggtcaacctcccatagtggacgatgattttccctacgaaatcaagctggaggagtccacatgggtgatagaagacggtaaaagtttgctaatcaatttagaaaagataaacaaaatgaactggtggaataaattggtcaagtctgatccggaaataagcacgaaaaaaatcaacccggaaccgtcgaaactgagtgatttggatggggaaacccgtggactggttgagaagatgatgtacgatcaaaggcaaaaagaacgaggacttcccactagcgatgatcaaaagaaacaggacgttattaataaatttatgcagcaacacccagaaatggacttctcaaaatgtaaatttaattag

SEQ ID NO: 1236 - DNA, 456 bp, Meligethes aeneus
atgcagggccactctgcaatgcctccaccccttcaatggagccctgataagaaacacagcgatcgcgaaagatgggtatgtatttatccagcatacatcaacagtaaaaaaactttagctcaaggcagaagaatatcaaaagaaaaatgcgtcgaaaacccaacacatcaagaaataagagatgtgttgctggcagcaaacttgaaagttggagtggaaaataaaatttactcaagagaaagaagtaaggagcttttgtaccgtggtagaataagagtgcaattaaagaatgacgatggttctttattcaatccaagttttccctccagagagagtattatgcttcatttaggagacatgattcctaagctgaagacacgacagacaaagagtggtggtgaacaacagcaatcaacgggtaataagggaaagggcaaaggaaaaggaagacgttaa

SEQ ID NO: 1237 - DNA, 1356 bp, Meligethes aeneus
caaattttcgaaagggctgttcagttttatggagatgatcatttggatgagaaattgttcattgcttttgctaaatttgaggagaatcagaaagaacatgatagagccagggttatttataagtttgctttagatcacattcccaaggagcagtccaaagaattgtacaaacagtacactatacatgaaaagaaatatggggatagaagtgggattgaagaagttattgtttctaaaaggaaatttcagtatgaacaagaaatattgcaaaatcctacaaactatgatgcctggtttgattatattagattaattgaaggtgaaggagaagtagaaattacaagagaaacctacgaaagagcaatagcaaacatccctccctccaaaaacaaacaattttggaggagatatatatacctatggataaactacgctatttttgaggaactcgaagcccaagactatgaaaggacaagacaagtatacaaagcttgtttagacttactacctcacaaagtattcacattttcaaaagtctggttattatatgcaaaattcgaaataagacaaaagaatttaaccactgctagaaaagtattggggatgtccattggcatgtgcccaagagataaactgtttagaggatacattgagttggaaattcagttgagagagtttgatagatgtagaagattgtatgagaagtttttggaatttggacctgaaaattgtgttacatggatgaaatttgctgaactagaaacattgttgggtgatgtggatagagctagagctatttatgagttagcaattaaccaacctaggttggatatgccagagctcttatggaaagcttatattgactttgaaatatcacaggaagaacctgatcatgccaggcgattgtatgagagattacttgaacgaacaaaccatgtgaaagtctggttatcttatgccaaatttgaattcaacaaccattcagaagatgagataaatataggtctagcaagaagggtgtttgaaagagccaatgaaacactaaaatcttgtgtagataaagaatccagagtgcttcttttagaaaactggaaggagtttgaaaacacccatggtgataatgttaataaagaaaaagttaattccaaaatgccaaggagaatcaagaaaagacagaaggttattgatgaagatggatttgagcaaggttgggaggaagtgtttgattacatctttccagaagatgaagctagcaggcctaatttgaaactgcttgctgctgccaaaaactggaagaaaaaagctgctgatgatgaaccttcagaaagtgataaatcagcagaaagagagtcatga

SEQ ID NO: 1238 - DNA, 762 bp, Meligethes aeneus
atgggcatcaaattcctcgaggttattaagcctttttgcagcattttacccgaaattgccaagccagaaagaaagatccaattcagagagaaagtactgtggactgcaatcaccctattcatctttttagtatgttgtcagatcccactttttggaattatgagttcagactcagccgatccattctactggattcgtgtgattctggcttcaaacagaggtacccttatggagttgggtatttcacccattgtaacatctggcctgataatgcaacttttggctggtgccaaaataattgaggtcggtgatacaccaaaagacagggctttgtttaatggagcacagaaattgtttggaatggtgatcacagtgggtcaagcaatcgtctacgtgatgaccggcatgtacggcgacccggccgaaatcggcgccggagtgtgtctcttgattatcatacaacttttcgtcgccggtcttatcgtgctcctcctcgacgagctcctccaaaaaggttacggtttggggtccggcatctctctcttcatcgccacgaacatctgcgaaaccataatctggaaagcgttctctcccgccacggtgaacaccggaagaggcactgagtttgaaggcgcggtcatcgctctattccacctcttgaccaccagacaagacaaaatcagagctttgcgtgaagcgttctaccgccaaaatctgcccaacttgatgaacttgctcgccaccgtattcgtctttgctata

SEQ ID NO: 1239 - DNA, 486 bp, Meligethes aeneus
atgtcttcaataacatccccgtccgtagaattaagctcctaccgtgatcagcatttcaagggctccagagccgaacaagaccgtttattaaggggtacaactactttatatattggtaatttatcgttctttacaacagaagagcaaatttatgagttgttttcgaaatgcggcgatattcggcgtgttataatggggctggacaaatacaaaaaaacgccctgtgggttctgttttgttgagtattataacagagctgatgctgaaaattgcctaagatacattaacggaacccgattggacgatagaatcgtgagaaccgattgggatgccggttttattgagggaaggcaatatggaagaggtaaaactggaggacaagttagagatgaatatagaactgatttcgatggcggacgaggcggttatggcaaaataatccaacaaaaaataggcagcggtcccgaaaccacttttccccgatga

SEQ ID NO: 1240 - DNA, 921 bp, Meligethes aeneus
atggctgctacagtaggacggatttgcggagctggcctcttaaaatcggctaatggggcctctgtaacccaaatatcttcgttctctacaagtagagaatggaccagaggaaggaaagcacttatgggtacattggggatgttagctggtggaacaggtgctttgttgtttgccctggatagatcagttaaagcttctgatttagaattgcatccaccaaaaaacccatggagtcatgatggaattcttagttcgcttgatcatgcaggtataagaagaggctacgaagtatacaaacaagtgtgcgctgcgtgccactccatgcgcttcatcgcctaccgtaacttgatcggcgtgtcgcacaccgaggccgaggccaaagccgaagccgaagaaatcatggtcacggacggacccgatgagcttggcaacatgttcaaacgcccaggaaaactttccgactacttcccgagcccctaccccaacgaagaggctgcgcgcgcagccaacaacggcgcctatccacccgatcttagctacattgttgatgcacgtcacggaggtgaagattatatctttgccctgttgactggatactgcgatcccccggccggcgcagttatcagagagggtcaatacttcaacccctacttcccgggtggcgccatttccatggctcaagcgctctacaatgaagccatggagtacaccgacggtactccagccactgccagtcaattggccaaggatgtgtccactttccttaaatggacatccgagccagactttgacgaccgcaagaggatgttcattaaagccgtaggaatattctccatccttattgcacttacatactacttgaagcgacacaagtggtcatcgatcaagacccgtaagattgaatttaaaccaagaaattaa

SEQ ID NO: 1241 - DNA, 1788 bp, Meligethes aeneus
tctaggttaactatcgtaaacaatccgtcttttccactaaaacaattaaaaatgctttctatccagcaatattcagacagtagtgatgacgattcacccaaagaacccttggaagacaaaacaacggcagtaataaaccaagattacctaaaacctttaccaccagaaaaggccaaattctcagtgcaaaaacagttacaaatttgtgctgcaccgattgttttacccacaggcgtcgacgaagataaaatacatctgcaccctgatacaaaggaggtggagtttaatcccaagtatgaagaattatttgctcccgagttggggcctcataacccatataaaacgcaacagcgagcgttttcgaaaaatatgctgtccgggcatgtcgaggccgctcatgtgagcgattttcaatttgagaatcagagaagaacgtttgctagttttgggtatgcattggatccttcagtgagtggcgaaggagagaaacttaaggttgtgggtgctaaagaggttaatagcgagtcaacggaaataacaactgtgtttgagactaccaaagtgagacctttagataagcgaaagcgcaagaaaaacaccgacgcaggcgacatagaagggttccttggcccgtggggcggcttcatagacgagcaacgcatcatgaaaccgaccgaagaggaagccatcgagctcgaagaactcgtatcgaagaaaacgaaacgcggcaaagtcgtcgaagagaagccgatcgaggaaaaatcggtgttgcacatcaaggacgcgctggattaccagggccgctcgttcctgcacgcgccgcaagatgtcggggtcaacctgcgctcggactcgccgcccgagaagtgcttcctgcccaagtcgcacatacacacctggtccgggcactccaagggcatcgcggccctcagatggttccccaggacggcgcatctattcctatcggcttccatggattgcaggattaagttgtgggaggtgtacaacgaacgcagatgcatcagaacctactacggccatcggcaagcggtgagggacataaatttcaacaactccggtaagcacttcctctccgccggttacgacagatacatcaagttgtgggacaccgaaacgggacaagttttgtcccgcttcacggcccgcaaaattccctactgcgtgaaattcaatccggacaaaaacaagcagcacctgttcgtggccgggacttccgacaaaaaaattatttgctgggacaccaggtcgggggatatcgtgcaggagtacgataggcatttgggagctgtcaatagtatcacttttgtcgacgagaataggaggttcgtgactacttcggacgataagagtttgagggtttgggagtgggacattcccgttgatatgaagtatatcgccgatcccaccatgcacagtatgccgtctgttacacctgcaccaaatggtaagtggctggcatgccaaagtatggacaacaaaatcgttatattctcagccttaaaccggtttaaaattaaccggaaaaaagtattcaccggacacatggttgccggttacgcctgcagtcttgacttctcaccggatatgtcgtatctagtttccggagatgccgacggtaaatgttacatttgggactggaaaaccacaaaactgtacaaaaaatggaaagcccacgataacgtttgtataagcaccttgtggcacccccatgaagctagcaaactattgactgctggatgggatggacttattaagtattgggattaa

SEQ ID NO: 1242 - DNA, 339 bp, Meligethes aeneus
gtgtttcctgatctcgtcagcgcggtcgttgaagttggtcttgatcgtctcgaccagcttgttgaggttagatctgtccccagagtccacctgcgtcagcgcgacggccgagcaagtcttacgtctcaccagcaatcccaagcgggctttgcctttcacgatgcagtacggtacccccatcttcctgcagagggcaggcaagaacaaaaccagctcaattgggtcgacatcgtgggcgatgaccaccaattgggcttttttctgctcaatcagctttgtgaccgtgttggtaccggcgcggagcacgtttggcttcttggctggcgcctcttctttctt

SEQ ID NO: 1243 - DNA, 990 bp, Meligethes aeneus
atggccacattaattaaagatgttaaattggaaaacgttcccacagaagtactcttcgataaacacaaagaattcctgcaaagttatgaaaaagacgaaaacaattatgaatacggtatgacggactatttacgaatatcggggatgtactggggccttacggcgctagaattgatgagtattaacactaaaaatcaaaaagtgatagactttatagtaaaatgtcaggaccctgagtctggaggtatcagtgggtgcatcgatcacgacccccatatgctacacacgttaagtgcggtgcaaatcttggttacaatggatgaagtaaatgccatagacgtagagggggttgtaaagtacgttgtgagtaaccaacaggaagacgggagttttacaggggataaatggggggaagttgatacacggttttcttttaccgctgtggcaacactggctttattaaatcgtttggatgccattgatgttaaaaaagctgttgagtttgtacagtcgtgtatgaattttgatggcggttttggctccaggcctttatcggagagtcatgcaggacttatttattgctgtttggggtttttgtccattacaaatagtcttcatattgttgaacaagacactctggcatggtggttatgtgagaggcagctttcatcgggtgggctaaatggcagaccagaaaaactcccagacgtatgttactcttggtgggtgttatcatctctatcaatcttgggaagaatacactggataaatcactctgcaatccaaaattacataaaagcatgtcaagatgttgaaactgggggcttttccgacagacctggaaatgtcactgatccttatcacacattatttggcctggcagggttaggtttattaggcgacgaaagaatcataaaagttaatcccacattttgtatgcctcaggctgttatagataagttaggattaaaaccacaaatattatcttaa

SEQ ID NO: 1244 - DNA, 2652 bp, Meligethes aeneus
atgcatcaagaaacactgcaactcatccaaattctagaaaagaccgtttcaccagacaaaaccgaattagagcaggcttcacattttctggagcaagcggcaacaactaacctattggaatttatcaggaccctctctgatatattaagacatgggggaaatagtcatgttgcccgaatggctgccggtttgcagctcaaaaaccaacttacatcaaaagatgccaccaacaaggttgtctatcagcagcgctggcttgctttccccgaagaagtgaggagttacatcaaaaagaatgtggtgggtgccctcggaaccgaaacaaatcgtccatcttcggcggcgcagtgcgtcgcgtacatcgccgtcgcggaacttccgcagaaacaatggccggatttaattcaaacgttggtcaacaacgtgtgccatgcaaattctaccgaaatgcagaaagaggccaccctcgaggccatcggctacatctgccaggaaatcgattcggacgtgctcgtgacgcaagcgaacgatattctcaccgctattatacacggtatgcgggtatccgagcagagtaaccacgtcagattggccgccacgcaggctctattaaattcgttggagttcacgaaaggcaactttgatcaacccactgaaagaaatttcattatggaggttgtgtgcgaagccacgcaatcgcccgattcgcagatcaaagttgccgccttgcagtgtctcgtcaagattatgtctctctactaccagtatatggagccttacatggcgcaggctctttttcccatcactctagaagcaatgaaatcggagaatgatgccgtttcgttgcaaggtatcgaattctggtcgaatgttagcgacgaagaggtcgatttggcgattgaggatacggaagccaccgaagccggtcgacctccttcgagagtatcaaggcactacgccaaaggcgccttgcagtttatcgtaccgattttgctgcagaagttaaccaagcaggaagaattggacgatgaggacgactggaaccccagcaaagccgcgggagtgtgtctcatgcttctggccacttgctgcgaggacgaaattgtaccgcacgtactgccgttcatcaaagagcacataaaatccgagaactggcgattccgggacgcctctttaatggcgttcggttctattctcggcggtctggagacaaccacgctaaaaccactcgtcgagcaggcaatgcccacgctaatcgaacttatgtacgacagcagcgtcatcgtgagagacacggctgcgtggacttttggaagaatatgcgagattatacccgaagccgccatacacgagacttttttgaaaccgctgctcgagagtttggtgacggggttaaaagcggagcctcgcgttgccgcgaatgtctgctgggccttttctggcttggccgaggccgcctacgaggcggccgagccgaacgaggagaccggaaatccggacacgtacgtgctgtcgcagtactttgatttcatcgtcgagaggctgctggagactacggacaggccggacggcgcgcacgccaacctcaggcccgccgcgtacgaggcgctcatggagatggtcaagaactcgcccaaggactgctacgtgaccgtccagaagaccaccatggtcattttggagcgcctgcagcaagtgcttctcatggacacgcacattacgagccactacgaccgttcgcaattcaacgacttgcagtcgctgctctgcggcaccctgcagtccgtgttgagaaaggtgacgccagaggacgcccccaggatatccgacgccatcatgaccgccatgctgaccatgttcagctccaattcgtgcgtgcaagaggacgccctcatggccgtctcgacgctcgtcgaagttctcggcgagaacttcctcaagtacatggacgcgttcaagccgtttctgtacatcggtctgcgaaaccaccaggagtaccaggtgtgcggtaccgcggtcggtctgaccggggacattttccgcgcgctgaaacacaaagctcttccgtactgcgacgagatcatggcgctcttgctggaaaacctgggcgaccagacggtgcaccgcaccgtcaagccgcagattttgtccgtcttcggggacatcggcctgagtatcggcgccgagttcaagaagtacctggagatcgtgctgtcgactttgtcgcaagcttcgcaggctcaagtcgacaggaacgattacgatatgatcgattatttgaacgagctgagggaaggcgttttggacgcttacactgggattttacagggcttgaagggcgacggggcgagccccaatccggaagtgaacatcctcgagccgcacataccgttcatagtgcagttcatcacggtggtggcgcaggaccaggagcactctgacggcaccgtcgcagtggcggcgggcatcgtcggcgacctgtgcgccgccttcggcgctcccatggtgcagctgttggatctcgagccgatcaacgagatgctggcgcaaggtcgcagaagccgcgtcaacagaacgaaaaccttggccacgtgggccaccaaggagctcaggaaactcaagtcgcagagcacagccgttgcggccagctga

SEQ ID NO: 1245 - DNA, 1503 bp, Meligethes aeneus
atggagactatattggaacagcaaaggcgataccatgaagaaaaagaaaggttaattgatgctatggtcaaagaaatgttgcacaagaaaaattcttacagagaaaccataaattcagatcaaaggcaaaaatatttgcttgatcgttatatgaatggaacggaaaagttgatagagttgtatgaagataaagatggtcaacgaaaagctgaagttgcagctttgactggacccaatgagtttaatgaattttataatcgtttaaaacagataaaggatttttacagaaagcatccaaatgagataagtgtaccaatgtcagttgagtttgatgaatttgctaaagctagagaaaatccctctgaagaaatgtccaacttggttgagtttactgatgaggaaggttatggaaaatttttggatttacatgaatgttatgagaaatttataaatcttaaaggaattgataaagtggactatattagttatttatccacatttgatcagctttatgaaattccaaaggaaagaaaatctggtgaatatagaaaatatctattaactttaattgaatacttgagctggtttgtgcaaagaataagacctttgatggacttggacaaagacttacaagaagaagccgacagtattataaatatttgggagagcggtactgttccaggatggccaaaagagactggttcagcattggcaaatgttggtgcacatttggatctttcagcattttcaagttgggaggaattggcttctttgggtctggatcgtttgaagtcggctttattggctttagggttaaaatgtggaggaaccttggaggagagggcacaaagattgttttcaacaaagggaaaaggttctttggatccatcattgatgactaaaaataataagggaaaagccaataaggaaaaagaacaactgagacatagggaccttgctatgttggaagctcagatttatagactggccgatttagtgtccactcaaaggggagcaacaaaagaaaatgttcaaaggaaacaagccagaactgacggagaaagaaacgacagtgaaaatgaggaaagtgaagaggatagtcccgatgaaggtgacgatgatgtcccatataaccccaaaaatttgccattggggtgggatggaaaacctattccttattggctgtataaattgcatggtttaaatatcagctacaactgcgaaatttgtggtaattttgtttataagggtcctaaagcttttcaacggcatttcgcggaatggagacatgctcatggtatgaggtgtcttggtattccaaacacggctcattttgccaatgttacgcaaattgaggatgctattgctttgtgggaaaaattgaaagtacagaagcaaaatgaacgctggcaaccagaaaccgaggaagaatatgaagattctcaaggaaacgtggtaaacagaaaaacatatgaagatcttaaaagacaaggattgctataa

SEQ ID NO: 1246 - DNA, 645 bp, Meligethes aeneus
aaaatgacgataggcaagaataacaagatgatccaacacataaactacagagtgagggtcactctgcaagactcgcgaacgttcataggaactttcaaagcgttcgacaagcacatgaacatgattctcggcgattgcgaggagttccgcaagataaaagcgaaaaactccaaagtggagcgggaggaaaaaagagttttaggttttgttttgctgagaggggaaagtatcgtctctctgacagtggaaggccccccacccccggaagaaggcctcccgcgcgtccccatacctggagcagccccagggcccggaattggcaaagcagccggccgtggtatgccagcgggcatggctggagtcccggtggggctccagggacccgtgaggggcgttggaggtccctctcagcaggtgatgacgcctggaggcagggggcaggtggcggcacctccacaaatgaatcagggacctccgagaatggggggaccacctccaggcatgatggggccccctcctggtatgatgggtatgcccccaaatatggggatggggcgtgggggacccccaccaccaatggggatgaggggacccccacctggtatgatgagagggggcccacctggacctccaagaccatactag

SEQ ID NO: 1247 - DNA, 1104 bp, Meligethes aeneus
atgcgtcttaaagatgaaaaaaaatttagaaattatcatagaatggccattgaagattttgataatttagtggaaaaagtttcaccttttttacgaaaaacatttatttcccgtgaaccaatatcgcctggggaaatgttgtctgttacacttagatatttggcatctggtgaaagtatgcgaagcatttcatatagctatagattaggactaagcactgtttctaatattattaaaagcacatgctctgctatttggaaagctttaagtgaagaatatttaccatatcccacagaacaaagttggaaaaaaattgctgttgattttgaatcaaagtggaattttcccaattgtgtgggtgcaattgatggaaaacatgtgagaatacaagcacctcaacattctggttcagatttttttaattataaagaattctttagcatgatattgctagcagtttgtgatgcaaattatcgatttactgtggttgacattggtgcaaaagggagacaaagtgatggaggagtttttcgcaacagtacttttggaaaacaatttttctcaaactccattaatttacctgctccaagaaaacttgcagatgatgaagaaccaactccatactgttttgtaggtgatgcagcatttccctttggagttaatttaatgcgaccataccctggaaactttcttccacagaatgaaagaattttcaattatagattaagtcgtgcaagaagaacaattgaaaatacatttggcattcttgttgccagatggagaatattagaaaaaccaattattgcaaagcttgaaactattgaaaaaatgataagtgcacttgtatgtctgcataactttttgaggaaatcagactcagataaggttgacagcaacaggtactgtccttctaattttgtggatagagaaacagaaacaggtgaacttatcgagggagaatggaggaatttagtgcataatgggttacctaatgctggaagaatgggtggaaatgcatattcccaaggagccagtgctatgcgcaattcattagctgattattttatccatgtggatccaattgcatcacaattgttaaaataa

SEQ ID NO: 1248 - DNA, 3786 bp, Meligethes aeneus
cagcaattaaatatgaaccaacaacagttgctgcaaaataagttgcaacaacaggcattgctacagcagcagcaacagcaacaagggaatcttgatggtaatggcagtaatgatccaaacttgatgcaaagagcacaattattgcatagacaaaacctggtaaggcagcaacagcagacacagcaacaagcgataggccaaccacagcctctaacaccgcaacagcatcaaaatatgttgcatcagcaaaagcttttgcagcaacagcaattggctcagatacaagctagacttcagcaacaacagcaggcgcaacaacagcagctaaataatccacctcagtcgccgttatcaatgcccccgaaaagtccaatgattaaccaacaaataatgtcacctcactctatgcctgcctcacctatgcctccacaaagtccaatgtccgtaagaagtccagctttttctcagagcgtcggacagccgcccagcagtcctatgagaagttcgcctatgccaagaagcccaatggtaaaccaaatccaatcaccgatgagtatgcgtagtccagcaatgccggaaagaccaactagcgtggagaatcctggaacaccaagaaccccttataacccccaaaacgtggagaacatgcaggaaaataacgtctccaacaccactacagatggtggcggcggtaacccgcgcaaccccgtaaatccaataccgtttccctttggaaggtttgggtcatttaagttgggtttgaggggtggatctccaatgtggggtggctttggccggggggctaaaagagtcccaacgccacctgtgacttctaccggcgtgggtgcttgcgtatctaaaccgattgctgcaacgaatgcgttggtagattcggcaacttcccaggtgccgcctaaaccaaagaaagaatcccattatagcaaagtatcgattcttaagaaaaaatctgcacccacaataaccaacaggcaatcttttgtggccaataaagtgagctcacttgttagttcagattataacgaattcgatgacagttcgtctactccaccagtaactcctccaccttcatcttcgaccagcaggaatgtcgttcagaaaacgatacataaaaaaattgccgaagaaaccaaagaaaaagcaaaagagagactaatgattttacaaagtcctgaacccaaacaaatccacgaaataatagattacgatgacgataacaatactgttctatcgggtgaagtttcgttgagttctgtggctcagcaaaacgatggtgacgatatcgaaatagaaaccctttcgcaaaacgatcttacagaagatctgtccagtcccttggaagcggatcagatcaccgacgagtatttactgtttcctggcaacatggtcgtggaagaagaagtcgatgactatgcaagcgaaaacatgcactttgtgatacgtagtcccaccacaagcgacgacgagtatataatgcagggtaaaaccaaaaaatacaatattgtatcttcagaacagttgatggcgataaatgatacgcccgaatcgccggaacaagaggaaatgaacgtggatccgtcaccggaaccgacggaagatgaagaaaacgaagtcgaagaatcgatctctacgaaggaggatttcgaggagctcatagatgaaggctctcgaaaggaaaaacttaaaaacgacggcaatgttaccgccaaacatattaacgagtttcataaatacgctgccaccaccgtttatagtttcccaccgaaagcctccggctcgcaacaaaccacggcccgtatcgcaaacataaacaaaatgccgcaaaaaatatccctgatcactccacttgtttccaaaaatgacgccgccaaagaactaataattgccccaaacgctaaaatagtcaaccacactcaaccgacttccaaagtgacgagtattattttaactccgcatccagtgcgcagtaacgtgcttacgccgaaaattgtgtcggctggcggtcaacctatcacaatagtgagtgcgaactccaagtccaaatttactgttcctatcatcagtgccagtgcagttagacaattaagcaacattaaagtgatcgataaatccatttcgttgaccacacacgacagttctttgccaaagaagattttcgaggacgattcagtttcaccagacagttccaattgcgaagaagacgcaaaatctaaagactattccgatgaaaaattaaaggattcaccgattaccgacgaaacaaaatcacaggtgtttgcgaaaaatgagtcatttaaaattataaaaacagtaaaatctgataatatggtggtgttaaacaaacaaccagaaaacgttaaaattgagaaaaaggaacaaaataaaccaaaggttttggagaaaaaggaacttcatccaatacatacaattgaaaacgtgaaaataactaacataataactaaacagaggattccaagtccaataattgcaaaatcgtcttctccagtcatcattcgtagcactcccgaattaaaaatgaccgctcaagtgtttcaggagacttcgcaaaatagaattcaaatatcaactgatacagattgcaattccaccgacgatactaaatcagtggttatttcaataccgtctccaacgccatctcaagagcaaatgttggacgatatcgctatgcgagcgtacgaaactcgaagacacggaacagcaattcctggtacgttcgactcctttgaagacgttttggatatgtttgaaaatataactgccgaacctggtacaattctggacgaaaaagaaaaagttaaacaatccaatgagactttcgactctgcaaagaaggccgagccggaaaagaaacacaccgcaaacaatgccacgatatcgaaaccggcaatgactcaaatgccagtgacagtaaccacaacatccaccaagtcttcggttgttccacaattatcacctctttcgcaaccgaccgaattgactacaaacatggcaactgcatcccaacaactaagaaacttgctgtccctgcagacgacaacgggttcttcgcccaccaacgtggaaacgttggtaaaaacacagcaaaagaacgtggtgactactgcaagcaccctaggagttctaccacaacaacctgctgtaaccgtaactagtgtaggcactgttgtatcaagtataaagcagttgcctgtaagtacaaaaaccaacacggtaaaaacacaatttactacaaacgtagtctcttcctctactacgccaacatttaccacacaccgtaacgtaggaggcatacaattgatgcctgatcactcgaaacttccacctgtcactcaacaacaaccgagcacttccgttgtcacaacaccgcattcgaatacagtagtggttcatagagctcctcttgtaaacaccacaccaacgaccactccgaacggcgaacaaaggaaaccttcgttgactttgacagccatgctacagaatcagccggccgctactccaactacaaaaaccacaccggattctatcacggcagccagtcttttggccactccagtatccatttccaggggatttaatacagcattagttcaggctcaaccaaatgtgtcggtttcgtccattgtagcaacaaccaacaacgttacttcggagtccgttactgcttttagatcggttacaaccaccactaacctcttacacactcaacttactaaggtgcgaaacaagtcggtcgaagaaccgaaagag

SEQ ID NO: 1249 - DNA, 2097 bp, Ceutorhynchus assimilis
atgcctagagacagtatcagacaccgataccgttatgacgaccacagttcaagctccagacaccgtcggaaatccagatcttcaagtgaagaatttcgaaaatccaccaaaaagtctggcaaaagtggctcggaaagacgccgatctacctcttcaaaacgatcaaaaagtaaccacaaccgtagaaaatctcctcacaaatccaaaaaacatgattccgacagtgattcttctagtagcagtgactctagtgactcaaataaatccataaaattactcaagaaactcgaaaagaagcgtttgcaggaaatcgaagagaggcgcaaacaaaaggagctaatgaaagctacagaaactgcagaagaaaaacgtttaagacgcctaaagaaaaaagaagaaaaagagaggaaacgcaaagaaagaatgggctgggacaatgaatatctccactacacaaacagcgataatccgtttggagatggtaacttactaagcacatttgtttggaacaaaaaactagcaaaagaaggtttaacaaatgcatcccgtgcagaacttgaagccagaaatagatttaagcaagacgaaagcaaaagagaactagaaaaagtaaaaaaaagacgtctggaaagggaattagaaaaacagcgccgagatgacgacaatcaattacttcaaagaagcaaggaggcagcacagtttgaggaatgggagagacaagaggataatttccatttagaacaagcaaggttgagaagccacataagaattcaggatggtagagccaagcctattgatctactagcaaagtatatcagtgcagaagaagaagtagatgctgtagaaatgcacgaaccttacacttatcttaatggactgcaaataaaagatttagaagatcttgtagaagatatcaaagtatataaagagttagagaggggcaagaatttagactactggaacgatattactgtaattgtagaagatgagcttcaaaaattaagaaaactgcaaagagaacaagattttgatgctggaattggtagacgcgaaggcataaatcaagcagtagcccaagacgttacagcagtattcaaaggcaaaacagccatacaacttgaggatcttcaaaagcaaattgaaagcaaaatcagtggcaaatctgatggtattgacataggctattgggagtcgcttttgtctcaattgaaagctcacatggctagagccagacttagagacagacatcaacttagtttgaagagaaaacttcaagtattaaaagctgaacaagctgtaactgtgcctgaaataaatgctgaaaatagtaatcagtcttcacaaagtccacaagaatccaaaccaggaacttcacaagaatcagcagacaatgaaagtcaaagcgatgaggaaggtgaaaataatgaagaagcagccagtgatatactcaatgaatgctttgttgcttaccaaaatggcaactacagtcctaaactattaaattctgagcaaattgagcctggcaccatagtggtttcagaagaagatgatataaaacgtttagaatttgccagattgcaagtgacaaataaaggcaagaaagtggaaaatgttatcacaaaagaggagcttttacttcagaaagaagctcgaagtggcatgggtgaagatgaagcccaattcagtgtggaacaagcattggatagtcaagtttatttatggtctgataaatatagaccgaggaaaccaagatacttcaacagagtccatacagggtttgaatggaacaaatataatcaaactcattatgacatggataatcctccacccaaaatagtccaagggtataagtttaatatattttatccagatttaattgataagaattgcactcctgaatatttcctcactccttgtccagaaaacagagaatttgctatacttagattccatgcaggacctccatatgaagatatagccttcaaaattgttaatagagagtgggagtattcatataaaagaggatttaggtgtcagtttcacaataatatttttcaattgtggttacatttcaagaggtatagttctaggagatga

SEQ ID NO: 1250 - DNA, 1251 bp, Ceutorhynchus assimilis
atggacaatttagaagctaacataatggataagtccatgcgatctgtctttgtgggaaacattccatacgaggccacagaggaaaaactaaaggatatattcggggaagtgggtcaagtattgtctttcaaactcgtctatgatcgtgaaaccgggaaaccaaaaggttatggattctgtgaataccgtgaccaagaaaccgccctgagcgcaatgagaaatctaaatagctacgaaatcggaggtcgtaacttgcgagtggacaatgcttgtactgaaaaatctcgaatggaaatgcaaaatttactcaaccaaccacccatagagaatccctatggagaaccggttcaatcagaaaaagctcctgaggctatcagtaaagcagttgcctctttgccaccagaacaaatgtttgaattgatgaagcaaatgaaagaaactattcaaaacaatcccactgaagctagacaaatgttattgcaaaatccacaatttgcttatgctttgcttcaagcacaagtagttatgaaaatcatcgatggttatacagctgcatcacttcttcatcctgtaaatcaagttccagcaacgcttatgcctggagacaaaaacgttcctgttcaagtgcctataaatagagagtttcaagctgctccagctccagttgctccacccaggcaagagtttcaacctgttccagctccaattattattccaaacaccaatcatagtgcaccagtgtttactagtatgaatgatgttgatttcagagctatggatccaagagtaccaactgttgaccctagattgaaccgcatggctgatcaggatctgaggatgccgcccgcagtgcaaatttcaaatcctttgccaccagtcgagagcttttcttcagcagcatctacagaacctaacgctagctttcctagggatccaagagaagttagaaacggccctggtgccttttccaatgatcctcgacagttgggaagagttgatcctaggcaaaaagctgctgctgcaccagttccagtctctcaaccccccagaccgtcacaagcagctgcagcagcttctatggcttcagtaaatggagcaatgccacctggtgcttctgatcaagaaaaggctgctcttataatgcaagtcttgcaattgtctgatgaacaaatcgccatgctgcctccagagcaaaggaatagtattttggtattgaaggagcagatagctaagagtgctcagggacgttga

SEQ ID NO: 1251 - DNA, 1179 bp, Ceutorhynchus assimilis
atgactgcaatggagccggaacgtgagaaagtcctgcaggactaccgaaaaaaactaatggaacacaaagaagtcgagtctcgactgaaagaaatgcgagagcaattgaaagacctcacaaaacagtacgacaaatcggaaaatgacctgaaagccttgcagagcatgggccagattgtcggtgaagtcctaaagcagctcactgaagaaaagtttattgtcaaagccacaaacggtccacgttatgttgtaggatgccgcaggcaactagataagctaaaattaaaagctggtactcgtgtagccttagatatgacaactctaaccataatgaggtatttgccaagagaagtcgatcctttagtttacaatatgagccacgaagaccctggcgatgtcacttattcggctattggtggtctttctgagcaaattcgggaattacgtgaagtaattgaattgcctctaatgaatcctgaattgtttatgagagtaggcattaccccacctaaaggttgtcttttatatgggcctcctggtactggtaagactttactagctagagctgtcgcctctcagttggatgcaaactttttaaaagtagtctccagcgctattgttgacaagtacattggagagtcggcaagattaatcagagaaatgttcaattatgccaaagaccatcagccttgtataattttcatggacgaaatcgatgctattggtggacgaagattttcagaaggtacttctgctgatcgtgaaattcagcgtaccctaatggaactgctaaaccaaatggatggattcgactctctgggacaagttaaaatgattatggcaactaaccgtcccgatactttagatccagctctattgaggcctggtcgtttggacaggaaaattgaaattcctttgcccaacgaacaagccaggcttgaaattttaaaaatccatgcagggcccattgctaagcatggagagattgattatgaggcaattgtaaagctttcagataattttaatggggctgatttgaggaacgtttgcactgaagctggtctctttgctatcagatctgaacgggagtatgttattcaagaggatttcatgaaggcagtgaggaaagtggctgataacaagaaattggagagcaaattggattataaaccaatataa

SEQ ID NO: 1252 - DNA, 780 bp, Ceutorhynchus assimilis
atggctcgccgatatgatacaagaactactattttctcccctgaaggccgactgtaccaggtcgaatacgctatggaagccatttccttggccggtacctgcttgggaatattagccaacgatggcattttattggctgcagaaaggcgtaataccaataagcttttggatgaagttttcacttcagagaagatttataagctaaacgaagatatggtctgtagtgtagctggtataacttcagacgccaatgtcttaaccaatgagctgcgcctcattggccaaagatatctgttccaatacggacagtcaatcccttgtgaacaattagtttcttggctgtgcgacgtcaaacaagcttacacccaatatggtggcaagaggccttttggagtatcaattttgtacatgggctgggacaaacattatggctaccaattgtaccaatctgaccctagtggcaactacagcggttggaaggccacttgcattggcaacaatagttctgcagcaatttccagtctcaagcaggaatacaaagaaggcggcatgacattaaaagatgccaaaactttggccatcaaagttttgagtaaaactttggacatgaccaagctgacatcggagaaagttgaaatggccactttgaccaggagcaacgataaaacagtcactagtattctgactggcaaagaagttgaagcattgattaaggagtatgaaacaactgaggccagcaatgaggcaatgaagagggaacaatcaaaagctgctgcttaa

SEQ ID NO: 1253 - DNA, 2670 bp, Ceutorhynchus assimilis
atgtcgcaaaccacagctgaaattcccaccaaagtgaaaaccaagaaagatgcggaggaagataaaaacgaattgtctgaggaagacaagcaacttcaggatgagctaaatctttgtgtggaaagattaacagaaaatgatgaaaatctatatttatccgctcttaatgttctctcaatgaaaattaaagcttccacaacttctatgacttcggtgccaaaaccattgaagtttatgaaaccccattatgataccatgaagcaagtttatgataaaatcaaaaacccagaagtccaaagggtgtgcgctgatattatttcagttttggccatgactttgggagacgggcgtgaatgtttgaaatatagacttttgtcagatttggataagattggagaatggggtcatgaatatgtcaggcatctttctggtgaaattgctgctgaatggggagaaaaagatgaagacgacaaagacatggaagcaaaagtcattcagttggccaaacaaattgttccttacaatatggctcacaatgcagaagctgaagcttgcgacttgctcatggaaatagaaagacttgatctcttggaaagatatgtggatgaaaatatttacaccagagtttgcttatatcttacaagttgtgtggagtatgttgctgatccagaaaacacgactcttttgcaaactgctctaatgctatttaaaaagtttggccagtatcctcaagctctacgtttgggaatgaagttgaatgaacaaaaacttattgaagaaatatttttgtcctgtccagataccattgtccaaaaacaactggcctttatgttaggtcgtcaacaaatctacatagaagtccctgaaaccactccagaatatgaagatctaacagaaataatggccaattgtcatttgaataatcatttcttaaacttggcaagagaattagatatcatggaaccaaaaacccctgaagatgtttacaaatctcatttggaaaataccagaccttcttttggaggtagtcaagtagattccgcaaaacaaaatcttgctgctagttttgtcaatggtttcgtaaatgctgcttttggccaagacaaacttctcatggaagatggtaataagtggctctacaaaaacaaagatcatggcatgttgagtgcaacagcttcacttggattagtacttttatgggatgttgatgggggtttgactccaattgacaagtacttatactcttcagaagatcatattaaatctggagcacttctagcatgtggtatagtcaactgtggtgtcagaaatgaatgtgaccctgctcttgccttattaagtgactatgttatgcatagcgctccgatcataagaattggtgcaatattaggtctgggattagcgtatgtgggctctaacagggaagcagtactcggcctactgtacccagtattttccgataaaagttctaatatggaagttattggaatggctgctttggcttgtggaatgatttcagttggttctgaaaattcccaagtaactacgatcctcatgcagacattgatggacagatctgaagatgacttgaaggatacttatgctagatttatacctttgggagttggcttatgtcatttggggaaacaagatagtgttgatgcaattgttgctgctttggcagttcttcctgaaccatttggatctatggcaacaactatggtggatatttgtgcctatgcgggtacaggaaacgtactaaaagtccaacaattgctccacatctgttctgaacactatgatactgatacatctgaaaaagacaaaaaagacaaagataaggataaaaaagaaaaatcagaagataaggaaaaagatcattcagcaaggcaagctattgctgtccttggcattgcccttataagtatgggagaggatattggcagtgaaatggcttttagaacctttggaaatctattaagatattgtgagcctgttattagaagggccgtacctttagctttaggtcttatctctgtctcaaacccaaaattgagtattctggatactttaagtaaattttcccatgacagtgactcagaagttgctcataatgctatatttgcaatgggcttagtgggcgctggcactaacaatgcaagattagctgctatgctacgtcaactagcacaatatcatgctaaagatcccaataatcttttcatggtcaggattgcacaagggttaactcatttaggaaaaggaactttgacgctttgcccttatcatagtgacaggcagctaatgagtcctgtagcagttgctggcctaatggctactttagttggttttctagatgttaaaaacattatcctgggaaaatcacactatttactgtacacattagcagcggccatgcagcctagaatgttggtcacctttgatgaagatctcaatccattacctgtacccgttcgtgttggtttggctgtggatgtggtagggcaagctggcaaaccgaaaacgataactggtttccaaactcacacaacgccagtactattagcacacggagaaagagccgagctggcaacagaagaatacctttcgcttacacccataatggaaggatttgtgatactgaggaaaaatcctgactttagtccataa

SEQ ID NO: 1254 - DNA, 1530 bp, Ceutorhynchus assimilis
atggctgacgatggaagagagaaaaatccagcttctggtgccagcgaagaaaacgacattgaagaaggcacttatttaatgaaaatggaaccgaaagaagagccccaagcttctccgcaagacgttcagcctcccaaagaaagcgaacaagatgctgcagaagtaaaattagaaaaacaagaagaaaataacattaaagatgaggcgaaagtgttggaagaaccgccaataacggaagtgattgttgaaagtcaaccgaatattactcctccgccttcagtgattaaaaaaaatgttctcaccacggcaggtaaaatagaaagtgcagaccatcttgaagcccacaacgaagaactcgtggaagcccaagaaagctctgatacagaagacaaacacagagtgccgcaagaagtggtaccttacgaaataatcagtcaagattcctctacgcattcggagcaccagtttactgttaccagcaaaagtttcaacgcaggaaacttccagcagcacctgcaccaacaccatccacatcagcaccatcagccggaaattttcacattgcaaataaccaattccgaaggtactaccgtgccggtcaccattgaaagtaccatagacacttcggctgattacgctaatcttgaaactgcacagtactcgaataacggacagtatccaccggatggttctcagtatttgcagcaacatcagtacagtaccatgcagtatcagttggaacggaatagcggggaaagtcctccgattttgaataataatgtgttagtgaggaataatgatcccactttggcgtcttccagatatcatcaggatctccggttttcagcaagcaactacgaacaacaattaaaccaaatcaccctgacagcaccccaaacgggccaaacgtaccaaatcagtccagcgagcgctggatcagattcctggtcgacgtccagtaccgccacaacgcagtaccagcaaacctatcaaggtgctgccaacgtgagcgtccaccaagctgacagcagtacagctcatcagtactacttgaacagcaactggccagcgggcgctttggaggatggaggcaacaacgtttcggcgcagaggtcgccgtcctcagaggctaacaatagaaggaatggggtggcatgtgccaactgtaaaactttgaacaccactctatggagaaggaacaaccaaggagaacctgtttgcaatgcttgcgggctttatttcaaattgcatggggtaaatcggccaataagtatgaaaaaagaaggaatccagactaggaagagacgaccgaaaaacaattcttctgttcataatggagctggagtttctggcatgcctcaacgattaagcaacacccaagccatctactaccaaaacatctcccaagaccaagaaatcccgatcgaccagtaccaattgccgcacaccgccgtgtaccaaacccagtaccacagaccgccgcaaattcaaaacgccgctgaccatttgggcagacaaatggcaaagtaa

SEQ ID NO: 1255 - DNA, 4983 bp, Ceutorhynchus assimilis
atggcactgcccagcaatgggattttcgtcgtcaaaggagagatgaccatcctgatgactgccatcaaaagaggaattcgttggccatcgcattcagacgaagacaccgacaatttattgaaaaacatccaagatttgaaagatctcctgatgaaaatcgatgatctaagactcgtagaacccgacgtcttcctggctccgtttctcgaagttatcagaagcgaagacaccagcggaccagtcacaagcttagccctggcagcagtcaacaaattcctatcttacggcctaatcgatcctacacaccctagtgttcctaatacagtttacaacattgcggacgcagtcactcatgccagatttgtcggaaccgatcaatcttcagatggagtagttctgatgagaatacttcaagttctgagaacattgaccttagctccagaaggagccatgctcacaaatgagagcctatgcgaaataatgctgagttgtttcaggatatgttttgaagctcgcattcatgagctcctaaaaaaaaccgccgaacaatatttaaaggatatggtacagctggtgtttatgcgtttgcctcaattttcagatgacctcaggtctagcgtgaagcaattgaaaatgagagcgggcatggaacatagcagaaccaaaaaacggagcaggcattcgtttaggaaaaaaagtgctgaggttatcgaagagaaatccaaagaagctccaacaaatgtagttgatatgcaaggccaaattttacaaatagatgagagtcctactacaacagttatcgaggataatattgatgctgaggaaaaagaaggttcattggaaaataatagtgaaccaattattcaaaaaccaccatctagcgaggtattagatacaaatgaaacttcaaaagattatgtgaatcaaagaggcatacggtttactccacaacttcaagatgatttagtcttgttaccttatggccttgcttgcgtcagagaactattcagatttctaataagtttatgtaacccaaacgacaaacaaaacaccgaagtcatgattcatttaggtttaactctattaactgtagcttttgaagtgggtgctgacagtataggaaaacacgccaccttattggctttagtcaaagatgatttggctcgcaacttattttcattattgacaaacgaaagaatttcgatatttgctgctgacttgcaagtgtcttttctaatgtttgaatcactcagaatccacttgaaatttcaaatggaaaaatacttaacaaaactaattgatattattgtaagcgataatcaaaaaattaacaattacgagcataaagaagttgctttagataacatattacaattatggagaatacctggttttgtaaatgaactttatcttaattacgattgcgacatgtactgtactaatttatatgaggatttaactaaattgctggctaaaaatgctactaatggaatttggcacacacacctaatgtctttggatgctttattaactgtcattgaaggcatagaaatgcattgttttgaatctaaaacaaaaaacataataggcaaaactataagacaaaattacagtgacaatttgcctgcactagatgatctattggccagaaaaaatattaaaaagtggctacctcaaggtaccgagcacttcaacacaaaacccaaaaaaggtattcaatttttccaagaacatggtgttctcaaacctgaattagacccacatgaagttgcaatgtttctacgagaaaatccagctttagacaaaaaaatgattggcgaatacataagcaacagaagcaacctaaacatccttgaagcctttgtaaaaacctttaatttcaacggagtaagaattgatgaagccttgagaagctttctagaatcgtttagattaccaggcgaagccccaactatttcattaatcctggaacaatttgctgagcattggcaccaaagcaacaatgaaccatttgctgacgtagactcagcatttactctggcttatgctgtaattatgctcaatgtggatcaacataatcagaatgccaaaaaacaatcaaatccaatgtcggattctgcattcaaaaaaaacctgcaaggagttaatggtggagacaattttgaagaatcaatgttgaatgaaatttatcatgccattaagggagatgaaattgtaatgccttcggaacatggtggcttgattcgtgagaattatttgtggaaggttttgttgaggaaaggggcttcaaataaaggagattattttcatatacctccaggtacttatgattctgagctatttcgtttaatttacgatccgattgtgtctgcattgtgcttcatttacgaacatacagaagaggattcggtgtacaaacacgttgtgagcggatttgaaaagtgcgccttggtagccgcccattttggtatgacagcgaatttggatactttgattttgtctttgtgcaagttcaccgttttttataatcagaggagacagaataatattatgatattattcggttcgaatagaaaagctcaactagccctaaaaacagtattcagtttggtgcatctaaacggcgacaatataagacaaggctggaaatatatattcgatctaatcctagccttatacagcaacaacttactaccaaaatcctacattgaaccggaagattttataaatcaaagcggccatatagtcctagtctatgaagaaactgaaaatttacaaaaacaagaatcaggtttatttagttctatctactcctacatggtttcggcagaaaacttgtctaaaatcccttcacctgaagagcaacaatttatggatttggccaaagaatgcatcaaagactgcaatttggatcaactaataacagactcaaaattcctgcatgaagaggctttagtggagttagtaaaatgtcttatagagctatcaagaggcccagatgttcaaaaaagcttaggatacaattacaatgaaaatgttactgtgtttttcatggaactattatttaaaattgttattcaaaacagggatcgtgtgataacaatatggcaaccagtatgtgatcacatttacactttagtaatgaacgcttcagttttcgactaccaattccttctagaacgctctgttattggcctattgagaatagccataagattaatgcgaaatgaagaaatgtgccccatagtcatacaatctctaagaatgttgttgctattaaaaagtaccactctatgtagaatctccaaacaaatttcctacgggctttacgagctactaaaaacttcagctcaaaatattcacaccacaacagattggactataattttcactttattagagtgcgtaggggcaggcgctcagcctccaaaacctgtagcagacgatggcagcacttgcgcagaccaatcaaagtcagatggcgaaaatcaaataaacagcgacgaagaaagtgtagtatcagacagaggctacacctcagattctgaactaacaaaaaaacaaaaagcaattctggcaacttctccctgtggcactccaaacacaggaggctggattttggtgggcaacgaaggcgaaattgttggtcgaacagtgcctccgacacaatacggcattgctttggaaagaaatttaggcccacacgattcaatgagtttgataaaatgctgcgaaagcttggcatttttagttagagacgtggcccacataacaccgtacaatttcgacatttgcgtacaatgtataaggacttttgttgaggcaagcctacaaactgacaacaaaaaacgcaaaagaaaagtcgcctctcgtaggaaatccgaattaagaagtcctgcggctagtagtccaagctgtagtgaagatgacgattttcctagtggttatcatcacttgcttttagacttgatgcatacgttgcacacgaggactgcccaaattttcaaatggtgggcggaggaaggcggcgaaatcgctcaagaaatgtcactgtggactcaaggttggtgccccttattacaaggcattgccaggatgtgctgcgatcgccgtgaagaagtccggatcagtgcgattgctttcttgcagagggcgttgttggtgcacgatttgcaaactttgaacggtttggagtgggaacaatgttttcatcgggtgttgtttccgttactcaattacttgttgcaaccgagcggttctaagggacccattgcgatggctgagttcaggaatagggctgccactgtattatctaaggtattcttacatcatttaacacccctactatctctgccaacattccccaatctttggacaaacattctggactacatggacaggtacatgcacgctgacaaaagcgacatcttatccgaagcgattcctgaactcttgaaaaacatgctgctggtaatgaactcggccaaagtattcgacaatgccgaaggcaaaaatcaactgtggcaccacacttgggagaaaatcggacggtttttacccaatctcaaagaggaactattcaaggaacctgtaaaactcaaacctattatacaagatgagatggtttcaacaccaattggttctacacaaacaccttctacatctatactacaacctactctacaacctggaatgccttatatgcctaatttattaactagtgcaaatcagcaacaaggtcaacaacacgcatttccagttttatataacagtcccacagttataccaagtaccaccacaaccgaaattcaaccattatcattgtatgccgaatttttaggaaatccttataatttggacaagaatttagaagccgtagacaatgctgaatcaaactttttccagtcttcaaactatttcaacaatacaattatgccagccggaagtgaaattttgtttggcatggataaagattgtaataat

SEQ ID NO: 1256 - DNA, 618 bp, Ceutorhynchus assimilis
atgtcgatcctagcatataacggaggcgctatggtagcaatgaaaggagaaaattgcgtcgctatagctgccgatagaagattcggtatccaagctcaaaccctagcaacaaatttcgaaaaagtcttcgaaatggggccccatctctacgtcggtctgcccggcttagccaccgatacccaaacagtcagagaaaaactgcggttcagaaaaaacttgtacgaactcaaagaaaacaggctgatgtcgcccaaagtattcagcgctatgctgtctcatatgctgtacgaaaaacgctttgggccgttctttgtagaacctgtagtagctggtttagacccgaaaacctacgagccatttatttgcaatatggatcttattggttgcatcaatcagcctaaagattttgttgtaggaggtaccgcttctgcacaattgtacggtatgtgcgaggctttgtgggaacccaatctagggcctgaggatttattcgagactatttcgcaagctttgattaatgcttttgatagggatgctgtttctggttggggtgcaactgtatacataattgaaaaggataaagtcaccatcaagaacttgaagacccgaatggattaa

SEQ ID NO: 1257 - DNA, 2811 bp, Ceutorhynchus assimilis
atggaggaaaaacctaacctagacattgtaattttggccgtgtccactttgtacaagaacccggagagaacagaaaaggaaagggcttcggaatggctgttgaacttacaaaaatcggtccatgcatggtcaatagcagacgaattgttacacaaaaaaccagacttggaatcttgctactttgcagcccaaacaatgagaacaaaaatccaccaatccttccacgaattgccagtagaagttcacgcagcattgagagattctcttttagagcatattagtcaaattaatgaaggaactaataccgtaataaccacccagctatgcctcgctctatcagatttgatattgcaaatgccctcttggccttgtgcttctttagatttaattaatcgtttttctaatcactcttacatgtggcctttggtggagattttgactgttttgcctgaagaattggagggtagatctgtaagattgggcgaaaatcgcagactagaagtactagaagacttaaaacaatgcgcaccaacagtactagaattcctaaagcattgctgtcacacttacggtaccaacgtaaacgaaaacacccatattgtagccagaatgttgcgctgtttcaactcctggatttccgtaggcgcaataactttgcacggtctttcggacaatatcgttttgaatttggcttttgacattttggactttaggcctcacgatggaaaagaatcttctggggcattatgtgacgcggccaccgaatgcatttgcacattgcttcagtgtttagaggacaataacaatcagcaagacttggaaaattaccttttcacaaacatattaaaactagaagtgtcttatcacatttcggttgccaatgaagatcaaagtaaatctatagattattgtagattgtttactgaattggctgagtcgtttttggaaaaaatcgtctcgaatagtacggcatcgaatttgcattacgctatcaaagttttagatatggttttaatgtgcgtagggcatcatgattatgaagttgctgaaataacttttaacttgtggtacgtcctcagtgaggaattgtatcagaaaaataataaggaattaactgagctgtttaggccttatgttgaaaggctgataactgctttgtgtaggcattgccaaatggaacctgatggagatggtattttagatgaaggtgacgaatttaaagatttcagaaagaaatcttcagacttgataaaagatgtggtttttattgtgggcagctgtagctgtttcagacaaatgtttttaaatttacagactcctaatgttacttgggatcaaactgaagctgctttattcgtaatgcaggctgttgccaaaaatgtcttaccatccgaaaacgaagtggtaccaaaagtggtcgaggccatcttgaccatgcctcaaaccacccatttagcggtacgtcacacttcggtactcctattgggcgaactatgcgaatggatccaaaaacactctcacgttttggatccggtactcaactttctcgtatccagtctttcagcacgaggattaggagccgcagctgcttcagcactacaaaacatatgcattgcttgtaataagtgcatttccaggcatatgccgattttgttacaattgctacaccaagttgatagtttctctattacaaataatgccattattggtttgttaaaaggtgttgcctcaattgtatcagtgatgccccattcagaaataacagttgtgttgcgtgaattatgttttatgcaattgactcctttggtacaagttatggaacaaaccactctccctgtaaaaggtaccacaaatgatccaattttgtggctggacaggctcagtgctattttaaggcatgttattattgtgggggttaatgaaaatgaggtccatccgtgcaaacctgtagtactggaaatatggcccattttattgaaagctacagataagtaccaaaaggatactagaaccatggaaaggtgttgtaggagtattaggtttatgcttagatgtgctagtcaacaagtatgtgaaatattggaaagtttagttagacaaataataaggctttataacgagcacaaacattcttgcctgctctatgttggcagtattctagtggacgaatatgctccaaattcccaatgtgtgaacgggcttttagatatgttacaggtatttattgaacccacatttcacatgttgcaacaagaagacggtcttcgaaatcatccggatactgttgatgactttttcagattgtgtgctcgtttcatccaacgagctccagttccactactccgttgcaacgtcttggttcccataatccagtgtgcaatgttagctgcctcgttggaccataaagaggccaacatgtccgtaatgaagttttttaacgacctcattaaccaaggtttgactggacattctttgcccgattttgccgagagacaccagctggtcaaagcgattttggaccaattaggacagcaattggttaacgctttagtgcaggcttgcgtgttttatttgcacacttatatgctaagcgaagttggagatgtttttgtgcaattgctggatttcaatagggagaatacgagtaaatggatagcgggggctttggataatcttcctaagcaaagcaatggaggcttgatgactgcaactcctgagcaattaaatgaaattcatattaatttaattaggtcaagtacttcaaaatccgtaacgcactctttgaaagacctaacacgactgtaccgatag

SEQ ID NO: 1258 - DNA, 1347 bp, Ceutorhynchus assimilis
atgaatactagtggcggtaccatgatccaaagaccttcaggagctcaatattcgccaatgagaggccagatgcaaagtcaacctggagggaaacgaccatctgataaccgtaattctatgcaacaaaaaagtgactatggtcacataaccagtaaaaagaaaaagaaactagctgacaaaattctcccacaaaaagttcgagacttggttcctgagagtcaagcatacatggacttactagcttttgaacgaaaacttgacgccacaataatgcgtaaacgtctagacatacaagaagctttgaaaaggcccatgaaacaaaaacgcaaattaaggatatttatttccaacacgttttatcctgccaaagaaccctgtcctgatggaccagacgggcctggagcagaaggactggttgcttcttgggaactaagagttgagggaaggctactggatgattcaaaaaatgacccgaataaagtaaaaaggaaattttcgtcattcttcaaatcattggtcattgaattggataaggagctctacggccctgataaccatttagttgaatggcaccgaacacttacaacacaagaaacagatggtttccaggtcaagaggccaggtgataaaaatgtccgatgtacgatacttctgcttttggattaccagcctttgcagtttaaactcgatcctaggcttgccaggctacttggagtacatacgcaaacccggccagttattatttctgctttgtggcagtatatcaaaacccacaagttgcaggatactcacgagcgggaatatatcatttgcgacaaatatttggaacagatttttaattgttccaaaatgaaattcgctgaaattccacaaagattaaatcctttattacatccaccggatccaattgtaataaatcacgtaatttcagtggagggaggagccgaaagtaagcaaactgcttgttatgatattgatgtggaagttgatgatacattaaaaacgcaaatgaataatttcttgttgagcactgcgagtcagcaagaaattcaaggattagattcgaaaattcatgaaactgttgacacaatcaatcagttgaaaacaaatagagaattcttcttgagttttgctaaggatccgcaacaatttattcataagtggatcgtttcgcaaactagagacctaaaaactatgacggatgttgttggaaatcctgaagaagaaagaagatctgatttctttcatcaaccttgggcacaagaagcagtttgtcgctatttttacactaaagttcagcagaaatgtgctgaattggagcaagccttagctattcgtaataattaa

SEQ ID NO: 1259 - DNA, 882 bp, Ceutorhynchus assimilis
atgccatcggccaccatcagtacactacaacttcccaacaatgaggattgtggtatcagagatgtttgggctcataatctggaagatgaattccgaactattagacagattgtccagaagtaccattacgtggctatggacactgagtttcctggtgtagtggctcgtcccataggagaatttcgtagttcagctgattatcagtaccaaatgttgcgttgtaacgttgacttattacgcatcattcagttgggactgacattcttggacgataatggaaaaacgcctgggggcagttatactacatggcaattcaatttcaagttcaacttgcaggaagatatgtatgcccaagacagtatcgacctgctcacaaattccggtatacagttcaagaagcatgaagatgatggtattcaacctttggaatttgcagaactccttatgtcatctggcattgtactaatggacaatattaaatggctgagctttcactctggatatgatttcggatacctgatcaaactcctaacagatagtaacctaccccctgacgagaatgactttttcgatttgctgaaactgtattttcccgcgatttatgatgttaaatacctaatgaaatcatgcaaaacacttaaaggtggccttcaagaagtggcggaacaattagaactagaaagagtgggaccccaacatcaggctggttcagactcgcttttaactggaatggcctttttcaaaatgaaagaaatgttctttgaagatactattgacgactcaaaattttctggacatctatatggcttgggcacctcttttgctgtcaatggatcgaataattacggacaggataatggagaaaacacaaactctacataa

SEQ ID NO: 1260 - DNA, 1206 bp, Ceutorhynchus assimilis
atggcagcgaaaactcaaaatgccccctttgaggacctctcgaacgttgagttcgaaaccagtgaagatgtcgaagttattgatacattctccagtatgcacctcaaagaggaacttacaaggggaatctatgcatatggttttgaaaagccttcagcaatccaacagagagccatcaaacccatcatgaaaggcagagacgtaatcgcacaagcccaatccggaactggtaaaacggccacattctccatttcgattctgcagtctatagatttaaccatgcgggaaacgcaagtactttgcctgtcgcccacaagagaattggctgtacaaattcaaaaagtcattctggctctcggcgattttatgaacgtgcagtgccatgcttgtatcggtggtactaatcttggtgaagatatcaggaaattggattatggacaacatgttgttagtgggactccaggaagagtctatgatatgattcgtagaagagctttacgtacaagaggggtaaaaatgttagtccttgacgaagcagatgaaatgttgaataaaggcttcaaagaacaaatttacgatgtgtaccgatttttaccaccatccacacaagttgtacttatttctgctaccctacctcacgaaattctggaaatcacatcaaaattcatgacagatccaattcgtattttagtaaaacgtgatgaattgacattggaaggaatcaaacaattctttgtggctgtagaaagagaagaatggaaatttgacacattgtgtgacttgtatgatactttgactataacacaagctgttattttttgcaataccaaaaggaaggtcgattggctgactgaaaaaatgagggaaaacaattttactgttagtgctatgcacggtgacatgcctcaaaaagagagagataatattatgaaggagtttagatcaggacagagtcgtgttttgattactactgatgtatgggcaagaggtattgatgtacagcaagtcagtttggtaatcaactacgatttgccaaacaatcgtgagttgtacattcacaggatcggtaggtctggtcgttttggacgtaaaggtgttgcaattaattttgtaaagtctgacgatatcagaattctcagggatatcgaacaatattattcgacgcagattgacgagatgcccatgaatgttgctgatcttatctaa

SEQ ID NO: 1261 - DNA, 1605 bp, Ceutorhynchus assimilis
atgacggcacccaaagcctccggagacgcgacccgcaaccggaatttagcttacaaagacaaaagtaaacccacagatgtaaggactagtaatataaatgcagcaaaagctgtttgcgatgctattcgtaccagtttggggcccaggggaatggataaaatgatccaagcaggaaatggccaagtgaccattaccaatgacggggccacaattttgaagcaaataaatgttattcatccagcagcaaaaatgttggtagaattatccagagctcaagacgttgaagctggagacggtaccacctcagtagtagtcattgccggagctctcctagatgccgctgaaagattactgaaccgtggcattcatcccacagcgatttctgaatctttccagcgagcagccgtgcatgctttgcagattttaaacaacattgccaccccagtggaactaaacaaccgagaacaactaatcaaaactgcagcaacttccttaaattcaaaagtagtctctcaacaatctagccagcttgctccattagctgtagatgctgtactaagaattgttgaaccaggtcgtgaagctgcctgtaatctcagtgacataaaagtcctcaaacaacttggcggtacagtggaagacaccgaacttatcaacggtttagtgtttccgcaaaagttggccaacgtttctggtccaaaaaggatggaaaaggccaaaattggtcttatccaattttgtatttcacctcctaaaaccgatatggaccataacattgttgtttcggattattccgccatggatagagttctgaaggaggaacgtgcttacattttgaatattgttaagcaaattaaaaaggctggatgtaatgttttattggtccaaaaatccatcctcagagatgcagtctctgacttggccatccactttttggacaaaatcaagtgcatggtcatcaaggacattgaaagggaagacattgaattcgtttgcaaaaccttgagttgccgtcccattgcttctcttgatcattttgtcgccgaaaatttagtatccgctgaactcgtagaagaggttggatttggaggaaacaggatggtcaaagttacaggtattcaaaatcctggccctacaatcacccttctagtacgaggttccaataaattggtcctagaagaggcagaaaggtctcttcatgatgccctatgtgtggttcgttgtcttgtacgtaagaaggcagtcatagctggaggaggagctccagaaattgagctggctttaagattggccgctctagctgataaactggaaggtgtagatgctatttgcctcagagcttatgctaatgctttggagattattccatttactttagctgagaatgctggattaaatcctatccagactgttacagagttgaggaatagacatgctaaaaacgaggtatctgctggtataaatgtccgtaaagggtgcatttcagatatcctagaggaaaatgtcattcagcctcttttggtaaccacttctgctttgtcttttgctacagaaactgtgagatcgattttgaaaattgacgatattgtcaacacaatgacctaa

SEQ ID NO: 1262 - DNA, 1233 bp, Ceutorhynchus assimilis
atggaagctatggatgtagttctaccagaaaaggaggaaggtagtccttctgacaacaccaaacagtctctccaagatgcagacactgaagacctctacacaaaatacaaaaaactgcaacaaatgctcgagttcctcgaagttcaagaagaatacatcaaagacgaacagagaaacttgaaaaaagaatacctgcacgctcaggaagaggtgaaaagaatccaatcagtccctctggtcatcggccaatttttagaggctgtagaccaaaacactggcatagtgggatccactacaggctcaaactattacgtcagaattctatcgactattgacagggaattgctgaaacccagcgccagcgtggctctgcataaacacagcaatgcgctggtcgacgtcttaccacctgaagctgattcttccataagcatgcttcaagccgacgaaaaacccgatgtcagctacggtgatatcggtggcatggacatgcagaaacaagaaatcagagaagctgtagaactgcctttgacgcactttgaactttacaagcagattggaattgatcctccaagaggtgttttgatgtacgggccacctggatgtggaaagactatgttggctaaagctgtagctcatcatacaactgctgcttttatcagagtagtaggatctgaattcgtccaaaaatacttgggagaaggacctagaatggtcagagacgtatttaggttagctaaggaaaactctccagcaattatattcattgacgaaatcgacgctatcgctacaaaacgtttcgatgctcaaaccggtgctgatcgtgaagtacagagaatcctgctggaattgttgaatcaaatggatggttttgatcaaaccaccaacgttaaggtcatcatggcaactaaccgtgccgatacattggatccagctttactaagacctggacgtttggacaggaaaatcgaatttccgcttccagacagaagacaaaagcgtttagttttcagcactattacttccaaaatgaatttatctgaagaagttgatttggaagattacgttgcaaggcctgataaaatatctggcgctgacatcaatgcaatttgccaggaagccggtatgcacgctgtgcgtgaaaatcgctacattgttttgcccaaggactttgaaaaaggttacaaaaacaacattaagaaggatgaaagcgaacatgaattctacaaataa

SEQ ID NO: 1263 - DNA, 423 bp, Ceutorhynchus assimilis
atgccaagaatcaaactccaatcatccgataatgaaattttcgatatcgaagtcgaaatcgccaaatgctcagtgaccattaagacaatgttggaggatttgggcatggacgacgaagaagaagaagctgtgcctctgcccaacgtcaactctgctattttgcgtaaagtgctgcaatgggccactttccacaaggacgatccaccaccgccagaggatgatgaaaacaaagagaagcgtaccgatgacatttcttcttgggacgctgattttctgaaagttgaccaaggaacgttgttcgaattgattttggcagctaattatttggacataaaaggtttgttggatgtcacctgcaaaactgtggccaacatgattaataggaaaagcccccgaggagataagaaagactttccacattaa

SEQ ID NO: 1264 - DNA, 993 bp, Ceutorhynchus assimilis
atggaaaatcaacagctagaaattgatgtccagcaatcgaactccgagctgcccacgatggcggtggacgacaaggcgtcgagtaaggagctggaccagtggatcgaacagctaaatgactgcaagcaattaacggaaaatcaagtgaaaactttatgtgataaggcaaaggagattctgtcaaaagaatccaatgtgcaagaagtcaaatgtccagtcacagtatgcggtgatgtacacggtcagttccatgacctcatggaactgttcaggatagggggtcgtagcccggacacaaattacctatttatgggcgattatgtcgaccgtggttactactcagttgaaacagtaacactattagttgccctcaaagtccgctacaaggaaagaattaccatcttgaggggcaaccacgaatcaaggcaaattacacaagtttacggcttctatgatgaatgcttgagaaaatacggaaatgctaatgtttggaaattctttaccgatttatttgactatttaccactaactgctctagttgatagtcaaattttctgtttgcacggaggattgagccctagcattgataccttggatcatatcagagctttagatcgtctacaagaggtgcctcatgaaggcccaatgtgtgacctgttatggtcggatccggatgatcgaggtggatggggaattagtcctagaggtgctggttacacttttggacaagacatctcggaaacgtttaatcattctaatggactgacactagtttccagagctcatcagctggttatggagggctataattggtgtcacgatagaaacgttgttaccatctttagcgcacccaattactgctacagatgtggaaatcaagctgccattatggaattggatgatgcacttaaatattctttcttacaatttgatccagctcctagacgcggtgagcctcatgtgactcgtcgaactcctgattatttcttgtaa

SEQ ID NO: 1265 - DNA, 2514 bp, Ceutorhynchus assimilis
atgcagatttttgtgaagaccttgacaggcaaaaccatcaccttggaggttgaaccctctgacaccatcgagaatgtcaaagccaagatccaggacaaggagggtatccccccagaccagcaacgtctgatctttgctggtaaacaactagaagatggtcgcaccctttctgactacaacatccagaaagagtctacccttcatttggtgttgagattgagaggaggcatgcaaatcttcgtcaagactttaactggcaagaccatcaccttggaagttgagccatctgacaccattgaaaatgtcaaggctaaaatccaggacaaggaaggtatccccccagaccagcaaagattgatctttgctggaaagcaattagaagatggtagaactttgtcagactacaacatccagaaagagtccacccttcacttggtgttgagattgagaggaggcatgcaaatctttgtcaaaactttaactggcaagaccattaccttagaagttgagccttctgataccattgaaaacgttaaagccaagatccaagacaaggaaggcatcccaccagaccagcaaaggttgatttttgctggaaagcaattagaagatggcaggactttgtcagactacaacattcagaaagagtccacccttcatttggtgttgagattgagaggtggtatgcaaatttttgtcaaaaccttgactggcaagactatcacattggaagttgaaccatctgacaccattgaaaatgtcaaggctaaaatccaagacaaggaaggtattcctccagaccagcaaaggttgatctttgctggaaagcaattagaggatggacgcactttgtctgactacaacatccaaaaggaatccacccttcacttggtactgaggttgagaggtggtatgcaaatttttgtcaagaccttgactggtaaaaccatcacacttgaagttgaaccatctgataccattgaaaacgtcaaagctaaaatccaagacaaagaaggtattcctccagaccaacaacgtcttatctttgctggcaagcaacttgaagatggaagaactctttctgattataacatccagaaagaatccacccttcacttggttctgagattgagaggtggtatgcaaatttttgtcaaaactttgactggcaagaccatcacccttgaagtagaaccatctgacaccattgagaatgtcaaagctaaaatccaagacaaggaaggaatccctccagatcaacaaagattgatctttgctggcaaacaattggaagatggcagaactttgtctgactacaacatccaaaaggaatccactcttcacttggtactaagattgagaggtggtatgcaaatctttgtgaaaaccttgactggaaaaaccatcacccttgaagttgaaccatctgataccattgaaaatgtaaaagccaaaattcaagacaaggaaggtatccctccagaccagcagaggttgatctttgctggaaaacaacttgaagatggcagaactttgtcagactacaacatccaaaaagaatccacccttcacttggtactgaggttgagaggtggtatgcagatttttgtcaaaaccttgactggaaaaaccatcacccttgaagtggaaccttcagacaccattgaaaatgttaaagctaaaatccaagacaaggaaggcatcccaccagaccaacagcgtcttatttttgctggcaaacagcttgaagatggcagaaccttatctgactacaacattcaaaaggaatccactctgcatttggtactcagactgagaggtggtatgcaaatctttgtaaaaaccttgactggtaagaccatcacccttgaagtagagccatccgataccattgaaaacgtcaaagctaaaatccaggacaaagaaggtatcccaccagaccagcaacgtcttatttttgctggcaaacaacttgaagatggccgcaccctctcagattacaacatccaaaaagaatccacgcttcacttggtattaagattgagaggtggcatgcaaatttttgtcaaaactttgactggaaagactatcacccttgaagttgaaccttctgataccattgagaatgtcaaggccaaaatccaagataaagaaggtatcccgccagaccaacaacgtcttatctttgctggcaaacaacttgaagatggccgcaccctctcagattacaacatccaaaaagaatccaccctccatttggtattaagactgagaggtggtatgcaaattttcgtgaaaaccttaactggtaagaccatcactcttgaagtcgaaccatctgataccattgagaatgtcaaggccaaaatccaagacaaagaaggaatcccaccagatcaacaaaggttgatttttgctggcaaacaactagaagatggaagaactttgtcagactacaacattcaaaaagaatctactctccacttggtactcagacttcgtggtggaaactag

SEQ ID NO: 1266 - DNA, 1620 bp, Ceutorhynchus assimilis
atgcaaccccaaattttactactcaaagaaggtactgacacatctcagggaaaacctcaattaatctccaacataaatgcctgccaatcaatcgtagatgctgttcgcaccacattaggcccaagaggcatggacaaattaattgtcgtgagaaatggtaaagcaacaatatcgaatgatggggctactataatgaaattgttggatgttgttcatcctgcagcaaagactttggttgacatcgctaggtcacaagacgctgaagtaggcgatggcaccactagtgtggttttacttgctggagagtttttaaaacatattaaaccatatgttgaggaaggtgttcatcctagaattattattagatctgtccggaaatgcttacaactatgcctggccaaaattaatgagatttctgtgaaaatcaacaaagcaaatgtgtcagaatttcgttcattattagaaaaatgtgctgcaactgcaatgagttcaaagctaatcaatcagcaacgagtatttttctctaaaatggttgtagatgcagttctactacttgatgaacttttaccactgaatatgattggaattaaaaaagtacagggtggtggcctagaagattctatgttggttgcaggtgtagctttcaaaaaaactttttcatatgctggctttgaaatgcagccaaagatttataaaaactgcaaaattgctttattgaatattgaattggagttgaaagctgaaagagacaatgctgaagtgcgtgttgataatgtcaaagaatatcaaaagattgtcgacgctgaatggaatatactttacaagaaactgcaaaaaatccacgaatccggagctaatgttgtgctttccaagttaccaattggagatgttgccactcaatttttcgccgacagggatatgttttgcgctggtcgcgtcccagacgatgaccttagaagaactctcaaagcttgtggaggagcagtaatgactactgttaacgatatcaatgattcagtactgggaaaatgtgatctttttgaagagcgtcaaattggtggagagaggttcaactttttcaaaggatgccccaatgctaaaacttgtacgttgattctaagaggaggtgccgaacagtttttggaagaaactgaacgatctttgcatgatgccattatgattgttcgtaggacaattcaaaatgatgctgttgttgctggtggaggtgcaatcgaaatggaactctccaaaatgctgcgagactattcaagaacaattgctggcaaagaacaacttttaattgccgcaatcgccaaggccttggaaataattccaagacaactatgcgacaatgctggtttcgacgccaccaatgttttgaataaacttcgtcaaaaacatgcccagggccattgctggtatggcgtagacatcaataaagaagacatcagcgataatttcgaatcttgcgtttgggagccagctataatcaagatcaatgccttatctgccgctagcgaagctgcttgtttgattttgtctgtcgatgagactattaagaatgaaaagagcggcggggaccaacctcaaatgggtcgtggtatgggtagaccaatgtaa

SEQ ID NO: 1267 - DNA, 2679 bp, Ceutorhynchus assimilis
atgagtaaaacaaaaaaattcaaaaagcgctacgaaacagactcgtcgtccagtgtcgactcagaagaagagcagcgcagaaaagatctgaaagaacgtgacgaatttgccgacagactcaagaaacgcgatggcgagaaaactagaaacattattcaagcctcagacagaagagcgtacgaggaagcggctaaaaggcttcagctggaaagtgccgcgagagaaaaaatcgttcccaagctcagagttgaatccagacggaaatatctagaaaaacgtaaagatgacaagttacaggaactggaagccgatattgtagacgacgaatatctattcgaagaaggcattttaacagaacgcgaaaaaaaggaaaggcaacacaaaaaagaactcctaaaattagctcaggaacatgaaaaagccagagagttggaaagagtacaaaggtatcacatgcccagagatttgggcaaagattcgacatcagactacattgaagtggacgaacttgaaaaagtaccacaatcagagcagaaaaaatgggaaaaagaccaaatggcatcagccgttttcaaatttggagccaaagatgctacaaaaaaagatgactacgaattagtactggaagaccaaatcgatttcattcaagccttgcaaatgccaggctctagagacaaaataaaaaaagaaccagaactgtctgaacacgaaaagaaaaagttaaccattgaggaaaccaaaaaaagcttacctatattcccttttaaagatgacttaatgcaagcagtgcgggaacatcaagtgcttataattgaaggagaaactggctctggtaaaaccactcaaattcctcaatacttacatgaagctgggtttacagaggatggaaaaaaaattggttgcacccagccacgtagggtagcagctatgtctgtagcagctcgtgtagctcaagaaatgggtgtaaaattaggcaatgaagttggatacgctataagatttgaagactgcacgtcagaaagaaccataataaaatacatgactgatggtactttgcatagggaattcttatcagaacctgatttgcagtcctacagcgtcatgattattgatgaagctcacgaaaggactttgcacacagacattttattcggactagtaaaggatattgccaggtttaggcctgacttgaaattactaatatcaagtgcaacattagatgcccaaaaattctcggaatttttcgatgaggctcccatttttagaatccctggtagaagatttcctgtggatatttattacaccaaagcccctgaagctgactatgtagacgcttgtgtaatttctgtgctacaaattcatgtaacccaacccttgggggacgttttagtatttttaactggtcaagaagaaattgaaacttgccaagagtcactgcaagaccgtttgagacgtttgggctccaaagtaagggaactcataatattgcctgtatatgctaatttacctagtgatatgcaagctaaaatatttgacccgactccacctggagccagaaaagtagtattggccacaaatattgcagaaacttctttgacaattgacaacataatttacgtaattgatccaggatttgcaaagcaaaatcactttaactccagaacaagcatggagagtttgatggtggtaccaatttcaaaagcttcagctaatcagagagctggtagagctggccgagtggctgcaggaaagtgttttagattgtacactgcgtggtcttataaacatgaattggaagagaatacagtgccagaaattcaacgcattaatttaggaaatgctgttttaatgcttaaagctttaggcattaatgacttggtgcattttgactttttggacccgccccctcatgagacattagtgttagctcttgagcaactgtatgctttgggtgctttgaatcatcatggagaattaactaaaatgggtaggagaatggctgaatttcctgtagatcctatgatggctaaaatgttgcttgcctcagaaaaatacaagtgctcagaagaagttgtcacgatcactgcaatgttgtctgtaaatagctcagtgttttatagacctaaagacaaaataattcatgcagatactgctagaaagaatttctatcacttggcaggagaccatttgagtttattgaatgtctacaaccagtggaaagatactgattattctttacaatggtgttatgagaatttcattcagtatagatctatgaaacgagctagagatgtcagagagcaactagtaggcttaatgcaaagagtcgaaatagaaatggtctctaatgtatcagaaactgttgatataagaaaagctattacagcaggatatttttatcatatcgctcggctctcaaaaggtggtagctacaaaacagtgaaacacaatcagagtgtaacagttcatcccaacagcgctctatttgaagaattgccaagatggattttgtatcacgaactagtttttactacaaaggaattcatgcggcaagtaattgaaattgagagcaagtggctgttggaggtggcaccgcactattataaacccaaggaacttgaggattctaccaataagaaaatgccaaaaactgttgggagaagcactcgaactgaataa

SEQ ID NO: 1268 - DNA, 1371 bp, Ceutorhynchus assimilis
atgaaggtggaggaagtgaaaagtaccataaaaactcaacgaattagtgcccatagtcacgttaaaggcctgggtctggacgaaaatggatttgctattgcccaggcggccggcttggtcgggcaagaacaggccagagaggctgcaggtatcgtggtcgatatgatcagaagcaaaaaaatggcaggccgagccgtattactagccggtcctccaggtactggcaaaactgccatagctcttgcaatagcacaggaactgggtaataaagtacctttctgtccgatggtcggatcggaagtgtacagctctgaaataaaaaagacagaagtactgatggaaaactttcgaagggctattggtttgagagtaagagaaactaaagaaatttatgagggagaagtttgcgaactctctcctgtggaaacggaacatcccgttggaggtcaaggtaaatctgtcagtcatgtagtaatcggcctaagaacagcaaaaggcaccaaacaactaaaacttgatccgaacatttatgaggctctacaaaaagaacgagtcgaagtaggagacgtaatttacatagaagccctcagtggggctataaaaagacaaggaagatctgatgctttcgccactgaatttgatttggaagctgaagagtacgtgcctctacccaaaggagatgtacacaaaaagaaggaagttgttcaggatgttacattacacgacttggatgcagcaaatgccaagccacaaggtggtcaagatgttctttcaatgatggggcaattattgagatccaaaaaaaccgaaataactgataaattgagaaaagaagttaataaaattgtcgacaaatacattgaccaagggattgctgaattggtccccggagtacttttcatcgatgaagttcatatgctggatattgaaacttttacttatttgcacaaggctttagaaagtgccattgctcctatcgttatttttgctacaaatcgaggcagatgtcttattagaggtactgatgatatttattctccgcacggcattccattagatttacttgatagactcttgattatcaggactgtgccatacgatcgtccagatatggaacaaattttgaaattgagagctaaaactgaaggtttagaaattgatgataatgctctaacagctctaggagctgtaggcacaaaggctactttaaggtatgcagtgcaacttttaactccggctcatttaacagccaaaggcaacaagcgaaccaacattacagtcgccgatgttgaagaagtttcatttttgtttttggacgccaaacagtcggcaaagattctgtcggaaaatagtgctaagtttatgcaataa

SEQ ID NO: 1269 - DNA, 2208 bp, Ceutorhynchus assimilis
atgacttcaataataaaactacaagtcctctcgggggctatggacgagtctccgccagcttaccttttgcaaatcgacgacgtaaaaatcctattggattgcggctgggatgaaaagttcaatatggaattcattaaagaagtcaaaagacacattcaccaaatagatgctgtcctgatctcgtaccctgacacaatgcatttgggggctttgccctatttagtgggcaaactagggctgaattgtccgatttattcaacgattcctatttataagatgggtcaaatgttcatgtacgaattgtatcagtcacaaatgaacatgaagtcttttatgttgtttaatttggacgatgttgatgctacatttgagaaaattatacagttgaagtataatcagagtgtgcctttgaaaggaaaaggttacggtctcacgataactcctttaccagcaggccacatgattggcggaacaatatggaaaataatgaaagcaggcgaagaagatatcatatacgctaactcattcaaccacaaaaaagagaggcacttgaacggttgcgaattggaaaaattgcaaaggccttctttgtttattactgatgctttcaatgccagttatcaacaggccagacgtagagccagagatgagaaattgatgacaaacattttacaaactcttagaaatagcggtaacgttctaatagcagtagacactgccggcagggtattggaattggcccacatgttggatcagttgtggagaaataaggaatcagggcttttaacatattctctagcacttataagcaatgtagcttacaatgttgtcgagtttgccaaatcgcaaatagagtggatgagcgacaagctaatgagaagttttgagggtgcgaggaacaatccgtttcaatttaaacatttaaatttgtgccacagcttacaggaattaaataaagttcccagcccaaaggtagttttggctactagccctgacttggaaatgggttttgctagggaactatttttgcaatggtgttcgaattcaaataatagtgtaattattagtacaagaacatctccaggaactttggccagggatttaattgataacaacgaaccgggacgatcaattgatttaattgtcgaaagaagagtgaaactcgaaggccaagaattagaagagtacgagaaaagacagcaaatgactaaagttgaaaaaacaaccaaagaagacgactctgactctgaaagcgacatagaaatgtcggtaatatccaaaggcaggcacgatattgttgtgaaacaagaaggcaaagtgggtggaggtttttttaaagtgaccaaaaagcatcatccaatgtatccttttaaagaagaaaaaatcaaatgtgacgaatatggtgaaatcataagagtagaagactacaaattggctgacattactccagaagttgaagacaataaagaaaatcttcaaattaaagtggaagatgttgatgaaatcattgaagttaccgatcttccttcaaaatgtatagccctagagcgtacagtccaagtcaattgccaagtgcagtatatagatttcgaaggccgatcagatggagagtctttaatcaagattttgtcacaattgaaacctagaagagtaatagttgtccatggaacaccagaaaacactgaaataattgcaaaacattgccgagaaaacattggagctagagtgtttacaccgcaaagaggcgaaattgttgatgctacaagtgaaacacatatttatcaggttcgattaactgatgctttagtatcccaattacaattccaaaaagccaaagaagcagaagtggcttttgttaatgctaatttacaaattagagagtcccaagctgatgctagaagattggatgctgatgatgaaccaatggaagttatagaagaagatgcccatcagcttacattggaaccgtgcaacgaagattattcaagggaaccagttttcattaccgaattgaaattgtcagatttcaagaaggttttggccaaagctaatgtgccttcggaattttccggtggggttttgtgctgttgcaatggtacaattgctgtaagaaagcttgatactggcaaaattgttttggaaggttgcatttctgaagactattataagattaaaggtcttttgtatgaacaatttgctattttataa

SEQ ID NO: 1270 - DNA, 2226 bp, Ceutorhynchus assimilis
atgtcttcttcgggggaagtaggtagtagtaccagtacccaagatgcggcaccggctaatcccattgtgggcatcatttacccgcctcctgaggttagaaacattgtcgacaaaacagccagtttcgtggcaagaaatggtcccgaattcgaagctaggattcgtcaaaacgaattgggaaacccgaaatttaactttttgaattcgggagacccttaccatgcttattatcagcataaggttaatgaatttagagaagggaaagctcaagaaccttcccttgctcaaggaatatctaagctgacagtatctgcaagtcagcaacagaaacaacatgacattcttaaacaagttgagcaaccgtttgtaccaaaggatccacccagtgattttgagtttattgctgatccaccttccatatctgctttggatttggacattgtaaaactaacggcccaatttgtagcaagaaatggtagaactttcttgacccaactcatgaacagggaacagagaaactttcaattcgatttcctacgccctcaacattctctattccaatatttcaccaaattgcttgaacaatatacaaagattttaattcctccaaaaaccctccagcaaaagttaagagacgaaatcgtaagccaccaaaccattctagatgaagtcaagtacagggccgagtatcaaaaataccaagaagcccaaaaagccagagaagaagagatactagaacgcgaacgagttgcctatgctcaaattgactggcacgactttgtagtggtagaagcggtcgattaccaagcattcgaaatcggtaatttcccacctccaaccaccccagaagaagtaggcgccagaattctgatccaagaacgtatagaagacggcgaagacatcgaaatgcaacttgaaagtgacgacgatgaacctacaaatgtagattcaggcctcagtcatatggaagacagaacaggccctacaagccgtaaagataacaatcaagtgcaagatatggacgaggagagttcagaggaggaatatgaaagagaacagccacaacccatacaaccacctatgcctccggctttggataaagtggttgttaaaaaatatgatcctaaaaaacaaacaccaaaagttactagaccaactccaggggatgattatttggtgtcgccaattacaggagagaaaattcctgctagtaaagtgcaggagcatatgcggattggtttgttggatcctagatgggtggaacaacgtgataaacatgttacagacaaaatgaatcaagatacagtttatgctcaaggtccagccatagaggccagtttaaaattgttggctgaacgtcgtactgatattttcggtgtgggagatgaggaaactgctattggtaaaaaaattggagaagaagaaagaagagatgaaaaggtcacttgggacggacacacttctagtgtggaggcggccactagggctgcaagggctaatatcaccttggaagatcaaatacatcaaattcacaaggttaaaggtttacttcctgacgaagaaaaagaaaaaatcggtcctaagaacttgcaaggctcaaacaaaatgaaaatgccaccggctccgatcattaaacctccaccaccagttttgacagcgccttctacaacatcgataggtattcctgtacctcctcaacctcagattatggtacaaccacctataatgatgatgccggcaccaccaatggcaccaatgagaccaccacttatgatgcccacccatccacccatggcaggttttgttactccaatgcctccgcccatgggtttaccgccaatgccagtaaaacacccaaacgatggtccttcagaggaagagccttccaataagaaattgagaaacgaagattcactggtgccagaagaaatattttcggcaagaaatccgaacccggttaatataaaagtggcgattccgatgatgcctgataaacccgaatggaaactgaccggacaaatgttgtcgttcacgttgcctataggcgaaaatgtgggaaatttgaaagtcaagatacaagaggaagtcagtatgcctccaacgaaacagaaattgttgtttgatggtatgtttttcaaagatcagaacactttggcttattacaatatcactccgggcgctgttattcagttgcaattgaaggagagaggtggcaggaagaaataa

SEQ ID NO: 1271 - DNA, 966 bp, Ceutorhynchus assimilis
atgcccagccaagaagtgagtaccaccaaagtggtggtccaccctttggtactactaagcgtggtcgaccatttcaatcgtatgggcaaaatcggcaactccaaaagagtagtaggggttttgttgggttgttggcgggccaaaggagttttagatgtttccaacagttttgcagtcccatttgatgaagacgacaaagacaaatctgtttggtttttggaccacgactacttggaaaacatgtatgggatgtttaaaaaagtcaacgccagagaacgtgttgtgggttggtaccacactggacccaaattgaaccaaaacgacattgctattaacgaattggtaaggcggtactgtccaaattctgtattggtaatcattgatgcggaaccaaaagatttgggcttaccaactgaagcttaccaagcagtagaagaagttcatgatgatggttcacctacttctagaacttttgagcatgtgccaagtgaaattggagcagaagaagctgaagaagtaggggtggagcatttactaagagacattaaagatacaactgttggtactttgtctcagagaattaccaatcagttattgggcctcaaaggccttcactcgcaactgagagaaatcagagactatttgatacaagtcagcgaatcaaaattgcccattaatcatcagataatctatcagttacaagacattttcaacttattacccgatatcaatcaattggaattcaataagtcgttttatgtgagaaacaatgatcaaatgttggttgtttacttgtctactcttgtccggtccattgtggctttgcacaatttgatcaacaataaattgaccaacaaagatgccgaagaaggcaaaaaggaagagaaaaaagataaagatgccaaggagaaggaaaaggaaaaagataaagacaaagacagcaagaaggatgaaaagaaaaaataa

SEQ ID NO: 1272 - DNA, 1650 bp, Ceutorhynchus assimilis
atgtttggcggcggacgtgcaccgattttagttttaagtcaaaacactaaacgtgaatccggccgaaaggtgcagttggagaatatcaatgcaggaaagcaaatcgccgatgtaatccgaacatgcctgggaccccaagctatgctaaaaatgctgatggaccccatggggggtatcgtcatgaccaacgacggcaatgcgattttgagagaaatcactgtgcaacatccggcagctaaaagtatgatcgagatagctaggacacaagatgaagaggttggtgatggtaccacctcagtcatagttcttgccggagaaatgttagctgcagctgaacaatttctagaacaacaaattcatccgacagtaatcatcagacaataccgtcaagccctcgaagacataatttcccttatcgaaggacctttgagtgtacccattgacaaaaacgacaaagccgctcttagcaatgttgtcagaggttgcgttggcaccaaattcattggcaaatggtccgatttggcagtgaaaatcgctttggacgccgtccatactgtgatgctggaggaaaatggtagaactgaggtggacattaaacgatatgccaaagttgagaaaattcccggtgggtctattgaagaatcagaagttttaactggagttatgctcaataaagatgtcactcatcccaaaatgagacgttatattgagaatcctagaattattttgctcgattgttctttggagtataaaaaaggagaatctcaaactaatgttgaaattacttctgatggtgattttactagaatgttgcaattggaggaagagcacgtcaggaggcaatgcgacgaagttatagccctcaaaccggatttggtgtttaccgaaaagggggtttcagatttggctcagcactttttgttgaaagcaggaatcagtgctattcgtagagtaagaaaatccgacaacaacaggatcgctcgcgcctgtggcgccaccatagtaaatagaaccgaagaattgcaagaatccgacgtcggaactggagcgggtctctttgaaatcaaaaaaatgggcgacgaatacttttgctacatcaccaagtgcaaaaacccgaaagcttgcacaatcattttgcgtggtgccagcaaagatatcttaaacgagaccgaaaggaatttacaagacgccttgcaagtagccagaaatattgtgctttcgcctcgtctggtaccaggtggaggcgcaatcgaaatggctatagcccaaaaattgttgcagaaagctactcacggaccttacagatctttggcacacgctttagaaatcattcctcgtacactggctcagaactgtggcgccaacacgatcaaaactctcactgcgctcagagcgaaacacgccaatcacaccgacgtaaactctccctgcacttggggcattgacggcgaatctggcgaactcgtagagcaaaaagaaagaggcctctgggaacctctggcggtcaaacttcaaacttacaagacggccatcgaaactgccattttgttgctgcgtattgacgatattgtttctggatctaagaagaaggacagggaaccagcagggcctgctcagactcaagaaactgccgctatgatgcaagattga

SEQ ID NO: 1273 - DNA, 699 bp, Ceutorhynchus assimilis
atgtctctcgtcgtgaaaccaaactttcctgattatcaaactgctcccgtacaacgcggatttaatccctacgctgacaatggcgggagtgttgtggcaatagcaggcgacgacttcgttataatcggagccgacacgcgtctgagtgccgggttttcgatttacactcgcgaacaaaacaaattgttcccattgtccagtaccacggtcttgggctgttctgggtgctggtgcgacaccctcactttgaccaggattttgaagtctcgcatgcaaatgtaccagcaggagcacaacaaaacaatgtctactactgcctgcgcccaaatgctctccactatgctctattacaaaaggttctttccctattacatttccaatgtattagttggtttggataatgatggaaaaggggtggtttacagttacgatcctattggtcattgcgaaaaaagaactcacagagctggaggatctgcgggtgctctattgcaaccacttttggataatcaaattggcaagaagaacatgttgaatgtgaaagaagaaccggtttcgcaacagagagctttgtccatcattaaagatgtgtttatttcagctgctgaaagagatatttacactggggatagtattttaataaatatcattactaaagatggaattaaggaagaaactttccaattaaggaaggattaa

SEQ ID NO: 1274 - DNA, 990 bp, Ceutorhynchus assimilis
atgtcctccaggcgtaatcgatttgtttcaagaagaattaacattcagaatgcggctgccagagagttccaatttggatttaacatgttcccggacattccgaggcccttcaatgttacttaccaatgctattcggtagctatgcttcctggaaatgagagacaggatgtagaaagaggtggaaaaattattatgcctccaagtgctctagaacaacttaccagactcaatataaattacccaatgttatttaaactgacaaataaaaattctggaagagaaacacactgtggtgttttggaatttgttgctgatgaaggaaaagtttatttgccattatggatgatgcacaatatgaacctagaagaaggcgagctggtacaaatggaaagtgtctctctacctgtcggtacattttccaaattccagccattatctccagagtttctcgacattactaacccgaaagctgtattagaaaattgcctcagatcgtttgcttgcctcactaaaggagatgtaattgccgtgcaatacaaccaaaaaatctatgagctttgtgtattggaaaccaaaccaggtaatgccataagcattattgaatgtgatatgaatgtagagtttgctgcgcctgtgggatacaaggaacctgaaatagtgaggaaacctgaagaggaaatggctgtagatcctgctgaattgatgccggagcctactggatttatagcatttaaaggagccggtaatagattggatggaaagaaacggaaggattctacatctactgatgtttcgccacataaaccaatatacgtcagaggaattccagactatgactatgaaattggaagtttgagattcattagagcaatagcaaaaccaaaaaataatgataataatgaaagtgatgagtttaaaccgttctctggtgaaggtttcagtttaaaagacagcgcttatttattgtttgttattattattatttttttt

SEQ ID NO: 1275 - DNA, 1629 bp, Ceutorhynchus assimilis
atggcgggttttccgggcagtattgccttcgacgagtacggcaggccctttatcatcctgcgggatcaggacaagcaaaaaagactgaccggaatcgacgccctaaagagtcatattttggccgctagacaaattgcaaacactgttaggacttctttggggcccaaagggctcgataaaatgatggtgtctcctgacggtgatgttaccgtaaccaacgacggcgccacgattctaaaaatgatggacatcgaacacgaaattggcaaactcctagtagaactatcccaatctcaagacgacgaaatcggcgacggtactactggagtcgtggtactcgctggggctttgctagaacaagcagccagtttagtagaccgcggcattcaccccataagaatagccgacggtttcgaaatggcctgccaaactgccgtagctcatttggaaaaaatcgccgaacttttcccggtttccgccaccaaccccgagcctcttatacaagtcgccatgaccactttaggttcaaaaatcatcaacaagtgtcacagacaaatggccgaaatcgcagtcaacgctgtgctagctgtggccgatttggaacagaaagatgtcaattttgagctgattaaagtcgaaggcaaagtgggtggcaaattggaagacactgtattagttaagggagtggttatcgacaagacaatgtcgcactcgcaaatgcccaaggagctgaaagatgttaaattggccattttaacttgcgcgtttgaaccaccaaaacctaaaaccaagcataagttggatgttggtgatgttgccgcttataaagagttgagacaatatgaacaggaaaaattcaaagaaatggttaatttggtgaaaaatgctggagctacgttggcaatttgccagtggggctttgacgatgaagccaaccatcttcttttgcagcaacaattaccggctgtccgttgggtaggaggtccggaaatcgaattgatcgccatcgccactggtgggcgcatcgtgccacgattcgaagaattgagcccggaaaaattgggaacggccggattagtacgcgaattgtctttcggtaccacaagcgacaaaatgttggtcatcgaagaatgcgcaaattcaagggcagtaacaattctagtacgtggaggcaacaaaatgttaatcgaagaagccaagcgtagcttacacgacgccttgtgtgtagttcgtagtctggtgcaagaacccaacatcgtttacggaggaggtgccgccgaaatcgcttgcagtttagctgtagcggctcaagctgaccaattagcttctttggaacaatacgcttacagaggttttgccgaagctttagaagccattcctttggctctagcggaaaacagcgggctttcagcaattcacactttgggtgaattgaaagccaagcaatcggctagtggagatccggctttaggtatcgattgtatgtttactggaaatatgaatatgagggagcagcacgttattgaatctttgaagtccaagaggcaacagctgttgttggctacgcagcttgttaaaatgattttgaaaattgatgatgtgaggtcacccagcgatcaacaaggataa

SEQ ID NO: 1276 - DNA, 348 bp, Ceutorhynchus assimilis
atggcatcagcatccgcaatggacgtggacactgacgaagtagaaatgcccacatcgagcagctcaaagggggaaaaaaagcggttcgaagtgaaaaagtggaatgcagtagccctatgggcctgggatatcgttgttgacaattgcgctatctgcagaaatcacataatggatttgtgtatagaatgccaggctaatcaggcctccgctaccagcgaagaatgcactgtcgcttggggcgtttgtaatcacgctttccattttcattgtatctcgagatggttgaagaccaggcaggtttgtccattggacaacagggagtgggaattccaaaagtatggacactaa

SEQ ID NO: 1277 - DNA, 1605 bp, Ceutorhynchus assimilis
atggtttccctcaatccagttagagtactaaatcaaaatgccgaagaagaaagggcagagattgctcgtatgagcagttttataggagccatcgccattggtgatttggtcaagagcactctaggaccaaaaggtatggacaaaatcttggtatcaagtggccgaaacgctggttccgtagaagtcacaaacgacggcgccaccatcctcaaatcagtaggaattgataacccagccgctaaagtccttgtagacatgtccaaagtgcaagacgatgaggttggagatggcacaacttctgtaacagttttggcagcggaactgttgagagaagctgaaaagcttgtcgatcaaaaacttcatcctcaaatcattattgcaggatggaggaaggcttctgatattgccagaaaggctttggaagacgcttcagaggataacagtgctagttcagagaaattccgcgaggatttgatgaatattgctcgtacaactttgagctcgaaaattctttcccaacacaaagagcattttgctaacttggcagtggatgctattcttagattaaaaggatctggcaacttacaagctgttcaaattattaaaaagtctggcggtactttagaagaatcgtttttggaagaaggcttcctcttggacaaaaaaccaggtgttcatcaaccaaaaagagtagagaatgctaaaattttaattgcaaatacacctatggatactgataagattaaagtgtttggctcgacaattaaggttgactctatggccaaaattgcagaactagaattagcagaaaaggagaaaatgaaagacaaagtaaataagattctcaaacacaacgctaacgtttttatcaatcgtcaattgatttacaattacccagaacaattgtttgctgatgctggcgttatggcaattgaacatgctgattttgatggcattgaaagattagcattagttactggtggtgaaatagtctccacttttgatcaaccagaatctgtaaaattaggaacttgtgatctcattgaacaaatcatgatcggtgaagacattttgttgagatttagtggtgttgccttgggagaggcttgctctatagttattcgtggtgcaacgcatcaaattattgaagaagctgacagatccctccatgatgctttatgtgtcttggccgccacagttaaagaacatcgtgtagtgtatggaggaggttgcagtgaaactttaatggctgttgctgttagtaaagctgctttgaatacgcccgggaaagaagctgttgctatggaagcttttgccagagctcttctacaactgccaacgattattgctgacaatgctggttacgattctgcgcagcttgtagcggaattaagagcatcccacaacaatggtaattcctttgatggtctaaatatggaaaaaggcgaaattggtgatatgcgtgccctaggcatcacagaatcgtttgcagtcaaaaggcaggtgcttctttcagcatcagaagcagctgaaatgattcttcgtgtagacaatattatacgtgcagccccaagaaggagagtcgaagatagaggacactgttaa

SEQ ID NO: 1278 - DNA, 840 bp, Ceutorhynchus assimilis
atgttcaggaaccagtacgacagcgacgtgacggtgtggagcccccaggggcgtctgcaccaagtcgaatacgccatggaagcggtgaacctgggttcagctactgtggggctcaaaagtaactcgcatgcggtcattatagccctaaaaagagcctcctctgaattgtctgcctaccagaaaaagatcatcaacatcgacgatcatattggtattactatatcagggcttactgcagatgcaaggattttgagcagatacatgagaacagagtgtttgaattataagtactctcacgatacttatatgccaatgaatagacttattacaactttaggcaacaaaatgcaagtttgtactcaacgttacgatcgtcgtccctacggtgtaggccttttagttgctggttttgacgataagggcagccacatttaccaaacttgcccttcggccaacttttacgattgcaaagccatgtctattgggtccagatctcaaagcgccaggacttacttggaaaagcatttggatcaattattaaacagcagcttagaagaacttattaaacacggtttgagggctttgagagacacccttcctccagaaatagatttgtctaccaaaaatgtttctattggttttgttggcaaggaaaggcaatttaagattttagaagaagaggagattgcaccttatttaggacttattgaaggtgaggagagaagaggacagggtgctgataaagctccagggcctcttagggaagatcagggggaagcaccgagggacccccaagcagctacagccacagaagctgcagacagaatggatacagattaa

SEQ ID NO: 1279 - DNA, 2550 bp, Ceutorhynchus assimilis
atgaaaatgccagttagaaaccaaatatccgaatttatgcctatggttatcgtattttcagacgatgagctaccttatgaagaagaaatactgcgcaacccctattcggtcaaacactggctacgttacattgaccacaaaaaacaatcgccgaacctcatctacgaacgtgccttaaaacagctacctggcagctacaagctgtggtacaactacttgctcataagacgtcaacaagtcaaaagcaaatgcctactggatccagattttgaggccgttaacaattgttttgaacgctccctggtgttcatgcacaaaatgccccgcatctggatggattactgtcaatttttaacagatcaaaacaagatcacgcgcacgcgcaaagtatttgatagggcgctgagagcgctaccagtaacacagcaccatcggatatggcctttgtatttgaagtttgtctctaaacatgacattccggaaacttctgtaagagtttttaggagatacttgaagttgttcccagaaaatagagaagaatttgtggaatttttgcaaaaaattgataggttagatgaagcaagtgttattttagctaaatgtgtaaataatgacaactttattagtcgaaatggcaagtctaagcatcaattatggaacgaactgtgcgaattaatgtcaaataacccacaaaaaattctaactttaaatgtggacgccattatcaggggcggcttaagacgttacacggaccagctaggtcatctatggaccagcttggcaaattattacgtcaggagcggcctgttcgatcgcgccagagacatttttgaggaagccatacaaactgttacaaccgtcagagattttacacaagtttttgatgcatatgctcaatttgaagagttaagcttgagcaagcaaatggaagaagtggctaaaattgctgagccaactgacgacgacaatgttgaccttgaattaaggttggcgcggtttgaacacttgatggagaggcggctactgcttttgaactcggttttgttgaggcaaaatccgcataatgtacaggaatggcataaaagagtccaactgtatgatggacaacctcacgaaattatcaatacttatacagaagctgttcaaacggttcagccaaagttggccgttggtaagcttcactccctctggatcgcctttgccaaattctatgaacaaaactcacagtgtgaagatgccagactgattttcgaaaaagccactgaagtagagtacatcaaagtagacgatttggcaacagtgtggtgcgaacgagttgaattagagatccgtcaggagaactacgaggaagctttaaaactgatgtaccgtgctacagcaatgcccaaacgtaaagtggcctactttgacgagaaagaatcagtgcaggcccggctttataaatctttaaaaatatgggcaatgtacgcagacttggaggaaagtttcggtacattcaaatcttgcaaagctgtctacgataggattttggatttaaaaattgcaacgccgcagattattattaactatggaatgtttttggaagagaacaactattttgaggaggcttttagagcgtatgaaaaagggatatcgttgttcaaatggccgaatgtttacgatatttggaatacgtatttgaccaaatttctaaagagatacaagggggacaaaatcgagagggcgagggacctgttcgaacaatgcctggaaacttgtccagaagcctactgcaaaaacctctacttactctatgccaaacttgaggaagattacggaatggcccatcatgcaatggcagtttacgaacgtgccacacaagctgtctcacaagattccatgctggaaatttttaatatttacatcaaaaaggcatcgagcatttacgggataccaaaaaccaggcagatatatgaaaaggctatttctgtcttaccagagaaggacatacgggatgtttgtctaagattcgccgatatggaaactaaattgggagagattgacagggccaggggtgtttattcgcactgtagccagatttgcgatcctaggattacaggggaattttggcaaacttggaaggagtttgaagttaaacatgggaatgaggagactatgagagaaatgttgagaattaagaggagcgtgcaggcaacctataatactcaggttaatatgatgtcagtccaaatgttgggatcatcctcacctctaggaactacagccgatttagcaccaggcgaaaaggatggaatgcgactgttggaagtcagagctgccgaaatggcttcttcttcaggtgctcaaaaatcggcgaccagcggtataatgtttgttagaggcgaaactcaaggaggtaaaaaggataaagtggttaatccagacgaaatcgatatcgatgccgacgggggtgaagacgaagatggggaagatgatgaggatcctgaacctttattggaacaaatagaggtgcctcaggaagtgtttggcagtttgaaaaagcctgattaa

SEQ ID NO: 1280 - DNA, 1089 bp, Ceutorhynchus assimilis
atggctaacggacccatagctgaaagaaatagagatgccactatctatgttggaggcctggatgaaaaggttgtagactccttgttatgggaactgtttgtacaaagtggaccattggtgaatgtccatatgcctaaagacagggttaccatgatgcaccagggctatggatttgtggagttcatgggcgaagaagatgcagattatgcaataaaaataatgaacatgataaaactatatggaaaacccattagagtaaataaagcctctgcccatcagaaaaatcttgatgttggtgccaatatatttattggtaatttagatctagaagttgatgaaaaattactttacgacactttctctgcttttggagtaatacttcaaacgccaaagattatgagggatccagaatctggaaattccaaaggttttgctttcgtcaatttcgccaactttgaatcttcggatgcttccatagaagccatgaatggacaatacttgtgcaacaggccaatttccgtatcttacgctttcaagaaagattcaaaaggagaaaggcacggatcagctgctgaacgtattttggctgcacaaaatccgttatcacaggctgacagaccccatcaactgtttgcagattctccaccaatcggcatgatgccaccaggaatgacgactgctcctccaccaccaccaggaatgttgggtctaccgccaccctctgtgacacccaacactacgattccacccccaccgcctgctgttcccccaccagcatcatttcctgcaggaattccgccgcctccgttaccgccctctcaaccacctttgccgccaattgcacccccaccgcctccagcttctaagccaggtgtgatgaacccaccagcaccatggaaaggggggttgggtaatcccccaccaccacctgtaccaccagtatctgatccaaacttctccaaattgcttctgcctcctccaccgccaagtggaccaccacaaaaatgggaaggaccgccgccctcggccatttctggaaggccgtcctttccacctagaagaccaccacccccgccgcccacaaattaa

SEQ ID NO: 1281 - DNA, 693 bp, Ceutorhynchus assimilis
atgggtcgtgtaatccgagcacagagaaaaggtgctgggtctgtattcaagtcccacacgaaaaagaggaaaggggcgcccaaattgcgttacttggacttttccgaaagacatggctacatcaagggtgtcgttaaggacattgttcacgatcccggcagaggagcacctttggctttcgtacatttccgtgacccttacaaattcaagacacgtaaagaattgttcatcgcccccgaaggaatgtacactggacaatttgtctactgtggcaagaaagccaatttgcaaattggaaatgtattgccagtaggaaccatgcccgaaggtaccattgtgtgtaaccttgaagaaaaaactggtgacagaggccgtttggctcgtgcctctggtaactacgccactgtaattgcccacaaccacgacacgaaaaaaaccagagtcaagttgccttcaggcgccaaaaaagtaatcccatccaacaacagagccatggttggtatcgtagctggtggaggtaggatcgacaaacccatcctgaaagccggtagggcttatcacaagtacaaggtgaagaggaactgctggcctaaggttagaggtgttgccatgaaccccgtcgagcatcctcacggaggtggtaaccatcaacacattggtaaagcttctactgttaagaggggtacatccgct

SEQ ID NO: 1282 - DNA, 411 bp, Ceutorhynchus assimilis
atggctcgtaccaagcagaccgctcgtaaatccactggaggaaaagcacctaggaagcagttagctacgaaagctgcacgtaaaagtgccccggctaccggaggagtcaagaaacctcatcgctacaggcctggaaccgttgctctccgggaaattcgccgttatcagaaaagtactgaattgctgatcagaaaacttccattccagcgcttagttcgtgaaatcgctcaggatttcaagaccgatttgcgtttccaaagttcagcagtaatggctttgcaagaagccagtgaggcctacctggtgggtcttttcgaggacactaacctttgcgccatccatgccaagcgagtgaccatcatgcccaaagacatccaattggccagacgtatcagaggcgaacgtgcttaa

SEQ ID NO: 1283 - DNA, 1596 bp, Ceutorhynchus assimilis
atggctattagcttgttaaatcctaaggccgaagtcgccagggctgcccaggcattggccgttaacatttcggccgcaaaaggtatccaggaggtgatgaaatccaacctgggacccaaggggaccatgaaaatgttggtatcgggagctggcgacatcaaaatcaccaaagacggcaacatcttacttcacgaaatgcaaattcaacaccccactgcatccttaattgccagagcttcaactgcccaagatgatatgactggtgatggtactacatccactgttctcctgattggtgaactcttgaagcaggcagacatctacattgcagaaggcctccatccgagacttcttgctgagggctttgataaagctaagaccaaagctttagaagtcctggacaaaatcaagatccccattgaaatcaatagagaaaatttattggatgtttgcaggactagtctaaggacaaaggttcatcaaactttggctgatgtccttacagaagtttgtgtcgaagcagtcttagcgataagacccaaagacaacaaacctgttgatttgcatatggttgaattaatgcaaatgcaacacaaaaccgagactgattcatcattaatcaaaggtttggtacttgatcatggatcccgtcatccagacatgccaaaacgtctggaaaattgctacattttaacttgcaatgtgagtttggaatatgaaaagagtgaagtcaattctggctttttctacaaaactgctgaggagagagacaagatggttcttgctgaacgtgagtttattgatcagagagtcaagaaagtcattgagttgaagaaaaaaatttgcactggtaccaataagacttttgttatcatcaaccagaaaggaattgatcctatgagcttggatcaattagcaaaggaaggtattatagccttaagaagagccaaaaggcgaaacatggaacgtttatctttggcttgtggtggtactgccatgaatacttttgatgatttgagtgagtcgtgccttggatatgctggtctagtttacgagcacgttctcggtgaaactaagttcacttttgttgaggagtgcaagaaccctcaatctgttactattttattgaaaggccccaacaaacattctttgcagcaaatcaaagatgctattagagatggtttgagagctattaataatgctattgaagataaagctgtaattccaggtgctggcgccttcgaaattgctgccaacaaagaacttcttcagtggaaagacactgttaaaggcaagactaggttgggggtagttgcgtatgctgaagctctgctggttattcccaagattctggctacaaattctggatttgatgtccaagaaaccattgtcaaacttcaagaagaaagccacacaagtcccgagccaattggcttagatctgacctccggagagccaatttctccaaaagatgctggaatttttgacaactacattgttaaaaaacaaataattaattcttgttcagtcattgccagtaatttattgttggtggatgaaattatgcgggctggaatgagtagtctaaagggctag

SEQ ID NO: 1284 - DNA, 3141 bp, Ceutorhynchus assimilis
atgtctagtgctgaaaacgcagacagctccgtcgatcccccaactaaaaaacggaagctcgaggcaagaaaaagtaccaacacggacagggaaatggcgaacaacggcacagcttcgagttctcaggctcagggtcaaactagtgaaattgatgaaggattatactccagacaactctatgtattgggccatgatgctatgcgtaggatggctacaagtgatgtacttatatccggcttgggaggattaggtgttgaagttgccaagaatgtcattttgagtggtgtaaagtcagtaactgtccatgacgacaaagaagcaacaataactgacttgagctcccagttttttttgtcagaagaggacgttggcagcaaccgtgccgaggtcgtttgcaaaaaactagctgagcttaacagttatgtcccaactcgttcttacactggatcccttgatgaagatttcattaaaaaattcagagtagtcgttctgaccaactctactagcagtgaacaactgagaatcagtgaaatcactcatgctaataatattgctttgatcatagcagacactagagggttatttgcccaagtgttttgtgattttggagaatctttcactgtggttgatgcaactggagagcctactgtttctgctatgattgctgatattagtaatgatacagaaggtgttgttacctgtattgatgataccagacatggaatggaagatggcgattttgttgtattttcagaggttcaaggtatgactgaattaaatgggtgctcacctatcaaaatcaaggttttgggaccatacacattcagcatcggtgacactacagccttctcaaaataccaaagaggaggtattgcgacacaagtaaaaatgcctaaggaattgcatttcaaatcgctcaaggaatccttgggaaatcctgagtttctcatgacggactttgccaaattcgattacccacctcaattacacttggcatttagtacgcttcacgcatttgaagaaaaaaacgggcgggtccctaaaccgtggagcaacgatgatgcagctgaatttgtggcacttgccaaaactaatgccagtagcggcgatactgaaataaatgccggcttattggaaacttttgcaaaggtttgtgctggaaatctaaacccaatcaatgcaacaattggaggtatagtggctcaagaagtaatgaaagcttcttctggaaaattccatccaattgtacaatggttatactttgatgccattgaaactttgccttctgataggtctgaaattacagaagaatcagctgcacctcaaggcaccagatatgatggacaaattgctgtgtttggaaaagaattccagaacaaaatagctgctcagaaatattttgtggtaggcgcgggcgccattggttgtgagctattaaagaactttgcgatgatgggcctgggtactgaaggctgcatcattgtcaccgatatggaccttattgaaaaatcaaatttgaacaggcagtttttgtttagaccacatgatgttcaaaaagcaaaatctgacactgcagcattggcaattctgaaaatgaatcctcaaatcaacattgttgctcaccagaatagggtcggccctgacactgaaagtgtttatgatgatgaatttttcgaaaatttagatggagttgcgaatgctttggataatgtagatgcaaggatttacatggatagaagatgtgtttactaccgcaaacctcttctagaatcaggcactttgggcacaaaaggaaacactcaggtggtggtaccattcctgacagaatcgtacagttcatctcaggatcctccagaaaaaagcatcccgatttgtactttgaaaaacttccccaatgccattgagcacacattacaatgggccagggatgcatttgaaggattattcaaccaaaatatagaaaaggcataccagtttctcagcgatcctgatttcttggaaagaactcttaaactgccaggagttcagcctttagaaactcttgaacaagtaaaggcagctctagttgatgaaaggcccaaatcatttgatcaatgtattgcttgggctagactttattgggaggatcaatacaacaaccaaatccgtcaactattgttcaacttcccaccagatcagctaacatcaacaggtcagctcttctggtcaggacctaaacgttgtcctcagcccttaacctttgacatcaacgaccctctgcatattgattatattgcagctgctgctcgattgaaagcagactgctatggtattccacatgctcatgccaatagagatcatattgcccaagtagctgctagcattgaggttcctgtatttgttccaagatctggggtgaaaattgcggttactgattcacaaatggccgccaacggtaacaatgtcgacctggatcgtattactcaacttactcaagaaataccaaccagggataaaattgatggtgtcatgttgaaacccttggacttcgagaaggatgatgacaccaatttccatatggatttcattgtagcggcatcaaatctgagagccctcaactacaaaattcctcctgcggatagacacaagtccaaacttattgctggtaaaattattccagccattgctacaaccacgtctgtggtcgccggtttagtttgtctggaactttacaaattgattcgatctcaaagaagtctggaaccatttaaaaatggtttcgtcaatttggctctaccattctttggattcagcgaacctattgctgccccacaaaaggaatatggcgaaaacaaatggacattatgggacagatttgagattgatggagaaatgactttagctgaatttttgcaatatttcaaagataaacataatttggaaatcacaatgctttcgcaaggcgtttgcatgctttactcattcttcatgcaaaaagccaaagctcaagaacgtttgggcctttcaatgtccgaagtggtgaggagagtgtccaaaaaaaagatcgaacctcacgttaaagctctggtctttgaattgtggtgcaacgacactgaaggtgaagacgtcgaagtaccatatgtcaaatataatcttccataa

SEQ ID NO: 1285 - DNA, 1272 bp, Ceutorhynchus assimilis
atggcggatgcagaagatcttctcgattacgaagacgaagaacaaaatgagcaaactccggccgaagcagcggccgaacctaaaaaggcggtaaaaggtacctacgtctccattcacagttccggattcagagatttccttttgaaaccggaaattttacgtgccatcgtcgattgcggtttcgaacatccttcagaagttcagcacgaatgtattccccaagcggtccttggcatggacatcctatgccaagcaaaatccggtatgggtaaaactgccgttttcgtcctggccactctccagcaactggaacccacagaaaaccaggtctacgtactggtgatgtgtcacaccagagagctggcattccagatcagcaaagagtacgaacggttcagcaaatacatgcccacaatcaaagtgggtgtgtttttcggtggcatgcccatccaaaaggatgaggatgtgctgaaaaatagttgtccgcatattgttgtcgggacacctggcaggattttggcgcttgttaggtccaagaagttgaacttgaagaatttgaagcattttgttttggacgagtgcgacaaaatgctggagttgttagatatgagaagagacgtgcaagaaatctacagaaacacaccacacggcaaacaagtgatgatgttcagcgccaccctaagcaaagacatccgcccggtctgcaagaagtttatgcaagatcccatggaagtgtatgtggacgacgaggccaaattgactcttcacggtttgcagcagcactacgttaaattgaaggaaaatgaaaaaaataaaaaattgttcgagcttttggatattctagaatttaatcaggttgtcatttttgtcaaatcagtccaaagatgtgtggctttggcccaactattgaccgagcaaaatttccccgccatcggaatccacaggggaatggaccaaaaagaaagattgtccagatatgaacaattcaaagatttccaaaagagaatattggtagcaacaaatctttttggcagaggcatggacattgaaagagtcaacattgtattcaactatgatatgcctgaagattcagacacttacctgcacagagttgccagagcgggacgttttggtaccaaaggccttgcaatcacttttgtttcagaagagagtgacgcaaaaattttgaacgaagttcaagacaggtttgatgtcaatattacggaacttccggatgaaattgatctcagttcatatattgaaggacgataa

SEQ ID NO: 1286 - DNA, 1473 bp, Ceutorhynchus assimilis
atggtttcagtggaaaacgacgtggaaatgaaaaacgccgacagccccccgggtcccgaggccggcgacagcaaacgagacgccgatttgcaaagtctgcaagagatccgagaacacaccaggcaaattgaaaaggcgatttccaacaaagaaagccgctttattttaagggttttaaggtgcttaccaaatacaagacgtaaactcaacggtgtagtacttagaagtctcataacgcaaatttatcctgcagcagatcgtgaagctctgctggtctttgttgaggaggctgtaggtgaaattgaaagctctcaaaccaggattcgttcagctactaaagctgccttgccagaggtggattcttatattaacttgttgattttggtaagactaattgacaccaacaagctggaggaggctcaaaggtgctcccaggctttgatgaacaaaatcgtcagtcaaaacaggagaactattgacttgattgctgctaagtgctacttttatcattctagagtagctgaattgtctaataagttggacacaattcgtgctttcttgcatgccagattgcgtacagcaactttgaggaatgactttgaaggacaagcagttcttatcaattgtctgttgaggaattatttgcactattcactctatgatcaagcagacaagttggtttccaagtgtgtttttcctgaaactgctagcaacaatgaatgggccaggtttttgtattatttgggaagaattaaggctgctaggttagaatacagtgttgctcacaaacacttggtgcaagctatgagaaaggccccccaaaacactgctgtaggcttcaggcaaactgttcaaaaacttttagtggtagtagagcttcttctgggtgatattcctgaaagacagattttcaggcaacctgccatgcgtcactcgttgagctcctacttccaactcactcaagcagtacgtatgggcaacttgcaacgatttggagaagttttggaaaactttgggccccaattcaggcaggaccatacttatacattaatcttgcgcttgcgccataacgtcatcaaaactgctcttagaagtattggcctagcttattcgagaatctctttgcaagatattgcacaaaagttaggcttggattcagctgaagatgctgaattcattgtggcaaaagccataagggatggggttattgaggccacattagacgctgagggtggctatatgagaagcaaggaaactacggatatttattgtactaaagaaccacagatggcgttccatcaaagaatatctttttgcttggatttgcataatcagagtgttaaggccatgaggtatccacctaaagcttacggtaaagagttggaaagtgccgaagaaagacgcgaacgtgaagcgcaagatcttgaattggcaaaggaaatggcggaagaagacgatgatggatttccttga

SEQ ID NO: 1287 - DNA, 1638 bp, Ceutorhynchus assimilis
atggcccacaccagtcaaagtttgccagtctcccaaatcctcaaaacaaaaaccaacgatatcgaggacgatgacgaacccaagaaaaaatccagagaagattggaggaaagcgaaagaactggaagaagctcgtaaagctggtaccgcccccgccgcagtcgacgaagaaggcaaagatatcaatcctcatattccccagtacatttccaatgctccttggtactatggtactagtgggcctacgctcaagcatcaaagacctcaagaggagcaccagaagcagttttctggactagacgagtggtaccagagaggattggacacatcaaaaattgtcaccaaattccgaaaaggtgcctgtgaaaattgtggtgcaatgacccacaaaaaaaaagattgtatggatcgacccagaaaaattggtgccaaatattccaaatccaacattctgccagatgaatatgttcagaaaaacttggcgttgagttttgatggcaagcgggatagatggagcggatacgatccaagtgaacacaaaactgttatagaagagttccaaaaagttgaggaagccaaacgccaactaaaagctgagaaactagatgctgagaactcagatgaagaggaaaaggatgaggacaaatatgtagatgaagttgatatgcctggcaccaaagtggacagcaaacaaagaattactgtgaggaatttgcgtataagagaagacactgcaaaatatttgaggaatttagatccaaattctgcctattatgatcccaagacaagatctatgagagaaaatcccaatcctggagtggatgagacacaccaaggagaaaactttattcgattcactggtgatactaaaaaccatgcaaaagctcaacttttcgcttgggaagcttatgaaaaaggtgttgacgtacatttacttgctgagcctacaaaactagaactgctcaagaaggaatatgagaaaaagaaagaacaatttaaagatactgtttcttcaagtgtattggacaaatatggaggggaggagcatttaaaagccccacctaaaacacttttattggctcaaactgaggattatgttgagtattcacgttcaggcaaaattatcaaaggccaagaaaaagaggaaatcaaatcaaagtatgaggaaaatgtttacattaataatcatacaagtgtatgggggtcctattggaaaggtggtcattgggggtataaatgctgtcattcttttataaaaagctcctattgcttatcagaagctggcaaaagtatagaacaaccaatgcctgaaactgttccgaatgaggtcttggagaaagttgcaagtgaaaaatctgaaagttcttcttcaagtgaagaagatgttagaactgcttcagaaaagtctagcaagaaaaagaagactaaaaaaattaagaagaaagataaagataagttggcagaagctctaaaagcagaagagcaacaacaacaacaggcagatcatttgttgtcgatagatgaaagaaaacgcccttataatagtatgtttgaggctaaaaaacccacagaagaagaaattgaagcttattacctaaaaaggcgcagggaagatgacccaatgaaccaattcatgtga

SEQ ID NO: 1288 - DNA, 627 bp, Ceutorhynchus assimilis
atgggtatcagtcgtgatcattggcataaaagacgtgccaccggtggcaaaaggaagcccctgcgtaagaagaggaagttcgaattaggacgtccagctgccaatacgaaattgggagcccgcagaatccattatgtccgtaccagagggggcaacatcaagtaccgtgccctcagaattgacactggcaatttcgcttgggctagcgaaggtactgccaggaaaactcgtattatcgacgttgtatacaatgctagcaacaatgaattggttcgtaccaagactttggtgaaaaatgctattgttgttgttgacgccactccgttcaggcaatggtatgagacgcactatattttgcctttgggtagaaagaagggagctaaactgacagcagaagaagaggcaattttgacaaaaaagaggagcaaaaaagtccaaaagaaatacgaaaacagacagaaaatcgccaaggttgaacctgcgatagaagaacaatttcagactggtagattgttggcttgtctagcctcaagaccaggacagtgcggtcgagccgacggttacatcttggaaggcaaagaattagaattctatatgagaaaaattaagtctaagaaagcaaaatga

SEQ ID NO: 1289 - DNA, 936 bp, Ceutorhynchus assimilis
atggatagactattaagattgggcggcggtatgccgggattgagccaggcaccccctccgaatgatgcccctgtggtagacacagcagaacaagtttacatttcctcgttggcccttttaaaaatgctcaaacacggtcgagcaggtgtgcctatggaagttatgggtctcatgctgggcgaatttgtagatgactacactgtaagggttatagatgtgtttgctatgccccaaaccggtaccggtgtcagtgtagaagccgtagatccagtatttcaagcaaaaatgttggacatgctgcgccaaactggaaggcctgaaatggtggtgggctggtaccactcgcatcccggttttggttgttggctttcaggagtcgacatcaacactcaacagtcttttgaggctttgtctgaaagagctgttgctgttgtagtcgatcccattcagtctgttaaagggaaagttgttattgatgctttcaggttgattaacccaaatatgatggttttgggccaagaacctcgccaaacgacctccaatttgggacaccttcaaaaaccttcagtgcaagctctcattcacggcctgaacaggcattactactcgattagcataaactacaggaaaaacgagctggaacaaaaaatgctgctcaatttgcacaaaaaatcttggatggacggcctcatgttggctgactattcagaaaactgtagtaccaatgaaaaaactgttgctgaaatgttggaattagccaagaattataacaaagctcttgaagatgaagagaaaatgactccggaacagttggccatcaaaaatgtgggcaaacaagatccaaagaggcatttggaagaaaaagtcgatgtgctgatgaccaacaatattgtacagtgtttgggtgctatgctagatactgtggtctttaaataa

SEQ ID NO: 1290 - DNA, 1215 bp, Ceutorhynchus assimilis
atgacggttataaataagatggagattgatggtggttcaaaaggcgaaggtttccgatcctactacatcaccaaaatcgaagaactacagcttgttgtagctgaaaaaagtcaaaatttgaggcgtctacaagctcaaagaaacgaactaaatgccaaagtccgtatgcttagagaagaactcatgctgttgcaagaacaaggcagctacgtgggcgaagtagtcaaaccaatggacaagaaaaaagtcctggtcaaagtccaccctgaaggaaaattcgtagtcgatattgacaaaaacatcgacatcaatgacgtcactcctaattgcagagtggctttgagaaacgaaagttacactctacataaaatacttcccaacaaggttgatccattggtctctcttatgatggtggaaaaagtgccagattccacttacgaaatggtgggtggtttggacaaacaaatcaaggaaatcaaagaggttattgaattgcctgttaaacatccagaattgtttgatgctcttggtattgctcaaccaaaaggcgttttgctttatggtccacctggaactggtaaaactcttctagcaagagctgtagcccatcacactgaatgcacttttattcgtgtgtctggttctgagctggtacaaaaattcattggagaaggatccagaatggtgcgagaattgttcgttatggctcgagaacacgccccctctatcatttttatggacgaaatcgattctattggatcgtctcgtatcgagtctggttcaggaggtgactcagaagtccaaagaactatgttggaattgctgaatcaactggacggttttgaggcaactaaaaacatcaaagtcattatggcgactaatcgtatcgatattctggatccggccttgttgagacccggtcgtattgataggaaaatcgaatttccaccaccgaatgaagaagcccgtttggacattttaaaaattcattcacgcaagatgaatttgacaagaggtattaatctgaggaaaattgctgagctaatgccaggggctagtggagctgaagtcaagggtgtttgtactgaagctggaatgtacgctctgagagaaagaagagtccacgtgacccaagaagattttgaaatggcagtagccaaagttatgcaaaaagattcagagaaaaacatgtccatcaaaaagttgtggaaataa

SEQ ID NO: 1291 - DNA, 600 bp, Ceutorhynchus assimilis
atggtgaaactctattgcattagcattctttacaaaggccctacatcggcgacatggttaaaatcagcctatgacctacaaagttttagctactttcaaagaggctctgtgcaagaattcatgttgttttgtgctaaaaccattgctgaaaggacaataccagcttcgaggcaatctgtaaaagaaggcgaatacttttgtcatgtgtatgtaagagctgacaacttagcaggagttattatttcagaccaagagtatccttcaagagtatctcatacgttgctcaccaaaatcctcgatgattttgctgataaaatcccttctaccagttggcctaatttacaagaaagagatgtggcttttccgcaaataaatacctatttagcaaaataccagaagccagccgaggcagatatattgacaaaaatccaaggagaattggatgaaactaaaattatattgcacaataacattgcagctgttttggataggggcgaaaagttggacgacctagtttccaagtctgaaggtttgagtatacaatcgaaagctttttataaaactgcaaggaaaactaatgcttgctgtagtttttcttaa

SEQ ID NO: 1292 - DNA, 771 bp, Ceutorhynchus assimilis
atgtttctcacaagaagcgaatacgaccgtggagtgaacaccttttccccagaaggacgcttatttcaagtagaatatgccattgaagctattaaattaggttccactgctataggaatatctacaagccaaggggtagtacttgctgttgaaaaacgtatcacttcacagcttatggaaccaacgactattgaaaagattgtagaagtcgataagcatatcggttgtgctgtatctggcctcattgccgattccagaactatgattgatagggctcgcatcgaatgccagaaccactggtttgtctacaatgaaaatatgactgtcgagtcatgtgctcaagcagtatccaacttggccattcagtttggagattcggatgatgatggggcagctatgtctaggccttttggtgtagcaattttatttgctggtatcgatgaaaaaggtccccaactttatcatatggatccatctggtacttttgttcaatttgatgccaaagctattggttctggctcagaaggtgcccaacagagtctgcaagaagtctaccataagagtatgacgctagaagaagccaccacttcggcactgacaatcttaaaacaagttatggaagaaaaattgaactcgtcaaatgttgaagtgatgactatgactcctgataagctgttccatatgttttctaaagatcaagtagaagaggctctgactcgtggacttcttgtagaacatcctgtaaccttaactgttggacagaaagcctaa

SEQ ID NO: 1293 - DNA, 1161 bp, Ceutorhynchus assimilis
atgacggaatactggctgatatctgctccgggtgacaaaacctgccagcaaacatgggaaactatgaacaatatgacctccaagcaaaactccttgtgcaccaattacaagttccacattccagatcttaaggttggtaccctggatcaactggtaggtctatctgatgatttgggcaagctggacgggtttgttgagcaagtcactcgcaaagtggcttcttacctcggtgaagtactggaagaccagcgggacaagctacaagaaaacttgatggccaataacactgatcttccgagttatttgaccaggttccagtgggatatcgccaagtatcctatcaagcaatcgctgaggaacattgctgacattatcagcaagcaagtcggtcaaatcgatgccgatttgaagaccaagtcgacggcctacaataatttgaagggcagcttgcagagtttggagaaaaaacaaactggaagtttgttaacaagaaatctggccgatcttgtgaaaaaggagcatttcatcttggactctgactacttgcaaacattgcttgtaattgttcccaaggctcaggtccatgaatggaacgcgacctacgaaaaaatcactgacatgatcgtgccaagatcgtctcagatggttactcaggataacgaatacggcctattcactgttacactgttcaaaaaagtcatggacgaattcaagcatcatgccagagaaaagcgattcattgtaagagacttcacttatgatgaagagcaattggccgcgggcaaaaacgaaattaccaaattggccacggacaaaaagaagcagttcggaccgttggtcagatggttgaaagtcaatttcagtgagtgcttctgcgcatggatccatgtcaaagcccttagagtatttgttgaatccgtattgagatacggtttgccagtcaatttccaagcaatcctcattcatcccaataagaagtcaatgaaacgtcttagagatgttttgaaccagctttatggacatttggatggtagtgtgggacatcaaggttccaatgttgataacgttgacattcctggtcttggtttcggccaatccgaatactacccgtacgtctcctacaaaataaacgtggagatgattgaaagcaaaaccctctaa

SEQ ID NO: 1294 - DNA, 1674 bp, Ceutorhynchus assimilis
atgtcgattttagcgagccccttatctgtggcgggccagagaacatccggggccccagtccgaacccaaaacgttatggctgctgctgcaattgccaacatagtgaaaagctcgctaggtcctgtaggactggacaaaatgttggtagacgatatcggcgatgtgacagtcaccaacgatggagccaccatcttgaaactgttagaagtcgaacatcccgctgccaggatcttggttgagctggctcaacttcaagacgaagaagtcggagatggaaccacatctgttgttattatcgctgctgaattactaaagaatgccgatgaattggtgaagcaaaaaattcatccaacttctattatcagcggttacaggttggcttgtaaagaagcctgcagatatattcaagatcatttaactattcctgtagaggatttgggaaaggaatatattatcaatgttgccaagacttctatgagttctaagattattggagctgatgcagatttattctctgcaatggttgttgatgcagcatatgcagttaaagttacagatgttaaaggtaaccctctatatccaattaaggctgtgaacgtacttaaagcccatggacgaagtgctagagaaagtaccttaatccaaggttacgccctaaactgtacagtagccagccaggcgatgcccaaaaaaattgttggcgccaaaatcgcctgtctcgatttttctttgcaaaaagctaaaatgaagatgggagtccaagtactcatcaacgaccctgacaagctcgaagctgtccgtgctcgcgaactagacataaccaaagagagaatccaaaaagtcttgtccaccggggttaatgtgattttgtgctcgggaggtatcgatgatttgtgtttgaaatatttcgtcgaggctggagctatgggagtgaggagagtcaagagggtcgacttgaagcgtatcgctaaagctactggggccacgtttttgacttctctgtcaaacatggatggtgaggaatcatttgatgccaatatggttggagaggcagctgaagttttgcaagaaagaatctcagatgatgaattgattattattaaaaacccaaaacaacgtactgcagcttcaataatcctacgtggaccaaatgatttttattgtgacgaaatggaacgttccgtacatgatgctctgagtgtcgtcaaacgagtcttggagtcaaaaagcgttgtagtaggaggtggcgctgttgaagcagctctgtcaatatacttggaaaactttgcaacaactctcagcagcagagaacaattggccatagccgaattcgctaggactcttttagtaattcccaaaactttagctgtaaatgctgctaaagatgccacagatttagtggctaagcttagggcttatcacaattcaagccagactaagttggaacacgcagatcttaaatttgtcggcttagatcttattgaaggtacagtaaaagacaaccggaaagctggagttttggaacccacagtttcgaaaattaaatctttgaagtttgctacggaagctgcaattactattctgaggatagacgatatgattaaattggatgctcaggaaaaaggaggcaggagctaccaagaagcctatcagtcaggacaactctatgattga

SEQ ID NO: 1295 - DNA, 765 bp, Ceutorhynchus assimilis
atgtttagtgcaccaccgttctggcaaaacggccccgctccgggcagtttttacgatttccctaacatgcagccccaagtacaacccaacgatttcaggcaacacactcaatctccagtgacaacatctacttctctagtagctgtcacttacgataaaggcatcattatcgctggtgatcttttagcttcatacggttcactagccagatacagaaattgcccaagaatcgttaaagtgaacaacaacataattttgggctccagtggcgattatgccgatttccaatacgttcaaaattttattgaacaaaaagtgataagtgatgaatgtttggatgacggtatcaccctcaaaccgaaatctctctactgctggttgaccagaatcctatacaacagaagaagcaaaatggatccactttggaataattttattgttgccggaattcaagacggagagcctttcttaggcacggtcgacaaacaaggcactgcgtactctgacaaaattatttgcactggctacggtgctcatattgccactcctatgctcagagacgctctggataataaacctcaactcacgcaagctgaagctagagctcaagttgaaagatgcatggaagttttgtactatcgtgatgctagaagttttcctaagtatcaattggggattattgatgctgatcaaggtgttagtattgaagggcctttgcaagtggcacagaattggtccgtggctcattctattaaaggatattaa

SEQ ID NO: 1296 - DNA, 2049 bp, Ceutorhynchus assimilis
atggatattcctaaagaaccaaatttctcattactaagttcccaggacttcgcccctgaaaaatacgtgcgagacatttcccaaaactacgtgggcggtctggaactgcaaaacatcaaaaagaaaatccaggcgttggctgacgaaaccagcaacaacttgaagaaaaacgtctaccaaaattacgtgcaattcatcgaaactgccaaagaaatatcgcacttagaaagtgaaatgtatcaactttctcacttgttgtcagagcaaaaagggttgcttacagctctgagtacttcgtctattttagaagacaacagggctcattttgatgttagaaatgaaaaattagacgaacaagagcttgaggaggaaaacaagcaaaaactggcaacaattttggataaggttgagaactgtaaagaagtagttgaagctccggatagatttttattgttcgaaggagatttgcttgaaatagacgcaacagagaatacagcaatcaaatttgtacatgtttatttgtttaatgacagtttaatgctaacaaacagaaattctaatagtagaggcttgatgcgatacgcctttgaaagcttatacgaacttagtagcttggctgtggttaatgtacgagatttaggcaacattaaacacgcattcaagttgcttatatttccagatacacgagtattccaatgttcatctaatgctagtaaaaaagagtggctggataagattgatcaagccaaaaaaacccgcttggtgcaagagcaacaaaaacgcgaatcctctttggaaaaaatctcccctgcccgttccatttcagttgacttaaacatcaacagccagcctgaagaaatattcacccatcccgattggtttttggacatccctgacgaactagacgtttgcatcgcccaaagacaattcgaagacgctgtcaaccacataaacaaatcaaaaacctacataaacaaacacccagaatatgtgggagcaattcagaaaaaaatcgaccaaaaacaaaacaccctagttgaaatgctaatgaaagagcttgaagttaatcctgaaaaatccttgcaaggtggtttaagagctactagaacagctgtcagattgttgaaccaattaggtcgctccacccaatcatgtgacttatttttaaagctttgctctagcatgttaaaaatccaatgcaaacgagtgaaaagagagggctccactagcacatacgtgcgtcatctatcaagcgtagtcttcaccaacatgtgtcacatgtcagaagagtttctaagggcctttccagactcttgtgcaaactgcgcatctgcttatgtagtctgggcaagtggggaattatctttatttactactcattttgccaagcaagtttttatgccgcaaacatctttgtctaccattacggagtgtgtggttttggtgaggtcgcagtgcgagcgtttatgcacttatggagtagattttcgatatcaattggacggggcccttagggctccgctaagtaaagcccttaatgacgcaagagataagtttgtcgattcgattaagttgagagcgatagatgaaaagtggattcctgtcaatttgaatacgagaagtggattagcaaggtgtcttcaagaatatgcagttttaggcctgaaactcgacacctacgtcaccggagatgtttggctccaattaacctcaagcaatttggcttttaccaaatccttcctaattctattggacgattgcctcaaactaaaaaccacagaacttttacactctattgatgaaactctagcaaaatgttttgaggcccaattacggtacaacgagcaaggcctcaaaaacgaagaccaaaaacagtttattttgaagaatttcgaatttttactggtggttttggtgcagcttacgcaaactaaatacaaggaggcaactgggtatgagtgtgacaacttaaacaaattggttaatgattatttgagtttattgaaggcgagaagcactaaaacaaaatattcttctgaatttttgtaa

SEQ ID NO: 1297 - DNA, 3675 bp, Ceutorhynchus assimilis
atggataaaatggatgaagtagagaagttggaatatttatctttagtgtcaaaaatatgtacagaattggaaaatcatttgggggccagtgacaaagatttagctgaatttatcatacatttatcagagaaaaacaacaccaatgattcattcaagaaagccctcattgaagctggtgcagaattcgcagattcatttatatccaatttgttgagaataatacagcatatgagacctagaaaagaccagtcaaaggatgaaattgttcaagaggaaaaaagtgaacttgcacagaaatttccaggtttagctataccaaatgagcctcagaaacctttgggtgatgatgaaaatattgattcaaaattagaaaattctaataaagctaaaaaacaggataatgatgttgtagcagatcttatggcacaatttgaagctgaggcaccatctgctagtaccaattccaaaactgaaaaatcaagaaaaaggtctagatcaagaaaccgatccagatcaaagaacagatccagatctagggaacgtaggcgcgacagatctcgtgatgacaaaaaaggtagatacagggacaggtcaagggatcgtcatcgagaaagagatcgtgaccgtgagcgtgatactgaaagaagaagagaaaggcacagaagcagatctagggagagacgaagatcaagagacagaagggacagaagtcggtctagaagtagaaccaggagaggcagagaggatgattttgataaaaaaaataaatttgataagggtagtgtggaacttgacgaagatcccgtggtaggcaaagtttacaacgctaaagtagcaaatattgtcccttttggttgttttgtgcaacttgaaggcttgaaacgtagatgggaaggactagttcacatttcccaattgaggggtgaaggtcgagtcacgcaggtgtcagaagttgtttctcgggggaataaagtgaaggtaaaagttttatcagttactggacaaaaggtatctttgtctatgaaagatgttgatcaattgactggaaaagatctaaatccgttgcacgctccacaagaaagagaagacaaagacagaaatccagaccggccaacttataatagcacatcagttctcaaacttgctctgcctttggaggaaaatgaagacggtactagaaagagggttacacgaatatcgagtccagaaagatgggaaatcaatcagatgattgcctctggaagtatcgacaaaagcgaactgccagactttgatgatgaaaccggtcttttaccgaaagatgaagaggatggggaagcagatattgaaattgaacttgtagaagatgagcctccttttcttcacggccacggacgggccttaaatgatttaagtcctgtgagaattgtgaaaaatcctgatggatcgttagctcaggctgcaatgatgcagtcggctttggcgaaagaacgaagagaacacaagatgcttcaaagggaggccgaagtggattcacagccgtctggaaaaagcaaatcatggattgatccactacctgatgaggaaaataaaccagcagcacctagaggtataggtttacaatctcaagacttacccgaatggaagaagcatgtaattggtggtaaaaaatcttcatttggtaaaaagacaaatctcactattctagaacaaagaaaatcgctgcctatctataaactaaaagaagaattacgcaaggccgtcacagataaccaaattctaatcgttatcggagaaacgggttcaggaaaaaccacccaaattacacaatatttggccgaggagggtttcacagctagaggaagaatcggatgtactcaacctcgtcgtgtagccgctatgtcagtggctaaaagagttgcagaagaatacggttgcaggttaggacaagaagttggatataccattcgattcgaagattgtaccagtcctgaaactattataaagtacatgactgacggtatgttactccgtgaatgtctgatggatttagacctcaaaggatattcagtcattatgttggatgaagctcacgaaagaactattcacactgacgttctattcggccttctaaaacaagcagttaccaaacggtccgaactcaaacttatagtcacttctgctactttggatgctgtaaagttttctcaatatttctttgaagctcctatttttacaataccaggaaggacgtttcctgtcgaagttttatatacaaaagagcctgagactgactatttagatgccagtttgataacagtaatgcaaatacatcttagagaacctccaggagatattttgctctttttaactggtcaagaagaaatcgatactgcttgtgagatcttatatgaaagaatgaagtccttaggtcccgaagttcctgaacttattattctgcctgtttactctgcactaccatcagaaatgcagacccgtatttttgagccagcgccacctggtagccgaaaagtcgtaatagcaacaaatattgcagaaacctctttgacaattgacggaattttttatgtagtagaccctggatttgttaagcaaaaagtttataattcaaagacgggtatggattcgttggtagttactcctatatctcaggcacaggcaaaacagcgagctggcagagcaggtcgtacaggtcccggaaaaacttacagactgtatacagagcgcgcatatagagatgaaatgttgcctactccagtgccagaaattcaacgaacaaatttggcaacgacggtgcttcagttgaaaactatgggtataaatgatttacttcacttcgatttcatggatgctccacctgtagaatcacttatcatggcattggagcaattgcattcactttcagcacttgatgacgaaggtttacttacaagacttgggagaaggatggcagaatttcctctagaaccaaacttgtctaaaatgctaatcatgtcagtagctcttcaatgttccgacgaaatcctaactattgtcagcatgctatcagtacaaaacgtgttctacaggcccaaagacaaacaagcagtcgccgatcagaaaaaggcgaaatttaaccaaccagaaggtgaccatttgactttattagctgtctacaatagctggaaaaataataaattctcaaatgcctggtgctacgaaaacttcgttcaaattagaactctaaaaagggcgcaggatgttagaaaacaattacttggtatcatggacaggcataaattggacgtagtttctgccgagaaaaacacggtccgagttcagaaggcggtatgttcgggatttttcagaaacgctggtaaaaaggatccgcaagaaggatatcgtactttggttgacagtcaagttgtttatattcatccgtctagtgctctcttcaatcgacaaccagagtgggttatttaccatgaactggtatgtaccactaaagaatacatgagagaagtgactacaatcgatcctaaatggttagtggaatttgctcctgcgttcttcaaattttcggatcctacgaaactgagcaaattcaaaaagaaccaacgtttggaaccgctttataataaatatgaagaaccaaacgcttggaggatttccagagtcagaagacgacggaattag

SEQ ID NO: 1298 - DNA, 1266 bp, Ceutorhynchus assimilis
atggccccacatcgaagaaatatcgacgatgtgttggctcgtatcaatttcccgttgtttacattacaaatgctcacaaatagacatgttttagttggaggtggcggaggttcttcaaaaacaggggtcgcaaatggctttgaaatatttgaattatcacatgatggcaaaaagttccacgttgaagaagtaactagacatgaaacaggtcctaacgtagtaatgaactgttcagtttcaagttcgcctgataaaaaacatacttatttagttgctggccaagaaagccactgccaattgtatcatgttaatacagattttgccgctcaactaaatggaagtgtagaaacgataggtaacaatcatgaagatactggagagcttaggcaaagaaaaaacaagactaataataacaaaaacacgaaaaaaaggctaaagtttgtcctcagtcctggcgatagtgttcaaactgattttaatggtactgaacctttatgcagggttgtaaggctgcatccaaatggaaaacttatggcgagtggtggaacagatggtgatattcgtatgtggaaattccctggcctcgaaccattagcaaaactaaaggcccacactaaagaaatagacgatatagactttagttcttttggcaaccttctcatcacaatagctaaagatggcctggcagttttgtgggattgtgttaaaggtactgaaattaaaaggctcaagtgggagcagcctcaaggatcaaagtatttatacaaaagatgcagatttggatcaattgaaggccaacaaaaatcggctttgtatatgttagctaatcccacaggagtggctaaaaggcagaaatcctatctgcaacaatggtatccagaggaaggtattctaaaaagagtaacagaatttgatgaaagtttatctgccttggcagtcagagatgatggtagattcatagctgtaggtacaatgtttagcggatctgtatctatacatgtagcatttagtttgcagcgcgttttaaatgtagcgggtgcacattccatgtttgtaacaggcctagaatttctcccagtgtccaatccagaaaaccacacagtgtgtagtgtggcagaagcggccgtactctcaatatcagtagataatcaagtttgtatacacaccttgccctacagaaaatctattcccctatggttggctatagtaattttaatatttgccatgttcttgacatttgtattttgctcatatataggtttgtag

SEQ ID NO: 1299 - DNA, 1224 bp, Ceutorhynchus assimilis
atgtccggggctaccttattcgaacgaccagggtccgagttgtttaaacacaaagaaaacgacgagaatgacgaaagaaacatccagaacaaggagcaggacatcctcaacctcggcgaaaagtacaagaacgagggcaaggccaaagaactggccgatttgatcaaacaaacgcgcccctttctgagcgaaatcagcaaagcgaaagcggcaaaactcgtccgatctctcatcgatttctatttggatcttgaagctggcaccggtctagaagtacaactctgtaaagaatgcatcgagtgggccaaagaagaaaaacgaacctttcttcgccagtctttggaagccaggttagttgcactgtatttcgacactggcatgttcagtgaagccctacagcttggttctactttactgtgggagctgaagaagttggacgacaaaaatttacttgtagaagtgcagctactagaaagtaaaatttatcatgcattgagtaatcttcctaaagccagagccgctttgacttcagcccgtacaactgccaacacaatttattgtcccccaaaaatccaagcctctttagatcttcaatcaggcatattacacgcagcagatgagaaagatttcaaaacagcttattcatacttttatgaggcatttgaaggtttcgacagtgtagaatcatcaaaagcactaacagctttgaaatatatgcttttatcaaaaattatgctaaatcattctgaagatgttcagcaaattgtcagcgaaaaattggccatcaaatacgcaggcagggatattgatgcaatgaaagctgtggctcaagcttcccataaaagatctttggctgatttccaagtggcactcaaacaatacaaagcagaactcgaagacgacgtcatagttagggctcatttggacactttatatgataacatgttggaacaaaacctactgagaattatagagccttacagtagagtccaagttgattatatagcaaaggctataaaactgtccatggcacaagttgaacaaaaattgtcacaaattatcttagatgggaaatttgatgggattttggatcaaggcgaaggtgttctaattgtgtttgacgaagccccagtagataaatcatatgaaatggcattagaaactattcacaatatgagcaaagttgtagatacgctttatcaaaaagctaaaaagctattatag

SEQ ID NO: 1300 - DNA, 1770 bp, Ceutorhynchus assimilis
atggctaccagagcgaaaaagtcggcgacgccgggttcgcagcctccgccgcgggctcagagtcctttgagccccaccagacattccagattgcaggaaaaacacgatttacaaaacctgaacgatcggttggctacttacattgaaaaagtcaggtttctggagaatgaaaacctaaaactaacaaaagaagtccaatgtcaccaggaaacaagccaacgcgaagtgtcccatatcaagtccatgtacgatcatgaactgggcgaggctcgcagattactggacgctactcacagtgaaaaatccagactcgaaatcgacttgaaacgagtgctggaggaaaacgacgaccttaaagctgacttggccaaaaaaacaaaagaccttgtagttgctgaaaatgctgccagggtttacgagacccggtgcaacgatttgcagttgaaatacacccaggccaatgctgacgccaagaaggctatcggggatcttaaggatttggaaaaggagagggacaagttgaagaagatgctggatgagcacagaaaacagttggaggaggaaagtttggctagggtcgatgttgaaaatgctaatcagactttgagagaggaattgtcgttcaaggatcaggtattccaacaacaactgacggaaacccgcactcgtcgtcaagtcgagatcaccgaaatcgatggacaattggccgaacaatatgaggccaagctccaacaggctctacaagatctcagagaccaatatgaagctcaaataaccaacaacagagccgagatcgaaaatatgtatgatagcaagattaagagtcttcaaacggccgctaatagacactctgcagccgctgccaatgctttggacgaagctcgtcaagttcgtaccagaatcgacactctatccagccgagtcacacagttggaaaatgaaaacggcgcattagtggccagatcaagagatcttgaaaaaatattggagcacgaacgtttgagacacgccgaagaactggcagccttggaaggcgaactgtccaggatgagagaagagatgaacgttcaactgcaagagtaccaagaccttatggacattaaggtgtctctagatttggaaattgcggcctacaggaaactattggaatctgaagaggacagattgaaaatcactccagcaggacaagaacgcgatgtttctcactcgagcagtcgcagtttggcacaacgttacactccaagccgtcacaacacgaaacggaagcgctttctgatggaagaaagtcaagattccagcctatcagacttcagcgttaccacttcttgcaagggcgacattgaaattctggaagccgaccctgagggtagatttgtgaaattagttaacaagagcaatcaagaagtttcacttggtggttggcaattacttcgtaaagctggcactgaggagaccaagttcaaattcaaccgatctttgaaacttgaaggcaaaggcaccgtaactgtttggtcggctgatttgaataaagaccatgaaccaccacataatcttgtaatgaaaggccaaaaatggctggttggagataatatgactactgtgctggtgaatttggatggggaggaagttgcaacatcagaaaggatcaaaactcaagtgtccacttctcacttgagacacagagaatcggcgggggggtttatagaaggtgaagatctccatcagcacgtgggtgacccccaaggcgacgaaaagtgtcgactgatgtga

SEQ ID NO: 1301 - DNA, 2427 bp, Ceutorhynchus assimilis
atggctgatcagcagaatgatgatttggcaactgccatcctccgcaaaaaagacaggccaaacagactcatcgtcgaggaagccgtcaacgatgacaactccgttgtcgctctatctcaagccaaaatggacgagctgcagcttttccgtggcgacactgttcttttgaaaggtaaaagacgcaaagagactgtctgtattgtcttatctgatgacacatgcagcgacgaaaaaattaggatgaatcgaaacgttagaaacaacttgcgggtcaggttgtctgacgtagtctcaattcaaccttgtcctgatgttaaatatggcaaaagaattcacgttctccccatagatgattctgttgaaggtctcaccggcaacctctttgaagtgtatttgaaaccatacttccttgaagcttacagaccaattcacaaagacgacgtttttatcgtcagaggaggcatgcgtgctgtggaatttaaagttgtagagacggatcctgctccattttgtatagttgctcctgacactgttattcattgtgatggagatcctattaaacgtgaagaagaggaggaagctttgaatgctgtgggttatgatgatatcggaggctgcagaaagcaactggcacaaatcaaggagatggttgagttgcctttgaggcatccatcattgttcaaagctattggagttaagcctccaagaggaatcttgttgtatgggcccccaggtacaggaaagacattgattgctagggctgtggctaatgaaactggtgcctttttctttttgattaacggtcccgaaattatgagcaaattggctggcgaatctgaaagtaatttgcgtaaggccttcgaagaggcagataaaaattctcctgctattatatttattgatgaattggatgccattgccccaaaaagagaaaaaacccatggagaagtggagagacgtatcgtttctcaacttttaactttgatggacggcatgaaaaaatcctctcacgtaattgtaatggctgctaccaacagacccaactcaatagacgctgctctacgtcgtttcggacgtttcgacagggaaatcgacattggcatcccagacgccactggccgtttggaaatcctccgtatccacacaaaaaacatgaaattggccgacgacgttgatttggaacagattgctgctgaaactcacggacatgttggtgccgatctcgcttcgctttgctctgaagccgctctgcaacagatccgtgaaaagatggatttgattgatttggaagatgaccaaatcgatgctgaggttctcaatagtttggctgttacgatggagaacttccgttatgctatgacaaagagtagtccaagtgctctaagagaaactgttgttgaagttcccaacgtcacatgggaagatattggaggtttggccaatgtcaaaaacgaattgcaagaattggtacagtacccagtggagcatcccgacaagtttctcaaatttggtatgcaaccctcaagaggagtactcttctacggtccgcctggttgcggtaaaactctcttggccaaagctatcgccaacgaatgtcaagcgaacttcatttctgtcaaaggtcctgaactattgaccatgtggtttggtgaatctgaagctaatgttagggatatattcgataaggctagatcagcagctccttgtgtcctattctttgacgaattggattccatcgcaaagtcaagaggtggcaacgtcggtgacgcaggtggcgccgcagaccgtgttatcaatcaaattctaaccgaaatggacggtatgggcgccaaaaagaacgttttcatcatcggtgctaccaacagacctgatattatcgatcctgcaatcttacgtcctggccgtctggatcagctgatctacatccccttgcccgacgaaaaatcacgcgaacagatcttcaaagctaacttgcgcaaatcgccagtagccaaagatgttgatatggtttatattgctaaagttactcacggattttctggagccgatttgacggaaatttgccagagggcttgcaagttggctattagacaatctatcgaagctgagataagaagagaaagggagcgcgctgctaatcctgctgccgctgctgctatggacttggacgaagacgatccagttcccgaaatcactagagctcactttgaagaagccatgcgattcgcacgtcgttcagtgtctgataatgacattcgcaaatacgaaatgtttgcccaaactttgcaacaatctagaggttttggtactaacttcaggttcccatcgagtcaaggtgcgcctgctcaaggtggtcaggtaccacctcctgtcgcgccaggcgatcaggccaactttgacgatcctgaagacgatttatatagttag

SEQ ID NO: 1302 - DNA, 825 bp, Ceutorhynchus assimilis
atgggagatcaatttgattgcgccctggatttgatgaggcggttgcctcctcagcaaatcgagaaaaatctgagcgacctcatcgatttggtacccagtttgtgcgaggatctcttgtcttcggtcgatcagcctttgaaaatcgccaaagacaaggaaactggcaaggattacgttttgtgcgactacaatcgagatggtgactcgtacagatctccttggtccaacacctactaccccccactggacgacggccagatgccttcagaaagactacgcaagttagaactggacgcaaaccacgcctttgaccaatacagagaaatgtactttgaaggaggcgtgagctcagtctacttttgggacttggatcacggatttgctggtgtaattctgattaaaaaaatcggggatggttctagaaaaatcaaaggttgctgggactctttacatgtggttgaggtgcaagagaaaagctcgggcaggaactcgcactacaaaatgacttccactgccatgctgtggctgcaaaccaatgaaacaggttcaggcactatgaatttgggtggtagtttgaccaggcaaattgagcaggactctgcagtcaacgagaataatcctcatattgctaatattggcaggatggttgaagatatggagaataaaataagaaatacgctcaatgagatttattttagcaaaactaaggacattgttaatagtttaagatcggtccagcctttaactgagagtagacaaaaggaaattttaaagcaagacttggctgcagctttacaaaaaaggcacaacaagtcggataattga

SEQ ID NO: 1303 - DNA, 3996 bp, Ceutorhynchus assimilis
atgcaacaagttgaggctgcagctcagaataataatactggtaaaatgaacgagcaagcctcggcaggcaacggggcggccgcggtgcccgcccagtccgccaccccatccaatgctatcgcccgggacaatcgcgaacctccgcccagaaacgaaccgccagttgaacctgtcgatggggtggttcaacctaacgtcataccacaagcagataggcctggtagggtaacaaatcagttgcagttcttgcaaaaaacagtactgaaagctgtttggaagcatcaatttgcttggccctttcaacaacctgtagatgctaaaaaattaaatttaccagactaccataaaataattaaacaacccatggacctaggaacgataaaaaaacgcctggataatatttactattggtcaggaaaagaatgtattcaagacttcaatacaatgtttacaaattgttatgtgtataataaacccggtgaagatgtagtagtaatggcacaaactctagaaaaggtattcctgaccaaagtggcagacatgccaaaagaagaaataattgtagagtcccaaatgaaaagtgcaaaaggtaaaaaaggccgggccagttcagtaggtgctaccaccccaaccgctaccattattggaacaccttcaagaggtagacctccagtgactgtatcatcaacagtatcaaatccatttgctacaactacaggctctatgggtttacctctcggcactgccgcccctgctacagttccaggcagtaccgccacaacgacgatagcgccccctatcaatgttaactcccaagcgacacccataattccagctccaacctacgcccctccacctcttgacccgacgcccgtaacggcgctgggtgtcgtacctcctgcgcaacctgccaaaagtaaaaagggcgttaaaagaaaggccgatactaccacacctgcgacagcttatgattatttaccttcaggtgccgattcaaattcatcctcgtccgctagtaagatctctaagaggcgggaatcgggacgacaaattaagaagcctcttcgtagtcaagaattagatggattaggtccatatagtggtggaccggcaggtataccctcaccaggtagccaagcggcgctcgccctaaagtccaaagaaaaactgaacgacactttaaaagcctgcaacgagatactaaaagaactattttcgaaaaaacactgcagttatgcgtggcccttttacaaaccggtggacgcggacttgttgggcttgcacgactaccacgacattatcaagaaacccatggatttgggcacggtgaaacggaaaatggacagtcgcgagtaccggtcggcgcaagagtttgccgaagacgtccggctgattttcaccaattgttacaagtacaatccttcggatcatgatgtggttgcgatggcgcgcaaattacaggacgtatttgaagtcaaatttgcaaaaatccctgacgaacccttaaataggataagtggtatggttcctaatgagtcgagttcgtccggttcaagttcagaaagttcgagcgaaacggaagattctgaagaggaacgacgaaacaagcaattgaaacaacttgaaaaagaactaacagcaatgcaagagagaatgcgaaaattggtggaagaaagtacgaaacgtaaaaaagaaaagaaaaaacaaaaaatgaaagacaaaccgaaaaagaattcagtacaagcgctggcccttcccaacagtactggtccccgaggtccaaaaccgggagcaggggcgccaggagtgaacgcgggcgggccggcgggcaaacgcgcgaaagcgggcagaggagcgggagcgggcggggcgggtccgggtcgcaaaaaagcgcagccagtgtccgtggtaccggcgttcgattcagaggacgaggacagcgccaagccgatgtcctacgacgagaaacgtcaactgtcgctggacatcaacaaactaccaggcgacaaactaggtcgagtcgtgcacataatccagtccagggagccgtcgttgagggactcgaatccggacgagatcgagatagacttcgaaacgttgaaaccgtcaacgttgagagaactggaaagttacgtcgcgtcgtgtctcagaaaaaagccacgtaagccctactacaaaaagttaccgggcaaatcaaaagaggaacaaatcgcagagaaaaaaaaggaactcgaggaccgactactcgacgtaaatcataaaatcggacccaccaaaaaggcgcctaaaaaagatgcaaaatctgatcctacaggagcaggtgcaggacacatgtcatcgtccagctccagttcggacagtgacagttcgacgtcgtccatgagcagcagctcgagcgattccagcgacagcgaagcaggtgcctcggcagccaggcaggcgaaaaagcctaaaatcgcgaatcccaaaaagtcgcccaacccttcggtgaatcacaacaatggtggtgcacctctcacagtgcctccaacaatcatccaagtgccacaactacaacaaaaacaatcgccccaaccaccagtcgtggccacgcccataccgacaacggccacgcccactgtcaactcggtagtaccgacgccgccgatcactcccgttaacggcccttcgccgccaataaaacctgtggcggcgccacgtaagccttcgactagtgataagccaccaacgataccttcgcccgtaccggcccagccgccaaataccggcgggggtgtgactaaaatgggggtgggcgtggctgcgtcgccagacaagcccaaagtaccatctcccttgttgactaccgctgttcaacagcagtataccgatcctattgaggagagtttggccaatttggaacaggaaatgaagatagagcctattgataacgttattgctatgactactagtatagctcagccaaaacaacaacagatgccggccattaacgcgatggtccctcaacatcacttgtcaatgccacccaatcctctggcaagtctggaacttaaacagcccttaggattgccgcctacgatcggcggcatgccgccaaatcctttggcagtgccgcaacatcataatttgcacatggatcaggacatgcaaagcctgatgcatcagggtcactctcatccaggaattcacactcaaaacaacggctacagcataaaacacgagttcgactcttcaatgggcacaaacaataatggtatggctactttaggcctacccatggaaatgtctataccgtcaatgtttgaccccttgcctcagcacgtcaacaacatgcaaatgctcaaaaaagaaatgcctctaatgaaaaacgaaccccaagatgtgtacgataaaaaggctcaaatgcacgagcaacataaatctatgggggcgtttcctgggtataacaaggccaaaccggacgtgaaaaatgccagttcgtggagtagcttggcaaaggccagttcacctccaaacagcaattccggaaatagtagcaaacaacaaaacatgatgcaagtcatggacagttttaaggcattccaaaataaggcaaaagaaaaggccgatagggaaaagcaaaggctggaaacgttagaattaaagaggcaacaaaaagagcaagcagaacgagagaggatgaggcaagaaattgaacgaaggagagaggtggaagagcaagaagcattagaaaaagctaggcaagcggttgcggaacgagaaaaaccagtacaagcacaacgagttgaagagttgaggtcttcaccgggtgagggcagcacttcgccaggttccctcagttcgggttcggacaggatatcagacagagagaggcagaggctgcaggaacaagagagacgcaggagggaagtgatggcgaataaaatagacatgaacatgcaaagtgatttaatggcagcattcgaaggttcgttacagtgtctcagtcgcgattag

SEQ ID NO: 1304 - DNA, 1143 bp, Ceutorhynchus assimilis
atgtcgttatcgacaacgcgtccactcgtgagcgtctacaatgaaaagtctgaagaagtcaaagggtcgagcatcgctcttcccattgtcttcaaggccccaatcaggcctgatgtggtcaactttgtccatcagcaagtttccatgaaccgtcgtcaaccttacagcgtaagcgacacagcaggacatcaaacttctgctgaatcctggggtactggacgtgccgtcgcccgtattccccgtgttcgtggtggtggtacccatcgttccggacagggtgctttcggcaacatgtgtcgcggtggtcgtatgtttgctcccaccaaaccttggcgccgttggcaaagacgtgtaaacatcaatcagcgtcgttacgctttggcttcagctatcgctgctagtggcgtaccagctttagtcatgtccaaaggacatgttgttgatcaaatcccagaattgcctttggtagtctccgacaaagtccaggaattgaccaagaccaaacaggctgttcagtttttgaggcggatcaaggcttggccagacatccaaaaggtatacaaaagtcaacgtttccgcgctggtaaaggtaagatgcgtaacaggaggagaatccaacgtaaaggacctttggttgtctaccatcaagatcaaggtcttcgtagggctttccgtaacattcctggaatcgacctaatcagtgttgaaaaactcaatcttttgaaattggctcctggtggtcatgttggacgtttcatcatctggactgaatcagcttttggaaaattggacaaagtttttggcagcagctcagctcagaaaggcaacttgcctcaaaccaaaatggccaacaccgatctttcaagattgttgaaatctgatgaaatcaaggctgtattgaggaaaccacagaaaaagattgttcgtcgtgtacgtcgtctcaatccgttgaccaataccaaggctttggtcaggctcaatccattcgccgctgtattgaaaagggaggcaattttgtcgcaacaaaagagggcaaaattggctgcagcacctgcagtcaagaaggcgcctgtagccaagaaagcgcctgtagccaagaaagcgcctgcagccaagaaagcgcctgcagccaagaaggcataa

SEQ ID NO: 1305 - DNA, 5316 bp, Ceutorhynchus assimilis
atggctgatttcatcgattctgaagcggaagtaagcagcgaggaggaggaattggagcctcatgaacgtaaaaaactcaaaaaagtcaaggcaatggacgatagttctgaagaggaagaagatgatgatgatagactgagagaagatttgaaagacctcatcgatgataatccaatagatgaaagtgatggggaagattctgatgcttctgggcgtcagaaaaggaagaaatctgatgatgaagaagatttggatgacagactggaagatgaagattatgacttgttggaagaaaacttgggggttaaagtggaaagaagaaaattcaaaagactgagaagaattcaagacgaagaaagcgaaggagaagacgaaaacgacgctgaacaagacagagaacaaatcgctaacgatttattttctgaagatgaaagagatggaggaagtagaaaggatgatgaaagacattctgaacgcagtcacagaccaacagttgtcgatccagatcaatttgctgaagaagaagacgaaggcgaatactcagacgcagatgatttcatcgttgacgacgacggtaaaccaatagcccgaaaaaagaagaagcccatctttactgatgctgctttgcaagaggcccaagaaacctttggagtcgatttcgattatgatgaattttcgaaatatgatgaatacgatgatgaagaggaagatgaagaagatgaatatgaggaggacgaagaaggcgaaagaagacgccgccagaaaaaggcagccaaaaaacgcccaaccaaaaagtcaatatttgaaatctatgaaccgtctgagcttaaacgaggcttctttactgatttagataacgaaatccgtagtacagacatcccagaaagaatgcaacttagagatgtcccattaacaacagtgcctgatgattcaactgaattagacgatgaagccgaatggatctacaaacaagccttttgcaaaagcactgtatccaatatggacgtaaatctgactcaagaggctcgcgaaaaacaacgcaaaggccccctagctataggcaaaataagaaaagctttagaattcatgcgcaaccaacatcttgaagtacctttcatagccttctacagaaaagaatacgtacagcctgaactaaacataaacgatttatggaaagtttacaaatttgacgccaaatggtgccagctaaaaaccagaaaggaaaacttgttgaatctgtttgaaaaaatgcgctcctaccaaatggatcaggttatgaaagaccctgacgcacccttacccgataacttacgcataataaaagacaacgacatcgagcgcctaaaaaacgtccaaacagtcgaggaattaaacgatgtccataatcattttattttatattacgcaaacgatttgcctgcaatgcacgctgcctggcgtctaaaagaaaaagaacgcaaaaagcaactgagacgtgaagccagactaaaagctattgctgaagctgaagacggtgcagacatcccagaagaaatcccagacgaagaccaagacgatgaacccgaacctgaaacaatcaaatacgcaaacagatcaggttcgtattcattatgcagccgggcaggtttggaaagtttagccaaaagatttgggctttcgcctgaacattttgccgaaaacttacgggacaattaccaaagacacgacgtcgatcaagaagcaggtgaaccaaacgaagttgctcgacaatatgtttgtcccaaatttcaaactgttgaagaagttatgcaggctgcaaaatatatggttgctttgcaaattgcacgggaaccactagtacgcaagtgtgttagagaggtattttacgaacgtgctaaaattactgttaatccaaccaagaaaggacaaaaagtaattgatgaagcccataattgtttttcgatgaagtatttgaaaaataaaccagtaagagatttggcaggggatcaattccttaagctaactttagctgaagaggatcaactagttacaattcaaataagtagtactattgaaggacatacatctagttcttttatagatgaagtcaagcaattatatattagagatgagtttagtaaaaatgtacaagagtggaataaagttagatcagagtgtgttgagcgggctttgactcgttgcgtcattccagacttacaagctgagcttagaagagtgcttttagctgaagccaaagaatttgtgctcaaggcttgctgtaggaaattgtacaattggatcaagattgctccgtatcaagttgaatttcctgaagaagatgaagacgaatgggatactagtaaaggtataagagtaatgggcttggcttatgtgccagattattctcagtcggcttttacttgtatatcgactgcagatggtgatattactgattatttgaggttgccgcatattttgaagcggaaaaacagctggaaacaggaagaaaagctgatgaaggaagcggatttgacggctttgaggaacttcatttacaccaaaaaacctcacgttatcgcaataggaggcgaatcccgagaagccctaatgattgccgaagacctgcgcggaatcgtgaaagacttaatcgaatccgaccaatttccggcaatcaaagtggaaatcgtcgataacgagctggcaaaagtctacgcaatttccaacaaaggaatcgccgatttccgagattaccccgaactattacgccaagcgatttcattggcccgtctaatgcaagatccactaattgaatattcgcaaatgtgcaacagtgacgaggaaattttgagtttaagattccacaaattgcaagaccaattgacaaaagaggaacttttagaagctttatgtttggagtttgttaataggacaaacgaagttggggtggatgttaatttggctgtacaacaagcgcataaaagtcatttgatacagtttatatgtggtttggggcctagaaagggacaggctttgttgagaatcttgaaacaaaccaatcagcgcttggaaaatcgtacccaacttgttacagcttgtcatatgggacctaaagttttcattaattgttctggatttattaaaattgataccaacagtttgggcgatagtactgaagcttatgtcgaaattctagatggttctagagtgcatccagaaacttatgagtgggccaggaaaatggctgtagatgctttggagtatgatgatgatgaaggtgctaatcctgcaggggctttggaggagattctagaaactcccgagaggctaaaggatttggatttggatgctttcgctgaggaattggagagacaaggatttggtaacaaaagtatcaccctctatgacatcagagccgaactaaactcccgatacaaagacttaagatccccatttagatctgccaatcctgaagaattattcgatatgttaaccaaagaaacccctgaaacgttttacatagggaaactagtccaagtttcagtggttggaattgctcgtaggaaaccgcaaggtgaacagttagattcagccaatcctgtgcgtaatgatgaaaccggtctatggcagtgtccgttttgtttgaaaaacgatttccctgaattatccgatgtgtggaatcattttgatgctggttcttgtcctggacaagccacaggagtaaaattgaggctagataatggaatttctggctatatttatattaaaaatttaagcgacaaacctgttaataatcctgaagaacgtgtaggaattgggcaactaatacattgtagaataatcaaaatcgatgtagaaaggttttcagttgattgcacttcaaagtccagtgatttggttgataagaatcacgaatggcggccacccaaagatcctttttacaatcaagaacaagaggataaagatttgagaattgaggctgaaaagagacaagaaaagcaaaagcaaacctacattaaacgtgtaatagtgcatccagcttttcacaatatttcctataaggaagctgaaaaatgtatggtcaacatggatcaaggtgaagtcattattaggccttcgagtaaaggggctgatcatcttacaatcacttggaaggtgggggatggcatttatcaacacattgatgtcaaagaagaaggcaaaattaatgccttttctttagggaagtctttatggattggtaatgaagaatttgaagatttagatgaaatacttgcaagatatgttacgcctatggcttcaaatgctagagatcttttgtattttagatattataaagatactaatggtggtatgaaggacaaagcagaagaagctataagagaagaaaaaaagaaaaaccccaacaaaatccattacgtagtgagcgcggctaaaaatttcccaggcaaattcctcctttcctacatgccaaggaataaaatcaggcacgaatacattacagtgacccacgaaggtttcagattgagacaacaaatgtttgactcagtaggctcactatttaaatggttcaaagagcactttagagaccccattcctggtggaacgcctagtactcctagattgggcagtacttctagtagaacaccttttcaaggaggcggtacaccttataacaatgtcaactctgaagcaattcaaagggtggctcagaatttgcccagtcacatgttgcaaagtttatcggctgtggccaatcaaacaccgcattatcctcacacccctggaggagcttatggggctaattacgtgactactccttatactcctagcagtcagacaccttttatgactccttatgctacacctcatactcaaacaccaagtttttctccctctcaacaatcacaatctggattgcctcaagggcaaagcacgtttttgcacccaggctcagtgactccttcaaatcatagtgtgagcagttcctactctagagccagtcaacgtagtcatatgtcttctagaaatcctcctaacaatagtgctgggtaccatcacaggtctggtagtgcttacggtagtactgctgatcaaatggattggcaaaaggctgctgaagcttgggcagcaaaaagtaaaggtactccaagaagtgaaggtcgtattacttctagaggatcaacaggtcaaagaacgcctcggtatgatgacatacatgctgatttggagcgtaccagaatgaaaaatgtaggcaagagtcctaggtctatgagaagcacgacgccccttagtatgtcgatgggtgatgctacccctctttatgatgagaatatttaa

SEQ ID NO: 1306 - DNA, 2571 bp, Ceutorhynchus assimilis
atggcttctgacaaagaaacagaccccagagtccttgtacaagaggacactgagggcaaagcatcgaaagaaaaaggtaatgataataaaaagaagtcgcaagataaaagaaggcatagtagatctcggtccaaatctccagacagggaacagcgacgtgaaaaaaggcgaaaacgaaaaggttctgatgagtaccaaataatgccccgctattatggtgatgacaaaaaaaaggaaaatagcgataaatattggagtaaatatccaaagaaagacgaacatcgagttggtaagagatactatgaagatgacccaaataattctgacgatgagaatatggaaaacaagagagcagggaaaaaagcttccaaagacgacaaaaaagtagaagataaatcggtcattaaacctcgtgaaagaaaaaccgtagatcttctaacatcacgcactggaggggcttatatcccccctgcaaaattgcgaatgatgcaagcagaaataactgataaatcatcagcagcatttcaaagaattgcttgggaagctttaaaaaagtccattcatggattcattaacaaaataaacacgtcaaacattggaattattgcaagggaattgttgcatgaaaatataatcagaggaagaggtttattatgtaaatcaattattcaagctcaagcggcttcaccaacatttaccaatgtatatgcagcattagttgctgttataaattcgaaatttcccaatattggagaacttttactcaaaagattggtattacaattcaaaagaggcttcaaacaaaataataaaaccatttgtatatcagcatcaacattcattgcccatttggttaaccagtctgttgcacatgaaattttagcactggaaattttaacgctacttattgaaactcctactgatgattctgtagaagtttcaattgcatttctaaaggaatgtggacagaagctctcagaggttacaagcagagggattaatgctatttttgaaatgctaaggaatattttgcatgaggggaaattggaaaaaaggatccaatacatgattgaggtcatgtttcaaataaggaaagatggtttcaaggatcatgctgctgttattgaagagctggacattgtggaagaagatgatcagtttactcatttgataaaacttgatgatgtagtacaggcagatactgatgatatattgaatgtcttcaagtttgatgatgactaccaaatcaatgaaggcaaatacaaaattttaagcaaagaaattttacaaagtgatggagaatcgggatcgggagaatcaggttcggaagaggattcggatgaagatagtgacgaagatgatgaagaggaggaagtaaaaaaggatcagggcactattattgacaacaccgagacaaatttgatagcactaagaagaactatttatttgactattcaatcgagtttggattttgaagaatgtgcccataagctactgaaaatggagctaaaacctggtcaggaaattgagctgtgtcatatgttcttggattgctgcgccgaacaaagaacctatgaaaaattctatgggctattagcccaaagattttgtcaaataaataaaacctatgtcgaaccgtttcaacaaattttcaaggacacttattcaacaactcaccgattggacgctaacaggctgagaaatgtgagcaaattctttgcgcatttacttttcacagacgcaattagttgggaatgtttagaagccatgaaaatgaatgaggaagacactaatagttctagcagaattttcattaaaattttgtttcaagaattggctgaatatatgggattgggaaagttgaatcaaagacttaaggatccgacacttcaaggacattttgccgaactgtttccaagagataatccaaagaacactaggttttcaattaactttttcacctcaattgggttaggtggtttgactgatgaattaagagagcatttgaaaaatttgccaaagaacatgccaacagtgactaaagaggaaagcagctctagttcttcttccagttccagtgaagatagtagtagttcagattcaagtgatgaggaatcggaagatgagaagacaaagaaaaaagataaacagaaaatatccaaatcatcacaagaaagacccagagataaaacacagaggactagcagagatgaaactaacaaaagaagctctagagaagatgaagaaaattatcgtaaacaatctagaagaagagagcaacgaaataattcagaagaaagggaaaaccgggaaaggtccagatataatgaccaaaataaagacagaagaagggattatgaatgggtcaaaagtagatacgaagataatattagtcagttgaaggatagaaggagagcatttgaaagacctagaggaaaagatgatagagtaaaagaagaaaaaaatagaaggtcgaggtcgagagataggattagggtgaaagatgaggatgacagaagtaaagacagggagtatcgtcacagaaggaatcatgaaaggcaacgaagttaa

SEQ ID NO: 1307 - DNA, 1785 bp, Ceutorhynchus assimilis
atggcattgaaaaatcaggtcggccaaaaaatcatgaacgaagtgataaaatacaaaccccaaaagaaaaatggccctgctgctgtggcaggaggaaaaatggaatggagagtcctggttgtagacaaactggccatgaggatgatatctgcttgctgtaaaatgcacaatatttcagctgaaggcataactttggttgaagatattttcaaaacccgcgaaccattgcccacaatggaagctgtttatctgataactccttcaaaagagtctgtggaagcactaatgagggactttgacggcatcaaacatattatgtacaagggggcacatgttttcttcactgaagcatgtcctgaccagttaattaatgacttagctcgtcaccctgtggccaaatatattaaaacccttaaagaaatcaacattgcttttgtaccaaatgaagctcagatcttttcgttggattgtgccgagactttccaatgctactataatccagcctattcccaaaaatacagcgccaatatggaaaggatggcagagcaaatagctactttgtgtgccactttaggcgaatatccttctgtaagatatcgcagtgactgggacaaaaacgttgaactagcccaactgattcaacaaaaattggacgcctacaaagcagatgaacctacaatgggcgaaggtccagaaaaagccagatcacagctgttgattctggatcgcggcttcgattgtgtttccccacttttacacgaattgactttccaagctatggcctacgatttgttaaatatacaaaatgatgtttatgagtatgaagcttctgctggtgtaaaaaaagaagtcctccttgacgaaaacgacgaaatgtgggtggaactgcgtcaccagcacattgcagttgtctcccaaagcgttaccaaaaacctaaaaaagttcaccgactccaaaagaatgacagctagcgacaaacaatccatgaaagacctgtctacaatgattaaaaaaatgccccaataccaaaaagaactgtcaaaatacgccacccatttgcaactggccgaggactgcatgaaacagtaccaaggctacgtggacaagttgtgcaaagtggaacaagatttggccatgggtactgacgctgaaggcgaaaaaatcaaagaccacatgcgtaatattgtgccaattttacttgatcccaaaataactgagcagtacgataaaatgcgcattattgctctatacgccatgaccaaaaatggcattactgaagaaaacttgcaaaaacttgccactcatgcccagatttcgaataaacaaacaattgccaatatccagtatttgggggtcaatgttgtcaatgatggtagcaccaggaaaaaaccgtacacagtgcctcgtaaagaacgcattacggagcaaacctatcaaatgtcgcgttggacacctgtagtcaaggacatcatggaggactgtattgaggataaattggatcagaaacattttccttatttggctgggcgggctcagagcactggatatcatccgacatcagccagtgcccgttatggtcattggcacaaagaccgcagtcaaccgacagtcaaaaatgtaccccgtttgattgtcttcatcgttggaggtgtttgcttctccgaaatccgttgcgcctacgaggtaacaaacgccctgaaaaattgggaagttatcgtcggttcttctcacattttgacgccgagagcttttcttgaacagctgacgtcactcacacccaactag

SEQ ID NO: 1308 - DNA, 2142 bp, Ceutorhynchus assimilis
atgatgcaacagtacatgaaagaacttgaacaggaaccctttgatgcagaagaattcgtcgaacgactcgcttggagaactataaatgaaaccaaaaccgaaggcgatgaaggggatttgaatcctacctttttacatgattcattcgtgcaagcaattaaagatttaacgttgcttcaagaaagacagcaaaagaaatgcgaaaggctcgaaggcgctgtcagagaggacgaggcaatgttttttcaggaaatttatactttactggaacaaaacaagcaatcaatggacacatttcaagagctggacagtaaaattaaccatgtagccacaaaagtcttacatttaggagaccaattggacagtgtcaatggtcccagagcccgagtagtagacgctcaaaaactgatgacccatttaagtgaatttttatcaaatggtccgttaaccagctccattttcaacgatccctatagaatcgacgaagcggctgacgtaatacagaaactatttttaatatcacaagatttgccttcgcccaagtttgaaaatgttaaaaggaaaatcgaaaggacttactcggatattgaaaaggctttaattgaagattttgttagggctatgagcaaagaggatctggttaggatgagggctatagctaacgtgctgagtcagtttaaaggttacagccagtgtgttgatgcctatattgatcaaagtcaagcaggttgtttgttgagcaaagacgttttcgctcatttggttccgctttgcaagcacaactacgaaattataaaagaagttttcaatagtccagaacaagtaatggctaaatttgttctgaacttgtaccagttgaaattggctgattatatagactccaggctaagtgctaaagttggcagctacggttacttgcaaatactttatgagttgtactcaaaaacaaatcagttttccaacgaattgagcgtctatgatttgggtaacgatcagaattatttgagcaaattgactacgaagatttttaataaatatatcagcgattatgtgcagattgagttgaaatgcctcaaagaacggtgcgcagcaaatctgcaaaagtactacgaagccaagaaccaccagaaaaaacaaatccaaaccggcggttttcaggaattgagacgagacttgcaagcagtcatcggtaccagagccaacataaatatcgctcagattgaaaactatggcggcgagacatttttgtccgaggaattggccataacaatcctgcaggataccaaaaatgcttttttgcgatgtcaacttctttcaaaacccgaagaaaaagccacaaatgcttcaaaaatcctcaacactttagtaaacagcctccttatagaacatgtagactatgcagttgaattaggcctacaagctgtacctgtagtagaaggtgctaaaacatctccaactttatccttcttcactatagttcatcaatgcaacaatataacgcatttacttgaaaaacaattcaccgacatggtagtgcccttaataatcaatactcaattctatagtgagagccttcaaaagaaaaaatacgtcttggaggacattgagagaaaagtcaatgtgggccttgaccgatgcctcaatgcagtagctgcttgggttaaattatatttgcaaactgaacaaaaaaaaggtgattttaaacctgaaactgatgattttgatacagtgtcttctcctgcatgcaaggcagtttgtcaacacatatcaaatataataaaacaaataaaaagcagcctggatggcaataatgtaatggcagtacttgaagaattgggtgtcaggttgcatagaaccatttacgatcatatgctgcagttccaatacaataccgctggtgcaatggttgcaatttgtgacttaaacgaatacaggtcttgcactaagtcaatggggcccttggttacggagttatttgaaactttacacgctctgtgcaatttacttttggtaaaacctgaaaatttacatcaagtttgctcagaggattcattggtgaatttagaaaaatctattctacacaattttatacagctacgtagtgactttaagacccaaaaacccacaatttttaaaacataa

SEQ ID NO: 1309 - DNA, 816 bp, Ceutorhynchus assimilis
atggatttccaaaatagagctggtggaaaaacgggcggaggcggcgtagcatcatggtccgaatcgaacagagaccgcagggaaagattgaggcaattagcccttgaaaccatagatttgcaaaaggacccctattttatgaaaaaccatttggggtcctacgagtgcaaattgtgtctgaccttgcacaacaacgagggaagttatttggcccatacacaaggaaaaaagcatcaggctaatttagctagaagggcagctaaagaagccaaagatgcccctagcatgctacaacctgaaaaacccagggtggaacccaaaaaattcgttaaaatcggtagacctggatacagggtgaccaaacaaagggaccccgaaactggacagcaaagcttgctgtttcaaatcgattatcccgaaattgccgatcatgttttgcccaggcacagattcatgtctgcttacgagcaaaaaattgaacctccagaccgtaaatggcaatatttgttgtttgctgcagaaccctatgagactatagcatttaaggttcctagcagagaagttgaaaaaaccgaccagaaattctggactcattggaacagagacaccaaacaatttttcctgcaatttgccttcaaaatcgaaaacaagaaactgaccaacatagtgccaaggcctcctatgatgggagttggaatacctcctccacctcctatgttgccagtacctccaccaccgagacctccaatgttcaatcatcctatgccacctccgcccatgatgagaggtgttatgccagtaccaccaccacgttag

SEQ ID NO: 1310 - DNA, 405 bp, Ceutorhynchus assimilis
atgtccatcggtgtgccaattaaggtcctccacgaagcggaagggcacatagtgacctgcgaaactattaccggcgaagtttacagaggaaaacttatcgaagccgaagataatatgaattgccaaatgactcaaatcactgtgacttaccgggacggcagagtagctcagctagaaaatgtttacattagaggttcgaaaatgagatttttaatactgccggatatgttgaaaaatgctcctatgtttaagaagcaaactaaggctggggtggctgggagaggaaaatctgggatacttcgagctcaagtggcaagaggtcgtggaaggggtggtccgcctcaaagaggcagaggaaatgctccttggcagcagcaagtcagcgcaggtggcagaggcagatag

SEQ ID NO: 1311 - DNA, 1323 bp, Ceutorhynchus assimilis
atggcatcgaatattgcaaaaagtaccatttttcgtgctgtcgggactagaggctacgctcagctggccccagttagtggcagcaccaattaccaagttaatgtaaaaacgctacccaataagcttgtggtagtgtctgctgacaatgattcgcctctagccagggtttcgatagtgttccgtgctggagcaagaaacgaaacgagcgaaaatctaggagccgctcacgtaattcgcaccgctgccggtctctcgacacaaaacatgactcagttcgccatcacccgcaacattcaacaactaggagccagtctaaccgccacttccgatagagaaaccatttcttacaccctagaaggcactagacaagccgtggaaaaagctctaccatacctaacagaagtagccacccaacaagtctttaaaccatgggaattggccgaactctcagaccgtctcagaatcgatttggccacaagacccttgcaattgcgcgcagtcgatttgcttcacaaagcagccttccgtacgggtttgggcaattcgctttacgcgcccaaattccaaattggaaaaatttcatctgaaactcttcagcattacgtgtcgagcaacttcacttcggctagaggggctgttgttggattgggactcgatgaatgcaaaatggacgagctggctcagtctttgactttggacgacagcaatggccatgttaatgtgagtccttacaaaggaggcgaaataaggtcggacaaaggtgggagttttgcctttatggctgtagcaggtgaaggggcttcggttaaaaaccctaaagaagctatggctactgctgttttgcaacgggcgctcggagttggacctcaaatcaaatggagcactgtagataatggtattttgagcaaggctatttgcagtagtgaaggctacgcctcttctgctattagtgctacctattcagacacaggtttggttggggttttaattgctgcgcctgctaaagctgcaggtaaaattttggaaggtgcagttaaggctttgaagagtggcaatgttaccgatgcagatgtcgctagaggcaagaaccaattgaaaacagccctgctgcttcatctggaaagcggctctgaagctgtagaattgctaggaaagcaagctgttttggctgggggtgctatgtctccctgtgaattggctgctgctgttgactcagtttccactgccgatgttcgtgctgcactttcgaaggctggccgaaaacttacaattgcttcagtgggtaatctatccaatgtaccatacgctgacgacctaaaataa

SEQ ID NO: 1312 - DNA, 333 bp, Ceutorhynchus assimilis
atgcgtaggtcccacgcaggcaattactacgaacctttgccccaagacaacaacgaaatcgaacacgaaaatgaacgtatggcacaggaactatctgacaaaataggcgtcctgaaatccttatccatagacatcggtaacgaggtgcagttccagcacaaactgttgagggacgtagacgatgacatggatagaactggagggtttctcggcaaaaccatgtctagggtagtcaaattgtctagagggtcacataactatattataatttatttgtttgtgtttgcaataattgtgtttttcatattgtatttggtgttaaagtttaggtag

SEQ ID NO: 1313 - DNA, 1479 bp, Ceutorhynchus assimilis
atgtcaatatcaaccaaacaagctgccagagaacatgttctggccgtatctagggatttcgtttcccagccaagattaacctacaaaactgtatctggtgtaaatgggcctctggttattctagaagatgtcaaatttccaaaattcaatgaaattgttgaactgaaactggcagatggaagtctcaggtctggtcaagtcttggaagtcagtgggtcaaaagctgtggtacaagtttttgaaggcacgtctggaattgatgccaaaaacacattatgtgaatttactggggatattttgaggactcccgtctcagaagatatgttgggacgtgtatttaacggatctggaaaacccatcgacaaaggacccccaatcttagccgaagattacttggacatccagggacaaccaatcaacccctggtcacgtatctacccagaagaaatgatccaaactggtatttctgctattgacgtcatgaactccattgcccgtggtcagaagattcccattttttcagcagctggtttgccccacaacgaaatcgccgcccaaatctgtagacaagccggtcttgtcaaggtgcctggaaaatcagttctagatgaccatgaggataactttgctattgtgtttgctgctatgggtgtcaacatggaaaccgctagatttttcaaacaagactttgaagagaatggttctatggaaaacgtatgcttgttcttaaacttggcaaatgacccaactattgaaagaattattaccccacgtttagctttaaccgctgccgaatttttggcttatcaatgtgagaagcacgttctagttatcttgactgatatgtcttcatatgccgaagcgttgcgtgaggtatccgccgccagagaagaagtacccggtcgtcgtggtttcccaggttacatgtacactgatttagctaccatttatgagcgtgctggtcgtgttgaaggtagaaacggttccatcactcaaattcccatcttaacgatgcctaacgacgacattacgcatccaattcctgatttgactggttatattactgagggtcaaatctatgtagacagacagttgcacaacagacagatctacccgccagttaatgtgttgccatccttgtcgcgtttgatgaagtctgctattggtgagggtatgacccgaaaggaccactctgatgtatctaaccaactgtatgcttgctacgccatcggtaaggatgtccaagccatgaaggccgtggtcggtgaggaagccttgacccctgatgatctcctttatttggaattcttgaccaagtttgaaaagaactttatctcgcaaggaaactacgaaaacagaaccgtattcgaatctttggacattggctggcagttactccgtatcttccccaaggaaatgttgaagcgtatccctgccgccacgctcgcagaattctatcctagagattcgcgtcactaa

SEQ ID NO: 1314 - DNA, 390 bp, Ceutorhynchus assimilis
aaatatttaaaagccgagagaccgaaacaagaactagatctagaccaaaaactcgcggataaagaaacccaaacaataccatgcggtaaaccaaaagtacccgaaggttatcaggatttattgctagagtttaccataaattgtaatctccatcatccgagaaacctcgtcgattatgccgctgaatattttgccgccttgaaagatcaaaaacataccaagattgtctacgatctggtttgtactgagaaagaagaaaaaacagacagggacagtactgcttttagtgaagctacaacagtcacggattcggaattttcaaaagatgaacatgaaaaaataatacttacatcagcagaatcagattcagtacctatactcttgaattga

SEQ ID NO: 1315 - DNA, 2397 bp, Ceutorhynchus assimilis
atgagctatcaaagcagggcaatgccttaccaaggcacaggtgacatgccaatggcaaactccaaagaacaaaacgtgatgtcgtggcaacaaaacaactatatgggtgactctggaatccattccggagctcaaacccaggtcccatctttgagtggcaaagaagaagaggatatggatctcttcgatcttgaccagggatatcaaggattcactcaagaccaagttgatgacatgaacaatcagctgaacacaacccgttctcacagagtaagggctgctatgtttcctgaaacattggaagaaggaattgagatcccttcaacacaatttgaccctggacaccaaacagctgtccaacgtttagctgaaccaagtcaaatgcttaaacacgctgtagttaacctaattaactaccaagatgatgctgaattagccactagagctatcccagagttgattaaacttttgaacgacgaagatcaagtagttgtttctcaggcagccatgatggtgcatcaactgtcaaagaaggaggcatccagacatgccatcatgaacagtccacaaatggtggccgctttggtcagagccatttcaaactctaatgatttggaaaccaccaaaggagctgttggtactctgcataaattgtcacaccacagacaaggtttgcttgctattttcaaaagcggtggtataccagctttggtgaaactgctcagttcaccagtcgaaagtgttttgttctatgccataactactctacacaatttattgcttcatcaagatggttctaagatggcggtgagacttgctggaggtcttcaaaaaatggttgcactattgcaaagaaacaataccaagtttttggctattgttactgattgtctgcaaattttggcctatggcaaccaggagagtaaactgattattctggcgtctcaaggtcccgttgaattggtgcgaatcatgagatcttacaattatgagaagcttttgtggacaacttccagagttttgaaggttctatcagtatgctcaagcaataaaccagccatcgtggaagctggaggcatgcaagctttagccatgcatttgggcaactcgagccaacgtctggttcaaaactgtctctggactttgagaaatctctctgatgctgccaccaaagtcaatggattggactctttattgtcatctttggtccaagtccttgcatcatccgatgtaaatgttgttacttgtgctgcaggtatcttatcaaatttgacatgcaacaaccaattcaataaagaaacagtttgtcaatacgacggtatttcggctcttgtacgaactatcatgaacgctggcgatcgagaagagataactgaacctgctgtttgtgctctgagacacttgacttccagacacgagaaatctgagttggctcaaaatcaagtcaggtcagtacctagtgatcagaatgacaggcttgttggaggtattcctgttatcgtcagactattgaatccgccatcacgttggcccttggtgaaagctgtaattggactgatcaggaaccttgcactgtgccaggataacttcgcaccattacgggaatcttgtgctatcaattatttggtgcaattattgatgagagcttatcaagatacacagagacgagctagcttggcaagtggaggcagtcaacaaccaggaacttacgctgatggtgttagaatggaagaaattattgaaggtactgttggcgctctacacgttcttgccagagaattctacaatcgcgaacaaatcagacaacaaggcgttattcccgttttcgtacaacttctattcaacgacatcgaaaatatacaacgagtagctgctggagtactttgtgaattggccgccgataaagaaggggcggatttgatagagcaagagggcgccactgcaccgctgaccgagcttttgcattcacggaacgaaggtgttgcaacatacgctgcagcagtgctattccgtatgtctgaagataagcctcaagactacaaaaagcgcctctccatggagttatcaagctcactgtttagagaggagaacctttggaaccctgacctgggcatggggacagatttccaggatattttgagtccggaacaggcctatgataatatgtacgcccaagggccgcctagtgtacatagcagccacactggtaggccttatcagcaacaaggctatgaccagatacccttaaacatgcaagctatggacatcggctcacccctagacgctatggacgtaacaggggctgagcctgacttgaattttgatggaatagaccagctaccaactccgccccaagacaacaaccaggtggcggcctggtacgataccgatctttaa

SEQ ID NO: 1316 - DNA, 837 bp, Ceutorhynchus assimilis
atggcaagaaacgcagaaaaggcgatgacaacactcgcaagatggcgggcagcacaagcaggggaaattgataaatcgaagagaagaagaccttatctagcctcggattgcaaaagcttgtatgcatgtgagaaatggcgtatgcacattatcagagaaatagctaaaaaagtcgctcagattcaaaacgctggtttaggtgaatttagaataagggatttgaacgacgaaattaacaaattgctcagggagaaacggcactgggaagaccaactaaaagaacttggtggtcctgattatcagaaaatcggccctcgaatgttggatcatgaaggaaaggaagtaccaggaaatagaggatacaaatattttggagcagcaaaagagctacctggtgtaagagagctttttgaacaagaaccacctcctcctcctagaaagacccgggcagagctaatgaaagatattgatgcagattattatgggtatatggatgatgatgatggtattttgataccactcgaaatgcaagctgaaaaaatagctgtccaaaaagcagtaacagaatggaaggcaaagaaagaagctagaaaggctgcaggtgaagcttcggatgaagaggatcaagaagtaagtgtatatgcagttgatgaggacgtagagaaagatgaaatactagaagatccaagtcagcaacttctcgatgggtcacaacaaagatttgtggctcacgtaccagttccatcacaacaagaaatcgaacaagccttgctgaggagaagaaaacaagaattaatggaaaagtatggagtattagacaaaacaataaataaataa

SEQ ID NO: 1317 - DNA, 648 bp, Ceutorhynchus assimilis
atggctgcagaacagcaactgccaacattcaagtgtgtgcttgtaggtgacggtggtactgggaaaaccacctttgtaaagcgtcatttgactggcgaatttgaaaaaaaatatgtagccaccctcggtgtagaagtgcatcccttagttttccacacaaacagaggcgaaatccgcttcaatgtttgggatactgctggccaggaaaaatttggaggtcttcgtgatggttattacatccaggggcagtgcgcaattattatgtttgatgttacttctcgtgtaacttacaagaatgtaccaaactggcacagagatctggtcagggtgtgtgagaatgttccaattgtactttgtggcaacaaagtggacatcaaagataggaaagtcaaggctaagagtatagtgttccataggaaaaaaaatctacagtattacgatatctctgccaaatccaactacaattttgagaaacccttcttgtggctggcccgtaaactaataggcgatcccaatctggagtttgtagctatgccagcgctcgtaccaccagaagtacacatggacccacagtggcagcagcaaattgagaaggacttggtggaagcccaaaacaccgccctgcctgacgatgatgaggatttgtaa

SEQ ID NO: 1318 - DNA, 2556 bp, Ceutorhynchus assimilis
atgccgcgtataatgataaaaggtggtgtttggagaaacaccgaggatgaaattcttaaagcggccgtaatgaaatatggcaaaaatcaatggtctcgtatcgcctccttgctccaccggaaatcggccaaacaatgcaaagctcgttggttcgagtggctggatcccagcatcaaaaaaaccgaatggtctcgcgaggaagacgaaaaacttttgcatttggccaagttgatgcctacgcaatggagaactattgctcctattattggacgtactgctgctcaatgtttggaaagatacgaatatttattggatcaagctcaaaagaaagaagatggagacgacggtgacgatccaagaaaactcaaaccaggcgaaattgaccccaatccagaaaccaagccagctagacctgaccctaaagacatggacgaagacgagctcgaaatgctgtccgaagccagagccagactggcaaacactcaaggcaaaaaagccaaacgtaaagccagagaaaagcaactggaagaagccagaagattagccgctctgcaaaaacgacgagaacttcgcgcagccggcatcgaagttgctcctagaagaaggaagaagcgcggcgtcgattacaatgctgaaattccattcgaaaaacgcccagcaattgggttctatgacactttgaatgaagaattagacccgatggcaccagatttttcagaaatgacccaacagaagctggatggcaacttgagggccgaacaagaggatcgcgaaaggaaaaaggataaacaaaagctgaaacaaagaaaagaaaacgatatccctgaagccatgcttcaaaatcaggaacctgccaggaaaaggtcgaaacttgttttgccagaaccacaaatctctgaccaagaactacatcaggtagtcaagttgggcaaagcaagtgaaattgccagagaggttgcttctgaaagtggtgtggattcaacggacactttgttgaatgactacactgttacgcctcatgctacagccactccaagaacaccggcagcacaaactgacagaattttacaggaagctcaaaacgtaatggcacttacccacgttgatactccactcaaaggcggcctgaatactccattacataattcggattttagtggggttgtgcctcaacaacaagctattgccactccaaacactgtgttggctactccttataggtcagttaggagtgaaactggttcaactcctggaaatacaggttttatgacacccaaaagtggagctatggtgccagtgggtggaacatctacaacttatgtggcaccatctataagggataaattaaatattaatactgaagatgccctagaagtaggagatactccagcacagcatcttatgtatcagatgtccaccaagcagcaacttaaaatgggcttgagtagtttaccaacgcctaaaaatgattacgaaattgttgttccggataatgaagaacagactattccagaacaagctcaagaaaaatcaattgaagaccaagctgacgtagatatgagatatcaagaagaaatgaaagccaaagctgccaaagagcttttattgagatcacaggtgatccaaagagatttgcccaggccacaagatgttaacctctcagttttaaggcctgccaatgagagttactcactgactgagctccagaaagcagaagaacttataaagttggaaatgtcaactatgcttcaatttgataatttgaaaaaccctgtggctactcaaagtaagccgtctaacaagagtcaggctcagcagttggcatttctagaggaacatccatatagaaatttccaagctgaagaacttgaaacggcaaagcaaatgttgaaaaaggaaatggaagtagttaaaaaaggcatgaaccatggagatttgccgatggacgcttacactcaagtttgggaagaatgtttgggtcaagtgttgtttttgcctaatcagaatcgttacacgagagctaatttagccagcaaaaaagatcgtttggagtcggccgaaaaacgtttggaacaaaaccgagcccacatggccaaagaagccaaaaaagctgccagaatggaaaaaaaattgaaaatcctcactggaggatatcagtcgaaagctcaaagtttaataaaacaattaaccgacgcctacgaaaacatcgatcaagccaatttagaattgaaaacatttaaatttttacaagaacaagagagaaacgcgctaccaagaagaatccaaggcctaacagaagatgttagtagacaactagaacgagagaagggcttacaaacaaaatataatgattatcaaaataaaatcatagatttacaagagcaattgggatacgagcaacaagaaactgcagagcaagttgaggatttagatggggtaagcgtgcagccagaaacagagcaagttaccaacaatttaaatgcaactgttgaagaaaatatcagttctacaatcaatgggctagataaggaggaggaaaatgttgcagttcaataa

SEQ ID NO: 1319 - DNA, 471 bp, Ceutorhynchus assimilis
atgcagttcatgctgttgtttagtcgtcaaggaaaactacgtttacaaaaatggtacgttgcacatccagacaaattgaaaaagaagattaccagagaacttatcactactatactggctaggaaacctaaaatgtgtagtttccttgagtggagagaccttaaaatagtgtacaaacgatatgctagtttgtatttctgctgtgcaatagaacaagatgacaacgaacttcttactttggaggtcatccatagatatgtggaactcctggacaaatactttggtagtgtttgtgagcttgacattatctttaacttcgagaaagcttactttatattagacgaactgatgttgggaggtgaaatacaagaaactagcaaaaagaacgttctcaaagcgattgctgcacaagatcttctgcaagaagaagaaacgcctcaaggtttctttgatgatcacggacttggctag

SEQ ID NO: 1320 - DNA, 1260 bp, Ceutorhynchus assimilis
atgcatcaaataagcaaatttctgttctatcaggccgcacggacatcaaaaaatggggttcggtactactcgagagagccgcaaaaacgacccacattcttgtcgagattatacgacaattttagagaagaaatgtccaaaaacaaagagatgaaagaatctttaaaaaaattcaaagaagaagcagaaaaactagagcaaagtgatgcattaaaagcggcccgtcagaagtttgaaactgtagaaaaagaggcaacgaaaagcagtgatgtttttaaggaaagattcagtactatcaaagacaaagtatccagtgtcatagacgaggctggtaagactgaacttgtgaaaaaagctggaaagatttcagaggagatttcaaaaaccacacattcaattggggaaaaagcacaagaaataggtaaaactaatgcttttcaaagtatcagcaaagctactgaagcagttaaaaaagaaatggataccaatagtatgcaaggtagagtttacgttagtccaataaaacttcggaaaagaacagaaacctcggcggtacaaaaccaaaaacattacgaaccaaacacagaagcgatgggtattgagctacataaagattctaaattttatcagtcatggcaaaatttcaaagacaataatccatatgttcacaaagtcatggattggaaattaaaatttgatgaaagtgaaaacccagtaataagggcttcaagggtgctaactgaaaaagtatcagatattatgggaggactatttcagaaaactgagctttcagaaactttaactgaaatctgcaaaattgacaacagttttgatactaaacgatttttaaaacagtgcgaagctgacataatacccaatgtattggaagctatgactaggggtgatttggaagttctaaaagactggtgtcacgaaggtccttacaatctcttctcgattcctataaaagaagcttacacgaaaggttataaaatagagtcaaaaatcttagatatagataatgtagatctagtcatgggtaaagtaatggaacaaggtcctgttctaataatttcatttacttcccaacaagtaatggccgtaagagattctcagggaaatgtggttgaaggagacccagataagataatgagagtaacatatgtttgggttttatgtagggatattagtgaaactgatcctagagcagcctggagactattagatttatcagcaagcagtaatgaacaactggtgtga

SEQ ID NO: 1321 - DNA, 909 bp, Ceutorhynchus assimilis
atggattactctagcgattctgaactcagcgacagcgatcgggagctgcaagaagcttttgttgagggaaaattgaagccgggactaaatacagtacaccaagcaccaaaaaaggcagttaacaatgttgaaggtttaaatcacaaactagaggaaatctatttaaatctaccatggatcgaaagattagactgcataaacgcacaagcacctttagctccagaactggctgctcaattaatggctcatgaacagaaacgagaaaaccaattaaagaataataaaaaactgccacagcttaaagcaagcgaggatcctatattgaatgattttaaaagggaaatggagtttcatagacaagcccaagccgctgtacttgatgccataccaaagttgaaggctcttggaatacctactaaaagacctgatgactattttgctgaaatggcaaaaacagacgagcatatgcaaaaaatcagagaacatttgatgacaaagcaacagcagcaacagagaagcgaaagagttaaacaactaagacaacaaagaaaagaaggcaaaatgcttcaaatacagaccaaactccaaaggcagcaagagaaaaaagaaatgctggaccaggttaaaaagcaccgcaaaggagtctcgaaagatctagacttcctggattccaaaaaaagcaaagctatttcgcggaaggcattggaaaagagaaatatgaaaaataagaaatttggatttggtggcaagaagaagggtgggaagttgaacacaagagatacagcagcagacattagtgaatataggagccctaaaccaggcggtagaaagggcagggattctaagggtaaacagaagaataataggccaggcaagaataggaggataaaagctaaaaataagaaatag

SEQ ID NO: 1322 - DNA, 1869 bp, Ceutorhynchus assimilis
atgaaccaaggggccccaaattatcccatggcgtctctgtacgtcggggatttgcatgctgatataactgaggccgtactttttgagaagttctctaccactggtccagttttgtccattcgtgtctgcagggacttaatcactcggaggtctttaggatatgcctatgttaacttccaacaacctgctgatgcggaaagagctctcgacaccatgaattttgatttaattaaaggaaggccgatccgtattatgtggtcccaacgagatccttcacttcgtaaatcaggtgtcggaaacgtgtttatcaaaaatttggatcgttccattgataacaaagccatgtatgacactttctctgcctttggtaacattttgagctgtaaagtggctcaggatgaaactggctcgagcaaaggctatggttttgtccacttcgaaactgaagaagcggcaaacaaatccattgaaaaagtaaatggaatgttgcttaacggcaaaaaggtttacgttggccgcttcattcctcgcaaggaaagggagaaggaacttggagaaaaagcgaagctatttactaacgtctatgttaagaatttcggagaggaattatcagaagaacaattgcgtaacatgtttgaaaaatacggaaagatcacgagctacaagatcatgaataaagatgatggaaaatcgaaaggatttgggtttgttgcttttgaatgttcggaagcagctgaggcagcagtggaagcacttaatggaaaagaatcagttgatgggaaacctctttacgttggtcgtgctcagaagaaagctgagcgccaacaagagttaaaacgtcgctttgaggctttaaaaatggaaagacttaaccgataccaaggtgttaacttgtatgtcaaaaatttggatgacacaattgacgatgaacgtttacgtaaagaattcactccattcggaacaataacttcagctaaagtaatgatggaagaagggcgtagtaaaggttttggttttgtctgcttctcctcccctgaagaggccaccaaagccgttactgaaatgaatggacgcatagtcggctccaaacccttgtacgtggcattggctcagaggaaagaagacagaaaagctcatttgacatcccaatacatgcaacggatggcaaatatgcgcatgcaccaaatgggtcaatttattcagcctggagcatccagtggatacttcatgccaacgatacctgctccacaaagattttatgcaggtgctcaaatgcctccaatccgtacaagccctagatggccctctcagtcacaagttagaccaactggtcaaggagttcctgctgcttacccaggcatgactaacccattcagggcaactacgcgtcctccaaatcaaacaatgtcaatgcgtggcaatattaatgtttccagatcaatcacttgtccacagcccaccaatatgcagggacgtccccttccaggacaaagtgttgttgcttcaaacagaactacattcaagtataccgccaacatgcgcaatccacctcagtctatggtaccattgcccagtcagccggttcaacaagcagtgcacatccaaggtcaagaaccacttactgcaacaatgttggctgctgctcttccaccagagcaaaagcaaatgctgggagaacgtctgtttccacttatccaacgcatgtatgcagatttagctggaaaaatcactggtatgttgttggaaattgacaataccgagttattgcacatgttggagcacaacgagtcccttaaaaacaaagtggaggaggctgtagctgtgttacaagcccatcaagccaagcaatcagttatcaagaaggactga

SEQ ID NO: 1323 - DNA, 2763 bp, Ceutorhynchus assimilis
atgaccgactcgaagtatttcactaccaccaaaaagggagagatttttgagttgaaatctgaattaaacaatgataaaaaggagaaaaagaaggaggcagttaagaaggtcatagcatcaatgacagtaggcaaagacgtatcggccctatttcctgacgtagtaaactgcatgcaaactgacaatttggaactcaaaaaattggtttatctttacttgatgaactatgccaaatctcaacctgatatggccattatggcggtgaatacttttgtgaaggattgtgaagacccaaaccccttgatccgtgctttagctgtgagaactatgggctgtatcagagtggacaaaattactgaatatctttgtgaacccttaagaaaatgcttgaaggacgaggatccttatgttagaaaaactgctgctgtttgtgtcgctaaattatatgacatttcttcaggtttagttgaagatcaaggattcctggaacaactcaaagaacttctaagcgactcaaacccaatggtggttgccaatgctgtggctgctttatcagaaattaacgaaagcagcccaacaggacaacctttagttgaattgagcacgtcaacgattaataaactgctaacagcattgaacgagtgcactgaatggggtcaagtgttcatcttggactcgctatccaattacactccgagagatgacagggaggctcaaagtatttgtgaaagaatcacaccaagattggctcatgctaatgctgctgttgtcctatcagctgttaaagttttaattaaaatgatggagattttacaaggagatgttgagttttgtaatactttgagtaaaaaattggcaccacctttggttactttgcttagttctgaaccagaggttcaatatgttgctttaagaaacatcaatctgattgtgcaaaagaagcctgatattttaaaacacgaaatgaaggtattctttgtgaaatacaatgatcccatctacgtaaaactggaaaaacttgatataatgattcgtctagcttctcaagctaatatcgcccaagttttaagtgagttgaaggaatatgctacagaagttgatgttgattttgtaagaaaagccgtgagagccattggaaggtgtgccattaaagtggaaccatctgcagagcgttgtgtatcaactttgttagatctgatccagaccaaagttaattatgtggtgcaggaggctatcgttgtgatcaaggatatcttcagaaaatatccaaacaaatatgaaagtatcatcagtacattgtgcgaaaatctcgatacactggacgaaccagaagctcgtgcctcaatggtatggattatcggtgaatacgccgaacgaatcgataacgctgacgaactcttggacagtttcctggaaggatttgccgatgaaaacgctcaagtacagcttcagttactaacagccgttgtaaaactgttcctaaaacgaccacagcacactcaaggtctagtgcaacacgttctaagtttggccactcaagattctgataatcccgatttgagagatagaggatttatctattggagattattgagtaccgatccggccgcagctaaggaagtagttcttgctgataaaccactgatttctgaagaaactgacttattagagcctacactgttggatgaattaatatgtcacatttcatctttggctagtgtctatcataagcctcctacagcttttgtggaagggcgcagtgctggtataagaaaaacgttaccagcgcgtcaagggtctgaagaagctcctactcaggaagcaacagttattccaaatcaggagagtctcattggagatttattgtcaatggatcttggggggccaactatacccactccagctgctgcacctgttgttgctccaactagtaatgtggatctgttaggtggaggattagatgttttgttgggtggtggtccagaagtaaccagcaacgtaggtgctgctccctcaaccacaggccttctaggtgacatcttcggaatcacaacaacacctacaatgtacacgccaccaaaagccttatggttgccggccgacaaaggcaaaggcctggaaattcaaggcacattttctcgtagatcgggacaaatttacatggaaatgacgttgaccaataaggcgatgcaagcaatgaccggattcgcaattcagttcaacaaaaatagcttcggtttggcaccttcggttccgatgaacgtgactgcgctgcaaccaggacaaagtttggagtatagtttgcctttgagtactactggacctgtgcagaggatggaaccgttatccactttacaagttgccattaaaaacaatgtcgacgtattttactatgcttgtcaaattccccttcaagtaatctttttggaagatggcaccttagataaacgagtatttttgactacttggagagacattccttctgctaacgagatacagtacacgttaaatgacatcaacggtggcacgaccgattccatttctaataaaatgactcgaaacaacattttcacaatagccaagcgtaatgtggaaggtcaagatatgctctatcagtcgctgaagctcacgaacaatatttgggtgcttctcgaattgaagttgactccagggttgagttatgcgaccctgagtctaaaatctaggtccttggaagtggctccttttgtatttcaggcttatgaaatgatttgcaagaattaa

SEQ ID NO: 1324 - DNA, 498 bp, Ceutorhynchus assimilis
atgccaccaaaattcgatcccaatgaagtcaaatacgtatacctcagatgtgtgggaggagaagtaggagccacatcatcccttgcccctaaaatcggtcccctaggtctgtctcccaaaaaagtcggtgatgacatcgccaaaggcacagccgattggaaaggtctgaaaatcactgtacaattgaaaatccaaaatcgtcaggccaccatttctgtatgcccctcagcggcttctctaatcattaaagctttgaaagaaccaccaagggatcgtaagaagcaaaagaacatcaaacacagcggtaacatttcttttgacgatgtaatctctatcgccagacaaatgaggccccgttccatggccaaaaacttggcaggcacagttaaagaagtcttaggtactgcccaatctgttggctgcacaattgatggtaaggcaccacatgacgtcattgacgaagtaaatgctggttccgttgaagtggcagaagagtaa

SEQ ID NO: 1325 - DNA, 1098 bp, Ceutorhynchus assimilis
atgagtgatcagagtggtatgagagccttaattttggtcgggggctacggcaccaggctgaggcctttaactttgagccgtccaaaacctttagtggaattcgcaaataaacctattttgttgcaccaagtggaagccctagttaaagtcggtgtcactgaagttatcctggcggtttcctatcgtgccgagcaaatggaacaggaactagccgatgaagctaaaaaattgggcgtgaaaatggtgttttcgcatgaaactgaaccgctaggaactgctggccctatagctttggctggagaacatttgagaaaaagcgacaaaccgtttttcgtgttaaactctgacatcatttgtgattttccatttaaaaagttgattgaattccacaaatcgcacggcaaagaaggcaccattgtagtgacaaaagttgaagagccttcaaaatacggtgtggtagtttacaatgagcaaaagtgcattgaaagctttgtagaaaaacctcaggaatttatttcaaataaaatcaatgcgggattgtatgttttaaatcctagtgttattgatagaatagaacttaaaccaacttcaattgaaaaagaagtttttcctaatatggcaactgacaatcaattgtttgccttcgagctggaaggattctggatggatgtgggacaaccaaaagactttttgattggaatgtgcttgtatcttaaacatttgaggagtgcagatccagagaaattgtacaggggaccaggcgtaataggtaatgtcttagtagaccctacagcaaaaataggcaaaagttgccaaataggaccaaatgtcaccatcggcccaggtgtagtaatcgaagatggcgtgtgcatcaaacgcaccacaatcctgagagacgccaccatccggtcaaacacttggctggaaagttgcattattggctggagatgcaccgtgggccaatgggtacgcatggaaggcattacagttttaggagaggatgttattgtcaaagacgaaacttatattaatggggggcaggtgttgccgcacaagaatattggggattcggtgcgtacgccacaaattattatgtga

SEQ ID NO: 1326 - DNA, 867 bp, Ceutorhynchus assimilis
atggcgtctgagggggacgaaataatttctgatcaagaaaaagtgcgaatagtttccgattttataatacattcgccgcccggcgagtttaacgaggtatttaatgatgttagaaaattgctggacaacgacgacctgctcaaagagggggccagcggggcattcgcccaatacaacaaggaccaactgacccccgtccgaatagagaattctgatcattgggtactgattactgaatacaacgatttaggaaataataggttttttgatccccgctccaaacaaagtttccgttatgaccacctcagaaaagaagcgtccgactaccaatcctacagcccggatacaacagccgaaccgtggcggtctgccctcgacacagaatttgttcaatacacaagaaatcactataaagatggtgtatgcagcgttatagggcgcagccaagggggcgtggtcagtttgacagcatgtatcgaggaccatcagtttcaacccaaaaatttctggaatggtagatggcgtagtcaatggttcataaccctaaacggtacctcaggtgccgaactacgaggtgtcctcaaagtacaagtccactactatgaagaaggtaacgtgcaactggtcagcaccaaggaaacaaaagacacagtcagcattaccactgaagcacaaactgttaaagatattgttcaggcaatagaggctgcggaaaatctttatcaaactgctatttcggagaattaccatacaatgtctgatacgacttttaaagctcttagaagattattgccagtcacacgtacaaaaatcgactggaacaaaattgtttcctacagcatcggaaaggaactgaaaactcaatga

SEQ ID NO: 1327 - DNA, 3825 bp, Ceutorhynchus assimilis
atgaaactacgaataattttactagtgacagttttttgtggtgtaagtttaggacaagatttaaatgaatcaaacccagacgttgaagccgttccaggcattattctagacttgggagaatcttctggacaaccagtacccgctgaggatgtaccacaaactccaacgcaacctaccaataacgatacagataatgtagcagtagatgatgtagagcagatgcctggtaacactagtttgcgtacaggtcaaaaaatattacgttttggaaaatacgttacttattatgaagctgattacgatccaatgacttcccatgttgcaccaccagacacagatcaaaggggtggttctggtactccctacaccctaacagaaaccagattgcaaacaattaggaaattattcatgtatcccttctatgaccaaggaggtaatgcagacaatgagggcgattaccaaaaagaaatccagtcatcgtcgcctcaagtccacaaaaacttcaacttccagttgccgtttttcggcttcagattcaactacactagagtgtctttgaatgggtatttggaattcagtgacccgccacccaactacaactatcccttgacttttcctgtaagggattggcccaagaaaaacgatccttcgtttattggaatatttttcagcaaatgtagaataggcaatcttcgtgatgaagacgaagacaaacgcttaccaggagtatatttccgcatggaaagagatttgctcaccagaaccgatcaaatgggagtggaaattcgtgaaagattaaagtgggacattcgagaaggggttattggctcggaagccttcgatcctaaacacgctgtcattgttacctggaaaaatgtttcctttaatggaggctttggaaatgctatttacaaaaccaacacttttcaaatggtccttgcaacagatgaagtctacacctatgcaatttttaactatttgaatttggattggacgagtcatactgaagctggaggggataccactagaggcgaaggaggtgtgccagcttatattgggtttaatgcaggtaatggtaccagatcctgggaatactctccctacagtcaagcatcagtcctaagagatttgagcggcagaggctacgctaacggattcccaggcagacacttattcagaatcgacgaaaacatcctggttggcacgtgcaataaagacatcgatggcgcaaatttacccctaatgtttgctccagaatctggcaacatgttgggtggtaccgttgtcaacattactggcccatgtttcaacccaaccgatcaaatcttatgcaaatttgacgtagccaatgtagtttacggtaccgtagtgagcagaaacagggcaatttgcgtccaacctttactaatggtagaaggatacgtaagatttgaaatcgccattggaccaggtacttacaagtggaaaggccggtactatgtggaaactcctgcaagtgcggctcagaaaatctacttcaaagacatgaaagtacacgaaaaatcccctagtgaaataaaaataacttgggaaaaatataatttgactacaaacgaaaacgcaaacattagaatttcgctttggggctaccgcgaaacctccataagaccctcactattatacattacagatatagctgaaaacgtccaaaacactggagagtacacgatagtaccttcacagtaccgcaacagagaaaacacctttttaaccgacataaaattcggcttcattcaaatcaatttaaccgaatcaatacctattcagtacgattatagcggtaccactcaaacaactacccaagctacaaccattaaccctgtagtatggagcaggcctatacctttaggctggtacttcggctggcaatgggaacgcatgtacggtaccaactggcccaaaaccttatgcgacgattggctaaggaccgacagatacctaaaaaactttgcccacgagctaccgcaatgtccttgcaccctggaacaagccctcatcgacaaaggcaaatacatgcccgattttgattgcgacaaagactcaaaccccacttgctactacaacaaccaagcagtacattgtgtgagaactggttctcctacactagaaggttccgagcaacagtgttgctacgacaaaaaccactacctaatgttgtcttatgaccaacaatggggctccagcccgaaacgttgccacaatttaggcctaatgccgtaccaggaagcaacaaaagtacccactttgtctcaatggttcaacgatatggtaccaaaatatttgtgctgtttgtggcaagatgaacaagcagttggatgtgaaactgtacgttttgaacgcaggcccagtcaggattgtgtagcttatcaagctccaggggttgcaggagtttatggagacccacacatagttacatttgatgatttagaatacacattcaacggtaaaggggagtttgttttggttaaatcaaaggccaagctgaataatattgaagtgcaaggcaggtttgagcaaatggatcctaatttgtatggggaagtaagggcgactcaattgagttcggttgttgcacgaggcaattcgtctactattgttgaagttaggagaaggcccgaatatgcccgatggcgttacaggctggatgttattgccgatggtaaaagagtctactttgataggccttccttgaagttccaacatttccctggagtaactgtttatactcctacttatattcttaatcagtctgaggtgattatgatgttcgataatggagttggagtggaagttttggacaatcaaggatacatgactgcaagggtttatttgccttggacttttattaataagacagctgggttgttgggcaattggagttttaataaggaagatgactttactttgcctgatggaagtaaagtcagtgttgctacaaatgttaatgacatggaaagggtttatacgacgtttgggtctttgtggatggttgatgatgttctggattcgaataaaggtcgcgcaatgttccttagggaaaacggccaatcatcggccaacttcaacaacaaatccttcgttccaattttcgcgatgacacccgaggaaattataccggccaaccggtcgtcacaaatcgaccggacttaccaaatttgtacttccaaaatgtacgagtgctactacgactacgccatgacactgaacagagatttggcccattacactcagaattataaagctacaatatatcagtataaggaacttagtaggacaaaggttatttcgtgtggtgtcttgccaacaccaagatttggccgcaagagtaccttcctgtttataccaggtaccaaagtgacgtttgagtgcgatcaagatttcgtcctagtaggagatgctagaagaacttgccaggcaaacggacaatgggatgttccagaatatggatacacttattgtttacgtcaacaagagtactctcaaaggcaactagccatggcctccggtgtggtattcttaataataattcctctacttctattattcttctatttggcctacatgtacctgagaaagaagcaacaggaaaaggaagaagaagagatgctggatagcgcctacgaagcacaaaaaaggagagctcaagaagcggctgccaaaaaactgaccgaagctaacgagtacgacgacgacgatgacgtcactagcaatttaaccagtacagcttcgccggtacctcataccgcaccagcttcacctacagccaaagaatcgacgatttattaa

SEQ ID NO: 1328 - DNA, 336 bp, Ceutorhynchus assimilis
atgcgttacgtggctgcttaccttttgtccgtcttgggcggaaaagcctcccccagtgcggctgacattgaaaaaatccttgggtcagtaggtatcgaagctgaagcagaaaaactgaaaaaggtcatctctgagctcaatggcaaatccatcgaggaagttatttctcagggccgagaaaagttgagctccatgcccactggtggcgctgctgcacccgccgccgccgctggtgctgctccagcagccgaagagaagaaagagtccaaaaaagaagaaaagaaagaagaatccgaatcagaggatgatgacatgggctttgccctatttgattaa

SEQ ID NO: 1329 - DNA, 2763 bp, Ceutorhynchus assimilis
atgactactatgactgcattgccattgggtacgattggtgatcattttggtctcaaatgggacccaaaaaatctagaaataaggacaatgtcagtggaaaaaacactggagcccttggtacttcaagttaccactctcgttaacacaaacgggccttccaagaagaaaaagggcaaatctaaacgtgccaatgctttagtacagactgttgaaaaggccactgaaaattttatagaaaaaggcgaacaaatcgcttatgaaaatcctgatatcactgaggagatgttggctgccgttgatgaagttagaaaaacaggaactcaaatgagtagagatgctagagatttctcagaagacccatgttcatcgctcaaacgtagcaatatggtaagagcggccagaaatcttctctcagcagttacgaggcttctcatcctggcagacatggtggatgtacacctattgctcaaatcactccacattgtggaaaacgacttggaaaaactcaaaatggcttctagcaatgacgaattgttagacaacatagaaacatttagacacaatgctaacgaactgatgaatcaggcagctaaacggcagcaagaattaaaagatccacagctcagagatgatttggctgctgccagggcagtgctcaagaaacattcaaccatgttgctcacagcttcaaaagtgtatgtacgtcatccagaacttgctgcagctaaagcaaacagggattatgttctgaaacaggtttgtgaagctgttaatactatcaatgatgttgctcaaggtagggcacctcctgctgcgggtccatatgatggacctggtgaattagcagcagctcttgatgattttgatgaacatattgtcatcgaacctttggcttataatgaggttcatactaggccatccctcgaagaacgcctggaaagcataatcagcggggctgcgctaatggcggattctagctgcacaagagatgacaggcgcgaacgcattgttgctgaatgcaatgctgtacgtcaagcactacaagacctgttgtcagaatacatgtcaaatatgggtaataaggacaagacagaaagtttaggaaaggcaattgataacatgaagggtaaaactaaggatttgaggaggcagctaagaaaggcagttgttgatcatatttctgacagcttcatggaaacaggcatccctcttcttattttgatcaaagcagcacaaaacggcgacgagaagcaggttgaagactatgctggtgtatttactgagcattctaacaaactcgtagaagtggctaatttggtgtgtagcatgtcaagtcatgaagacggcgtcaaaatggtgcgttacgccgctgctcaaattgactcactatgcccagaagtcataaatgctgccaggattttggcagctaggcctcgtagcaaagttgctcaagagaatatggacgcgtttagacttacttgggaaaatcaggtgcggattttaacagatgctattgatgacataacaaccgtggacgatttcttggccgtatccgaaaatcacatcttagaagatgtgaataaatgtgtgttagctctccaggaaaatgaagctgatactctggaaagaactgctgctgccattagaggtcgaactggacggataggagttgttgttgcagccgagatggataattacgaaccttgtatctataccaaaagggttttagaagctgtaaaggtgctcaatgatcaagtgatgccaaagtttacacaacgcgtacaagttgccgttcaagcaataataaatggacaacagggtcaaccctctaaagaattggacgaaaatgaatttattgatgcttcaagattggtctatgatggcgtcagagaaatccgcagggcagttcttatgaacagggctgatgaagatttggatccagaagatgttgaacttgatgaaaattatactttggagactaagagtaaatcgagtgcccatacaggtgaacatggtgttgatgaatatcctgatataagtggtatcacaacagcccgtgaagctatgggcaaaatgccagaagaagaccgtaagaagatccttcagcaagtagaatacttcagaagtgagaaactcaagtttgacagagaagtggctaagtgggatgacactggtaatgatatcatcgttttggccaaacacatgtgcgttatcatgatggaaatgactgattttactcggggcagaggaccattgaagactaccatggatgtaattaatgcggcaaagaaaatatcagaagccggcacaaaacttgataagctaaccagacaaattgcggagcaatgcccagaaagttctaccaagaaagatttgatagcatatcttcaaagaatcgctttgtattgccatcaaatgaatattacctctaaggtaaaagctgatgtgcaaaacatcagtggggagttaattgtatctggtctggatagcgctacatctctaattcaggctgctaaaaatttgatgaatgcagtagtattgactgttaaggcatcctatgttgcatcaacaaaatatccaagacagggaactgttgcgtctccaattgtggtatggaagatgaaagcacctgaaaaaaagccattggtgagacccgaaaaaccagaagaagttcgcgcaaaagttagaaaaggatcacagaaaaaactccaaaatccaatacatgctctatccgaattccagagcccaaccgaatcagtgtaa

SEQ ID NO: 1330 - DNA, 1266 bp, Ceutorhynchus assimilis
atgtcttttaacttcggaactccgcctaatacaatggcaccgcctaatgcaactgcaccgcctaaagccgctacaggattcactttaccctcttcgaccccagtttcagctgcctcaggtgctccaggcggtgggttcgcgttcaacttaagccaaacacccggtgcaggtgacaacaaacaaacaccctcactattttcccaatttaaacctgctacaccagcaacaccaactggcttgaatttcaatttaggacaagcacctaaaacagctgcacccactttatcatttggaacacccactgctcctgcaacaactggcgctacagcaggatttggtggttttggattgggaactgcaggtaagcgtccagctcctgcttctgtaacatctacagctgcaaccagtgtgccaggacttcagttcagcttcagttcaccagcttctgcagctgcaacaactgccacaactactttcactcctattgttggttccactgcaactagcactataaatgttccagcaacagctccaacttccagtgctccaaagctgggattaggtgttgcacctactactactactccggcaaccacaggattttctttgggtttaggtagtacagctgccactacaacaactgttacttcagctcagtcgacaacttctacagcagccactacaaccactggatcactgacttttgcccaattagaagatgcaatcaacaaatggactattgatttggaagaacaaggaaaattctttatcaatcaagctaagcagcttaacgcttgggacactttattgatttcaaatggtgacaaaattctgaatttgaacaccaacattgtaaaagtacagcaacaacaatcccaactagatcaggaattggattttattagtgctcaacaaaaagaactggaagaactcctggtgccactagaaacagaattaatggatgttcctgcgactgatatcaacaggaaccaaatgtatcagttttcagaaataattgattcacagcttaaacaaatttctgatgatctaaaagaaatcgttgaaataattaatggttcaaataaagaccaggacacttcaaatccaattcagcaagtaagtaaaattctgaattctcatatgcactccttacaatggatcgagaaaaatacctcagaaattagtaagcaaattgaagaactttccaagatggatgaaaacactagaaaaaacatcagttttaatggttctaatttgtatcagtga

SEQ ID NO: 1331 - DNA, 582 bp, Ceutorhynchus assimilis
atgttcatctgggattggtttactggagttttaggatacttaggtttatggaagaaatctggcaagctcctcttcctgggtctggataatgccggaaagacaacactgttgcatatgctcaaggatgatcggctagctcagcatcttccaacgctacatcctacatctgaagaactttcgattggcaacatgagatttactacttttgatttgggaggccacacacaagccagaagagtatggaaagattacttcccagcagtagattcaatagtgttcttggtagacgcctacgatagatctagatttaaagaaagtaaacaagaattggactcgttactcacagacgaaagtttggcaaattgtcctgttttgattttgggaaataaaatcgacttgcccggcgctgcttccgaagacgaacttaggaattactttgccttgtatcaacaaacaacaggaaagggtaaagtgccaagagcagatcttccaggacgccccctggaactctttatgtgctccattaaaaaaagacaaggttacggtgaaggttttcgttggttggcacagtatattgactga

SEQ ID NO: 1332 - DNA, 558 bp, Ceutorhynchus assimilis
atggacggaattgatttgttggaaaaacgcattgaagccctcgaagagcaaatattgcccaaggaaacctcgttggaaaacaagtcccaggccatcaccgatttactgttgcagtctcaaacgatgatcacttccgctctgagctgtcgagaatcaatcacttctatcctaggccacatgactacaatcaacaactatttggacccttgcaattgggaaaacgatctggaagttgaagctaagaggcattacttattggaattgtatccagagctcagaaacactgtccagctggtacgttctgtccaaaaactcatcccatacaccaactcagataagatcatgaaagtgactgagctgtcaggcaaactggagcagctgactgaaaccaatctggttgtatactcagaaagtcgagacgtgactcagaaggtgctaaaatcattgcaacaatacaatgacatcaccacctccattaaagtcttgtttgctcagctggatcgagctgtagttgttttggaagaggctctactacccaaatttgaaactgaagagtag

SEQ ID NO: 1333 - DNA, 1752 bp, Ceutorhynchus assimilis
atgtccacgtcggaagtatatagcgatttaactttatatacaacagcagaaaaactatatctagaacccaaaacaagtgacgagttgcttataatcgaccgagcatccgaagttatcagcttacaaaggaacgcgggccaaattcctccatccaatacccgaatagacttttgcggtttgttgggatcaatcgaattacttgctggccggtatttggttatcataactcagagagatttagtgggttatattgctggtcatcctgtatggaaactagtcaaagcagaacttattccttattcaaaaagtctattacatttgaccaatgaaaaacaagcagacaataatgtctaccttagtatggtggaaaatgttttagccactccaagcttttattttagttatagctacgatataacacattcaattcaaagattgcacgatatcagccccgaattctggcaacagtcattgctagaacggtctgatgcgagatttgtctggaataagcaccttttgcaacaattcagggagccgagcttaaaacggttcgctttaccgttaatgcatggttttgcctccataaatcagtgtgtaattaatggacataattttgtttgggctcttatatcacggagaagtgtgaacagggcaggcacaagatggttccgtagaggcattgacaaatcgggtaacgtagccaactttgtagaaaccgaacaaattgtagaatctggagaaggagacagagcttcttttgttcaaattagagggtcaattcctttattttggttccaaaaacccgacctcaggtataaacccagcattgatattgaccatagtgtcgatcctcaggagcatcaaaatgcttgtctgaggcatattgaatcgatggccggagtttatggcaggcaagttatggttgatttggtcgatcaagttggatcagaaggtagattagaaaaagccttcaaagacaccatcaattatttagctcatccgtccgtgagatatgaaccattcgattttcacgccgaatgtagaaaaatgaaatggcatcgattatcaattttaatagacagagtgtctttggatcaggacgaaatggggtactttttgattttgaaagatggtactctgtcctcattacaagaaggtgtctttagaacaaactgtatagattgcctggatcgtaccaatgtagtccaaagtatgttagcgcacaggaatttagaaattgtgcttaggaaattcgatattttaagcccagatcaaaagctagaaatgcaactttctttcgagtctttgaacaaaaatgtttgggctgatcatgccgacctcatcagtactcaatattcaggtactggagctttgaaaacggattttactagaacgggcaaacgaacaaaagcgggacttattcaggatggaatcaattcgttgatgcgttattataagaataactttaacgatggtttccgacaagactctatcgatttgtttttgggcaatggaaaagtcgtttcaccaattgcaccaccaccaggatggagatatattacttttccttcagttttacttatagctacggcgatgtttgtagcttcagctatattgcccgcagaatattccactgaatgcttgatgtatttgatgttttggggaggaatgatggcagctacagcttattatatatttcaatacggtccagagtttgtggataagccaaaactaactaataataattcatag

SEQ ID NO: 1334 - DNA, 1677 bp, Ceutorhynchus assimilis
atgacgatacaaaacggagctcctgccgaaaaacgacaggacagaccatcaaaacctccggaaaaaaagcaagaactaatagttcgtgtaaagtacagcaacaccttaccagacttaccatttgatctgaaatttatctcctacccctttgagccttcaagatttatccaatacaatccaacctctttggaaagaaactatagatacgatgtccttacagagcatgatttgggcgtaaatatagacctaataaacaaggacacttatcctactgaaccgggtgttgttttggacccagctgatgagaaacttctcgaggaagatattcttgcgccacaagattcaaaaagatcccggcaccatgctaaagcagtctcctggcttagaagaactgagtacatctccactgaacaaaccagatttcagccacaaacaatggacaaagtggaagccaaagttggttttagcattaaaaaatctctcaacaatgaaacacattatatggatagaaatgcgcaaattgaggctattgaaaaaacctatgcagactccaaaatacctattgaaaagcactatagtaaacccaacgttgtaccagttgaagtgtttccagtttatcctgatttcaatttgtggaaatatccttgcgctcaagttatatttgattcagatcctgctccggttggtaaaggtgttccagctcagattgaagaaatgtctcaagcaatgattcgtggtgtgatggacgaaagtggtgagcaatttgttgcctacttccttcccattgaagaaacattgaaaaagcgtagagaagattttgctaatggtgtcgcttaccaagaagacgaggagtacgagtacaaaatggcacgtgaatataattggaatgtcaagagcaaggcaagcaaaggctacgaagaaaattacttctttgttattcgccctgatggtgtttattataatgaactggaaacaagggtaagattgagcaaaaggcgtcaaaaagtaggtcaagcccctagcaacactagattggttgttaaacatagagttatgaatgctggcgaatttaaaatacaaagatacagggaaaaacaattggaacctccacgtgaagatgatgaagaagaatttgaaatggatgaaactcaggaagatgaagtggcagccaatgatagccaaggagaatctgaccaagaaaaagacaatgttgacattgaagataaacctcaagacagtgacaatgaaagcaaaggcggcagaacatctagacaatcgcgtgcctcttcacgcacttccagaaaatccaaatccgcttccagatctaaatcgggctcaaggtcctcatccaaatcaagatcacgctcagtttcaagatcaaaatccaagtctccttcaagatccagatcagcttctgcatcaaaaagcagatccccgagcaagtcaccttccagatctcgatcagcttcgaaatcaccatctagatcaaggtcgcggtccaagtccgcatctagatcaaggtcgcggtctaagtccgcttctagatctagatccaggtcaaagtctggtagatctaggtccaggtcaaagtcgggtagatctaggtccaggtcaaagtcgggtagttctaggtctggttccggttcaggatcaggaagtgcttcagaaagtgagtaa

SEQ ID NO: 1335 - DNA, 1170 bp, Ceutorhynchus assimilis
atgcctgtcgaaaacctggaagatcaaggcctggaaaagaaccccgacttggaattggccaattacaagttcctgctcactttgcccgaatttcgaaatgataagggggtacatgcgaaaatcactgaagctatcaagaaagatgatatggctccttggtatgaactcgtttgccaagacgccggctggaaaaaagacgaaaaactcctgaaaaccttcaaaacgaaaaacgaggaacaaataaagaagctggacgaagctattgaagatgcggaaaagaatttgggcgaaatggaagtgagagaggcctacttgagaaaagccgaatactacagtagaataggtgacaaagaaaatgccatcagcaccttcaggcaaacctatgacaaaactgtatctttggggcacaggctagacatcattttccacttgataagaatcgggttgtttttcatggaccatgatcttatcacgaggaatattgaaaaagctaaaaccctgattgaggaaggaggcgattgggacagacgcaatcgcctcaaagtttatcaaggggcttactgtatggctgtaagagactttaaaactgctgctaacttgtttttggacactgttagcacttttacttcgtatgagttgatggattataaggcttttgtacgttatacggtttatacttctattataagtttgccaaggaatcaattgagggataaggttgtaaaaggttcagaaatccttgaagtattacactctgagcctttcgtcaaagactacctgttttccttgtacaattgccagtacgccgattttttcaaaaacttagccaaagtagaagagatattgagaaaggactacttcctcaacccccactacagatactacatccgggaaatgaaaatatcagcttacactcaactgttggagtcttacaggagtctcactttgcagtacatggctgaagctttcggcgttaccatgcaatttattgacgaggagctttcatttttcattgccacaggccgagtgcactgcaaaatcgacagggtgggcggaatagtggaaaccaacaggccagatttgaaaaacgcccaattcaatgctgtggtgaaacaaggcgactttttactgcaacgcgtccagaaactatccagagttattaatatttaa

SEQ ID NO: 1336 - DNA, 15705 bp, Ceutorhynchus assimilis
atggatgaattacctccggttctagatccagacgagcttatggatctagaagaaccggaaacttatgaaattgaagacgatgacgaagaaattgttgaagacccatcatcatctccctttcaacagttttcttctggaccggcatctaatgcgacatctgcagcctcatcaccacacaccaatgatgattttccaccacctttcaattttaacgggaaacctgttactattaaaaggggccgtggacgtcctaggagagaaggaggtaaaccgactcccagacgatccggtggcgttggtgttcccagagttagaagagcaaaatctgctggattttcccgttgtagaggatccaggagtgttagacaaccagacagaatggattttgatttttcttatatcagccctacttctattgatgacatgggtctcactgacatcgatggttttttcttcccagaaagggaaagacccagtccagtttttgaagaactaccttatgcaccagaggtctggcctggaaaagtctgtgctttttgtaatttgggtgaacgcagtcagctaggacaaggtgaaataatgagattaaattgcccagatggttttacgcctcaaagatcagtcggtgaatctaacactccagctgttcaattaccagatagggattttggtgataaaagtccgcgtggtcctgttacatgcaggaggaataaaaattttaatagaagtcgaagttttgtgtccaataatgaacatatagatgagcttaccataattggacatgctgaagaaccaagtgtgaacattttgtatgaaataagtggacaattttatgttcatagaaactgtgccttatggtcaaatggggttacccgcacagaacatcaagccttagaaaatgttggaccagttgtactaaaaagttcatctcagaaatgttcattttgtaatcatttcggtgcaagtctcacatgcaggtcgaccggttgtacaaaagtttatcatttcccatgcgccactgcctcaggtgccttccaggatatcactagtttgcaagttttttgcaccaatcaccttcacgaagctgccttgtgttcggaatccgccatttgctatacgtgtaaaagcgtgggagatatttcaaacttaatgtattgctcaagctgtggcacgcattatcatggaagttgtgtgggtttagctcagttacctggcgtaagggctggttggcaatgtagaaaatgtcgcaattgccaagtttgtcgaatgatgggggacgaaactaaattgatgagttgtgagcagtgcgacaaggtttatcacgccagctgtcaacgcccattagttacgtccattccaaaatatggttggaaatgtagatgttgtagagtatgtggcgactgtggttcccgaacaccaggcgctggtctatcttctagatggcatttacactatacagtttgcgattcgtgctatcaacaaagaaataaaggttgttgttgcccaatttgtcaaagggcttatagatcacatgctcatagggaaatggtgcaatgtggaacctgccgaaagtttgttcatgggacatgtgatccagaagcagatttggtaacatatcaacagaaaaaggaaataaatcctgattatgagtatcattgcgttatttgtaaaaattcattgcagcaactctccagccgccctgtcactagcaaaagatcaagtctagatgactttggagatttgtccgcttcccaagaatctttatatgatgacatatcagaatttgatatgccttctgaagaatctttcagagggacagggttgggaaaaggcaaaccatatgcaagtaaaattgcgaagaagaaattgagttattcaactggaatgcctgggagaccaaagggtagttttggcaaaggcaaccctggcaaacaaggattcatgaaacgtcagcgcttagtcgaatttggccgtaaaagaggcgccaaagctaaaatacggggtgtgtttggagtaccgggagttggattatctcgtcccgtatctgatggtaaaggagacgaagaaccaggagtagaaaaccgactagttttgtgttctgccaaagataaatttgttctgacacaagacatttgtgtgatgtgtggagccttgggcaccgaccaggaaggttgccttatttcttgcgttcaatgtggacaatgttatcatcctaactgcgtgaacgttaaagttactaaagttattcttaccaaaggctggagatgtttggattgtacagtttgcgaaggctgcggtcaacgcaatgacgagcctagactaattctttgtgacgattgtgatgtatcttatcatacttattgtatggatcctcctttggattacgtaccacatggaaattggaaatgcaagtggtgtgcatgttgtcgaagctgtggctccacagatccaggatttaatagcacatggatgaatggatgtacagaatgtggaccatgtgcctcccattcagcttgtcctagctgtaatgagtcatatgcggagggagatcttattattcaatgtgctcaatgtgaacggtggttacatggtatatgtgatctcattaaaacagaacaggatgcagaaaaatgcgctgaagatggctacacttgcctgctatgccgccctagagacgtcccacctccacacttaattccttcctcgatagcccccaaaccaccgacgcctactaaaagccctgaggtccgctcgcaacccaacatcttcgtcgatggtgtttgtctcagcgaatggggccatagtctaattaaatccctttcccaggagtatcacggtactcgcaagaaacgcaagaaacttccaccagttgtacatgataaagaagctggtataatggcaactattgagtcagttgttgctggaggaagtggaggcgaaaatagttttgaagataccaaaatagaattagtggatatgaaagacgaaccgcaagagctttataaagaaggcatgatttggactaaagaagatggttctccacctgaaggatttactatttttaccatggaaagtggtatatgtgttttaaggagaaaacggcaaagaaatctgcaaaaattgggtataggaggctttttggttcggatgagaggcttcaagagtcaggaaaatgatgagattgatactttacctggacaaagtacacttaattttgatttaccaataccaatgacgtcaacactcgaaggcgataaaccaaaaaagaaacccataagacgcaagcaaaaatctaaattggctgaaacatttcctgcatatcttcaggaagctttctttggcaaagatcttatggatgtaactgagtttaaaaaagaaatggagggcggtgttagcagtgacgaagataaactttttgaaaataagcagcaggcgatcaagttaacagcagaggaactactggcagttgaaagtgctagacaagaaaagaccacctctgaggggcgctctcaaccgagagacggcttttcagatactttaaaaatagataaaccaattttgattaaagaggaagaggacgacactgctgaagacttgaaagatgtacttgctttgcctggcgacttactggatactgatttggttaatagcattataaatgaagatgatgaattgactaaaaacacagaattggatgctttggcagatgatgacgcagaacttcctcagactttaggaagctcagaaaattctaaagatgccaaagacgaattaagtgatattttaggatcacacttttcactagaatctatacctaatataaatagtaaagatgttgaggatatatttaagggcgttcttaccgatgaatcgcaagaatcgcagctttcccaagaagccacaaatatgtatccttcaatgccatccacgccgactccaattagtccaatgtttccaagtaattcgtctcaactaccgacagctggtataatacctcaaatgcatttgccttcagctccagttagaccgactgcgttacctggagttcagcatgttagcttccctccgtcgccttatcattctgaatatagcaatagtccccagtttagtccggcgttttctgaacctccaagtccttgggtaaacataaacgacaacacagaaatggacactgccagcgttgcaggtgtgccatccacccataatcaacgttcttcggaaaaaatgaaggcagatgaaggtctcggtaatggggccactatatcggcagttctctatgccaataggaatcatccagaatggaaagctgagtatcctgtgtggtctgacagatacaagcatattatcaaaaagtggagaactttgagtcaagacgagaaggctccatatcttcaacaagctcgcgacaatcgaagccagcttcgaatgaagaaacaacaacagtcacagaccagcaaggaaacctccacaacgagtcctgtcgctcccacaaagccaccccctaccgtagtaccggcagctgctttggttaccaatctgccttcaccggggttaccaccaccttcgctcgttacacaggcgcaggcgcaacagagtcctaccgcgataactactgaggaccaagaaaaattagcccaacaacagagaacagcccgagaggctgagcaagaaagacaatggaaacatttacaagccatgagacagcaacaagctcagcaacaagcgcatgttattcaagaacaaagagttcaagcaattgcaagagtccaacggacaatgtcagaccctaatcctcaatttatccccaccaaccaaacgagtcccctacaagttaccacaacatcgcaagaaggcagtcctgtggctcctccatcacccagacaatttatcggtataaaatcgccaccatttgcccatccttcacctccttccactaatattcgtactcctacctcttcacagtctccggttcacgagttccagcaaccaaatcagcaaactccgaatcctgaggaatcctttatagaacccactagtccgcaagtcaatttctctaaagtaccaaccggaaatgaggcgtttggtcaaccgcctccaccgaggagtccatttgttgctgcaagaccgcccatgcaggctagaccggatcaaccagaaatcgcacgtcagttgcgggagttgctccagaggcagcagcagcaacaacaattgaaaaacttcgatttggtgcaagcaaaatcaactcaaagaatctggaatcctaatgatccgcctgcaactgaacctgtgaatgcgggtgcgactgcagaagaaataactttcaggcaaccactaccgcctggatccgtaagacccagaatcccattacaactaggacccaggcctggtccaaatctccgtatgccgcaattagaaggcaggcttcaagggctcgatcctagattaagactcattctacaccaatcaagggctgctctgcctggccaacaagtaccggcaggcggtatacgcttcacccaaggagcaaaccgaccggcaacaatcgaacaatatgaacaattgttgcaccgacaagctcagctacaagctagaaatcaagctttagagcaacaaggtgtcggtgtgaggttgcctttaggacaaagtggtggtggggtgattcagaaacaaccttcctcgataactcaagcaatgcctgtagttcaaccagctcaacaagcggctgcaacaaatgaccaagaaatacctgataatgtaactgcagaactagaaaaattggaacaagaaactggcacaatggccgagctgcaaggtgtcagcgaaatattgggaggtttgggagatgatgacgacgaactcctagctgaaatgggagcagatttcaatattttggagtatgcggatccagaattagaagcattagcgggagagaagacaaacattctggatttggatttggaagatgacaatatgaagcaggaaaagaagagggaagctatgatgcaacgacaaaataatgtctcttctgcccaaacagcaacgtctcaagcgactaaaactgtagttgcaagtaattcacagaaagaacaaaagctagaaaaacgaccaacctccactgctgcagaagagccgcataaatcagatgcatctgctttacctcaacctaataataatcctccactgcctcttcaaaaacatcaacaagttcctcaaacacatcaagtttctcaaaaacatcaagtgtctcaaaaacatcaagtttctcagaaacatcaacctcattccgataataatttacgtcctcaaacgccagcattggcagatcagtctcaaaatcaaataactcaaaatttatcacaacagcgtgttgtacaaaatatatcctcatcgcaaccccaactagcccaggctttggctaataattcaaatccacaacaacagcagcaacaacagctgcctcagccagagcctcccgtgttacagcaacaattacaacaacagttacaacaacaaccaccacaattacaacaacaacaaccttctccttcccaacatcaacccaatattgctttaacagcccagcaactccatcaacagatgctgcagcaggtaggatgcaaaatgtccaaatatgtacagcaagctgctgctatgggaaaaccgatgccaccgggatccaaactacaaacccctgaaggtattgtcggcattgttttggctaataataatgtccaattgcaaatacctccgaatttccaacaaagactgctgcaaacattacaaaatcaaaaactccaaatgcgaatcgggcgaactgttccccgtccccaacagccgaatataaatcaaccccctcagcctgttcctggacaaatagcaagacccagaatggctttaccaacgccacctccaccgcctccgtaccctggtccaccgccaccctatccagggaatctcatggctcagcaacaggcaatgcctcagcaggaacagcctctgttgctggaagatctattggaacaagaaaagagagaacaggagaaacaaaaccacaatcatcctctaccttcagatatcaacacaagaagtaacgattcagaatcggctttgtgtgttagcgatcatgattttgaaagactcaaagctgatgtattcagtagtgggcattctgatacctcatcttcagactccacagttggcatggtgcaacaacaatggcaacctaatcgtctacagatgcccagtgcgccaactcaacacactacagaagttacgaccaaaattcaaatgttcaatgcaaatttaatgcctgctccgccactaccatcagaaaatatcgttacggaacaagacaaacaggctcaacttttatatgagcagtggcttaataatcaaaataatgttttgactcagcaacttcgatactatgaaactgaagtgctaaaattacgtaaaagtaaaaagtcattaaatagcaagcaaagacagctaaggaaatctggcaatcagctaactgaaattgattcaaatgagctacaaaggatttctgccgagcaagctattttacaaaaacatctagagtccagcagaaagcagagtcgtcaacatggaatgctcatacaggaataccggaataaacaacaactgctccagaagcccctcatgggcgggccgcagacgcaactagcctcccctctaggacctccaggatcttctccaatacatcacgcagctgccagtcactcacccatgttgtcaccgcaacagtcgcctttgcctcagcagtctccattgacgcagcataattcacctatgaatagtccgggtcctatgatggttcattctccagggcctggatcagtggctgctttgttacagagtccaggcgggagtgtgtctccaatacagactaggattgggacaccattgtctcaagaaggaagcccaggtccaatccaatcgccttcccaagtttgtctgccaccaccgatgcctcgaatgacatctccccaacatcgccgagtggtaaccagccctgttggatatacaggagatatgcgcagtggagtgacacaaatgagatttatgagacccaccgtggaacataattctctgcaacgtatcagaggtcaagcgcctggtcaattgcagaatttcccctctaaagttggcactccatctcctctcaatagtccacctctgaatcaaatgtcactggctcatcagcaaatattacaaaagcaattgcatcagcatcaacaagctttgcttcatcaacaacagcagcaacaacaacaacaacagcagcagcaacaacaacaacagcagcaacaacaacagcagcatcaacaacaacagcagcaccaacaacaactacaacagcagcagcaccaacaactacaacagcaacagcaccaacaaatacaaatttccgatggtactcagcaacaagaagcaaatgttatgcattctccccgcgttgcccaattaatacagcatagaaatcttggacgaccgcagcagcaacaacaacagcaaactttgacggctcaacaacatcagcttttgaccaaacagcatcaacaaatagctcttcaattacaagcaaggctgaatcaacaatctcagcagcaatcacctactccacaatcaccaatgcctccaaaaagtcccatgcacaaccagaatatgtctcctctatcgatgcccacctcgcccatgcctccaaaaagccctatgttgtctttcaatcaacagcaaagcactcctaattctccagcagctcatagaaattcttactctcaaaatcctactatgaatcaacctccgagtagtcccatgatgcatcaatatcatcaacctacttctcctatgatacaatctccacacgcaatacgtcgacctccaagcagtcctgctatgcctgagaggcccttgagcgtagaaaatcctggtacgcccagaactccttacagtttagatatgcatcttcaagataatatgcacacagggggaggaaatcctaataatccaaataatccaattccattgcctcctgatgggttttgctactctaagctaggcttaagaggcggtatgtggagcggatttggaagaggagaaaaacgagtcccaacacctcctacaagctcatctactagtgaaactgaaaagcaattaccagttgaagtaactactttgaacaaacctaaaaaagaggctcatattaataaagtttccattctcaaaaagaggacaccactgccaaaaagtagtcctaaatctattataaccagcaaaatcgctgattttacagaatatgatgaaacttcttctacatctcctgcttctacatcttctttattagctggacgtggaggggcaggactgaaacccctgtcaaaacaagatgccactggggataagttacaacttcctgaaatggtggattatgaggatgacaatagtacaatactttcttcagagatttcgttatgttccgcagctcagcaaaacgatgacgaaattgaaataactgaaactctttcacaaaatgacattggtgaagtcttatcaagtccaatggaagctgatcaaatttcggatgagtttatgctgtttcaagaaaatatgttggttgatcatttgagtggcattcaatattcagataaagaagaaactgaggaggagtatgcaaatattgtcattcgaagtccaactactagtgatgatgaatttattatgcaaggccgaacaaagaaatataatatattgaacattgcagaaacttctggttctccagagcaagataccactatggagccatccacagagccagaagatgaggaaattactcagccatttgacgaatcggaagtggttattattgagcaacctgtaaaatcacctgaggaacaaatttcaactaaagaagattttgaagaacttattgatgaaggttctcgaaaagaaaaaatgaagcaagacacaaaaagtgtagttgaacctccacaatttactgctgccagcgtgtataggtttccttctaagacccctattactgtaactagaactcaaaacgttatgacaacagcaaaagtggcaccaaaaatatcattaattacaacggcgccaattattcaaaatttcactgctcgttctgagggtggaaaactgaatgcagaaactcaacaacttatattaactcctacaacaaaaataactaccacaaatgcaggttcaaagctaacaagcattattttgacacataatcctgttagaagtaatattttgaatgtgggacaaaaacttgtaacatcatcaccaggaattacaattgttagtgccagtacttctcaaatagcttcgattttgccttccaaatttagtgttccaattatcagcgcaagtgcagtgaggcaactgccaaacgtaaaagttattgacaagcccagctcttcgctatctttgacgccacgcgatagtactttgcccaataaaatatttgaagatgaatcagtctctccagaaaatgcaaattttgatgatgaaaagaaaaatttatttgatgagaagttgaaggcagaatttaccgcagctaatggaagaatgccaatgtttgggaaaaatgtcattgcaacaaataataaaaatgatgagaataacactagtcaacgtaaaaatgacaaatctgaaattagtaatattgttactaaagaaaaagttcaagtcatagctagtccaataatagcgaaatctgtatctcctgtaataattcatcatgcaccacctgaattgaaaatgacggctcaagtaatccaagaaacatccactcgtatgcaaataactgccactgaaactgttagtactttcatgggtgatggttcagtcgaagataaatcagtagttatttccataccttcccctacgccatctcaagaacaaatgcttgataatattgctttgcaagccttggaggagaataggaaaagagaatttgattctttcgattatgtattgaatatgattgaaaacatgcaacattcagaaactccagagcagtcagatgaacaaaatactgagaaaaaatcaactaaaccagcagtaaaagaggaagctaatgaatctactgcaaataaacaaactatgccgcagttgtcgcctttatcacaaccagctgatctgaccacaaatatggcaaatgcgtctcaacagttgaggagtttgctttccaatatacaaactacaagttcttctcatgtgcccaaagttgaaactcttgtaaaaaccgcaaataaacaaaaaataatcaatgttacttcttcaactattacttcccctgttgttgcttcaagaataattcaacaagcaacaactacaagtaatgtcagtactgttatagttcctaatgtagtcaagcaaaaagtaactcttgcacctactagtaaagctagaacatcgagtacagaaagttttttaactaaccgatttctaggaagtgaacctaaatccacaacatctactccatctcagacaactgaaactatcaataaatctccagatctcaataaaaaagcttcactaacgttaaccgctatgcttcaaaatcaaccatcagctactcccacaacaaaatcctcacctgatacaataactgctgccagtttattagctactcctgtgagcctgtcaagaactagtttttcaccggctttggctctagcacaacccaatgccattatagctagtagcctagctaatactagtaccagttctgtaatttcgtctgctttcaaaacaatcacttcaacaaacttattgcatactcacctaactaagtcgagaactaaaagtcttgatgatattaaagatttgaaaactgatgatcaaaagtctgaagctgatattataacaagcataaaacaggagcttagtggttgtagatatttacccgtaacttcgtcaagtcaaataaataaatgtgaagactcgcagaatgtcctattaaagcaacttcttcagaatactgcttgtgcaagcactcaatcgccgccaccaagtactacatccacaataacgacagctccaactactgaagttcagaaagttagcccaccaactttgtcatctttacttcctccagtaactaaaaccgaagttcaacctactagtacccctcagtcaagacctccaatgcaaagaggtttaatacgagaaacttcctttgtttctagcccaataattcaacatactccaactagtacaactgtcgcagctaccactacaactcaacagctacatattgatattaaaaaatgtgctcctgtagttaggccttctagtagagatgatttactatctccacccactccgagatcgtgcggtagtcaagagtctagtttacaaacgcccccgttaatagtcaaaaaagaaagtccagcttctacttctacatgtcttagtattgagggcatcaaaaaagaattactagatgaatcttcccaacactcggaaatatctgatttgggcaaagctgacattcaaataaaagaagagtctgagccaggggagattagtgataaaattattgttgataaagaagaattaaaaaagcaaaaaaggagaatgtataatcaaaagagacgtcaaaatcagttactgaacaaagagttgaataataaacctaataagagaccgaggaaaaattccaaaattgaagaagattacgattcttatatagacagtgttttaaaccagataaggcatttgcatcctatggttgtctcagaacctgctatagtacgaaatcatggaattttaccagtttttggctctggcgatttatccaaattaggtacaaaatctttcgatcccagatttggtgatttaactggtacttatggcaacgcatcgattcccggatattcagatttttataatacaattccttatggcgatgaagaacccattcctgaaaaaccaccagcttctacacagagaggattttatgatcaagaatttcctcttattaaatttgatacagaagatgataagaagtttgatttgttttccagagaagatacaccagattcaattgttagttgttcttcccccgaatgtgatgcttttgatgcttctgatagatatttgggtttgaaacttattagtgacgatgaagaagaagaagaattatccaagggtagacgttcgccgaaaataccaatagttaaacccattgctattaaactaaaagccgctggcttgttcttgaaagagcccgctactacgaaaattgcttcggataataataaagaaaatattctgaaagaaatggatcaggaaaaactgaaaccaaatccttcgccttcaggtccagtaaaagataatgaaaatattaaagttacgctgacgttcacatcatcggctgctgaagatattgtcggcgtgctaagagatttggcgaatattttacaaattcctccacctacctcttatcagattgttgatagaacttcttcaccgactagtcagaagctgggattgtatcggaccaagggaaaagatggaaaggaaggagctcctatcgatatacagagtatccttaatggggcagcaaagttttgtaaacattgtgacgtagttattctaaacaacttggtgaaaaagaagccttcagatttgccatttttgtcaaaagattccgaattactaagtgaaggagaagaactatatttttgtggttcttcttgctacatgcaatttgctttgatgaatagatcgccgtctattccagaggacaaggctgcggctatcatagatcatctatcacaaaaagactgtcaaaacttaaagcaacatggacaacttcaagatcctttcgattcgaaatcagctctcgttaaccgtttgttgacagaaaataccggattcaatcagtactttggtggggccttcaaacaaactatgaaatttgggtcgttcaaaccacctgagcatgcaaaaagccatagaaatgcgtcggttaaattttggactcctggatgcttgcagcctagtcacaagcataagaaacctactgataaggagatgacggaaatgctgtatcagatggggattacggttacaccttcaaaattgcctgacgataccaggaagtgcatgttttgtcaagttattggagatggtgtagctgacggtccagctcgcttgctcaacatcgacgtagacaaatgggtgcacctcaattgcgccctctggtccgatggagtctacgaaacagttaatggcgcccttatgaatttggaaaacgccatgcagcaaagtttaacctcaacatgcatccattgcagtaagctgggagctacaatacgatgttttaaaaccagatgttcgagtgtataccatttatcttgtgctgtaagagaaaactgtgttttctataaaaataagactgttttctgtatggcgcatgttcccaaacatgaaaaagataatgagttgactaccttatcagtgggcaggagagtttatataaacagagatgaaaatagacaagttgctgctgtgatgcataattcagatactaataatttattgagggttggcagtttgatttttctcaatattggacagttattacctcatcagttgcaaaacttccatacaccaaattatatttatcctataggttatagaataatccgtttctactggagcatgagaaacgtgaataaaagatgtcgctacatttgttctattaacgacaatatgggacgtcccgaatttcgagtgttagttcaagaacgttccgaagaagataccgaatttaaagactttacacctaaagcagtgtgggcacctattctcgaaaaaattgctagcatacgaaaagaaaacaagtgcctacaaatgttccctagatttatttcgggtgaagatctttttggtttaactgaaccagctattgttagggttttggaaagtctacctggaattgagacactttccgactataagtttaaatatggaagaaatccgctgctggaattacctttagccataaatccaacgggtgctgctagaagtgaaccaagattacgccatcaaactcattggaaacgtttccatagaactacaggatctagttcgagacctttgtttgcaccacttccttccaacgcatcagcgccctcttcttttggagaaagtgtatgcccttatagcaaacaattcgttcattcaaagagttcacaatataaaaagatgaaacaggaatggagaaacaatgtttatttggcgaggtcaaagattcaagggcttggattatatgcagctaaggacatagaaaaacacactatggttattgaatatattggagaggttatcagaagtgaattatctgaatgtagagagaagcagtatgaagataggaatcgtggcatatacatgtttagacttgacgatgacagggttgtggacgcaacgttaagcggaggtctagcacggtacatcaatcactcgtgcaaccctaactgtgtagcagaaactgttgaaattgacagagatttgaaaattatcatttttgccaaaagacgaattcaaaggggagaagaattggcgtacgattacaagttcgacattgaagacgatcaaaataaaatatcctgcatgtgtggagcaccaaactgtagaaaatggatgaattaa

SEQ ID NO: 1337 - DNA, 4173 bp, Ceutorhynchus assimilis
atggatgatgactctgaagcgagaaaaccaaaaaggcaaaaaacaagctacaaggcaaaagcctttgaaaaatttaaacagcttaaaagtggtggtcgtaataaatatgaaatcgaagaagttgataacctttatgaagtcgttgatgagagagaatatgccaaaaaggtgctggacaggcaagacgatgattggatagttgatgatgatggtagtggttatgtggaagatggcagggacatttttgacgatgatttagatgctgaatcaatcaatcaagccaaatccaaaaataaaggtgttaaaaggaaaaaagctgtctctgataatgcacctaaaggcaatttgaaatatatgctttcaaatattactagcaaaaagaaagaggaaacacaaatagaagatgataatatgctgtcagaaattttgggcgaaatcgatgcctctccatctacaagcaaaaaggattcgaaaccttttgtccctaaaagtcagctggctcaaaattacctcaagaaattttcaattgataagaaaacgaaagctgaaaaacccccaattgatactgtcatggatgaagagattgttgaaatacctttaaaaaatgtagactcagaaaaggatgaattattgtcgaattcaaaacaagcaactaagataattccacagaaacagaaagaagaagtctctgaatcacatcaaaatgaagattttcatgatgcagaagacgtctttgctgacgatcttgatttagtccaaatggacgctattgaatcaaaaatcactgaatctgagactgctgcggagcccaaaaacgattcatttgatttagctgctatgtttacgcagagcagcggcttcaatgaatctttggaagaagaggaaatttgtacaccttctgtatctgatgatgaggctttcagattcttttggtgggacgcattcgaagatgccgaaaaacaaaaaggcaaagtttttctatttggtaaaacttattgcagaaaatccaaatcttacttgagttgttgtgttgctgtagaaaatttaagctcgcaggttttcgtgcttccacgtccatttatgctagatgatagcggaaagccaacagaaaaacccgtgacttatcaagagctgtataaagaatttacatcgttagttgccgacaagatgaatattcaaaattataaagccaggctgtgtcagaaaaaatacgccttcgatccaactgttcccgccgagtccgactatatggaagttaggtttccagcaaatggccccagaatctttccagaatccatcaaaggatgcccgaaaacattttccaaaatattcggcgccttttccagcaccctggaacgattccttttggaggccaaactcaaaggcccttgctggttggacatcaaaaatcctatattcaataatcatccgatgacctggtgcaaaattgaagtcaaatgtgcttccataagagatgtggttaaagttgcagaaaatttaccaccacctccattgactgtggctacaattaactttaggcatcatataaatttaggtacaaatcagcaagaaattttgatggtctcttgtgtgactcagacgagttatgctgttgataagaaagctcctaggcaggtgtttgatcaacatttttgtgtgtttactggtccttcaaagcaacctcttcccttaaatatccacgcacagctacaaaactacaaaggaactcgtgtacaaaaaatggactccgaaaaggcacttttaaactatttcatcatccaatttgccaaaatcgatccagatttaattgtcggtcacgatttggttggattacaaattgacattttggctaatcgcctaataaaacgcgatgtttctacgtttagtaaactgagcagggtcaagcgggcagaaaagggccgcttggtacaagatttgtttaccggacgtttggtggcggatttaaaaatttccgccaaagaattaatcaagtccagaacgtacgatttgccaacgctttgtcagcaagtccttaagctacgagaagaccaaataacagatttggaaccagacgaggttgtaagaatgtatgaaaacacagaagatatttttaaattaatagaatatacaatgcaagatactgcttatatgctcaaaatcttatacgatttaaacattattcctttggcattgcaaataaccaacatagcaggaaatattatgtccaaaacacttatgggtggcagatctgagagaaatgaatatttgctgatgcatgcttttcaagaaaaggactatattgttccagagaagaagttcaaaagaagaagaaacaataatgatagccaacaagtagctaagaagaaacctgcatatgcaggtggtttggttctggaacctaaaatcggcttctacgacaaacttcttttactcatggattttaattcactttatcccagcatcatacaagaatacaatatttgttttaccacattacccaccacagacgaagacaataatttagttttgcctgataaaaatctacctcccggcatcttgcctgtggaaataaaaaaacttgttgatagtagaaagcaagttaaaaagttaatggccactcctgatctatctccagatatgtggatgcagtataatatcaggcaaatggctttgaaattaactgctaacagtatgtatgggtgtttgggatttgcaaattcaagattctatgcaaaaaatctagctgctcttgtgacacaaaagggcagagaaattttaacaaacaccaaagatctagtagaaaaaatgatgtttgaagtagtttacggagacactgacagtataatgattaacacaaacttgctagattatgatcaagtccttaaaattggcaacaaaattaaacaggaagtgaacaagtattataaaatggtggaactagatgttgatggaattttcaaatatttactattattaaaaaaaaagaaatatgctgcagtcacacttaaaagaacaaacgatgggcagttacaagaagaaaaagaatataagggtttggatattgtgagaagagattggtctcgaatatcttctgaggcaggcaaacaagttctggagtatattctgagtgaccaaaccgaagatgaacgcttaattaatatacaaaattacttgagaaagttgcgtgaagatttggaagagggtagaatgccgattcagttgcttgaaattaccaagcaattggcaaaagatcctaaagaatatccgaataaagataactttgctcatgtgttagttgctttaaggtacaatcaagaacacagaggtcatctcagagttggggacgctgtatgctacgttatttgtgaagatggcacaaacaactcggccacaaaacgtggttatcatcctgaagaactaaaaatcaaagagcacctaaaaatcgatgttaaatactacctatcccaacaaattcatcctgttgtggccagattaattgatcctctggaaggaattgatgccgatgtgattgccgaatgtttgggcttggacgggactgtttacaaaaaggctgttgcaaagaaacctcaagatgtaggagaaaatattatgttacccgaagtgaaatttcgaaattgtgttaagtttaccttcaaatgcctcgtatgccaagaagagaatatcgttaacgggcctttaaacgaagacaaagtaccatttttgacgaaatgctctaacccagactgcacagctaaacctatagattatctgtatcacatccaaaatcaattgtgtttcaaaatcaacgaattcataaggaaatattacaataacaagttgatttgtgaagatccaagttgcaccaccgaaactaacaagttgccaatcaagtttatgtcgaaatatccagtttgtcagggatgtcagcaaggcgttttgtatagggactacactgaggcagagctggctactcaattggaatattttgtttatatatttaatctcgctaatttgaataaaaaaccattacttgaagattccatagaacgaggttatcaccagttagtggaaactgtcagcagttatgtgaaaagatctgcctactctgtggttaatttgaaggaagtttttgaaattcttgagaaaatcgggtctgaaaaatgtattcgttaa

SEQ ID NO: 1338 - DNA, 1392 bp, Ceutorhynchus assimilis
atggcttctgcagctgccgctaaaatagccgaagtgcgtgaaactaccagggtagaaagaattggggcccattcgcatatcagaggtttgggactagatgattgtctcgaggctcgcccggtctcccaagggatggtcgggcaattgtcggccagaagagctgtcggtattgtcttgcagatggtgcgtgaaggcaggattgctggaagggctgttttgttggctggacaaccaggaactggtaagactgctattgctacagctttagcagccgccctaggatctgatactccattcacaagcatggctggatccgaaatttactcactggaaatgagcaaaaccgaagcattgactcaagctatcagaaaaagcattggagttagaataagagaagaaactgaaattattgaaggcgaagttgtggaagttcaaattgaacgaccagccactggaatgggcacaaaagttggaaaactcatccttaaaactactgatatggaaacagtgtatgatttgggcggaaaaatgattgagagtgttttaaaggaaaaagttcaatcgggagatgttatatttattgataaagcaactggaaaaattacacgtattggtagatcatttgcaagagcacgtgattacgatgccacaggtgctcaaaccagatttgttcaatgccctgaaggagaattgcaaaaaagaaaagaagtagttcatacagttactttgcatgaaattgatgtaattaatagcaggacgcatggatttttggctttattttcaggtgatactggagaaattaaacctgaaataagggaccaaattaatggaaaagtggcagaatggagagaggaaggcaaggcagaaattgtccctggagttctatttattgatgaggttcacatgttggacattgaatgcttttcattcctgaacagagcattagaaaacgaaatggctccaattgtaattatggccaccaatcgtggcataacaaaaatcagaggcaccacctacaaatctcctcacggcattcctttggaccttttggatcgtacaattattgtccctacaagtccttacgaagagaacgaactcaaagaaattctgagcatccgatgtgaagaagaagactgtcaaatgtcagataatgctttgactgtgctgacaagaatatctaaagaaacttctttgagatatggtatgcagctgatcatgacgtccagtttgattgctaggaaacgtaaagcgcatgaggtggatgttgaggatattaagagggcctatcagctgtttttcgatgaaggtagatctgtgcagttcctgaaggaatatcagcaagagtttatgtttcatgagttggatgatgacatgcgaatggaattaagttaa

SEQ ID NO: 1339 - DNA, 1116 bp, Ceutorhynchus assimilis
atggctattagaacttatggagataaacctataactttccaattggaagagaatggcgaatactattgtgttggatcagaggtgggaaattatcttcggctctttagagggtctctatataagaaataccctgggatgttcagaaggtccattacaaatgaagaaagaaaacgattgattgatttgggactttcacaacactgccttgccagtagtgtatctttgctaagggcttctgaggtcgaagacatcatcgaaggaaatgatgacaaatataaagctgtctcggttcatacaagtgacccaccagtaccaagggaaggtaaaagcaaaaagaaccaacaatgggtaccatctttgccaaattccagtcatttagatgctgtaccacaagctactccgattaatagaaacagagttgctgcaaaaaaagtaagaacttttcctttgtgctttgatgataccgatccccagctcaacattgaaaatggttgtcaacaagaggttctggtgcccatccgtttggacatggaaattgaaggacagaaattgagagacacttttacttggaataaaaacgaaagcttaataactccagaacaatttgctgaagtcttatgtgatgatttggatttgaatcccttgacttttgtgcctgccatttctcaagctatcaggcaacagttggacgcttttcctccagaacctcctagtattattgaggaaaacgctgatcaaagagttattattaagctgaatatccatgttggaaacacttcattagttgatcaagttgaatgggatatgagcgaaaaacaaaacaatccagaagaatttgctttgaaattgtgctctgaactgggattgggcggagagtttgtcacagcaatagcctactctatcagaggacaattgagttggcatcaaaggacttttgctttcagtgaagctccattaccaactgttgaagttcctttcagaactccatctgaatctgaccaatgggcaccgttccttgaaactttgacagatgctgagatggagaagaagatcagagatcaagatcgaaacacgagaaggatcagaagactagccaataccactcctggctggtga

SEQ ID NO: 1340 - DNA, 624 bp, Ceutorhynchus assimilis
atgttttgttgttggtctcaacaggaggactttggaaaaggtccgatggcagctattcgaaaaaagttagtaattgtcggtgatggagcctgcgggaaaacttgcctgttgattgtgtttagtaaagaccaatttcctgaagtgtacgtgcctaccgttttcgaaaattatgtggccgacattgaagtggatggaaagcaagttgaactcgctttatgggatactgccgggcaggaagattacgaccgtcttcgccccctgtcttatccagacacagatgtgatccttatgtgcttctcagtagactcgccagattctttagaaaacatacccgaaaaatggacccctgaagttaaacacttttgtcctaatgtacccattatcttagttggtaacaaaaaggatctccgtaatgatcccactacaatcaacgagctgaaaaatatgaagcaagaaccagtgaaaccgcaggatggtagatctatggctgaaaaaatcaacgcatttgcttatcttgagtgttcagctaaaagcaaggaaggcgtccgagaagtctttgaaaatgctacacgtgctgcactacaagtcaaaaagaagaagaagcatcgttgcattttgttttga

SEQ ID NO: 1341 - DNA, 4146 bp, Ceutorhynchus assimilis
atgataaacacaagctcaacgatgaattccacacaaaagtctcaaaatactcaattcccgttgccgaaaatggaagtggctgctagtcaaatcgacaaagctcttgccgaagacgcctgcgcccccaaactgattgacttgatgaatataaacgcggaaacgggtccaacttataccggttttgtggattctgattatcctgtgctgagcaacaatgatatgcataatatggctctgggcgatctggtccagatcaaaaatgttagcagtaaccctctgcctccaggaatatcggatcatttcagtcaagctcagtatcagtgcactatggggctatttccagaaataaacagggcttggctaatcgccgatagtgatctttatatttggacttatgaaactaacatagatatggcttattttgatggtatcagtcaaaccattttgtgtgtgggccttgttaagcctaaaccaggagttcttcatgagtttatcaagtacttgttggtggtggctactgctacggatattatagtacttggagtcacttttacagaagctaagtatggggtggaggaagagatgcatttaattccagatccagtattcagcatttccactgatggtaatacaattacaactataactgctgcaaataatggcagaatattttttggtactaaagaaggttctttatttgaaataacttaccagacagcaagtggttggtttggaaaacgttgtaaaattgtaaacctttcaactagtcgcttatcattccttgtaccatcattcataaatgcagctctaggcgaagaagatggaattttccaaatagttatagacaaatccagaaatattttgtacactctaacagaaaaaggagcaatagaagtttgtgatttaggcgaaagaggcaacagtttttccagaattattaaactctcccaaaaaagcattgttcatcaagttttgcatacagttacaactttagacagtggggcttttcggccaattgtcagcattgctccaattgaagcttatgaatcaacaaatttaaatctagttgccatcaccaaaagtggcgtaagattttatttcactgtcactggattatcatatcagcaacccaatgctcgcccttatgctttaactttagcccacgtccgattaccaccaggtttttctgcaaatatcactgttagacctagagacgtacacattggctactacagagaccgtaacgccattttattaactacagtaaaccacaaagacgttttgtggtgcttaagctcggacctattccctttcagctataatttgaaggaggcttacacaactatcaacttggacgcgcccgctttagctatggcggaaattcgacatgaagattttctacatttgaatcctcaaaatgaagaagaacctcctttggtggtcaggcagcatgcagaggcgcccaaaaagtatgtggtgctcacttctcacagtgttcaagtgtttattaaattgagaccggtggatatgcttaagcagattttgctggatagtaatggtcaagatacattacctctcaccacatttttctcgatacaaagcgaggtccaagcttgtgctactagcctaattttagcttcactattgagcgaagaaaatgtcgaaatagctgaattagccacaagagcctttttcctatttggcggagagcctcaattaatacaagccaatcaacagaatattcatcaacaaaatactactcttttaggttctacaatgttttcgccgcaaataatttccaccccggccccgcaaaatcaacaataccacatgcaaagaacacaatcgcctcctggttatatgtttaatgtaactcaaaggcctcaaatgggtagttatgtagctgaacggccacaatcgcctaattatatgacaacaggaagtgtaatgcaacaacaacaacaacaatcttttgtacagccctttgatccaagtatttttattaatttttcccataaacacaacggcttgtacttatatttatgcagaattttaaggcttatttggaatagacattgtgtggaacgtttctgtcctgatggtgaattcgctttgtttcaaagcagcatatctgtagaagactgtatcaaattgcaaaataatttaaatgccctgcacaattttttgactttaaatactgatttttctggaactactaatcaaatggcaattcataataattctacattgaatcaaactttggtgcgtcagcctgtcacacttcaggacgctcaacttatagaacgcaagtctttggatgccctaaagacttttctgtgtcattgttgtcaaattatgggcttgtggaggatattgtgcgatcatcaatttcacgagctggtcgcttgtttgccggacaacgaccaggaaattttgcagaagactactttcaaggaattgttccttttcagaaaagacatttgcactgttttaatacaaactttggtgaatagctatttaggtgataatgcttcagtggacgctattagtaataggcttatggaggtttgtccgcatttgtataagcctgaggatgctgcttttacgaaggccagcgaacttctcaaaacaacacgaggcatacaaaacgtagatgaaagagaagagaaacttttaacggcgctgcaactctgcaaaaatatagctccaaatgtgaaacttcctgtggtttgcaaacaattcactgccttaaaagcttacaaggctgtcatagaactttgcgcctactgtgctagaaggatagaccccgacaatattgctaagagttattttcacagtgaggatgacgatgctgatgaggacggtcttaaaatgtaccacaaacgaatggaaacttatagggaaataattgtaatgcttgaaactttgtattgcgaacaagatcctgtgcagcctgcaacttacgatcctgatttaactaatactagatctatattgcttgatggtactgagggtcctaaattaggtgaaagtataaatgatataattcaaacaatcttgttttacgatgacgaaataatgcacgtggcagtttacgagtggatggtttctaggcaaatgacgagcgatattcttcaaatcaaggcacgttctttggagctttatttgaaaaaagcctccatgcaaaatcccaataatcttgtagtgatgaatttgctatggcaatactacgagactaattctaaccatgcgttggctgctaagattttacataatttggccagtagaacagatattaatatacctctaaaagaaagactgacttatctagcgagagccataatgtgtatgagatgcgataaaacgggctactctgtagattccggtatgtttctgagagatctggaggataaaatcgaagttgccaaagtccaaaatctcattttggaggacattaccaatttcaggacacaaattgccaccgccgacgaggccatttcggctttgaatagtggactttatgaaatttcacagctgtatgaaaactttgcagaaccatttaacctcctagaatgtaaattagccatcatagattgtgcagggtacacggataacaataacgccctagcgacgtcgatctggcaagaaattttggccaacgaactacgaaaaacgacaacgggaggcgctgatcgaataaaaccgattttgcaaaaagtcaaaaatttagcccggctctacggtagctcagacaattcgtttccgttgtcgtatatcacttcagaattggaaatgatcaatgccaagctcagagggcccaaaggtttagtgccgaatacttttatcgaagtcaatatcgattttcagcggttgattgaagtttactcgagtctgcttaatttgtcaggaaatttaaatttttggcaaaacgaagatcacgaatttcacttgtgcgaatctacttgtgctttagttatgtcatttataaacaatcacaatgcgtttagcagcattgaaaagaggaaaattgtagcaacatgtcaagacaccatgacgacgttgttgtcaaatttatacaccaaggccaacagtgacgctctagttaatcaagttaggaatatccaaactaaattgtcaagaatataa

SEQ ID NO: 1342 - DNA, 4083 bp, Ceutorhynchus assimilis
atgacacagtttactttgggctatcgcgaagtgatagcagaccaagacctgattgaaaaatggacagaaataccgattttcactggaggcgcccagagcaccttgcaggacatcaaagtaaccgaaaaggcaagcggctacagctatgcagattccaaccgttactatacaagaaatagattcatatactggcgaatagattcagatatccttgagctaatagaacacagtttggatataaacttaactggaaacaaacttagatacaagttcattgatagccctattctagacggtgtatcggttaaagaaacagaggatcatatttttatattggtccctactgtttgtagtgtgcataagttcacattcccacatccatcaaaataccatagacaggatgaattattggactcgcacctaaaactggccgccccttcaattttctgtaatgccatccacaccggggatgatcctactagttactatgtattcaataatccaagcacagctaatgaccagctaccaaacttagctaaatccttttacaatccagacacagaagaggcagtttttattctggcctatccatctgccgagctccttttgatcaaattaaattcacaaggccgcgcattgtgtatggaactaaaaggtgaatcgttgatgcccagatttttatcgggaataactgaaaaattcagatcaaaacataaggacggcaaccaaataatcagcgctttgattgaagtgtttgaatatgaagtttacgctttaactttggccagaaatggacatttgaaattctggtcgtgcagaaatggtcagtgtgtggctgctattgatatgatgcctcaaggatcagatagattacaaaatgctttattaaggaaggcagagggaaatgttgaaagttacagccccatagcaatattcatgagtttcccatccagaggacagtttcatatattaaaacctattattaataatgaacaaattactattgaagtagtaagagtcatagagtctgttgagaaaatggttttggacttttcattacaatccaaccaaatttggttggcttgtgtcacaggtaatacccaatgcagtgtctatatgcgtccaatggaaggaggaggaacttggaggcctgtcatcaaggaagctgttcacgaaaaagaggcacttgatggaaaatcagatcctcgtcaagtttattcgcagcaccttttccatcctggaagatttccattatacacattgaataaatctttggggactttaatgaaaaacgaagtcaaattaacatcagtggcagccctaaaacaagccatatgcctagcaatagaaaacgatatccaaaatcaattcgccgacatcgaagatataaccgacgaggaatatttggaaaaagccaaatggtgctgggaaaaattctactcaagttgctgtcagtattatcaaatcagcctgaaacccttaggcctgatgcttctgcctcaaaactctgcagctattctcattaggaaagcaaccttttcacttgtcagacccatggaacctttggaacatatgtttttgtgcaacgattccggtttcaaagatcagtttataaattttgctcttttgggcgaagaacaagacttactggataatgtcaagaaattatttgatttgattgtctttattgagagtcaaatgagcaaaaatttaaagactacttttgaaagggaaattggtattactttgcaaccaaagcttgttgtttccagtttatgtgaaatattacgtaaagagcaccctagtatccgcgatcaagtaaatgaattaaaaaaagtaaaagacttatacaaagcgatacacaaactattggatctattacgtcacgacagtaccccggctaatcctgacaacgaatccaatcctcaggcaatgcattactttagcagcgcactgggtatttcgtttgtgtcgacttgtttaaggcaacagtgtcaaaatcgtttcgccatttgcaggaatttgttaataatttgccacagtttgaacaatgttgacgctgttacaagggacatacgacaagcttgtgaaagtgatattatcgagcttactcaggctaattatgttatgctttggctggctaatttgcctgcattcaataatgtggcacaagaatcagcgcttcagcggttaaatacaataaagctaacaccagcctttaatgtcacacgaaatattttttcacttttggaagcatttatttcctctaccgggggttatgaggcaaggaaaatgttgtccaaaatggattatcatggagaagctagggcgcattggcatttgagcttgttgccatttatcagcaaccttagaactatactatggcctcttaaaaccggcacaattttaccagaatggttggtaagcagcggtcaacatctgtggttgcagcaatatacaagactactaagtccttggtgtgtacagaataaatacagctgtaaatttctgttagctgcatcgtttttaacatgtgcagaaaaccataaagcattgaaactattccaagcagcaagcgatggcattttagttgaaccttttttacaaaaactaataaaagacgcacacgaaggtcaagaaaaaatcttttattatctaaaagtgattcatctatttgaactacacaaatccagagattgtgcaattcaaatggctgtttacgccttgaaggcaattgaacctgaaagtgctttagtacctacgttgtactcgattaaattcaagcatcatttagctttgagacattacaaatgggcttttgacgatttgaaagcgaatccggatttggaaagacggaaagacaatttgagggatttggttaagactttgttggacgaaagggaatttgatgtattgctaggatttacttacggagacatggaggaattgtttactaatattctgtttacaagggcaagagctactgatgcacttaataatgtgttttacgatattttgtattctcaccaaatcaacagggggtcactttattatagattagctgcctccataaaatatgagcaatccttcaggctctcccgttgcaacaccgtccaagctttagaaaaacaagtaaaatgttgcctcatagctaaaaatgtactacaactaaccgatccagaatatgcttgggttatacgtccttctgatcctgacgaagaagaaactgaaatcattatggaatcccttgctggttctggaaaagactttgaagttttccgtattaaaaagcaagtagaagtcgttactgttgatacaatggaaaaggaacttgttttcttgatggccaaactgaaactaatcaaatttcatcctgaagcttccagcaaaattacaaatatttatgaatctgaagaacttgttatgcatttaaataatgcaggattattcaaggaagcattacaagtgtgcaaaacctataaactgtcttatgcgtcagtctttagtgatttaactggcagatgcgttatactcagtgaagatgaaaattcgtatccttgtgattggctatctgaaaatgatttccaagatttgtcggcatataggaacaactattcaacactagcatgggaattattacaaaaactattaaaagaatgtgaagaacctaatttaacagtacttcataaagtggttactgaaaaaatcattagtatgagaatgtatttgcctttttggttaaaagtttcctataagaaaagaaattcaggtgagctcctaagactgctacacttatccggtcatttagacgaagccttcgaactgtgccgagaataccttctactcgccctaacatctctatcacccaattctcaggccttttgtatgcccgtgtacgaaatccagtctctcgtgtaccagcttaagttgcaaaacgaaaaacatttcaacaggccttttaaaaatgagctcaaaacattgagtgaacttttccagaagtacttaactagtgccatgcggatttccaacgaaaaggcccaacttcagatgtcaacctttggtactattccattaaatagatag

SEQ ID NO: 1343 - DNA, 2910 bp, Ceutorhynchus assimilis
atggaaatctcagatgaaaacctccaaacgttagccagatatctccaagaaaccctcaacccagaggtcaatgtccgtagaccagcagaaaagtttttagaaggtgtagaagtcaaccaaaactaccctctactactactaaacttagtccacaaacccgaagttgatatgactgtgagaatagctggatctgttgcctttaaaaattatatcaaacgcaactggactgtacaagaagatcaaccagacaggatacatgagtcagatagagctgctatcaagagtatgatagtgactcttatgttaacttctccagaatctattcagaaacaactaagtgatgccataagcatcatcggcaagacagattttcctgttaaatggcccgaattaataacacaaatggtggaaaaattcgctacgggtgacttcaatgttataaatggcattttaagaactggtcatagtttattcaagaaatatcgttttgaattcaaatccaacgaactttggactgaaattaaatatgttttggaaaaattggcacaacctttaaccaatttattcgtggctaccgtaaatctaacacaaacacatgcaaatgatgttaatgcacttcaaactatttatagctccttagtattaatatcgaaagtattttattcattaaacttccaagatttgccagaattttttgaagataacatgcaaatatggatgcagcactttcacctgttactcactgtggaagctaaaaatttacaatcagacactgatgatagtgtaggagttattgaacaactgaaaacacaaatttgtgacaacattgctctctatgcccaaaaatatgatgaagaatttcgggaatatttaccacaatttgtcacagatgtatggagtttgttagtaggcacaggattagaaccaaaaaatgatttactagtctccaatgcattgcaatttttatctaccgtagccgaaagaaatcattatagaaatttatttgaagacgatcaagttttaagcagcatttgcgaaaaagtcatcatcccaaatatggaatttagagaatctgatcaagaattgtttgaagataatccagaagaatttacaagacgagatatcgaaggctcagatgtggacacaagaagacgtgcagcatgtgatttggttaacactttaagtgtgcatttcgaggaaaaaataatgaaaatttttggtcagtatttacaagtcatgttagccaaattcgcagagaatcccaaaagtaactggcgacacaaggatgcagctttatatttagtgatatcgttagtcagcagaggagcgacacaaaaacacggagtaactcaaaccagtaaattggtagatatttcccaatttttccagcaaaatattgtagctgagttacagcggcccaatgtagacgaacttcctgtactgaaagctgacgccataaaatatttgatgactttcagatcagtgttgcccagtactttagttgtttccagcctgccccagttgattagacatttgagctgtgaaagcgcggtagttcacacttatgcagcttgttgtatagaaaaaatactaatcatgagagatagtaataatcatccacatgtgacaggagctcaaattcaaccttttgctgctgaattaatttcacaattgtttggagttttggagaagccagtatctgaagaaaatgagtatgttatgaaggctattatgaggactttttcgactttacaggatttagttattccattccttggagcgtctttgcctaaactgacggaaaaactacaggcagttgcgaagaacccatccaaacctcattttaatcattatttgtttgagactctttcattatccatcatgattgtttgtaaatctaatcaagcagcagtgaaatctttcgaggacattttattccctacttttcaagccattttacaacaagatattcaagaatttattccttatgtttttcaaattgtttcgttatttatggaatatactcctgcagggaatattccagaatcctatatgcaactattgccgtgtttattagctccagttttatgggaaaggccagcaaatattagtcctctagtaaggttattgagggcctacattacacaggcggctcctcaaattatagctcaagataaactttcgggttttcttggagttttccagaagcttatcgcctctaaatctaatgatcatgaaggtttctatttgatgcaaagtatgatacaaaatatcccgaaagaaacattagccccatttttaaaacaaatattctttttattatttcaaaggctgtcgtctagtaaaacaactaaatttgttgttggttttattgttcttatttgtctgtttatggtcaaatattcggcaagtgagttaataatgctcattgatggaattcagcctcaaatgtttgggatggtacttgaaaaattgttgatagcagaaattcaaaaagtcaccgggcgaattgagagaaaaatcgtatcttgtggtgttagtaagttattaggcgaaagccctgaaatgattgatggtatttatggaaaatattggccacaacttttacaagctttgttagtatactttgaaatgcccccagacgaatccactttgcccgatgatcattttatcgaagtagacgacattcctacttatcaaacatcaaatgctcgccttaattttgctaataccacaaaggaagatcctctgccaaatgtaagcgagccaaggcaattcttggtacaaagtttgaagagtttgagcaactctcaaccaggcagggtgcctactttaatcagcaacacttcgactcagtctcagacatgtcttcaaaattatttggccaagtttggtgttcaattagtgtaa

SEQ ID NO: 1344 - DNA, 591 bp, Ceutorhynchus assimilis
atggcaaaagttcaactttgcaatattacggttatggacaatccgagcccctttttgaacccgtttcaattcgaaatcacgttcgagtgtattgaagaacttaaggaagatctggaatggaaaatgatatacgttggatcagctgaatccgaggaattcgaccaagttttggattctgtttttgttggccccattccagagggcaagcatatgttcgtattccaggctgatccaccaaacgtttcgagaatcccagaaaacgacgctttgggtgtaacagttgtccttctaacctgctcctacagagcccaagaattcataagagtgggctacttcatcaacaacgagtacagcgatcccgagctcaaggaattgccacccagcccaccacaattcaacaaagttaccagaaatatcttggcttcagaacccagagttacccgattcaaaattaactgggaagaaccgaacgctcaggaatccatgcctggaccatcagaaaatgccgagcctatacctatcccgccactaggacaaacacccagtttcaatgaaagttcaaactcttgggctactatggaatgctcttag

SEQ ID NO: 1345 - DNA, 948 bp, Ceutorhynchus assimilis
atggatcaaatgcttccgagtcctggcttcagtattcccagtattggtactccattacatcagttagaagaagaccaacaaatccttccaaatgcattacagcagcaacagcaaccaataacaagtcaggtgccccctttggccccaatgggtgggctaacgcccactttaagtttgggcatgggtaatgccattgcaatgccccatacaaaatatgtgactggtttcagtatgcctatggggggtaataatagtggaatgaccccacagacacctcaacattcaatgatgacttcgatggtaaatttggggggtacagggggtagtacccccagtatgacccccatagtgggagggccttcgactccaagcccgatgacccccatgacgccccattctgctgatcctggaatcgtacctcaattacaaaacatcgtatccacagttaacctaaactgcaaactggacctgaaaaaaatcgctttacatgccagaaatgccgagtacaacccgaaacgtttcgccgccgtcataatgcgaataagggaaccccgaaccacggccctgattttcagttccggcaaaatggtgtgcaccggagccaaaagcgaagaagattccagattagctgcccgaaaatacgctcggatcatccagaagttgggattcaacgcaaagtttctggattttaaaatacagaacatggtcggcagttgtgacgtaaaattcccgatccgtttggaaggtttagtgctgactcacagctctttcagctcgtatgagcctgaattatttcctggattaatttacaggatggtcaagcctaggattgttttgttgattttcgtttccggaaaagtcgtgctaactggagcgaaagtcaggcaggagatttatgaggcctttgataatatttatccgatacttaagagttttaagaagcagtga

SEQ ID NO: 1346 - DNA, 477 bp, Ceutorhynchus assimilis
atggccgcaatgagatcaatgtcccgtcttttgaccagcagggctttaaataccaccatccgacggggctacgctgaagaaatgaactttacttttgctgctggaaaccaagtattttatgatggaaaaagtgtaaaacaagttgacgtaccatcattctcaggcagttttggtatcctccccaaacacgtccccactttggctgtcctcaaacccggagtagtttctgtatacgaagaggatggtggtgtcaaaaaaatctttgtatccagtggtacagttactattaatgaagactcttcagtacagattttggctgaagaagcacatccaatagaaaatattgatgcttcagctgctagagaacttctcactaaatcacaaagtcaactttcttcagcggccaacgatcaagctaaagctgaagcagaaatcgccattgaagtttcagaagctttagtaaaagctgctgaataa

SEQ ID NO: 1347 - DNA, 990 bp, Ceutorhynchus assimilis
atgagtggtgacggtgataaagctgaacagttcgactctcttttcctcacaatagcgcaacaccatccagaaggcgccctcaagcttctagacacgtttgtaagttttttgggccgaaaaaccgactttttcacaggcggcaatgaaggcgattgggaaaaacttgttatgaacacgttcaaaaaacatgaaagaataagccgttccagccgtgaggccgaactgaaagcaaaaaaagaaaaagaggctgcgagaaaagctaaaaaggaggctaaaaagcttgaagagcaatctgttcagcctgcagaaattaaagaactgacagatgaagaagcggaaaagttgcaaaaagaacttgacactaagcaaagtgttgaaagtgttgcaacctcaagcgcagttggcacttcttctgaaacaacggatgaggtaactgaagaggaagaagatgaatcagaaaagggaaaaattaaacctaataaaggcaatggttgcgatttgggcaagtacaaatggacgcaaacattacaggatattgagttgagaattcccttgaacaaaaactatcaagtcaaaggaaaagatctggtagtcaatctaacgaaaaagcatctcgtttgcggattcagaaacgaacctcctattatcgatgacgattttcagcatgaaattaagctagaagaatctacatgggtgatagaagacggaaaaactctactttttaatttggagaagatcaacaaaatgaactggtggggcaaactagtcatgtcggatcccgaaattagcaccaagaaaattaatcccgaaccgtcgaagctcagcgaccttgatggcgaaactaggggccttgtggagaagatgatgtacgatcagagacagaaggagatgggtttgcctactagcgacgaacagaagaagcaagatgcaatcaaaaaatttatggagcaacatccggaaatggacttttccaaatgcaagtttaattag

SEQ ID NO: 1348 - DNA, 459 bp, Ceutorhynchus assimilis
atggctggtcattccggagcaccgcccgttttacaatggagccctgataagacgcacagcgatagagaaagatgggtttgcctctatccagcctacataaacagcaaaaagtccttggccgaaggcagaagaatccccagaaataaatgtgttgaaaacccgacttaccaagaaataagggatgttcttgctgcagcaggtttgaatgttggagttgaaaacaagctctacagccgcgaaagaagcaaagaactcctctacagaggtcgcattcgcgttcaactcaaaaacgacgacggctctttggtcaatcctgcattttcttcaagagacacactgatgcttcatcttggtgacatgataccaaagctgaaaacgcgtttgcataaaccgtctacggaccagccaagtcaggctagtcaaggaaaaggaaagggcaagggtaaaggaaggagataa

SEQ ID NO: 1349 - DNA, 2052 bp, Ceutorhynchus assimilis
atggaaggaaaagcccaaaaaatgccgaaagtggccaaagtcaaaaacaaagcacccgccgaaatccaaattaccgccgaacagttgctgcgcgaagccaaagaaagagatttggaaatcctaccgccgcccccgaaacagaaaatctctgatccagccgaactagccgactatcagctcagaaggcgtaagcaattcgaagacaacatccgtaaaaatcgtacagtaatatccaactggattaaatatgcacaatgggaagagtctcaaaaggagattcaaagagcgaggtctatttgggagagagccttggatgtggaccacagaaacatcacaatatggctaaaatacaccgaaatggaaatgcgatgcaggcaagtgaaccacgcgagaaatttatgggatagagcagtaactatcctcccaagagtcaatcagttttggtataaatacacctacatggaagaaacgctagagaacattccaggagctcgtgcagtatttgaacgttggatggaatggcaaccagaagaacaagcctggcaaacctatattaactttgagcttagatacaaggaaatcgatagagcaaggcaaatttatgaaagatttgtaataacccacccacaagtaaaacattggatcaaatttgcacgttttgaagaaaaccatgcattcatacattcagccaggcaaatatttgaacgtgcagtacaattttttggtgatgattacatggatgagaaactatacattgcttttgccaaatttgaagaaaatcagaaagagcacgatagagccagggttatttacaaatacgctctagatcacattcccaaagaagaaactaaagagctttataaagcttatactattcatgaaaaaaagtttggggatagaagtggaattgaagaagttattgtatctaaaagaaaattccaatatgaacaagaaatagctgcaaatcctacaaattacgatgcctggtttgattatattagacttgtagaaggccaaggtgaaactgatattataagagaaacttacgaaagggccattgctaacgttccacctttaaaaaataaagatttttggagaagatacatttatttatggatcaattatgcttgctacgaagaactagaagcccaagactatgacagaactagacaagtatacaaagcctgtttggaactactaaatcataaagtgttcactttttccaaagtttggttgctctatgccaaatttgaaataaggcaaaaaaatttaacatcagctagaaaaatacttggaatggccataggcatgtgcccaagagacaaattattccgcggctacatagagatagaaattcagctaagagaatttgacaggtgcagaaaattgtatgagaaatttctggaatttgggcctgagaattgtgttacttggatgaagtttgctgaacttgaaaccctattgggcgattttgagagagctagaggcatttatgagcttgcaattaatgtgcctagattagacatgccagagctgctatggaaatcttatattgattttgaaatagctcaagaagaaccagaaaatgctaggcaaatttatgagagacttttagaaagaacttcacacgttaaagtatggctgtcttatgctaagtttgaattaaaccaagagtctgatgatggtatgaacattcgtttggccagaagagtgtttgaaagagctaatgaaaacctgaaaagttccccggacaaagagagcagggcgttgctgtttgaaaattggaaagagtttgaaaatatgcatggagatgaaacatctctgaacaaaatcaccaacatgatgcccaagagaattaaaaagaggcaaaaggtcattgacgaggaaggcaacgaacaaggctgggaagaagtgtttgattacatattccctgaagatgagtctaataggcccaatttgaagttgttagcggctgctaaaagttggaaacagaaaatggaaaaggaagctactaaagaagttattgtcagtgcaaatgataataatgaataa

SEQ ID NO: 1350 - DNA, 1431 bp, Ceutorhynchus assimilis
atgggaataaaattcttggaggttatcaagcccttctgcagcattttacctgaaatagccaagcctgaacgaaagattcaattcagggaaaaagttttatggacggcaattacacttttcatatttttagtatgttgtcagataccactctttggtataatgagttccgactcggcagatcctttctactggattcgtgtgattctggcatcaaacagaggaacacttatggagctgggtatttcacctattgtaacttctggattgatcatgcagttgttggctggtgcaaagattatagaagtaggcgacactcccaaggaccgggcattatttaatggtgcacaaaaattatttggcatggttatcactgttggtcaagctattgtctatgtaatgacaggtatgtacggagatcctgcagaaattggagcaggagtatgcctcttgatcatcatccagttattcgttgctggacttatagtattgcttctggatgaacttttacaaaaaggttatggattaggatctggtatttctcttttcattgccaccaatatctgcgaaacgattatctggaaggccttctcaccagctaccgtcaacactggacgtggtactgaatttgaaggagctgtaattgccttgttccacttgctcaccaccagacaagataaaatcagggctttgcgtgaagctttctaccgccagaacttgcctaacttgatgaacttattagccactattttagtgttcgctatagtgatatacttccaaggtttcagggtggacctacctatcaaaagtgcaagataccgcggacaatattccagttatccaatcaaacttttctacacctcaaacatacccattattttgcaatctgctctagtttccaacttgtatgtaatatcccaaatgctggcagtaaaattccaaggcaacattctgattaatttactgggcgtttgggcagatgtaggcggtggtggcccagcaagatcgtaccccatcggtggtttatgttactatttatctccaccagaaagtgtgagtcacattctcgaagatccagttcacgctttcctttacattgttttcatgttgggatcttgtgcctttttctcaaaaacgtggattgaagtatcaggcagctcagctaaagatgttgccaagcaacttaaagaacaacaaatggttatgcgaggacacagagataactccatgattcatgaattgaatcggtatattcctacagctgctgcatttggaggcctcagtattggagccttatcagtactagcagattttatgggagctattggttctggtactggtattttgctagctgtaacaattatttaccaatactttgaaatttttgttaaggagcaaagcgaaatgggtggaatgggaactctattattctaa

SEQ ID NO: 1351 - DNA, 483 bp, Ceutorhynchus assimilis
atggttagtgtcagtgctgcctcagtggaactaagctcctaccgtgaccaacattttaaaggcacccgagcagaacaagacaaacttctacgcctctcatgtaccctctacgtaggcaatctatcattctacaccactgaagaacaaatatacgaactattttcaaaatgcggcgaaatccgtcgaatcattatgggcctggacaagtacaagaaaaccccgtgcgggttctgctttgtcgagtactacattcgtgaggacgcagaaaattgtttgcggtacattaacggtaccagactggacgataggatagtgaggactgattgggatgcgggctttattgaaggccgtcagtatggacgaggtaaaactggcggtcaagttagggacgagtacaggacagattatgatgcaggaagaggcggatatgggaaattaattcagcagaaaattggaacagaagttccttcatttttacgataa

SEQ ID NO: 1352 - DNA, 924 bp, Ceutorhynchus assimilis
atggctgccagagttgggcgaatttgcggagctggacttttcaagtccaatacaacttctagtttgaatcagattagttcctattcaacaaccagagattggtcaagaggaagaaaagcactggttggtagcctgggtatactggcaggaggagctggagccattattttcgccctggacaggtccgtgagggcttctgaattagaattgcacccacctaagaacccatggagccacaatggctggtttgattccttagatcatgctagtgtaagaagaggttacgaagtttacaagcaagtatgttcggcttgtcactcattgaggtttattgcttaccgtaacttggtaggagtgacacatactgaggaagaagctaaggctgaggcagaagaacaaatgattactgatggacctgacgaagctggtaacatgttcaaaaggcctggaaaactgtccgactacatccccagtccttatcccaatgaagaagctgctagagcagctaacaatggtgcctacccacctgatttgagttatattacgttggccagacatggaggtgaagattacattttcgctcttctaacgggttaccatgatgctcctgctggaattgctctaagagagggccagtatttcaatccgtactttgtcggtggtgctatttcaatggcccaatctttgtacaacgaagtaattgaatatagtgatggaacaccagcctctgccagtcaacttgctaaggatgtatcaactttcttgaaatggaccgcagaaccagaattcgacgatcgcaaacgcatgatggttaaggcgatcggcattttcaccattttaacaatggtgtcctattacgccaaaagattcaaatgggcaagtttgaaaacaagaaaaattgaattcaaacccaaaagtaagtaa

SEQ ID NO: 1353 - DNA, 1683 bp, Ceutorhynchus assimilis
atgatgtccatacaggcctacagtggtagtagcagcagcggcgacgaagaaacccctgcggcgccccctcctgtaagtttttccgcaaaaaccctacaaatatgcgcggcccccacagtcctaccccccgccattgacgaagacaaaatccacatccatcccgatactgtagagctccaatacaaccccaaatacgaagagttatttgctccaactgtggggcccacaaaccccttcaaacccaaacatcaagaaatcgaaaaaaacacgctttccggccacgtagaaccggcccatgtaagcgaattccaattcgaaaaccaacgccgcacctttgcaagttacggctacgctttggacccctctataagcgcacatgaacaaggcctcactaaagtaattggcgactcagaagaagccaccgattcactcaaaactgtatttgaaaagacccaactcagacccttggacaaaaggaagcgcaaaaaaaacgacaaaccggacgatattgaagggtttttaggcccctggggcggattcgaagacgaacaaaaaatcgcaaggcctacagaagaagaacaggccgaattgcaagaacttgtaagcaaaagaaccaaaaaaggcaaagaacctgaagaaaaacacacagaagaaaaatcagtgttgcacatcaaagatgccattgattatcaaggcagatccttcttgcacgccccccacgatgtcggagttaacctcaaatctgacatgcctcctgataaatgcttcttacctaaatcccacatccactcctggaccggacacactaaaggcgtctcagctattagatggttccccaaaactgcccatctctttttatcaagtggcatggattgcaaaatcaaaatttgggaagtatacaaggaacgcagatgtgtacgcacctattatggacatagacaagctgtcagggatattaatttcaataataatggcaatcagtttttgtctgctggctatgacaggtatattaagctgtgggacactgaaactggccgggttgtttcaagatttacaagcagaaaaataccttattgtgtcaagtttaatcctgattacaataagcaacatttgtttgttgctgggacttcggataaaaaaattatttgttgggatactagatcaggagacattgtacaagaatatgacagacatttaggggctgtcaacacaataacctttgtagacgagcataggcgttttgtgactacatcggatgataaatcattgagagtctgggaatgggacattccagtcgacatgaaatacattgcagatcctacaatgcatagtatgccagcagttactcccgccccaaacggcaaatggctggcctgtcaaagcatggacaacaaaatcgtcatattttccgctctgaaccggttcaagttgaaccgcaagaaaacctttaccggacacatggtggccgggtacgcgtgccagctggacttttccccggacatgtcttatttggtatctggggatgctgatggcaagtgttacatttgggactggaagactaccaagttgtataagaagtggaaggcgcacgataatgtgtgtatcagttgcttgtggcacccccacgaacccagcaaaatgatcactgcaggctgggacggccttattaaatactgggattga

SEQ ID NO: 1354 - DNA, 810 bp, Ceutorhynchus assimilis
atggaccagaagaaaccccagaagaagactggcggtaaaaaagtggcagaagctcctcttgctgtaaaaaaagtagaagcaaagaaagaagtaactcctttattcgaaaagaggccaagaaactttggaattggtcaagacatccaacctccacgtgatctttccagattcgtaaaatggcccaaatacatcagaatccaaaggcaaaaagctgtcttacaaaaaagattgaaggtgccaccaccaatcaaccaattcacccagactttagataaacaaacagcaactcaacttttcaaagttttggaaaaatacaggcccgaaactgcccttcaaaagaagaacaggttaaaggcaaaagctgaggctaaagtggctaaaaaagaagaggctccctcaaagaaacccaacactcttagggcaggtaccaacactgttaccaagttaattgagcaaaagaaagcccaattggttgttatcgcccatgatgttgaccccattgagcttgtactcttccttccagccctttgcaggaaaatgggagtaccatactgtattgttaaaggaaaggctcgtttggggctccttgtcagacgtaaaacttgctcagctgtagccttgacccaagtcgattccggtgacagatccaacttcaacaaaatcgtcgaagccatcaagaccaacttcaacgatcgcggtgacgaaatccgtaaacactggggcggcggtttgctgggatccaaatccgcagcgcgaattgccaagatcgaaagggcgaaggccaaggaattggcccagaaacaaggataa

SEQ ID NO: 1355 - DNA, 999 bp, Ceutorhynchus assimilis
atggcaaccctaaaaaaagacatacaactcccagaaaacctagtcaaaaaaatcctcttcaaaaaacacatagatttcatcaatgaatatggcaaagacgaaaacaatttcgaatatggaatgaccgattatcttcgagtctctggtatgtattggggcctcacagctctggaactaatgaaagcacagcctgtgcaaagtaaagaccacattattgcttatattaaacaatgccaggacccacaaagtagaggaatcagtgcttgtattggtcacgatccccacatacttcatacactttctgccgtccaaatattggctatgtacgataaacttgatgcaatagactgcgaaggggttgtgaagtatgtacaaagtctccagcaacctgacggaagcttttcgggcgataaatggggtgaaatcgatacgcgtttctctttttgttctgttatgacgttgactttgcttaaaaaagaggatgctgttgatttggacaaagcagtggaatttgttcagagttgtaagaattttgacggtggatatggatcgaggcctctatcagagagtcacgcaggattggtttattgtagtgtaggatttttttcacttacaaagagattagatttggtggatagagatactttggcttggtggttgtgtgaaaggcaactaccttcagggggcttaaatggtaggccagaaaaattaccagacgtttgctattcgtggtgggtattagcatctttggctatattaggaagattacattggattgatggagaagcgctgaaaaactttatttttgcttgccaagatactgaaactggtggttttgcagataggcctggagatgtagcggatccgtttcacacagtatttggaattgccgcattatcgcttttgggtcaggagaatgtacagaaagtaaatccaacttattgtatgccccaacatgtcatcaagcgaatgggattaaatcctgaaattttatcgtag

SEQ ID NO: 1356 - DNA, 2727 bp, Ceutorhynchus assimilis
atgcatcaggaaaccctacaactggtgcaagtcctagaaaaaaccgtatcgccggacaaaaatgatcaggatcaagcctcctccttccttgaacaagcagcagccacaaatctgctgggcttcatcaaaactctgtccgacgtcctcagacatggcggcaacagttctgtggcccgaatggccgctgggctacagctcaagaatcaacttacagccaaagacctgagcatgaaagatcaataccaacaaagatggctcgcctttcctgccgacgttagaacctacatcaaaaaaaatgttgttggggctcttggaactgaaactaataggccatcctctgcggctcaatgtgtggcttatattggagtagctgagctgccaaagggagattggccagatttaatttcaactttagttgccaatgttgtgaatgctacatcagaaatgcaaaaagaagcgaccctagaaactatcggttatatttgttctgaaattgactccgacgttcttgtaagtcaatcaaatgacattctaacagccatagtaaatggtatgcgagtaactgaacaaaataatcacgtcaggttagcagctacaagggctttattgaattctttggagttcactaaagctaattttgagcaaccaactgaaagaaactatattatggaagttgtttgtgaagccacccaatctcctgaggcccaaattaaagttacagcattggaatgcttagtaaaaatcatgacactttattaccaacacatggaagcctacatgtgtgctgcattatttcctatcacattagaagccatgaagtcagagaatgatgcagttgcattgcaaggaatagaattttggtccaatgtcagtgatgaagaggtagatttatccatagaagatagtgaagctcaagaagctggcaggccaccttctcgagtttcgcgtcattatgctaaaggtgcccttcagtacattgtcccaattttattgcaaaaactaacaaaacaagaagaattagatgatgaagatgattggaatcccagcaaagctgctggtgtttgcttgatgctgctagcgacatgttgtgaagaagaaattgtccctcatgtattgccattcattaaagacaacattaaatctgataattggagatatagagatgcctctcttatggctttcggttctatattgggtggtctagattctgctacattaaaacctttagtagaacaagccatgccaacactaatagaacttatgtatgatagcagtgttgtagtcagagatacagcagcttggaccttcggcaggatttgtgagataatacctgaagctgccataaatgaagcctttttgaaaccattgctggaaagtttgattactggacttaaagctgagcccagagttggagcaaatgtttgctgggcattttcaggtttggctgaagctgcatatgaagctgctaaccgcgacattggcggcggtgatgatccaactcctgaaacttattgtttatcgcaatattttgaatttatagtgcaaaggctattggaaactacagacagaccagacggggcacaggccaatcttaggcctgctgcctacgaagcccttatggaaatgattaaaaattcgcctagggattgttacgttactgtacaaaagacaacaatgatcattttggagagattacaacaggtccttcaaatggaatctcacattagtaatcacaacgatcgttcccaattcaacgatctacaatccctattgtgtggcacattgcaatctgttttgagaaaggtcactcctgaggatgcccctcaaatttcagatgctgttatgacagctctcctaacaatgttcaactcaaacaaaagtggtggagtccaggaagatgcacttatggctgtttctacgcttgttgaaacgttaggagaaggattcttgaagtacatggatgctttcaaaccatttttgtatttgggattaaaaaatcatgctgaatatcaagtttgcggtacagctgtgggacttactggggacatatttagagctttaagattcaaagctctaccatattgcgatgaaattatgacacttttgctggaaaatctaggtgaaccttctgtacaccgtagcgtaaaacctcaaattctatccgtgttcggcgatatagttttaagtataggagctgaattcaagaaatatttggaggttgttttgggaactttggcgcaggcgtctcaagcccaggttgatcggtcagactttgacatggtagactacctgaatgagttacgcgaaggagtcctagacgcatacaccggaatcattcaaggcctaaaaggcgatggaccgacaccttcatcagaagtggctgcactagaaccccatataccattcatagttcagtttatcacaattgtcgcgcaagatactgagcactcggacggaactgtggctgtcgctgcaggtattgtaggtgatttgtgtaccgccttcggccctccgatgttgccccttttggacttagttcccatcaatgatatgctagcacaaggacgaagatccagggtggggcgtactaaaactcttgccacttgggcttcaaaggaactcaagaagctgaagtatgcacagaccaacagcctagtgcgcctgcggccagttggaaacttgttgaggtgcagcagaaattttattgagaacagcactatttcctag

SEQ ID NO: 1357 - DNA, 1503 bp, Ceutorhynchus assimilis
atggaaacaattttggaacagcaaagacgctaccatgaagaaaaggaacggctcgtggatgccatggtcaaagaaaatctacataaaaagaattcttatagagaacaaataaactctgatcaaagattaaaatatctactggatagatatgtaatgtcaaccaataaacttattgacctatatgacgacaaagatggccaaagaaaagctgaagttgcttctcttacaggcccgaatgaattcaatgaattttatagcaggttgaaacaaattaaggatttttataggagacatccaaatgagatcagtgtgccaatgtctgtggagtttgacgagttagcaaaggcaagagaaaatcctactgaggaaatgtcaaatttggtggaatttactgatgaagaaggatatggaaagtttctggacttgcacgaatgctatgaaaaatacatcaacttaaaaggcatagaaaaagttgattacatcagttacctgagtatgtttgatcagctctacgacatacccaaagaaagaaaaacaggcgaataccgaaaatacttaaattgtctcatagaatatctatgttggtttatccaaagaataaaacctttattgcatttggacattcttttagatgacgaagctagaaaggctgctatagaatgggaaacggattcttgtcctggatggccaaaagaagcagggtctgctttggctaatgttggagctcatttagacttgtctgcattttctagttgggaagaattagcttcactcggactagatagattgaaatctgctttgatggcgctggggctcaaatgtggagggactttagaagaaagagcacaaagactgttttcaactaaaggtcaaagctcactggatcctgccttaatgactaaaacaactaaaggaaaggcaagcaaagaaaaagaattgttgagacaaagagatttggctatgatggaagctcaaatttacaaactttctgagatagttagtgaccaacgagtagcaactaaagaaaacgtccaacggaaacaagccagaaccgatggcgaaagggatgacagtgaaaatgaggaatctgaagacgaaagtggtgatgaaaatgacgatgatgtaccatataatcccaaaaatttacccctgggatgggacggaaaacctattccttattggttatataaactacacggcctgaacatcagctacaactgcgaaatttgtggtaattttgtttacaaaggccccaaagcattccaaagacattttgccgaatggagacatgctcatggtatgagatgtttgggtatacccaacacagctcattttgccaatgtgacacaaattgaggatgccttagcattgtgggaaaagctaaaggttcagaaacagagcgaacgttggcagccagaaactgaagaagaatatgaagattctcagggtaatgtagtgaacaggaaaacgtatgaggatttgaaaagacaagggctactttag

SEQ ID NO: 1358 - DNA, 651 bp, Ceutorhynchus assimilis
atgacgataggtaagaataacaagatgatccagcacataaactatcgtgtgcggatcaccctgaacgactctcgaacgtttattggcacgtttaaagccttcgataagcatatgaacatgattttgggcgactgtgaagagtttagaaaaatcaaacccaaaaattccaaagttgaacgggaggaaaagcgagtacttggctttgtgttattgagaggcgaaactgttgtttctctgactgtagaaggacctccgccaccagaagagggactgcctagagtaccgattccaggagcaacttctggaccaggcattggcagagctgcaggtcgaggaatgcctgcaggaatgagcggagtccctgtaggattacaaggtccagtcagaggtgtaggcgggccatctcagcaagtgatgacgcctggaggaagaggtcaaatggcgggtccaccacaaatgaaccacggtccacctaggatgggtgcacctccaccaggaatgatgggcggtccaccacctggtatgatgggcatgcctccaaatgccatgggcatgggtagaggtggtccaccaccgccaccaatgggaattagaggtcccccacctggtatgatgagagggggacctcctggaccaccaagaggatattag

SEQ ID NO: 1359 - DNA, 1179 bp, Ceutorhynchus assimilis
atggacgcgcaactgtgtacctcgggcgttgttgccgtggcagcatattgtctaattcaaaggaaaaaagcaagaaaaagacgattttgggtacatcctattgtcaaccaaaggttactgaaaggtgcatttgttaccctttattcggagttaagggagcatccaagaaaattttttaattactttcgtatgagtactacgaccttcgacgaattgtatgtaaaactagaatccaagttgatccataaaaatgtggttaggctatctatttcggcgacagaacgactatgtgtagctctcagatatttggcaactggcaacacattcacagatttacattacacatatcgactgggcatttcaactatcagcattgttgtggaagaagtttgtaccgttatttggactttgctcaaggatgaatgtatgggtataccaagtaccgaaaagtgggaaaacatttccatggaatttgaagagcgtgcaaattttcctaattgtatcggagccgtcgatggcaaacacatcagaattattaagccgacaaaaagtggctctctcttttttaattataagcatttcttctcagtccttttattagccgtttgtgacgcgaattattgcttcacttatatcgatgttggagcatatggaaagttttctgattccacagtattcaaaaatggtccgttttggcaaaaacttcaaaacgattcattaaatatcccaaaaggaaaacctttacctaaagaaagtattgctcaaccttatgtcatagtgggtgatgaagccttcccgctgacaaaaaatttactacggccgtatgcacgaaagaatctaaattacaaaaaaaaaatattcaactataggttaacccgtgctagaagatatatcgaatgtaccttcgggatattatcaaataaatggcgaatttttcacagaccattgaatgtaagtttacgcctttcaaaaaaaattattaaagcctgctgcattctgcacaactttgttcgtgtaagagatggtttcaagttcgaagatactttaacagttcatggatttcgcgattcgacacaaagaataccacaaaattctactataaacacaacaagagatgctttcgccaattattttataggcagtggacaagtggcttggcaagatagtaaaataaattag

SEQ ID NO: 1360 - DNA, 15819 bp, Ceutorhynchus assimilis
atggatgaattacctccggttctagatccagacgagcttatggatctagaagaaccggaaacttatgaaattgaagacgatgacgaagaaattgttgaagacccatcatcatctccctttcaacagttttcttctggaccggcatctaatgcgacatctgcagcctcatcaccacacaccaatgatgattttccaccacctttcaattttaacgggaaacctgttactattaaaaggggccgtggacgtcctaggagagaaggaggtaaaccgactcccagacgatccggtggcgttggtgttcccagagttagaagagcaaaatctgctggattttcccgttgtagaggatccaggagtgttagacaaccagacagaatggattttgatttttcttatatcagccctacttctattgatgacatgggtctcactgacatcgatggttttttcttcccagaaagggaaagacccagtccagtttttgaagaactaccttatgcaccagaggtctggcctggaaaagtctgtgctttttgtaatttgggtgaacgcagtcagctaggacaaggtgaaataatgagattaaattgcccagatggttttacgcctcaaagatcagtcggtgaatctaacactccagctgttcaattaccagatagggattttggtgataaaagtccgcgtggtcctgttacatgcaggaggaataaaaattttaatagaagtcgaagttttgtgtccaataatgaacatatagatgagcttaccataattggacatgctgaagaaccaagtgtgaacattttgtatgaaataagtggacaattttatgttcatagaaactgtgccttatggtcaaatggggttacccgcacagaacatcaagccttagaaaatgttggaccagttgtactaaaaagttcatctcagaaatgttcattttgtaatcatttcggtgcaagtctcacatgcaggtcgaccggttgtacaaaagtttatcatttcccatgcgccactgcctcaggtgccttccaggatatcactagtttgcaagttttttgcaccaatcaccttcacgaagctgccttgtgttcggaatccgccatttgctatacgtgtaaaagcgtgggagatatttcaaacttaatgtattgctcaagctgtggcacgcattatcatggaagttgtgtgggtttagctcagttacctggcgtaagggctggttggcaatgtagaaaatgtcgcaattgccaagtttgtcgaatgatgggggacgaaactaaattgatgagttgtgagcagtgcgacaaggtttatcacgccagctgtcaacgcccattagttacgtccattccaaaatatggttggaaatgtagatgttgtagagtatgtggcgactgtggttcccgaacaccaggcgctggtctatcttctagatggcatttacactatacagtttgcgattcgtgctatcaacaaagaaataaaggttgttgttgcccaatttgtcaaagggcttatagatcacatgctcatagggaaatggtgcaatgtggaacctgccgaaagtttgttcatgggacatgtgatccagaagcagatttggtaacatatcaacagaaaaaggaaataaatcctgattatgagtatcattgcgttatttgtaaaaattcattgcagcaactctccagccgccctgtcactagcaaaagatcaagtctagatgactttggagatttgtccgcttcccaagaatctttatatgatgacatatcagaatttgatatgccttctgaagaatctttcagagggacagggttgggaaaaggcaaaccatatgcaagtaaaattgcgaagaagaaattgagttattcaactggaatgcctgggagaccaaagggtagttttggcaaaggcaaccctggcaaacaaggattcatgaaacgtcagcgcttagtcgaatttggccgtaaaagaggcgccaaagctaaaatacggggtgtgtttggagtaccgggagttggattatctcgtcccgtatctgatggtaaaggagacgaagaaccaggagtagaaaaccgactagttttgtgttctgccaaagataaatttgttctgacacaagacatttgtgtgatgtgtggagccttgggcaccgaccaggaaggttgccttatttcttgcgttcaatgtggacaatgttatcatcctaactgcgtgaacgttaaagttactaaagttattcttaccaaaggctggagatgtttggattgtacagtttgcgaaggctgcggtcaacgcaatgacgagcctagactaattctttgtgacgattgtgatgtatcttatcatacttattgtatggatcctcctttggattacgtaccacatggaaattggaaatgcaagtggtgtgcatgttgtcgaagctgtggctccacagatccaggatttaatagcacatggatgaatggatgtacagaatgtggaccatgtgcctcccattcagcttgtcctagctgtaatgagtcatatgcggagggagatcttattattcaatgtgctcaatgtgaacggtggttacatggtatatgtgatctcattaaaacagaacaggatgcagaaaaatgcgctgaagatggctacacttgcctgctatgccgccctagagacgtcccacctccacacttaattccttcctcgatagcccccaaaccaccgacgcctactaaaagccctgaggtccgctcgcaacccaacatcttcgtcgatggtgtttgtctcagcgaatggggccatagtctaattaaatccctttcccaggagtatcacggtactcgcaagaaacgcaagaaacttccaccagttgtacatgataaagaagctggtataatggcaactattgagtcagttgttgctggaggaagtggaggcgaaaatagttttgaagataccaaaatagaattagtggatatgaaagacgaaccgcaagagctttataaagaaggcatgatttggactaaagaagatggttctccacctgaaggatttactatttttaccatggaaagtggtatatgtgttttaaggagaaaacggcaaagaaatctgcaaaaattgggtataggaggctttttggttcggatgagaggcttcaagagtcaggaaaatgatgagattgatactttacctggacaaagtacacttaattttgatttaccaataccaatgacgtcaacactcgaaggcgataaaccaaaaaagaaacccataagacgcaagcaaaaatctaaattggctgaaacatttcctgcatatcttcaggaagctttctttggcaaagatcttatggatgtaactgagtttaaaaaagaaatggagggcggtgttagcagtgacgaagataaactttttgaaaataagcagcaggcgatcaagttaacagcagaggaactactggcagttgaaagtgctagacaagaaaagaccacctctgaggggcgctctcaaccgagagacggcttttcagatactttaaaaatagataaaccaattttgattaaagaggaagaggacgacactgctgaagacttgaaagatgtacttgctttgcctggcgacttactggatactgatttggttaatagcattataaatgaagatgatgaattgactaaaaacacagaattggatgctttggcagatgatgacgcagaacttcctcagactttaggaagctcagaaaattctaaagatgccaaagacgaattaagtgatattttaggatcacacttttcactagaatctatacctaatataaatagtaaagatgttgaggatatatttaagggcgttcttaccgatgaatcgcaagaatcgcagctttcccaagaagccacaaatatgtatccttcaatgccatccacgccgactccaattagtccaatgtttccaagtaattcgtctcaactaccgacagctggtataatacctcaaatgcatttgccttcagctccagttagaccgactgcgttacctggagttcagcatgttagcttccctccgtcgccttatcattctgaatatagcaatagtccccagtttagtccggcgttttctgaacctccaagtccttgggtaaacataaacgacaacacagaaatggacactgccagcgttgcaggtgtgccatccacccataatcaacgttcttcggaaaaaatgaaggcagatgaaggtctcggtaatggggccactatatcggcagttctctatgccaataggaatcatccagaatggaaagctgagtatcctgtgtggtctgacagatacaagcatattatcaaaaagtggagaactttgagtcaagacgagaaggctccatatcttcaacaagctcgcgacaatcgaagccagcttcgaatgaagaaacaacaacagtcacagaccagcaaggaaacctccacaacgagtcctgtcgctcccacaaagccaccccctaccgtagtaccggcagctgctttggttaccaatctgccttcaccggggttaccaccaccttcgctcgttacacaggcgcaggcgcaacagagtcctaccgcgataactactgaggaccaagaaaaattagcccaacaacagagaacagcccgagaggctgagcaagaaagacaatggaaacatttacaagccatgagacagcaacaagctcagcaacaagcgcatgttattcaagaacaaagagttcaagcaattgcaagagtccaacggacaatgtcagaccctaatcctcaatttatccccaccaaccaaacgagtcccctacaagttaccacaacatcgcaagaaggcagtcctgtggctcctccatcacccagacaatttatcggtataaaatcgccaccatttgcccatccttcacctccttccactaatattcgtactcctacctcttcacagtctccggttcacgagttccagcaaccaaatcagcaaactccgaatcctgaggaatcctttatagaacccactagtccgcaagtcaatttctctaaagtaccaaccggaaatgaggcgtttggtcaaccgcctccaccgaggagtccatttgttgctgcaagaccgcccatgcaggctagaccggatcaaccagaaatcgcacgtcagttgcgggagttgctccagaggcagcagcagcaacaacaattgaaaaacttcgatttggtgcaagcaaaatcaactcaaagaatctggaatcctaatgatccgcctgcaactgaacctgtgaatgcgggtgcgactgcagaagaaataactttcaggcaaccactaccgcctggatccgtaagacccagaatcccattacaactaggacccaggcctggtccaaatctccgtatgccgcaattagaaggcaggcttcaagggctcgatcctagattaagactcattctacaccaatcaagggctgctctgcctggccaacaagtaccggcaggcggtatacgcttcacccaaggagcaaaccgaccggcaacaatcgaacaatatgaacaattgttgcaccgacaagctcagctacaagctagaaatcaagctttagagcaacaaggtgtcggtgtgaggttgcctttaggacaaagtggtggtggggtgattcagaaacaaccttcctcgataactcaagcaatgcctgtagttcaaccagctcaacaagcggctgcaacaaatgaccaagaaatacctgataatgtaactgcagaactagaaaaattggaacaagaaactggcacaatggccgagctgcaaggtgtcagcgaaatattgggaggtttgggagatgatgacgacgaactcctagctgaaatgggagcagatttcaatattttggagtatgcggatccagaattagaagcattagcgggagagaagacaaacattctggatttggatttggaagatgacaatatgaagcaggaaaagaagagggaagctatgatgcaacgacaaaataatgtctcttctgcccaaacagcaacgtctcaagcgactaaaactgtagttgcaagtaattcacagaaagaacaaaagctagaaaaacgaccaacctccactgctgcagaagagccgcataaatcagatgcatctgctttacctcaacctaataataatcctccactgcctcttcaaaaacatcaacaagttcctcaaacacatcaagtttctcaaaaacatcaagtgtctcaaaaacatcaagtttctcagaaacatcaacctcattccgataataatttacgtcctcaaacgccagcattggcagatcagtctcaaaatcaaataactcaaaatttatcacaacagcgtgttgtacaaaatatatcctcatcgcaaccccaactagcccaggctttggctaataattcaaatccacaacaacagcagcaacaacagctgcctcagccagagcctcccgtgttacagcaacaattacaacaacagttacaacaacaaccaccacaattacaacaacaacaaccttctccttcccaacatcaacccaatattgctttaacagcccagcaactccatcaacagatgctgcagcaggtaggatgcaaaatgtccaaatatgtacagcaagctgctgctatgggaaaaccgatgccaccgggatccaaactacaaacccctgaaggtattgtcggcattgttttggctaataataatgtccaattgcaaatacctccgaatttccaacaaagactgctgcaaacattacaaaatcaaaaactccaaatgcgaatcgggcgaactgttccccgtccccaacagccgaatataaatcaaccccctcagcctgttcctggacaaatagcaagacccagaatggctttaccaacgccacctccaccgcctccgtaccctggtccaccgccaccctatccagggaatctcatggctcagcaacaggcaatgcctcagcagatgggattgagaatggggcctggttttcatcatcacatgggactcgtgcatcccctggcactgcagggtttcccgatgcacccacactttgagaggagaccgcttttactggaggaacagcctctgttgctggaagatctattggaacaagaaaagagagaacaggagaaacaaaaccacaatcatcctctaccttcagatatcaacacaagaagtaacgattcagaatcggctttgtgtgttagcgatcatgattttgaaagactcaaagctgatgtattcagtagtgggcattctgatacctcatcttcagactccacagttggcatggtgcaacaacaatggcaacctaatcgtctacagatgcccagtgcgccaactcaacacactacagaagttacgaccaaaattcaaatgttcaatgcaaatttaatgcctgctccgccactaccatcagaaaatatcgttacggaacaagacaaacaggctcaacttttatatgagcagtggcttaataatcaaaataatgttttgactcagcaacttcgatactatgaaactgaagtgctaaaattacgtaaaagtaaaaagtcattaaatagcaagcaaagacagctaaggaaatctggcaatcagctaactgaaattgattcaaatgagctacaaaggatttctgccgagcaagctattttacaaaaacatctagagtccagcagaaagcagagtcgtcaacatggaatgctcatacaggaataccggaataaacaacaactgctccagaagcccctcatgggcgggccgcagacgcaactagcctcccctctaggacctccaggatcttctccaatacatcacgcagctgccagtcactcacccatgttgtcaccgcaacagtcgcctttgcctcagcagtctccattgacgcagcataattcacctatgaatagtccgggtcctatgatggttcattctccagggcctggatcagtggctgctttgttacagagtccaggcgggagtgtgtctccaatacagactaggattgggacaccattgtctcaagaaggaagcccaggtccaatccaatcgccttcccaagtttgtctgccaccaccgatgcctcgaatgacatctccccaacatcgccgagtggtaaccagccctgttggatatacaggagatatgcgcagtggagtgacacaaatgagatttatgagacccaccgtggaacataattctctgcaacgtatcagaggtcaagcgcctggtcaattgcagaatttcccctctaaagttggcactccatctcctctcaatagtccacctctgaatcaaatgtcactggctcatcagcaaatattacaaaagcaattgcatcagcatcaacaagctttgcttcatcaacaacagcagcaacaacaacaacaacagcagcagcaacaacaacaacagcagcaacaacaacagcagcatcaacaacaacagcagcaccaacaacaactacaacagcagcagcaccaacaactacaacagcaacagcaccaacaaatacaaatttccgatggtactcagcaacaagaagcaaatgttatgcattctccccgcgttgcccaattaatacagcatagaaatcttggacgaccgcagcagcaacaacaacagcaaactttgacggctcaacaacatcagcttttgaccaaacagcatcaacaaatagctcttcaattacaagcaaggctgaatcaacaatctcagcagcaatcacctactccacaatcaccaatgcctccaaaaagtcccatgcacaaccagaatatgtctcctctatcgatgcccacctcgcccatgcctccaaaaagccctatgttgtctttcaatcaacagcaaagcactcctaattctccagcagctcatagaaattcttactctcaaaatcctactatgaatcaacctccgagtagtcccatgatgcatcaatatcatcaacctacttctcctatgatacaatctccacacgcaatacgtcgacctccaagcagtcctgctatgcctgagaggcccttgagcgtagaaaatcctggtacgcccagaactccttacagtttagatatgcatcttcaagataatatgcacacagggggaggaaatcctaataatccaaataatccaattccattgcctcctgatgggttttgctactctaagctaggcttaagaggcggtatgtggagcggatttggaagaggagaaaaacgagtcccaacacctcctacaagctcatctactagtgaaactgaaaagcaattaccagttgaagtaactactttgaacaaacctaaaaaagaggctcatattaataaagtttccattctcaaaaagaggacaccactgccaaaaagtagtcctaaatctattataaccagcaaaatcgctgattttacagaatatgatgaaacttcttctacatctcctgcttctacatcttctttattagctggacgtggaggggcaggactgaaacccctgtcaaaacaagatgccactggggataagttacaacttcctgaaatggtggattatgaggatgacaatagtacaatactttcttcagagatttcgttatgttccgcagctcagcaaaacgatgacgaaattgaaataactgaaactctttcacaaaatgacattggtgaagtcttatcaagtccaatggaagctgatcaaatttcggatgagtttatgctgtttcaagaaaatatgttggttgatcatttgagtggcattcaatattcagataaagaagaaactgaggaggagtatgcaaatattgtcattcgaagtccaactactagtgatgatgaatttattatgcaaggccgaacaaagaaatataatatattgaacattgcagaaacttctggttctccagagcaagataccactatggagccatccacagagccagaagatgaggaaattactcagccatttgacgaatcggaagtggttattattgagcaacctgtaaaatcacctgaggaacaaatttcaactaaagaagattttgaagaacttattgatgaaggttctcgaaaagaaaaaatgaagcaagacacaaaaagtgtagttgaacctccacaatttactgctgccagcgtgtataggtttccttctaagacccctattactgtaactagaactcaaaacgttatgacaacagcaaaagtggcaccaaaaatatcattaattacaacggcgccaattattcaaaatttcactgctcgttctgagggtggaaaactgaatgcagaaactcaacaacttatattaactcctacaacaaaaataactaccacaaatgcaggttcaaagctaacaagcattattttgacacataatcctgttagaagtaatattttgaatgtgggacaaaaacttgtaacatcatcaccaggaattacaattgttagtgccagtacttctcaaatagcttcgattttgccttccaaatttagtgttccaattatcagcgcaagtgcagtgaggcaactgccaaacgtaaaagttattgacaagcccagctcttcgctatctttgacgccacgcgatagtactttgcccaataaaatatttgaagatgaatcagtctctccagaaaatgcaaattttgatgatgaaaagaaaaatttatttgatgagaagttgaaggcagaatttaccgcagctaatggaagaatgccaatgtttgggaaaaatgtcattgcaacaaataataaaaatgatgagaataacactagtcaacgtaaaaatgacaaatctgaaattagtaatattgttactaaagaaaaagttcaagtcatagctagtccaataatagcgaaatctgtatctcctgtaataattcatcatgcaccacctgaattgaaaatgacggctcaagtaatccaagaaacatccactcgtatgcaaataactgccactgaaactgttagtactttcatgggtgatggttcagtcgaagataaatcagtagttatttccataccttcccctacgccatctcaagaacaaatgcttgataatattgctttgcaagccttggaggagaataggaaaagagaatttgattctttcgattatgtattgaatatgattgaaaacatgcaacattcagaaactccagagcagtcagatgaacaaaatactgagaaaaaatcaactaaaccagcagtaaaagaggaagctaatgaatctactgcaaataaacaaactatgccgcagttgtcgcctttatcacaaccagctgatctgaccacaaatatggcaaatgcgtctcaacagttgaggagtttgctttccaatatacaaactacaagttcttctcatgtgcccaaagttgaaactcttgtaaaaaccgcaaataaacaaaaaataatcaatgttacttcttcaactattacttcccctgttgttgcttcaagaataattcaacaagcaacaactacaagtaatgtcagtactgttatagttcctaatgtagtcaagcaaaaagtaactcttgcacctactagtaaagctagaacatcgagtacagaaagttttttaactaaccgatttctaggaagtgaacctaaatccacaacatctactccatctcagacaactgaaactatcaataaatctccagatctcaataaaaaagcttcactaacgttaaccgctatgcttcaaaatcaaccatcagctactcccacaacaaaatcctcacctgatacaataactgctgccagtttattagctactcctgtgagcctgtcaagaactagtttttcaccggctttggctctagcacaacccaatgccattatagctagtagcctagctaatactagtaccagttctgtaatttcgtctgctttcaaaacaatcacttcaacaaacttattgcatactcacctaactaagtcgagaactaaaagtcttgatgatattaaagatttgaaaactgatgatcaaaagtctgaagctgatattataacaagcataaaacaggagcttagtggttgtagatatttacccgtaacttcgtcaagtcaaataaataaatgtgaagactcgcagaatgtcctattaaagcaacttcttcagaatactgcttgtgcaagcactcaatcgccgccaccaagtactacatccacaataacgacagctccaactactgaagttcagaaagttagcccaccaactttgtcatctttacttcctccagtaactaaaaccgaagttcaacctactagtacccctcagtcaagacctccaatgcaaagaggtttaatacgagaaacttcctttgtttctagcccaataattcaacatactccaactagtacaactgtcgcagctaccactacaactcaacagctacatattgatattaaaaaatgtgctcctgtagttaggccttctagtagagatgatttactatctccacccactccgagatcgtgcggtagtcaagagtctagtttacaaacgcccccgttaatagtcaaaaaagaaagtccagcttctacttctacatgtcttagtattgagggcatcaaaaaagaattactagatgaatcttcccaacactcggaaatatctgatttgggcaaagctgacattcaaataaaagaagagtctgagccaggggagattagtgataaaattattgttgataaagaagaattaaaaaagcaaaaaaggagaatgtataatcaaaagagacgtcaaaatcagttactgaacaaagagttgaataataaacctaataagagaccgaggaaaaattccaaaattgaagaagattacgattcttatatagacagtgttttaaaccagataaggcatttgcatcctatggttgtctcagaacctgctatagtacgaaatcatggaattttaccagtttttggctctggcgatttatccaaattaggtacaaaatctttcgatcccagatttggtgatttaactggtacttatggcaacgcatcgattcccggatattcagatttttataatacaattccttatggcgatgaagaacccattcctgaaaaaccaccagcttctacacagagaggattttatgatcaagaatttcctcttattaaatttgatacagaagatgataagaagtttgatttgttttccagagaagatacaccagattcaattgttagttgttcttcccccgaatgtgatgcttttgatgcttctgatagatatttgggtttgaaacttattagtgacgatgaagaagaagaagaattatccaagggtagacgttcgccgaaaataccaatagttaaacccattgctattaaactaaaagccgctggcttgttcttgaaagagcccgctactacgaaaattgcttcggataataataaagaaaatattctgaaagaaatggatcaggaaaaactgaaaccaaatccttcgccttcaggtccagtaaaagataatgaaaatattaaagttacgctgacgttcacatcatcggctgctgaagatattgtcggcgtgctaagagatttggcgaatattttacaaattcctccacctacctcttatcagattgttgatagaacttcttcaccgactagtcagaagctgggattgtatcggaccaagggaaaagatggaaaggaaggagctcctatcgatatacagagtatccttaatggggcagcaaagttttgtaaacattgtgacgtagttattctaaacaacttggtgaaaaagaagccttcagatttgccatttttgtcaaaagattccgaattactaagtgaaggagaagaactatatttttgtggttcttcttgctacatgcaatttgctttgatgaatagatcgccgtctattccagaggacaaggctgcggctatcatagatcatctatcacaaaaagactgtcaaaacttaaagcaacatggacaacttcaagatcctttcgattcgaaatcagctctcgttaaccgtttgttgacagaaaataccggattcaatcagtactttggtggggccttcaaacaaactatgaaatttgggtcgttcaaaccacctgagcatgcaaaaagccatagaaatgcgtcggttaaattttggactcctggatgcttgcagcctagtcacaagcataagaaacctactgataaggagatgacggaaatgctgtatcagatggggattacggttacaccttcaaaattgcctgacgataccaggaagtgcatgttttgtcaagttattggagatggtgtagctgacggtccagctcgcttgctcaacatcgacgtagacaaatgggtgcacctcaattgcgccctctggtccgatggagtctacgaaacagttaatggcgcccttatgaatttggaaaacgccatgcagcaaagtttaacctcaacatgcatccattgcagtaagctgggagctacaatacgatgttttaaaaccagatgttcgagtgtataccatttatcttgtgctgtaagagaaaactgtgttttctataaaaataagactgttttctgtatggcgcatgttcccaaacatgaaaaagataatgagttgactaccttatcagtgggcaggagagtttatataaacagagatgaaaatagacaagttgctgctgtgatgcataattcagatactaataatttattgagggttggcagtttgatttttctcaatattggacagttattacctcatcagttgcaaaacttccatacaccaaattatatttatcctataggttatagaataatccgtttctactggagcatgagaaacgtgaataaaagatgtcgctacatttgttctattaacgacaatatgggacgtcccgaatttcgagtgttagttcaagaacgttccgaagaagataccgaatttaaagactttacacctaaagcagtgtgggcacctattctcgaaaaaattgctagcatacgaaaagaaaacaagtgcctacaaatgttccctagatttatttcgggtgaagatctttttggtttaactgaaccagctattgttagggttttggaaagtctacctggaattgagacactttccgactataagtttaaatatggaagaaatccgctgctggaattacctttagccataaatccaacgggtgctgctagaagtgaaccaagattacgccatcaaactcattggaaacgtttccatagaactacaggatctagttcgagacctttgtttgcaccacttccttccaacgcatcagcgccctcttcttttggagaaagtgtatgcccttatagcaaacaattcgttcattcaaagagttcacaatataaaaagatgaaacaggaatggagaaacaatgtttatttggcgaggtcaaagattcaagggcttggattatatgcagctaaggacatagaaaaacacactatggttattgaatatattggagaggttatcagaagtgaattatctgaatgtagagagaagcagtatgaagataggaatcgtggcatatacatgtttagacttgacgatgacagggttgtggacgcaacgttaagcggaggtctagcacggtacatcaatcactcgtgcaaccctaactgtgtagcagaaactgttgaaattgacagagatttgaaaattatcatttttgccaaaagacgaattcaaaggggagaagaattggcgtacgattacaagttcgacattgaagacgatcaaaataaaatatcctgcatgtgtggagcaccaaactgtagaaaatggatgaattaa

SEQ ID NO: 1361 - DNA, 2058 bp, Nezara viridula
atgagtagcaaacataagcataagaaatatgaagaaaaggaggagagaagaaagaaacacaaatctcggtactcagatgactcagaggatgaaggggaaagaaaaagttcctcatcaaggcatcagtacaagaagaaaaaaaatgaccacagtcataagcataaaaaagaaaagaaaaataaatcgaaaaggtctgaaagttcagattcaagtaccagttctgattcatcatctgacaattcagtaaaacttttaaaaaggttacatgataagcatgaaaaaatgattcaacaaaaaaagaaagaaaaagaactgatgaaggtaaatgagactccagaagaaaaaaggattaggcgacttttgaaaaaagaagcaaaagaaagaaaaaggaaacaacgtatgggatgggacaaagattatttacactatactaatactgacaatccatttggtgatgcaaacttgctttccacttttgtttggtcaaaaaaactagcaaaagatggactcacagatgtatcccgtgaagaattagagaggattaatagaataaaacaagaggagaataaaatagaattagaaaaggttaaaaagagacgacaagagagagaacaagaaaggcaagaacgggaagaagccatgatgagattgcagcgcgataaggaagctgaacagtttgaggcatgggcaacgcaggaagatcagtttcatcttgagcaagcaaggctgagatcaaggatcaggatagctgatgccagagcaaaacctattgatcttcttgcaaaatatatcaattcagaagaagaagtggatgctgttgagatgcatgaaccatatacttatcttaatggtctatcaattaaagaccttgaagacctcgttgaagatattaaggtctatatgaaattagaaaaaggaaaaaatttggattactggaatgatattactgttattgttgaagatgaattgtataagctgaggaaaatgggaaagaaatcagactatgaagcagctgttggcagaagagaaggtattcatgaatctgtagctaaagaagtatcttcagtcttcagaggtaaaacagcttcacaacttgcagccatgcaaaaacagattgagaagaaaatcagtgataaaggtgaaggaatcgatattggatactgggaatctcttctttcccaactaaaagctcatatggcacgagctcgtctcagagataaacaccaagaaaacctaaaacagaaattggaattactcaaagcggaacaaagacagcaagaacaagaaataaaagaagaacctctagacgaatcagaacaacaggagaatgaaaatagtgatgaaatcaaagaagaaaaagaagatagtgaagaagagcatagtggaggtgatgaggatggtggggagtctatgctaaaagaaagtttcggagagtacgaagctggagcatactcaccagtttatgttgatcctgcaagtcttgaacctggaactcttatcattggtgaagaggaggatgctcagaggctggagtatgctaggcagcatcttacctctcaagaaagtcaggtgggagctacatctgaagagttggcaatgcaaagggaagcacgtaaaggcatgtctagtgatgaagccatattttcagttgaatctgctctcgattctcaagtgtatctgtggtcagataaataccgtcctcgaaaaccaagatattttaatagagtacatacaggatttgagtggaacaagtataatcaaacccattatgatatggataatcctcctccaaaaattgtacaaggatacaaattcaatatattttttccagatcttattgataaaacatcaacaccagaatattatcttaccacttgtcctgataatcccgactttgctgttcttcggtttcatgctggaccaccttatgaagacatcgcatttaagattgttaatagagaatgggagtattcgtacaaacgaggattcagatgtcagttccacaacaatatatttcagttgtggtttcatttcaaaagatacagatacagaagataa

SEQ ID NO: 1362 - DNA, 1209 bp, Nezara viridula
atgggggacgctaatattattgataaatctatgagatcggtgttcgtgggtaatattccttatgaagccacagaagaaaaattgaaagatatatttaatgaagttgggcctgttctctcattcaaactagtttacgatcgggaaactggaaaacccaagggctatggtttttgtgaatataaggatcaagaaacagctctcagtgctatgaggaatttaaatggatatgaaatcggtggacggtctttgagagttgataatgcgtgtacagaaaaatccagattagaaatgcaaagtctcttagctggaccaccaattgataatacatatggggagtcagtggaatctgataaggcaccggaagctataagcaaagccgttgcttcattaccccctgagcaaatgtttgagctaatgaaacagatgaagctttgtatacaaaacaatcctacagaaggtaaagcaatgttgttacagaatcctcagctagcgtatgctcttttgcaagcccaggtcgtgatgaggatagtagatccacagattgctatcacaatgttgcacaaggccaacccaagcgtacctcctcttcagccgcctcctgtcgaggcaatacggcctgtgcctgtgccacagcctgctccagctgtcgcaccgcctccagttgtaccgccaatagtgcagacgagacctgtcgtggaaccggagtgggtacctccggctaggccgcatcaaccacctcatccaccaacattcattcctcaaccaggtggtgatttagatatgagaacattggacccgagggtaccaccggtgagattgaatcaagaccaagacttgaggatacctccgatggttccagcgcctcagcagcctccggctcagcctcctcagccgtaccctcaggaacatgtgatatcaagtactgttcgggatccaagacagtatcgtgatcctcgcacaggtgcagcacctgttcccgtcccgccaagaccggttgttgcccaggcagtggtgccaccacgacctgtagctcctccacccagtcatatcacatcagcgcttcctcctgcggcttcagaccaggagaaggctgccttaataatgcaagtactacaactttccgaggaacagatagcaatgctcccaccggaacagcgtcagagcatccttgtgctcaaagaacaaatagccaagagcactcaacgttga

SEQ ID NO: 1363 - DNA, 1188 bp, Nezara viridula
atgacggcttctcaagcaatggaaccaaacagagaaaaggctttacaagattatcgtaaaaaattactggagcataaagaagttgaagtcagacttaaagaaatgagagaccagttaaaagatcttaccaaacaatatgataaatctgaaaatgacttgaaagcccttcaaagtgttggtcagattgttggagaagtattaaagcagcttactgaagaaaaatttattgtcaaggctaccaatggtccaagatatgttgttggttgtagaagacaacttgataaattaaaacttaaatctggcacgagggtagcattggacatgacaactttaacaattatgcgacatttgccgagagaagttgatccattagtgtataacatgtctcatgaagatccaggagatgtaacatattctgctattggaggtcttgcagaacaaattagagaacttcgtgaggtgattgagctgcctctgttgaatcctgaactttttcaacgagttggtattactccacctaaaggatgtctactttacggccctcctggtactggaaagactttgttggccagagctgtagccagccaattagatgcaaacttccttaaggtagtctccagtgctatcgttgacaaatatattggagaaagtgctcgtctaattagagaaatgtttaattatgcaagagatcaccagccttgcataatttttatggatgaaattgatgctatcggaggtcgacgattctcagaaggaacatctgctgatcgtgaaatacaaagaactcttatggaacttcttaaccaaatggatggatttgattctctgggacaggttaaaatgatcatggccactaatcgtcccgataccttagaccctgctcttctccgtcctggcaggctagacaggaagattgaaattcctttgccaaatgaacaggcaaggctagaaatcctcaagatccatgctgggcctatttctaagcatggagatattgattatgaggctgtcgtgaagttgtctgataatttcaatggagctgacttgagaaatgtttgtactgaagctggcctttttgctattcgagctgaaagagaatatgtaatgcaggaagactttatgaaagctgtgagaaaagtggctgacaataagaaacttgagtcaaaactcgattacaaaccagtataa

SEQ ID NO: 1364 - DNA, 777 bp, Nezara viridula
atggctagacgttatgattcaagaacaacaattttttctcctgaagggcgcttatatcaggtagaatatgctatggaagcaataagtcatgcagggacttgtctcgggatcctagcaaacgatggcattattcttgtagctgagaaaaggaatactaacaaacttcttgatgaatcagtatattcagaaaaaattttcaaactaaatgagaacatgatatgcagtttagctgggatcacagctgatgccaatgttctgactaatgagttaaggcttatttctcaaagatatttgttacaatatggagaaacaattccttgtgaacaacttgtctcgtggttgtgtgacatcaaacaagcatacactcagtatggaggtaaaaggccgtttggagtatccatattatatatgggttgggataagcactatggatatcaactttaccagtctgacccaagtggaaattactctggttggaaggcaacatgtatagggcataacagtggtgcagctgtttccagtttgaagactgattacaaagaaggtgaaatgacagtgaaagatgctttggctttgggtatcaaagttctaagtaaaacattagatactgctaagctttcagttgatagagttgaagttgcgacattatctcaaaagaatggaaaatgtgttacttgtatcctacctactgaagaggttcaagaacttatcaatgcatatgaaaaatcagaagctgaggctaatgctttaaaaaaagaaaaaactccaaaatcttaa

SEQ ID NO: 1365 - DNA, 2643 bp, Nezara viridula
atgacgaaaattcaagaaccacaacaagaagaaatgtctgaagaagacaaacgacttcaagaagaactcaatatgcttgtggagaaaatcacgggaacagacacccacttgtatattcctgcgttggagagcatgcgagacctgataagaagttccaccacaagtatgacatcagtgccaatgcccctgaagtttcttagatctcattatggtgctcttaaagaggcctgtgctgtcatggcagataaaaaagctcaggagctttgtgccagtatagtctctgttcttgcgatgggacaggatctaccaggggctcgagaatgtctgaagtattgtttgcaatcacatcagaaagaagttggtgattggggccatgaatatgttagacaattggaaggagagatagcggatgaatgggcctctacagaagaaaaagataagctgctaggtttggtggagagtataattaaatttgatatggagcataatgcagaaatccaagcctgtgatctcttgatggaaatcgaccgacttgatatgctggacaagctcatggatttgactaattattctagagtttgtctttacttgattaattgtgcagtttatgtagaagagccagaaagaggaaatattgtaaatggtgttatgaatcactacatgcgatttaaggaatatccccgtgcactgtgccttgctatgcaattaaataaacatgacttaatgatagacatctttaaccaatgccaagatccattggttcgtaaacagttggcctttatggtaggcaggcaacagttaagtctggaattgagtgatgacctacctgacaaatcagatctcactaacatcatgtctaatgcccatgtgaatgatcattttcacagtttaggaagagagttggatatcatggaacctaaaaccccagaagaagtatataaagtttggttagaagggttggtccttcgcccaacttacaatctggaagtacctctcgattctgctaggcataatcttgcttctacatttgtaaatgcttttgtgaatgctggcttttccagagataagttggtatcagttgaagatggcaacaagtggatgtataagaataagcaacacggtatgttgagtgctgctgcatctcttggcctgattcatttgtgggatgttgatggagggctgactcccattgacaaatatctctacacttctgaagattatatcaagagtggtgcattgctggctttgggtattgtgaattgtggagtcagaaatgattgtgaccctgcattggctcttctttctgattatgtgcttcatgagagcgttactttgaggattggtgctgttttaggtttgggtctggcttatgttgggacaaaacgacaagatgccattacccttttgctgccagtgctctccgattcgagatcgacaccagaggttgtcgctatggcagccttggcatgtgccctcattacacttggcacgcctcaccctgatgttgtatcaaccatcctgcaaactctccttgatcttcctgtagctgagatgactgaaggccattattccaagtttttacctcttgcacttggcttatgttacctgggtcagcgagaaggtactgaagctacaaaagccgctcttgaagcacttccggaacctttgaggtctttatcacaacatatgttgaagatgtgtgtctatgcagggactggtgatgtacttgtcatccaggagcagcttcaagtgtgctcagaacattaccctactccagaagaaaagaaagaaactgataagaaggacaaggataaagacaaagacaaagatgagtcgaagagtagtaaagtgaaggacatgacatgcatgcaggcagtggctgctctttctgtagcagtgattgctatgggcgaagagacaggatctgaaatggccaccaggatattcgcacaattgggaaggtatggtgaacctgccgtacggagagctgtacctttagccatagctttgtcttcgatatcaaaccctcagttagctgttatcgatgttcttaataaatattcacacgacctcgacgaagaagttgcccacaatgctattttctctatgggtcttgttggtgcaggcactaacaatgctaggttggctaccatgctacgtcagttggcacagtaccacgctaaaaataccggtcacttgtttatggtgcgcattgctcaaggattgacgcatcttggtaaaggtactctttcactttgtccgtttcacactgataggcaggtcatgaactattcagcagttgctggtcttcttatcaccctggtttccttcctggacacaaagacaataatgcttggaaaatcccactatttgctctacacacttgcgactgccatgtacccaaggtggttggttacgcttgatgagcatctggaaccactccctgtctccgtcagagttggacaggcggtgaatgtgattggtaaagctggaactccaaagacgatagctggtgtccatactcacactactcctgtgctgctcgctgttggtgaacgtgctgaactggccaccgaggattatactcctctcacacctgttatggaaggatttgtcattctcagaaagaaacaaccagcatga

SEQ ID NO: 1366 - DNA, 1302 bp, Nezara viridula
atggagcctccagcggcagagcagccccaacagcagccggagcaggaggcaggcgtaatccggcagaggacaatcaccacgtccggcacgatcaccaccagtccccagccggaggccagtccgtcccccgaacagccagctcaggaacatgatgctcgaagaagcgggaaggacgtggaggtgccgtacgagatcgtgcagctgcggccggggacctacgacgaggggtacagcctggaggaggcgacgcgctacagccccggctccggccgctactacaccaccgacggcagcgtcaagtacgagcgggacgacaagggcgaaggcagctacgtcacgctggagcctgtcaactatccgcccggcggcgcctaccaggagcccgcggccggctactacacctacaaggaggaggaggatgtctacatcaaggcggacccgccgctcacaccgaagaacttcgcgcacttcgatcatccggtcacctcgcatccgacacagctcagtgcacaggttacttacgtgacgggaggaggcagccgaggagagtacgtgacggccaaccagcctggctactggtccagtgagtacgtctaccagcagccgcagcaggagatccagctgcctccaggaacaccctacgtcttctccagcaatgggcaggctacctgggccatcgacgagtcttacgatcccaatatgctgtctacgagcgacatcaaggagtgcgtaaactgcgcggcgagcgttaccccgctgtggagaagggacgggactggacaccacctctgcaacgcctgcggcctctacagcaggatcaacggagtacacaggccaccggtgaggactcaccacaagaaagtacacaatattggcaacagaagaaatggcgtaagctgtgccaactgccagacaaataatacaaccctctggcgcaggaacaatacaggagaaccagtgtgcaatgcttgcggcctgtattttaaactacacggtgtaaataggcctcataccatgaagaaggaaggtatccaaaccaggaaacggaaaccaaagaacccccaagtaaaccttccaagtcctaaaaacgatataaagacaacaggtgaaaaatcaggcagttgggataaatgtgacaacgacctactagacagtggatatacgatggctccatcatccatatttcttcctagttcctttttaacaaagcctgtaggagtcagtgtatctggcttagaaagtgtaccacccagtgtcatcattccacccacatcgagtcaagacacacagagaactgaataa

SEQ ID NO: 1367 - DNA, 5439 bp, Nezara viridula
atgtcattaccaggagggaaaatggcttgccctggaaatgggatttatgttattcaaggagaaatgtctgttctgcttactgctatgaagaaagtaaacagatggtcttctcatgtccaccaggatgatgaaaatgatattcttatcagaagcttcactgatctcaaagacgttttaaatcagattggtgatcttagagaagtagagccaaaccattttcttagcccctttctggaagtaattagatcagaagaaactactggacctgttaccagtcttgctttatcctctgtcaacaagtttctttcttatggattaatagattcgaagtcgaagacaattgcagctactgttgaaaacatagcagaagcagttactagggccaggtttgttgggactgaccaaaccaatgactcaattgttttgttaaaaattttgcaggttcttcgaactttgttactttctcctgaaggttgttggcttaccaatgaaagtgttttagaaatcttgctgagttgttttcgaatgtgttttgaaccccgtttaaatgaattgttgaggagatgtgctgagaattgtttacgtgatatggttcaattgttatttagtcgacttcctagttttactgaggataataggaaaatccagcaaaaactcaaaatgaatactagtgcccctttggattcaggtaaagggaagaaaaaaaccagccgaccatcctccagaaaagtttccaggaaaagtcaagacaaatctccaagccctgtatttggttcagaagtttcaaatgctctgaaagaatgtgatatccagcaattgcccttacctgatgagccaccaattacatctcatgataaattagaacccgagattcttactgtgcctactgaggagtcgctagctaaaattccatctaatggttcacttgaaattaattctgttaataatgtttccaatgtgaataatttggaggaacatcaaaatgccacttcatcagcgattcttgatgatggtgttattatcagtattgaagattcaagttcccaaaatagtgaatcaacagaacaactggcaaccattggtaacttgtccgaagtgaagaggccagatgacttagatgtgaatccttctgaaactaatttcgcttctccgttggattcgaaagcggaagaagaacctttgataagtcctacaactcctgaaagccctgtagaaggacaagattggacaaaccagcaaggggttaggtttaccaatactgaaagtgatacaacagctccttctggtccttacggactgctcagtgctcatgagctcttgaggtttttggcttctctttgcaatcctctagacaagcagaattcagatagtatgattcacatcgggctcactcttatcactgttgctcttgaagttggggccgacagcattgcgaagtttccttcacttttatcaactgtgaaaaatgatgtctgcagaagccttttagctttgttaaatactgaaaaacttccaattttcgcatcagtgctgcaagtttcattccttctgtttgaatctcttcgaacacatcttaaatttcaactggaacgttatttatcaaggctgactgaaataatcatttctgattcctcaaagatttcatatgaacaccgagaaatagcactagaatctgtcgtacatctttggcgaatacctggcttagtgacggagctgtaccttaattatgactgtgctctgtactgtcctaatttatatgaagaactaaccaatcttttatctaaaaatgcttttcctgttactggtgtttacaacacccatttactgtcattggatgctttattgactgtcatagactctatagaaagtcactgtaatagtagaatattaaatgaaaggcaaaatccatcaaaagatggagaaattaataaattagagttccatgattttgccagcaattatatccatcgcactggcacccgtcaaaagttgtcattgaatatccctagtcacgagcaattgatggctgtgaaaagaaagaaaaagctcctggctactggcactgaacatttcaattcaaaacctaaaaaaggaatccagtttttacaggaacacaacctgttatcgacacctctagatgctgttgaagttgttgggttcctgagagaaaatcctcatctcgataagaaaatgattggggaatacatcagtaatagggccaacattgctatacttgatcagtttgtcaagtcatttgactttactgagatgcgcattgatgaagcattaaggttatatctagaaacgtttaggctacctggagagtctcctctaatatctttagtgatggaacattttgctgaacattggcataaatgtaatggagagcctttcgctaatgctgatgcagcattcacacttgcctacgcgattataatgttgaatgtggaccaacataatcataatgttaaaaaacaaaatactcctatgtcatcagatgcttttaaacgcaacttgaaaaatgtgaatggagggcaagattttgaagaagaaatgcttgatgaaatttatattgcaattaagactgaagaaatcgtaatgcctgctgagcagactggtctagttaaagaaaactacgagtggaaagtattgctacggcgaggaaccggaccagaaggttgttatgtacatgctcctaatggtttgttggatcacgatctgttttctctgatttggagcccgaccatttcagctttgtcctatttgtttgataagaccaatgatccaactatttatcagaaagctatatctgggttcaggaaatgcgcaatgatatcagctcattatggaatgagtaatgattttgataatctgattgtgtcactttgcaaatatactatgcttcattatagtgccgagagtccagaaaatcttactatctcctttggatcgagccctaaggctagacgtgctgctaaaacagtttttgaccttgctcatcgccatggtgacataattagggaaagttggagaaatattttagattgtatcttgcaactgtataggtgtaaactattaccaaagatcctcgttgaggctgaagattttattgaattaagcggtaagatatctcttatacgtgaagacatacaactcagccctaaaaccgaaactggaatcctcagctcattatattcttacatagctctcggagcagaaacgaatactcaaaaaggaccatcagttgaagatcaagaagccattaaagttgcacagaattgtataagggagtgtcatctcgagcagcttattacggaatctaaatttctgcgcattgattccttacaacattttgtcaaggcacttgtcactgcatcttatggacctgaaggccacgtttctctcggtacttcttatagtgaggatactgctgtatttttcttggagctccttttgaaagtcgttattcagaacagagatcgcatttcttcaatttggtgttctgtgaaagagcacatctataccctgcttatgggcgctgctgcttgtgatcaccacttcctagttgagaggtctgtcgttggtctcctcaggcttgcgattcgcttgatgcacaaagaagaaatgggacctatggtattgcaatctcttcgcatgctgctcctccttaaaagttctacattgtcacgtgtttctcgtcaggtttcatatggtacatttgagcttttgaagacatcggcagcaaatattcattccgctaccgattgggcaataatatttacccttttggaatgtgtcggagcaggtgctcctcctccgaaagtcgtttcgaaacctgtcagttctactgaatcagcaggcgcccggtcggaaggagaagtgcaggtggatagcggactgggtaacgaaaggggctatacttctgattcagagctaagcaaagctggtagtgttcctttatcacctagtctgagtccagaggctcctcttagcaacactcctactggctggattctggtgggccgagaaggtgaaatccaaccggtaagctgtgtgaggagaacaatgttgccagaattgtctcgctatgatcccttatcgatggtgaagtgtgtcgacagtttgtcgtttctagtcagggatgttgttcatatcacgccatacaattttcatgattgtattcgttgcataaggacatttgttgaagcagcagctaatacagttgaaaggaaaagcagaaaatctgggagggatacggctaggcaggctaagaggaaaagtacaaaaaggagagaagaacgaggactcagccccacaggaagtgcctatgatgcagatgaaagtgatcctgaggattcgcctggttatcagcaagtttgtattcagcttttggaactgatgcatacccttcacacaaggacagctcagatctttcgatggtgggctgaagagacaggacagaaagaagtggccaacccctcttactggactccaggttggtgccctcttctccaaggcatatccaggctttgctcacaccctaatagagctgttcggatgtcagcaataacctatctgcaaagagcgcttctcatgcaagatttacagtccctctccggagaggaatgggaagaatgttttactcaagtgctgtttccactcctgtccactctattatctgttaatattccagcgattgaagaaacaaggataagggcagccactgtactatccaaggtgttcctgcaccacttgtctcctctgcaaacccttcctagttttgcacagctatggctgactatacttgattatatggataagtatatgcacgcagacaacagtgacctactttatgaggctattcctgaatcattaaaaaacctcttgcttgtaatggactcggctggtgttttcaatggattagacgggcgcaatgagatttgggtcgtaacttgggatcgaattagctcattccttcccaaccttcaggcagacctatttaaagatcatctaccagttgtagatgctagttcacttgaaacaaaagaagctttagaaacatctaaaagtgaaacagaagtcgttcaaaccgagcaaccaacattgcaaaggcctccaggctctcaacagtcatctcctctacctccgttaatgcctaaacctggagaagctgttgaaatatctggacctacgactaacaataatgttggttcacagaattggcaacctcctgctcctgtctaccctcatcttgagcagatggtttcaactcctatcggcccagcaagtcatctcccagtttactctggatttgcgagtatgccacatcaaccccctcccccgtcggcccaatttttctatcaggacatgtcttcttcaagcccgcctaatatgatccaaagttctgagcaacctgcaggtatactaagaatcatatag

SEQ ID NO: 1368 - DNA, 618 bp, Nezara viridula
atgtcaatcttagcgtataacggcagtgctgtaatagctatgaagggaaaagattgtgttgctattgcttcagacttgaggtttggtattcaagggcagactgtttcgactaattttgaaaaaatttttgaaatgggtcctcacttatacattggacttcctgggttaactactgatacatttaccgttctaaataaacttaaatttagggcaaacatgtttgaattgaaagaagataggaaaatagctccagatgtgtttctttcaatggtctcgaatttgttgtatgaaagaaggtttgggccattttttgttgaacctataattgctggattaaaaccaaaaacgtttgaaccttttatagcttcgatggatttacttggttgtcctaacaaacctgaagattttgtagtggcaggaacagcttctgaacaactctacggaatgtgtgaagctctttgggaaccagatcttagtcctgaagatttatttgaaactatatctcaagcccttgttaatgcttgtgacagagatgcactttcgggttggggagcttctgtttacataatagagaaagacaaagtaacccacaggagaataaaaacaagaatggactaa

SEQ ID NO: 1369 - DNA, 2778 bp, Nezara viridula
atggagtcatctccgtcattggaaacagtccatcaggctgtttacgctctttatcataatccagatcctgctgaaaaagagaaggcttcattatggctaggccagttacaaaaatctgttttctcgtggaaaatcgctgatgaaatactacataccagtacagatgttgaatgctgttattttgcagctcaaactatgagaactaaaatccaacattcttttcatgaacttcctccaggatctcaccttcctttaagagattctttaatggatcacatcagcaaaattaatgagacaacaaattctgtgattggtactcagctgtaccttgctttggcagatctagcattacaaatgggatcttgggaaaagcctgcaattgatttgattgaacgatattccatgacttcagttcctccccttcttgaaatgttaacatttttgccagaagaagttaattccagagctttgcgtttgggttctaaccgaaggcaagagcttctccacaagttttcacttgctgttcctaatgtctccgagttcctgaaaatgtgtctcaacaattctggaaataatcctcaaattcaaatcaaagttttcaagtgctttacaagttgggtatcagtacaggcgatgactcttaatgatgtaactgacaatatagttgtggctacagctttccatgttcttgccaatagaatggcatcatccaatttacatgaagcagccgccgattgtgtttgctctcttcttgaatgccttgaagataacaataatcaacaatcgatcgagatgcaactgttcaacggagtcatttcattagagcaaccgtttcatatttctgtcgcacatgaagaacatgaaaagtgtgttaattattgtcgagtatttacagaacttgctgagagtttcctagaaaaaatagttagtgggagtagtcccaacaaagcacattttgctattaagattttcgatctcgttctaacttgtgttggtcatcatgactatgaagtagctgccattacatttaatttatggtatcgtctttcggaagaattataccaaaagaaaaactctggactgacctctttattcaaaccatacatcgaaaggcttattgaagcattatgtagacattgtcagatggaacccgatcatgaagggatccttgaagaaggggatgattttcctgattttaggatgaaagttgctgaactgattcgtgatgtcgtattcataatcggttcttccaactgctttaggcaaatgtttatttccctacaggggccaaataccacctgggacaccacagaagcagcgttgtttataatgcaagctgtcgccaaaaacattattccggaagaaaacgatgttgtccctaaggttgtcgaggcaattttaaaccttcctccaaacacacacatagcagtcagatctacatcagttctcctactgggagaattgtgcgagtggattgaaaagcatccccaatatttagaaccagtattgaatatggtgctgttctgtcttcagcagccacagttggcgaattcagctgcaaactgtttacaaagtatatgcagtacatgtaaaaatcaaatggtggccaaatttttaggccttctccagatacttcaatctctcgacaaattcgttctgacgaatgaatcagttgtcggacttttaaaaggtgtggcttcaatattgagcataatgcaccccgatcagttacagcaggctatgagggatgtttgtctcatccagattaagccacttgttcatttaattgagaatgatgttaaactggagaaaggtacaaaaacagatccagcagtttggatggacaggctgtctgctatattccgccatatcaatctcactgttaggaatggtgaaattcatccttgtcaacctgtcataaccgaaatatggccagttctttcctccgtttgttcaaaataccaagccaactcacatgtgatggagagatgttgtagatgtctcaggttcgctgttcgttgtgtgggtaaacagtctgtgaatttacttgaaccgttagtcaaacagatagtctctctctattctcaacacgagcatagctgtttcctgtaccttggttctatcctggttgacgaatatgcttctgaaccaggctgcatccaagggctgttagacatgcttcaagctttcattcacccgacgtttaccctccttcaaggagaagcgggcctgaaattgcacccagacactgtggacgatctcttcaggctctgtgcgaggttcttgcagagggctcccatggcgttcctcacctcgcccgccatcaactccatcctggagtgcgccctttcgtgcatcccacttgaccatagggatgccaattcttcagttatgaaatttttctatgacctaattcacgctggaatgactaatgaagatcacgaagatttcgcattgaggcaaagactggtacaaaatataatccaagaaaagggttcagatttagtaaacaatcttctcacagcatcagttttcttccttcagatatatatgctgtcggatgtagcggacgttttaatggagctaatattacttgacaagcaggctgctggcaggtggatagaacaatcattgaaaagaatgccaacgcacaacagtacaggaagtattaccgcaacaccaaagcaattgcaagatttccatcgctctctactcagcgcctgcagttccaaaactcttacaactacactgaaagaattttctcgcctctaccgctga

SEQ ID NO: 1370 - DNA, 1173 bp, Nezara viridula
atggcgcaaaggtttcctccgtcgcaaccaactccgagcccagttcagcagcctcaaagatatcctacgccctcaggacctccactcaggcaatatgcaacccctacgtttccaggaggtggtatgggaagcgggatgatgcctcgtccccagcagcaaccgtacaaccccatcagacctccgattcctcagtcccaaaaaaggcctagcgatgtcagaccaccacaacaacaaccaaaaggggagtttcctcatacatccgctggtggaagtagtggcaagaagaaaaagaagctggcagataagatcttaccccagaaagtacgagacctggtgccggagtcacaagcatacatggacttattggcattcgagagaaaattagattctacaataatgagaaagaggcttgatattcaggaagcgttgaaacgtcccatgaagcaaaaaaggaaattacgcatttttatttctaatactttctatccagctaaagaggcaactgagacggaagaaggcagtgtagcatcctgggagctgagagtcgagggaagactgttggaagattctaaaaatgatcctaacaagcctccaccgttacaggtaaagaggaagttttcctctttcttcaaaagtcttgttattgagttggataaagaactatacgggccagataatcacctcgttgaatggcacagaacccctaccacacaagaaacagatggttttcaggtcaaaagaccaggtgataaaaatgttagatgtaccatactgctccttttagattatcagcctttacagttcaaacttgatacccgacttgctcgtcttctaggagttcacactcaaacaagacctgttattataagtgcgctttggcaatatattaagactcataaattgcaagatccgcatgaaagagagtatataaattgtgacaaatatcttgagcaaaccttcagttgtccaaggatgaagtttgctgaaataccgcagcgtctcaaccctcttcttcatcctccagatcctatagtcattaaccatattatcagtgttgaaggtaccgaacagaaacaaacagcttgttacgacatcgatgtagaagtagacgacacattaaaaacacagatgaacaacttcctcttatcaacagccagtcagcaagaaatacag

SEQ ID NO: 1371 - DNA, 435 bp, Nezara viridula
atgcctaaagtacgaagaagcaagaagcctccaccagatggttgggaacttatagaacctaccctagaagaattagagcagaagatgagagaagccgaaactgaaccccacgagggtaaaagaaaagttgaatctttgtggccaatttttaaaattcatcaccagaaatcgcgatatatatatgatttatattatcggaggaaagccataagtaaagaattgtatgagcattgtctcaatgaaaatattgctgataaaaatttgatagccaaatggaaaaaacaaggctacgaaagtctttgctgtttaagatgcattcaaaccagagacacaaattttggaacaagttgcatatgccgggtcccaaaggccaagctcgaagagggtaagattgtggaatgcatccactgtggctgtcgaggatgctctggataa

SEQ ID NO: 1372 - DNA, 1029 bp, Nezara viridula
atgaaagtgctacttgagagtgatgtccaactaactactcatttttggggagcatcggactacaaggataaacttagcgttgcgataggagaacctttggttctgagctcagatgccagttgggcgaatcacattctcctaggacaccctgctatgcccacagccacaggacacagtggggtcatcccaagtaatgaagaatgcggcattcgcgatgtatgggctcataatctgaaggatgaatttaaagttatcaggaagatcattcataaatacaattatgttgcaatggacactgaatttcctggagtggtggcaaggcctattggtgagttccgaagttcagctgactatcagtatcagcttctaaggtgcaatgtggatcttctccgtatcattcaattgggacttactttcttggatgaaaatggaaaagctccagctggtccttacagtacctggcagttcaattttaaatttaatctctcggaagatatgtatgctcaggacagtattgatcttcttcaaaattctggaatacaatttaagaaacatgaagaagatggtatcgaccctgttgattttgcagaacttctcatgacctcagggatcgtcctgatggagaatataaagtggttatcctttcatagtggctatgatttcggatacctattgaaactgcttacgaatcagaacttacccaatgatgaaagcgaattctttgagcttctgaaaatctacttccctactgtttatgatgttaaatatctcatgaagagttgtaaaaatttgaaaggtggtcttcaagaggttgctgaccagctggagcttacgagggtaggaccacaacatcaagctggctcggattcgttattgacaggaatggcctttttcaaaatgagagagatgtttttcgaagataatatagacgatggcaaatactgcggtcacttatacggattgggtgcatcctttgttgtgaacggtaacagtttccacgacaacggagacaactcaagtaattcatga

SEQ ID NO: 1373 - DNA, 1206 bp, Nezara viridula
atgtctgactcacggagagttcaactgaaagaagacttgtcttttgtggagtttgaaacaagcgaaaatgttgaagttatatcttcttttcaaagcatgggacttaaagaagatttgctcagagggatatatgcttatggatttgaaaagccatctgctattcagcaaagagccatcattcccatagttcgtggtagagatgttattgcacaagctcaatctggtacaggaaaaactgcgacatttgccattgccattttacaatccttggatacccaaacaagggacactcaagttttatgtttgtctccaacaagagagcttgctgtacaaatacaaaaggttattcttgctttgggtgatctcatgaatgttcagtgccatgcttgtataggaggaacaagcttaggagaagatattagaaaacttgattatggtcaacatgttgtatctggtacacctggtcgtgttttcgatatgataaaacggcgaactctaaggacaaggtcaatcaaagtattagttcttgatgaagctgatgagatgttaaataaaggtttcaaagaacaaatttatgatgtatatcgtttcttacctccagctactcaggtagttcttatttctgcaacccttccccatgaaattcttgaaatgaccagcaaatttatgactgacccaatcagaattttagttaaacgtgatgaattgacattggagggaataaaacaattttttgttgctgttgaaagagaagaatggaagtttgacacactctgtgatttatacgatactttgactatcactcaagctgttattttctgcaatacaagaaggaaggtcgattggttaaccgaaaaaatgagggatgcaaatttcacagtttgttctatgcatggtgatatgcctcagaaagaaagagatgcgataatgaaggagtttagagctggaaaaagccgagtgcttataacaacagacgtgtgggctagaggtattgatgtacaacaggtctcccttgtcattaactatgatttaccgaacaaccgagagttgtacattcataggattggtaggtcaggaagatttggaaggaaaggtgtagccatcaattttgtgaagagtgatgatattaggattttgcgagatattgaacagtattacagtacacaaattgatgaaatgcctatgaatgttgctgatctgatttag

SEQ ID NO: 1374 - DNA, 1599 bp, Nezara viridula
atgacgcatgccgctggagatggacacaggtcacacagtaatgtctataaggacaaaagtaaaccacaagatgttcgaaccagtaacatgactgcggctaaaggccttgctgatgctattcgtacaagtcttggtcctaagggcatggacaaaatgatccagaaaggaaacggagaagttactataacgaatgatggtgctactattttacaacagatgaatgttatgcatcctgctgctaaacttttggtcgaactgtctcaagctcaagatgttgaagcaggtgatggaacaaccacagttgtcatattggccggagccataatggaagctgctgaaaaactgatgaaccgtggaattcatccaacaacaatttccgatgcattcagcattgcagttgaaaaggccatcccaattttaagagagatgtctattcctctacaacaaaacgataacgaaagtcttatcaggagtgcatcaacatctcttaattcaaaggtcgtttctcaacattcatcgatattggctccattagctgtgaatgctgttcttagaattaccgacccaaagaaagacaaaaatgtcgacctaaaagatatcaagatcattaagaaacttggaggcaccgtggaagatacagaactcattgagggcttagtcttcacgcagaagttggcaaatataaacggaccaaagcgtcttgagaaagtcaaaattggtctcattcagttttgcatttctccccctaaaacagatatggatcacaacgtggtcatctccgactatgcagcaatggacaggattctaaaagaggaaagagcctacatactcaacattgcgaagcaaatcaagaaggctggatgtactatgttgttgatccagaaatctattttaagggacgccttgtccgatttagctattcacttctttgacaagttgaaaattatggtcgtgaaggatatcgagagggaagatatcgatttcgtctgtaagactctcggctgccgacccattgcgtctttggatcacttcaccagcgaggctctggtcagtgctgagctagcagaagaagtatcggcaggatcttctcgtatcgtcaaagtgaccggaattcacaatcctgcgaagacagtaacaattctagttcgaggatctaacaatcttgtcctcgaagaagctgatcgttctattcacgatgctctttgcgtcatccgatgtcttatcagggaaagagctcttcttcctggaggtggagctcccgagattgagttgtctcttcgtttaggacagcatgctcaggttttggggtcggtggaagcttattgtttgagggagtatgccaaagctttggaaatcgttccttacactctcgctgagaatgctggtctcaatcccgtagctactgttactgaacttaggaataagcacgttcatggccaaaccagtgctggtattaatgttaggaagggccaggtaacagatattcttgaagaaaatgtcctacagcccatgctggtcacagcaagtgctatcaccttagcgacggaaacagtcaggagtattctaaaaatagatgacattctgaacgtcgctcactga

SEQ ID NO: 1375 - DNA, 1248 bp, Nezara viridula
atggatgaaattggtatcgttctccccgagaaagaagaaaacagtcaagatggaaagttaagtaccatactaggacagaatttgtcagatgacagtgatagtagtgatttattcaccaagtttaagaaattacagagacagcttgaatttttagctgttcaggaagagtatatcaaagatgaacagcgaaatttgaagaaagaatatttgcacgctcaggaagaagtcaaacgaatccagagtgttcctttagttattggtcaattcttagaagcagttgatcagaatactggaatcgtcggtagcactacaggttctaattattatgtgaggatcttatcgacgattgatagagaattattgaagccttcggccagcgttgctctccacaagcacagcaatgcccttgttgacgtgcttccgcctgaagcagattcctccatttcaatgcttcaagctgatgagaaaccagatgttcagtattcggacattggtggtatggacatgcaaaagcaggaaattcgtgaggccgtagaattgcctttgacgcacttcgaactctaccgccagattggtatcgaccctcctaggggcgtgctgatgtacggcccaccgggctgtggcaaaactatgcttgccaaagcagttgctcatcatactactgctgcattcatcagagtagttggctctgaattcgttcagaaatatcttggagaaggaccgagaatggttcgtgatgttttcagactcgcgaaggaaaacgctccggccatcatcttcattgatgaaattgatgctatcgccactaaaaggtttgatgctcagactggtgcagatagagaagtgcagaggattctattggaactgctcaaccagatggatggtttcgaccaaaccacaaacgtaaaggttataatggctacaaacagagcagacacattggatcctgctctgctgcgacccggtaggctggacaggaagatcgaattccctcttcctgacaggcggcagaaaaggctcgtcttctccaccatcactgccaagatgaacctctccgaggaggttgacttggaagactacgtagccaggccggacagggtatccggtgctgacataaatgctatttgccaagaggctggaatgcatgctgtccgggaaaatcgttatatcgtccttgcgaaagattttgaaaaaggttataagaacaatattaaaaaggacgagtctgaacacgagttctacaaataa

SEQ ID NO: 1376 - DNA, 489 bp, Nezara viridula
atgcctaacatcaagttgcagagttctgatggagaaatatttgaagtggatgtggaaattgcaaaatgttcagtaaccataaagactatgttggaagatctaggtatggatgaagatgaagaagaagttgttcctttgccaaatgttaattctgctattttaaagaaagtaattcaatgggctacataccataaggatgatccaccaccacctgaagatgatgaaaataaggaaaagagaacagatgacatctcatcttgggatgcagactttttgaaagttgatcaaggaactctttttgagttgattttggctgccaactatcttgatatcaaaggcctgcttgatgttacatgcaaaacagtggctaacatgatcaaaggtaaaactccggaagaaattcgtaaaacatttaatattaagaatgatttttcggctgctgaagaggaacaagtacgtaaagaaaatgaatggtgcgaagagaagtaa

SEQ ID NO: 1377 - DNA, 930 bp, Nezara viridula
atggaagataagacttcgttaaaagaactggatcagtggatagaacagctgaatgaatgcaaacaacttaccgaaagccaagtcaaaactctttgcgataaggcaaaagaaatattagctaaggagtcaaatgtgcaagaagtcaaatgccctgtcacagtttgtggagatgtacatggacagttccatgacttaatggaactgtttagaataggaggaaggtctccagacactaattatttgttcatgggtgactatgttgatagagggtattattctgtggagacagtgacattactagtagctctaaaggtaagatatcgagaaagaatcactatcttaagaggtaatcacgaatcacgccaaatcacacaagtatatggtttctatgatgaatgtttacgtaaatatggaaacgcaaatgtttggaaatatttcacagatttatttgactatttgccattgacggctcttgttaatggtcaaatattttgtcttcatggtggtctttcaccgtctatagacactcttgatcatatccgtgctttagatcgtcttcaagaagttccacatgagggtcctatgtgcgacttgctttggtcagatcctgatgacaggggtggttggggcatatctccaagaggtgctggttacaccttcggtcaagatatttcagaaacatttaaccactctaatggtctcactcttgtgtccagagctcatcaacttgtaatggaaggctataactggtgtcatgatcgtaatgttgtaacaatattttctgcacctaattactgttatcgttgtggtaatcaagcagctataatggagttggatgatgcgcagaaatattcattcctgcagtttgacccagcgccgaggagaggagaaccacacgttactaggagaactcctgattacttcctataa

SEQ ID NO: 1378 - DNA, 927 bp, Nezara viridula
tttgcaggtaaacagctcgaagatggtcgtacattgtctgactataatattcaaaaggaatctactctgcatttggtccttcgtctgagaggaggcatgcagatctttgttaagacacttactggtaaaacaatcacacttgaagttgagccttcagacacaattgaaaatgtgaaagctaaaattcaagataaggaaggaattcctccagatcagcagaggttgatttttgcaggtaaacagctcgaagatggtcgtacattgtctgactataatattcaaaaggaatctactctgcatttggtccttcgtctgagaggaggcatgcagatctttgttaagacacttactggtaaaacaatcacacttgaagttgagccttcagacacaattgaaaatgtgaaagctaaaattcaagataaggaaggaattccaccagatcagcagcgattgatctttgctggaaaacagttggaagatggtcgtactttatctgattataacattcagaaggaatcaacactacatttagtattacgtttaagaggtggaatgcagatttttgttaagacgctgactggaaaaaccataactttagaagttgaaccgtcagataccattgaaaatgtaaaagccaaaattcaagataaggaaggaattccgccagatcagcaaaggctgatctttgcaggaaaacagttagaagatgggcgtactctttctgattacaacatccaaaaggaatctactttacatcttgtacttagacttcgaggaggcatgcaaatttttgtcaagactttaacagggaagaccatcaccttagaagttgaaccatctgatactattgagaacgtaaaagcaaaaatccaggacaaagaaggaattccaccagaccagcaacgtttgatctttgctggaaaacaa

SEQ ID NO: 1379 - DNA, 1629 bp, Nezara viridula
atgcaaccacagataatacttttgaaggagggaactgaaagttctcagggtaaacctcagctggtatccaacataaacgcttgccaaataatcgcagatgcaattcgaacaacccttggcccaaggggcatggataaacttattgtggatggtaatgggaaagcaacaatatcaaatgatggtgctactattttaaaacatttggatatagtgcatcccgctgccaagtgtttggtggatatagccaaatctcaagatgctgaggttggagacggaactacaagcgtagtcctgatcactagtgaaattttgaaacagctaaaaccatacgttgacgagggtgtgcatcctagaataatgatgaaagcagtgagaaaggcaacacaattatgtttagacaaaattaacagcttagctgttaagattgaaaagagtagtgcagaacaacatcgctctctgctggagaggtgtgctgctactgcactcagttccaagttgattcatcagcagaaagattttttttcgaaaatggttgttgatgctgtgttgttgttagatgaactccttccacttgatctcattggaatcaagaaagtacctggtggagctttggaggaatctttgttggtctctggtgtggcatttaagaaaactttttcttatgccggctttgaaatgcaacctaaaaagtacaccaatccaaaaatagctattctcaacattgaattagaattgaaagcagagagggacaatgccgaaatcagacttgataatgtagaggagtatcaaaaagtagtagatgttgaatggcaaattctctacgaaaaattggacactattgttaaatcaggagctcaggttgtgctgtctaaacttccaataggcgatgttgctactcagtattttgcagacagagatatgttctgcgctggtcgtgttgctgatgaagacatcaggagaacacagaaagcatgtggtggcactatgattaccactactaaagatatgtcagcttcagttcttggtacttgtgaagtatttgaagaaagacaaattggtggtgacagatataatttgtttgctggctgtccaaatgctaaaacatgtaccatgatactgagaggtggagctgaacagttcttggaggagacagaaagatctctacatgatgccatcatgattgtcaggagaacgattaagaatgacgctgttgttgcaggtggtggagctattgaattggaactttccaaaatgttgcgggattactcaaggactattgcaggcaaagaacaactgttaataggagcagttgctaaagctttagaaattattccacgacagttgtgtgataatgctggttttgatgcaactgctattcttaacagactcaggcaaaagcatgctcaaggaagctgctgggaaggtgttgatgtagcacttgaggatatctccgacaatatggagaaatgtgtttgggagccgtcagtagttaagagaaatgctttagaagcagcttgtgaagcagtatgcctgatcctttctgttgatgaaacaattaagaaccccaagtcaggaggtggcgggcagggagaccaaccaatgatgcctccgagaggcaggcctatgtga

SEQ ID NO: 1380 - DNA, 5226 bp, Nezara viridula
atagacaggatattcagacagccacaggggcacttgctgctcatcggtgtctctggagctggcaaaaccactctgtctcgctttgtcgcctttatgaatggactctctgtattccaaataagagttcataataagtacactagtgaagatttcgatgaagacttgagatcagttctaaggagatctggttgtaaaaacgagaaaatagctttcatccttgatgaatcaaatgttctagaatccggttttctagagaggatgaacacactgcttgctaacggtgaagtgcctggtttatttgaaggtgatgagtacagcacgttgatgacccagtgcaaggaaggagcccaacgggaaggattgatgctggactctaacgaggaattgtataaatggtttacgggtcaagtgatgagaaacctccacgttgtgttcacgatgaacccgagccatgaagggcttaaggacagggctgctacatcacctgctctgttcaataggtgtgttctcaactggtttggagattggtcggatggtgcattgtatcaggtgggtagagagttcactaacactctcgatttggatggacctcctacttggaaagcgccagactttttcccaattgcttatgcaaatttaccatcacctccgaaccacaggcaagcagttataaacggatgtgtttttgttcatcaaactttgcacaaagccaatcaaaggcttaccaaacgtggagcacgcacaatggccatcactcctagacattacttggactttatcaatcattttgtaaagttatatagagagaagtgttctgaacttgaagaacagcaacttcatttgaacgttggtttaggaaaaatagcagagactgttgagcaggtcgaagagatgcaaaagagtttggcagttaaatctcaggaacttcaagctaagaatgaagctgctaatgccaagctaaagcagatggtcaaagaccaacaggaagcagagaagaagaaggttcagtctcaggaaatccagtcccagattgaaaaacaaaaactacttatagcgcagaagagagaaggtgtgatggcagatcttgcccaagtggaaccagctgttattgatgctcagcaggccgtgaaagagataaagaagcagcagctggttgaggttaggtctatggccaaccctcccgctgtagtcaaattggcactcgagtccatctgcctcctgctaggtgagagtgccactgactggaagtccatcagggccgtcgtcatgagggacaacttcatcaattctatcgtcaacaatttctctacagaaaatatatccgatgaagttagagagaagatgcatacccgttacctgagtaacccagaatacacatttgaaaaagttaacagggccagtatggcttgtgggcccatggtgaagtgggccgttgcccagatcagttatgcagacatgttaaagaaagtggaaccactgagggaagaattgcgatcattagaagagcaggctggtgagaatgaacaaaaaggagaagacacaaaagcactcattgcgcagttggagaagagtatagcagcttacaaggaagagtacgcccaactaatacaggaagggcttgcgattaagcaagatttagaaaacgttcaagctaaggttgatcggtctattgctctcctgaaatctcttggtcttgaaagatcaagatgggaagccacatcagaaacattcaagtctcaaatggcgaccattattggtgatgtcttactatcttcagcttaccttgcatatgctggttattttgaccaacactctcgacataaccttctgtcccggtggacggagcaccttagttctgcgggtatccagttcaggcaagacatagctcttacagagtacctatctaatcctgatgaaagactcaggtggcaggcaaacagtctgccgaccgatgatctatgtactgaaaatgcaattatgttgaagagattcaaccgttatccactaatcattgatccatcaggacaagctacagaattcattatgaatgaatacagagataaaatcaccaagaccagtttcctagatgattcattcaggaaaaatcttgagtctgctcttcgatttggaaatcctttacttgttcaggatgtggaaaattatgatcctattttgaatcctgtactcaaccgtgaagtgagacgaactggtggcagagtattgatatcattaggagaccaggatattgatttgtcaccatcatttgtgatattcctctctactagagatccaaccgttgaattcccaccagatatctgctccagggttacgttcgtcaatttcactgtcaccagatcctcattgcagtcgcaatgtttgaaccaagtacttaaagctgaaagatctgatattgatgagaagagatctgaccttcttaaattgcaaggtgaattccatctgagattgagacagctagagaaatctttattgggagctttgaacgaagccaagggtaagatcttagatgacgactctgtgattactacgttagagacactgaaacaagaggctgcagagatcagtaagaaggttgaagaaaccgatagggtaatcggggaaatagagactgtttcacaacagtataagcctctatcacaggcatgcagcaacatgtacttcaccctcgattctttacaccaaatacacttcctctaccagtacagcctcaagttcttccttgatattttctcagctgttcttttctctaatccatctctggatggacttactgaccacacccagaggctgggtgtgataacgaaacagctgtttgctgtttgctatgagagagtggctcgaggtatgctgcatactgacagattgacacttgcattgttattatctagaatatatctccgtgggttgccccaagaagaccagctggaagctgagttccatcatttcctcaggggcaaagagggagtcatagcttcaagtggaggagcttcccatctggaagggttgtccagtgaccaactagaagccctcattaggttaagcaataggctaccacaattcaaagaattaatgaagaaagttaatgaaatgcctgagtttgtagcgtggctccagcaatcaacaccagagcagaatgttccaacattatggcatgaagacaaacccttatcttcaatcgcaactgctatgaacaggcttcttctaattcaagctgtacgaggagatagggtgactgcagccggtgcctggcttgttagtgcggtgctcggcgaaggctttacagctcgagctgagagggaattagatttggctcatattgtcgaatctgaaatgaccgctggcgtgcctgttcttttatgctctgtgcctggatttgatgccacttcaagggttgatgacttggctgctgaatcgggtaaacagttggcatctatagctattggttctgctgaaggattctcacaagcagactctataatcaatatggctgtgagatcaggaaggtgggtactgcttaagaatgtccacctcgctccacagtggcttgtacaattggagaaaaaacttcactcgctgcaaccgcactcaggcttccggctgttccttacaatggaaattaatcctaaagttcctgttaatcttctgagagcaggtcgcatcttcgtctttgaaccacctccaggaatcagggcaaacctattaaggacattcagcactgttcctgcctcaagaatgatgaaggcacccagcgaaagagcgagattgtacttcttgctggcctggtttaatgctattgtgcaagagaggttgcgatatgctccccttggctgggccaagcattatgaattcaatgagtcagatcttagggtggcatgtgatactttagatacttggattgatgccacagctgtcgggagaacacagttgccacccgagaaggtaccttgggatgctttggttacacttttatcacaatgtatctatggtggtaaaatagataatgactttgatcagaggttgttatcttcattcctttcaaaattgttcacaccgagaagctttgaggcagacttcgcattagtagccaatgttgatgctggagctccaggaggtcagaggcatataacaatgccagatggaacgagaagggaccatttcttacattggatagagtctttggctgatagacaaactccatcatggcttggtctgcctaataatgcagagaaagttcttttgaccaataaaggtactgacttggttattaaacttctcaagatgcaacagctggaagacgaggacgagcttgcttacaccgaacaggagtcaggacctccgtcgtccctgcagccaggaactgacccgggcaggcctgcttggatgaggacactgcacaactccgctctcacctggctccagttattaccaacaagtcttcagacattgaggaggacggtagaaaacatcaaggatccattataccggtactttgagcgtgaagtcaactccggggccaaacttcttagggatgttattcatgatcttactgatgtagttgccatttgtcagggagagaagaaacagaccaactaccataggaccatgctgagtgatctcgttaaaggaattctcccttcaggttggaggaggtatactgttcctagagggtgtactgttattcaatggataacagacttcagcaacagggtgaaacagttggacacaatttcacagcttgcttcgcaaagaggaccatctgaaattaagaatactccaatctggttgggtggtttgatgaaccctgaggcctatatcaccgccactaggcaatgtattgcacaagctaatagttggtctcttgaagagttaatcctagatgttactatacctgaaccaacacctaataactctattgccactgatgaatgcagtttttctgttactgggctcaaactgcaaggtgcacagtgcagaaataatcaacttctcctcacatcaacaattatgatggatctaccaacaacattactcaggtggcaccgggctggtggagagggagactctgggaagctgtctttaccggtataccttaattcaacacgtagcgagcttcttttcactgtcgacttgaacattgctcctggtcaagaaccacacagcttctacgagagaggagtagctctcctcacttcaacagcgctcaactag

SEQ ID NO: 1381 - DNA, 2640 bp, Nezara viridula
atggctaagtcaagttccgaatctagtgatagtgaggaggataggaaacagagagatgaattcgctgcacgacttaggaaaaaagataaagaaaatacaagaaaaattacaactattcattcagataagagagcatatgaagaagcggcaaaaagattaaaaattgattcagagcaccaggaaaaattgattcctcgattaagagttgaatcaagaaggaaatacttagaaaaacgaaaagaagataaagttctcgagcttgaagcagatgttgttgatgatgaatatcttttcaatgaggaagaactcactgagcgggaaaggaaagacagagatcataaaaagaaattattaattctcgcaaaggaacatgagagagcaagagaattggaaaaggttcagagatatcatatgcctagggatgttaaagacagtgtcgaacaatatgaagaagtcgatgagagagaaaacaaaccaaattacgaacaaaggaaatgggaggaggaacagatgtcatctgctgtatttcactttggcgctaagaaaaaagataaatcccaagaagaatacgatttagttctagataatcagatcgagtttattcaggctatgagtctagctggaactaaagaaaagcctgagccacaattaacagaaaaagaaagaaaaagattgactattgaagaaactcaaaaaagcctccctgtttacaagtttaagaatgaacttgtacaagctatcaaggatcatcaagttctgattatcgaaggtgaaacaggctcaggtaaaactactcagatcccacagtatttataccaatcaggctttactgatgatggtaagaagattggatgtactcagccaaggagagttgctgcaatgtcagtcgcagcgagagttgccgaagagatgtccgttaagttaggaaatgaggtaggttacagtattcgttttgaagattgcacttcagaaagaacaattataaaatatatgacggatggtactcttcaccgagaatttctctctgaaccagatctgcaaacttacagtgtgatgatcattgatgaagctcacgagagaacgttgcatacagacatattgttcggtttagttaaagatattgctaggtttagatcagatcttaaacttcttatatccagtgctacgctggacgcagaaaaattctcagcattttttgatgatgctccaatattcaggattccaggaagaaggtttccagttgatatatattataccaaagctcccgaagcagactatattgatgcttgtgtcgtatcgatcctacagatacatgcaacgcaaccactaggcgatattcttgtgttccttactggtcaggaagaaatcgagacctgccaagaaattttgcaagatagagtaaggcgtcttggaagcagaattaaagaactattaatccttccagtttactctaatttaccatctgacatgcaggccaaaatcttccagccaactcctccgaatgcaagaaaggttgtgttagccacaaatattgctgaaacctctcttactatagacaacattatttatgtcattgatcctggtttctgtaagcagaataatttcaactctaggaccggtatggaatcattgatagttgtgcccgtttcaaaggcttcagccaatcagagagcaggaagagctggacgcgtggccgctggaaaatgcttccggctctttacagcgtgggcatacaaacatgaactggaagataacactgttccagaaattcaaaggatgaacttgggaaatgttgtgctcaccctcaaagctctaggaattaatgacttgattaattttgatttcttagatcctcctccacatgaaacattggtacttgctttagaacagctttacgcattgggagctttgaaccatcatggtgagctgacgaaattgggtcgaagaatggctgagtttccattagacccaatgatggggaaaatgttacttgcttctgaaaagtataaatgtagcgaggaaatagttacaattgctgcaatgttgtcagtgaatggtgccattttctacagacctaaggacaaagttgtccacgctgatactgcgagaaaaaattttttccttcctggcggtgatcaccttgttctctggaacgtatacaagcagtggtcggacactgatttcagtactcaatggtgttatgaaaattatatccagtataggtcaatgaaaagagctagagatgttcgggagcaactggtaggtctgatgcagcgtgtagagatggacataatttccaatcctactgatagcattgccataaggaaaactatcacagctggatatttttatcacattgcaaggctttctaagggcggtcattacaaaacagtcaaacataaccaaactgtaatgatacatccaaacagttgcctgttcgaggatctccctcgctgggttgtctaccatgagcttgttttcactacaaaggagtttatgcgacaggttgctgaaattgagagtaaatggctgcttgaagtcgcaccacattattataaacctcgtgaattagaagattcaacaaataccaagatgcctaaggtattaggaaagacgagagcacagctgggagaacattag

SEQ ID NO: 1382 - DNA, 1440 bp, Nezara viridula
attacctcccgttgccatagcgcgtttaaacttctgagttttgagtgttggtcacaacttattaaaaagatgaagattgaagaagttaagagtactgtgaaaacacaaagaatttctagtcatagtcatattaaaggtttgggcttagacgaaaatggggtgcctatacaaatggcggctggtttggtaggccaagaaaatgccagagaggctgctggaatagtagttgaaatgattaaatcaaagaaaatggcaggaagagctgtgctgatggcgggaccaccaggaactggtaaaacagcaatagctctagctatggctcaagaattaggaaataaagtaccattttgcccaatggtaggttcagaagtgttcagctctgaaattaaaaagacagaagtattgatggaaaattttaggagagctattggcctaagaattaaagaaactaaagaagtatatgaaggtgaagttacagagctcacacctgtagaaacagaaaatccaatgggagggtatggtaaaactgtatcccatgtgatcattggcttgaaaacagcgaaaggtacaaaacagttgaagttagaccctagcattcatgaaagtttaaccaaggaaaaggtagaagttggagatgttatatacattgaggctaacagtggtgctgttaagaggcaaggaaggagtgatacatatgctactgaatacgatcttgaggcagaagaatatgtccctctacctaaaggcgatgttcataaaaaaaaagaagtcatccaagatgtgacattacatgatctagacgttgcaaatgctagaccacaaggagggcaagatgttttatcaataatggggcaacttattaagtcaaagaaaacagaaattactgacaagttaagagctgaaattaacaaagttgttaacaggtacatagaccaaggtattgctgaactagtgcctggggtgctttttattgatgaagtccacatgctggatatagaaaccttcacttaccttcatcaggctcttgaaagtgcgatagctcctattgtagtctttgctacaaatcgaggtcgttgtcaagttagaggggctgcagacattatttcaccacatggactaccgttggaccttctcgataggctgctcattattcgtactgcgccttacacccaaccagagatggcccaaattgtcaagttgagggctgtaaccgaaggacttagcattgatgaagatgcattatcagagctgagtgatattggaagcaaaacaactctcaggtatgcagttcagttactaactccatccaatttaactgcaaaagtgaatggtcgttcctctatcactagagaagatgtagcagaagtgggacaactgtttctagatgcaaaatcatctgccaaaatactagcaaaacatcaggaccagtttatgaaataa

SEQ ID NO: 1383 - DNA, 2196 bp, Nezara viridula
atgacatccataattaagttccatgctttatctggagttatggatgaatctccaccatgttatattttgcaagttgatgaatttcgctttttactagactgtggctgggatgagcactttaaccaggattatatcaaagaacttaagagacatgttcatttaatcgatgcagttttgcttacttatcctgaccacttacatttgggagcattaccctacttagttggaaaatgtggacttagttgccctgtatatgcaactattccagtttacaagatgggacaaatgtttatgtacgatttatatcagtctcgttataatatggaagacttcaatgtgtttagccttgatgatgttgacgctgcatttgataaagttgttcagttaaaatataaccaatcagtaacaatgaaggggaaatgctatggacttagcattgttcctatgccagctggtcatatgataggaggaacaatgtggaaaatcatgaagactggggaagaagatattatatatgctatcgattttaatcacaaaaaggaaagacatctcaatggttgtgacctagaaagattgcagaggccatcattgcttataactgatgcatttaacgcaacttatcagcaagaacgaagaagagcaagagatgaaaaacttatgacaacaattcttcaaacattaagtaataatggtaacattcttattgctgttgatactgctggtcgccttttggagttggcacacatgctggatcaactttggaggaataaaaattctggtttacagattcaccctttatgccttattaataatgtaagttataatgttgtcgaattcgctaaatctcaaatagaatggatgagtgataaattaatgaaaagctttgaagctgttcgtaataatccttttcaatttaaacatatacgtttatgtcatagtgtttcagagcttaacaaaattccttctgcaaaagtagttcttgccagtatgcctgatcttgaatgtggatttgctcgtgaaatattttttcaatgggcctctgattctaaaaacagcattgttctaacatcaagatgttgtgaaggtacactagcaagagatttattagacaatggtgttggaaggaccattcaaatcactgttaaaaaaagagttcgtcttgaaggggaagaattaaaggaatacttaaaagcacataaaaaaactaatgacaaaaatgaagaaaaggaaagttctgagtcagaagatgaaatccaattgctcagtgtcaccaaaggtagtcatgatttagttattaagcaagaacgaaggaaaaaaaaccaaaaatctttaaagaaattttatccaatgtttcctttcattgatcgtaaagttaaatttgatgaatacggtgaatttgtgcgcatagaagattacaaagctcctgataccgctaaacgtcctcctgaaaaaaagtctaaaaagaaggatgatgatattttagatcctgccgatattccaaccaaatgtgtttcttatgagaagtcactaactgtaaatgctcaagttcaatacatagattttgaaggaagatctgatggagaatcagtacagaaaataatcactcagttgagaccaagaagagtaatacttgtccgtggtacctcagaaaatacggaagctttagagaagcatcttttgcaatggtctgaggctaaaatattctgcccgaaaaaaggtgatatagtggatgctaccactgaaagtcatatatatcaaataagattgacagattctttagtatcttcattacacatgcaaaaaggtaaagattcagagcttgcatggattgatgctattaccaaataccgtcagaaaccctctgacactatgcagtcgacagaagaaatggaagttgaagaagatggtaattacagcatttacaatgatgactacttaactctggaacctctccccttaactgaagtcaatcctcatcaagcagtgtttataaatgagttaaaattatcagacttgaaacaaattttatctcgtaatggtatagaatctgaattctctggtggtgtattgtggtgctgtaatggtactattgctattcgaaggttggagtcttctaaagtgtacttagaagggtggatttcagaaaattactatagaattagagaaattttatatggacaatatgcaattttataa

SEQ ID NO: 1384 - DNA, 2421 bp, Nezara viridula
atgccctcgatagatgttatacagcctcctcctcctcctcctaccttggagaaggaggaacctttacttcaaccaacaactaagcctattgttggtattatataccctccacctgaagtaagaaatattgttgataaaactgccagttttgtcgcccgtaatggaccagaatttgaatctagaatcaggcagaatgaattgggaaatcctaaattcaactttctcaatacgggtgacccttaccatgcctattatcaacacaaagttaaagaatttaaggaaggaaagggaactgaaccaccaccacctccacctccagtgcaacagaagactgtagcttctgcgacacaactgaaacagcaagaaatcctaaagcaggtcacggaacagccgtttgtaccaaaagatcctcctccagattatgagttcatggctgatccaccttccatttcggctctggatttggatatagtaaagttgacagcacagttcgttgctagaaatgggcgccagttcttgactaacctcatgaacagggaacaaagaaattaccaatttgattttcttcggccacaacattctctttttctgtatttcaccaaactactcgagcagtatacaaaggtgttgattcccccgaaagacctaatgtcccgtctaaaagaagaatgttccaatcctactggagttctggagcaagtcaggtatcgtgcagactggcttcactaccaagaattgcagaagagaaaagaggaacaagcgcttgagaaagaaagggtggcttatgcacagatagattggcatgactttgttgttgtcgagacagtggactatattccaggtgaagtaggcaactttcctccacctactactccagacgaagttggtgcccgagtcttgatgcaggagcgaatcttagaaaatggaggagaggatctgacggaaggaacaggtagcgatgatgagagagagaaggaagatagcgaaagagaagaagcagctggcgataagggagataatactcaggtccaagatatggaagaagaatcatccagtgacagtgacgaagacgatgaacagagggaccaatctcttcaagaaaaacaacaggcaacacctgcccagaaacagcaagcgttgcaacaaaatcaacagcacccctccgccgatggcaagaaaccccaaccttcgatgcaacctcctctgccccctgctccagataaagttatcgtcaagaaaggctataatcctaagcagcaccagaaaacttcgaaaggtgcagataactatcttatttctccattgaccagtgaaaagatacctgccaacaaggtacaggaacacatgagaattggtctgttggatcctcgctgggtcgaacaaagagacaaacacattcaggatagaatcaaccaggagactgtctacgcaggaggttctgctattgaggccagcttgaaacaacttgcggagagaagaactgatatttttggtgtgggtgatgaagaaactgctattggtaagaagattggtgaagaggataagaagaaagatgataaggtgacttgggatggtcacacttcgagcgtggaggctgcaactcgcgctgccagggctaacatcaccatcgaggaacagatccaccagattcacaaggtgaagggattgctccctgatgaagaaaaggagaagataggacccaagcctgtcccaggagcggggagcagcagcggaggaaatccaatggctggtggcccccaaatcgttgtccaagccaaagcccctcccctccctcctccaccgaaggtgcctccacttccacctccagctcctctgccgcctccaccgggccttgtacctcagccacccataatgatggtacctgcacctcttcgtcctccgctaatggttccgccgggagcattccccgtagttgctgctactccttctgctttcatggctccaccaggaactgcgcccttgccccccgccccgcagccgccccctcaggtcactcaggtggggaacttgttaaagcacgtcgcttctgcctctgtgggcgaggctgatgatgagcctatgaccaagaaggctaaaacagaagattgtcttgtaccagaagctcagttcctcatacagaacaagagccctgtcacattcaaagtgatcgtaccgcttttggctgaaaagccagaatggaagttgaacggccaggcactgacgttcacccatccgttgacggacaccatcgcctctatcaaagccaatatttctgaagccataggaatgccggctgctaagcagaagttacattgtgatggtatcttttacaaggattctaactctttagcattctataatatttctcctgctactgtagtctacttgcaggtgaaggaaagaggtggcaggaagaaataa

SEQ ID NO: 1385 - DNA, 942 bp, Nezara viridula
atgccaggagtagagcatgttactaacaaagtcgttgttcatcctttagttctattaagtgttgttgatcatttcaatagaatgggtaaaattgggaatcagaagagagtagttggcgtattattaggatgctggaaggcaaaaggtgttttagacgtatctaatagttttgcagtgccatttgatgaagatgataaagacaaatcagtttggtttttagaccatgattatttagaaaatatgtatggcatgtttaagaaagttaatgcaagagaaaaagttgttggctggtatcatacaggcccaaagttacatcaaaatgatgttgcaattaatgaacttatacgccgttactgccctaactcagttcttgttattatcgatgcaaaaccaaaggatcttggtttacctacagaagcatatagagcagttgaagaagtacatgatgatggttctcctacgacaaaaacatttgagcatgttcccagtgaaataggggctgaagaagcagaggaagtgggtgttgaacatctgctgagagatataaaagatacaactgtcggctcactttcgcaaagggttactaatcaatttcttggtctcaaaggccttaatcaacaaattcaagacatcagggattaccttatgcaggttgttgaaggaaaattgcccatcaaccatcaaataatatatcagcttcaagacatatttaatctccttcctgacatgaaccatgggaactttgttgattcattatacataaaaacaaatgatcagatgcttgtcgtttatctcgctgccctcgttagagctattgttgccttgcataatctgatcaataataaactcagtaatcgtgatgccgaaaaaaaagaaagcaccaaaaaagaagaaaaacctaaagaagaagaaagtgtaaaaaaagaattgaaggctaagtaa

SEQ ID NO: 1386 - DNA, 1623 bp, Nezara viridula
atgtttcagcccattttcgtgttaagccaaaactctaaaagggaatcaggcaataaagttcggactgagaatattgctgcagccaagatgattgcagaagttattagaacttgtcttggaccacaggcaatgcttaaaatgttaatggatccaatgggtggtatagttatgaccaacgatggtaatgctattttgagagaaataactgttcaacaccctgctgcaaaaatgatcattgaaattgctaggacacaagatgaagaggttggagatggcactacatcagttgtgattctttgtggtcaaatcatggcagaaattgaaagacatatagatgaagtccatcctacgacaatcattaaagaatttaaaagagctttggatgatattttaaaaatacttccagacataagtacttctcttgatcttaaggacaaagctaaagtgatagaagtggttaaaggatgtttaggtaccaaatttttaggtacttggtctgaaatggcttgtcagatggcaattgatgctgtagatactgtcagagatctaaaaggtcttggaattgatttaaaaaactttgctaaaattgaaaaggttcctggtggttttattgaagattctaaagtattggaaggtgtaatgcttaacaaagatgtgacacatcccaaaatgtcacggttcattaaaaatccacgaattttattactagattgttctcttgaatataagaaaggggaaagtcagactaacgtggaaataattaaggaaggtgattatacaaggcttctacaaattgaagaagagtacattgaaaaaatgtgcaatcatattattgagcagaaacctaatgttgtcattactgaaaaaggaatttccgatttggctcaacaccatcttttcaaggctggtattacagccattcgtagagttaagaagactgataataacagaattgctcgagcagtagatgcaactattgttagtcgtgtggaagaaatcaaaccttatcatattggttgtggtgctggtctctttgaagtaaagaagataggagatgagtacttcactttcattactgagtgtaagaacccaaaagcttgtacaattttgctgcgtggtccaagcaaagatgtgttgaatgaagttcagagaaatttacaagatgcaatgaatgttgtcaggaacttgtacttggatcctcgaatacttccaggaggtggtgctgtagaaatggccctacatagagctctaatcaaagcaaattacaccatagatatggaagatgattgttatgctgccatcccatctgctttaagaattattcctagaacactgttgcaaaatgctggtggtaaagtgattagatcaatgaacgaacttgagaaacaacataattctggtattcttaaaggagttgatggaataactggagaattaaaaactgttgaagaattaggtgtatgggaaccctattcagtcaaagtccagatctataaaactgctattgagtcagcaattttattgttgaagattgacgatattgtttctggtgctaagaataaagatagggaaagaaatagcggctctgtagcgcaacctactgaagaatcacttaaagaataa

SEQ ID NO: 1387 - DNA, 699 bp, Nezara viridula
atggcaatgccaagaagttatggtggcttatctgattacagaaccgttcctgcaccttcttttagtccatattctgaaaatggagggagtgtagtagctgtagctggcgatgacttcgcaattatagcatctgatacacgtttaagtacaggttttcaaatttataccagaaaccagtcaaaattatttaaattgtctgacaaaacaattcttggtagtactggttgttggtgtgatgttctttctcttactaggcttgttcaaacccggataaaaatgtatcagtacgatcataataaagttatgtccactccagcagttgcccaaatgctctctgtactactttattataaacgctttttcccatactatgtagccaatattcttgctggaatagatgataatggtaaaggagtggtttacagttacgatccaatcggtcatcatgaaagctcaaaattcagagctggaggaacagctggagctttattacaaccactgttagacaatcagctcggtatgttgaatcaagaaaatgttcaagacaaaacatacactttggaaaaagcccatgcaattgtaaaagatgtctttatatcagctgctgaaagagatatttttactggtgacagaatatcaattaacataataacaaaggatgggatcagagaagattcatttgagcttaggaaggactag

SEQ ID NO: 1388 - DNA, 900 bp, Nezara viridula
atgtttgggtttagtatgtttccatttcctcctaggccttttaaggtccagtattattgtttttctgttgcaatgataccagggaatgaaagggatgatgttgaacgtgggggtaaaattattatgcctccttcagcactggatcacttgactagattaaacattaattatcctatgctttttaagttgcataacgcgaaaacgaatagatcttctcacagtggtgtattagaatttgttgcagacgagggaaaagtctatttaccccactggatgatgaggaatttaatgcttgaagaaggtgatgttattgagatagaaagtgtctccctgcctgttgcaactttttcgaggtttcagcctcaggctccagattttttggatatttcgaatcctaaagcagtcttggaaaactgtctcagaaactttgcttgtttaactactggtgacattattaatattaagtataaccaaaaagattatgagctttctgttttagaaacacaaccaggggcagcagtaacaattattgaatgtgatatgaatgttgaatttgctgctcctttaggatataaagagcctaattctgaacaggagtcattggatgagtcatctgaaagaacagaaaacttatctaatgagggaagtggattcaccccattctttggtgaaggctataggcttgatggaaaacagaagaaagcgattgaagatgaaaatatgaaatttaaaatcccgactgtgagaggaattcctgattatgactggaaagtaggtgtgattaccttcatgagaaatgtgcgtcaacctgttaaagaagctcagaaagatgatgaagataaatttcaacccttttatgggcaagggcatgtgctaagtacgaatcgtcacaggaaataa

SEQ ID NO: 1389 - DNA, 1629 bp, Nezara viridula
atggctgcttttccaggatccattgcatttgatgagtatggtagaccatttattatcatcaaagatcaggaaaaacaaagacgtttaaccggtaatgatgccatcaagagccatatactctcagccaaagcaatttccaaaattgttagaacttccttgggtccaaaaggtttggacaaactattggtgtcgcaagatggtgatgttatggtaagcaatgatggagctaccatcatgaagcaaatggatgtggataatgaaattgcaaaactgatggtgcaactgtctcaatcccaagatgatgaaattggagatggaactacaggagtcgttgttcttgctggtgctttgttagaacaagctgatgttttattagataaaggtattcatcctattagaattgcagatgggtatgaattagctgctcgagctgccatagaacatttagattctatcgccacaaaatttcctgttgatcctaataatttagaacctcttattaagactgctatgacaactcttggatcaaaaatcgttaacaaatgtcatcgccaaatggcagaaatagctgttaaggcagtattatcagtggctgatctggaaaagagggatgtcaacttcgagctcataaaagttgatggtaaagtcggtggaaggctggaagattctatgcttgtcaaaggggtggtcattgataaggatttctctcatccccaaatgccaaaggtattaaaggatgttaaaatagcaatcttaacttgcccatttgaaccgcctaagccaaaaacaaaacataagttggatgtaacatctattgatgactatagggcgttgaggaagtacgaagaagagaaatttaataccatggtttctcaagtcaaagaggcaggtgctactcttgctatttgtcaatggggatttgatgatgaagcaaatcatcttcttctaaagagagaacttcctgcagttaggtgggtcggtggcccagaaatcgagttgattgccattgcaactggtggacgtatcgtaccccgatttgaagagttgaatcctgaaaaacttggtcgtgctggacttgttagagaaatctcttttggtactacaaaggataaaatgcttgtgattgaggaatgtgccaattctcgttctgtcacaattttcattagaggttcaaaccaaatgataatcgatgaagctaagaggtcaatgcatgatgcactttgtgtcgttagaaatttgatttgtgatgacagcattgtttatggtggaggtgctgctgaactttcatgttctattgccactgccaaacaggcagataagatttcaacaattgaacagtacgcattccgtgcattttctgaagctttggagtccattccttttgctctagcagagaattcaggtttaccaccaatgcaggttgtaactagtgtaagaggaaggcaaatccaagaaaacaaccctgcacttggtgttgattgtatggggaaaggaactaatgatatgaaagagcagcatgttattgaaacacttaaaagcaaaaagcaacaaataatgcttgctacacaattggtgaaaatgatacttaaaattgatgatgtcagaacacctaatgatatgcaatattaa

SEQ ID NO: 1390 - DNA, 342 bp, Nezara viridula
atggcttcagcaatggacgttgacgatgaggagaacgaggttccgacctccagcagtggaaaaggtgaaaaaaagaggttcgaagttaaaaaatggaatgctgttgcactttgggcctgggacatagttgttgataattgtgctatttgtcgaaatcatataatggatttatgtattgaatgccaagctaatcaagcctctgctacaagtgaggaatgcacagtggcgtggggtgtttgtaatcatgcatttcattttcattgtatctcaagatggctaaaaactaggcaagtttgcccattagacaatcgtgaatgggagtttcaaaaatatgggcattaa

SEQ ID NO: 1391 - DNA, 1605 bp, Nezara viridula
atggtgtctttaaatccgattagaatactcaaacatgaagcagaacaagaaaagggtgaaatggctagaatgtccaatttcatcggagcaattgccgttggtgatttagtgaaaagtacactcggtccgaaaggtatggataaaattcttgtatcttacggccgaaaccgtgggcagatagaagttaccaacgatggtgctactattttaaaatcagtgggttttgacaatcccgctgctaaaattctggtcaacatgtctaaagttcaagatgatgaagttggagatggcacaacttcggtcactgttttggccgccgaacttctccgagaagccgaaaaattgatcgaaaggaaaatccatcctcagacaataataagcggatatcgccgcgcgacaaatgtagctcttgctgcattagataaatgtgctgttgacaatagcagcaatgataaggagtttgccgaagatttgctcaaaattgcccgtacatcattgagttccaaaattttgaatttacataatgaaaaattcagtaaattggcagttgaagctgttctccgccttaaaggatcaggtaatttaagtgcgattcagatcatcaaaaaaacaggtggctccttggatgattcatttttagatgatggcttccttctggacaagaaagttggtcaattccagcctaaaagggttgaaaatgccagaattcttattgcaaatactcctcttgacaccgataaaattaaagttttcggttcgagaatacgtgttgactctgtagctaaagtggcagatttggaattagctgaaaaagaaaagatgaaggaaaaaattgacagaattataagtcataaatgcaacgtatttgttaaccgtcagctgatatataattatcctgaacagctatttgctgatgctggaattatggcaattgagcatgcagattttgatggtattgaacgcctagcgcttgtcactgggggtgaaattgtctctacatttgatacacctgagcttgttaaattaggtgaatgtgatttaattgaggaaataatgattggtgaagacaatttgttgaggttcagtggagtcaagttgggagaggcctgcagtattgtcataagaggcgcaacacagcaaattgttgatgaagccgaacggtctcttcacgatgcattgtgtgtacttgtaaccactgtcagggataagaaaactgtttttggtggtggatgttcagaaataattatggcgagtgctgtaagcgatgaagccatcaatgttactggcaaagaagcagttgctatggaatcctttgctaaagctttgctcgagttgcctatgaccatctctgataatggtggctttgattctgcctatttagttacagctctaagggctgctcataataaaggtcagataacttatggcttggacatgaagaatggtggagtagcttgcatgagagaacttggtatcgtcgaatcccattcagtaaaacgtcaaatgcttctatctgcttctgaagcaactgaagtcatattgagagttgatgatattctcaaagcagctcctcgcaagcgaacggaagatcgaggctactgttga

SEQ ID NO: 1392 - DNA, 834 bp, Nezara viridula
atgttccgaaaccagtatgattccgacgttaccgtttggagccctcagggccggttacatcaggttgaatatgctatggaagctgtaaagcttggagcagcaactgttggtgtgaagaataaacagtatgctgtccttgttgctcttaaaagagcatcttcagaactttcagctcatcaaaagaaaattattcctcttgataatcacataggcatgagcatttctggcctaactgctgatgctcgtatattgagtcggcaaatgagaagtgaatgtctatcttattcatattcatatggaactgaaattcctattatcaggcttatgaataaaatatctaacatgatgcaaagttcaactcagcgctatgacagaagaccgtatggggttggtctactggttgcaggatttgatgccgacggtcctcacatttttcaaatttgtccttctgcaaatttgtatgagtgtcgttcaatggctattggtgctagatcccagagtgcaaggacgtatttggaaaagcatctagcagacattggaaactctggcaccctcacagaccttcttaagcatgcacttcgggctcttagggattcttctcctaatgatacagaacttagctctaagaatgtagcaatagcggtagtaggaaaagataccccactgaaggaattatctgaggccgacacccagacttatctggacatgatcctgagtgaagagagaagaagtggcgatacagcaggaggtagtgacgatgctcctcctccaccaccgccgtccgatccaccagctcaagatcctacaccagttgtggctatggaaacacaataa

SEQ ID NO: 1393 - DNA, 2544 bp, Nezara viridula
atgccagtttatcaagaaagaaaacctaaaatagtaattaatgaagaagatttgccttatgaagaggaaattcttcgaaatcctttttctattaaacattggttaaggtacatcgagtttaagaaggatgcaccaaggaatggggtgaacataatctatgaaagagcattaaaagagcttcctggaagttataaactgtggtataattatttaatactaagaaaaagacagattaaaggacgatgcattacagatccttcttttgaacatttaaataatacttatgaacgatctttagtatttatgaataagatgcctaggatatggatggaatattgccagtttcttgttgatcaatgtaagattactaaagcccgtcacgtatttgatagatctttaagggcattgcctatcacccagcaccatcgtatttggcctctttatataaaattcttaaaaaaacataacattccagaaactgcagtccgtgtatttcgaagatatctaaagctctgcccagaagatacagaagaatatattgattatttaactgcaatccatcgtctagatgaggccgctgttagattggccgatattgtaaatactgatgattttgtttcaaagcatggaaaatcaaaccatcagttgtggactgaattatgtgatttaatctctaaaaatcctcaggaagttaggtctctgaatgtggatgcaataataagaagtggtttgaaaaaatatactgaccagttaggtcatttatggaattcattagctgattattatatcagaagtggactttttgaaaaggcaagggatatttatgaagaagcaatacaaactgttactactgtcagagatttcactcaagtttttgatgcttatgctcagtttgaagagctttctttgagtaagaaaatggaagaagtttctcaaaaagcttttcccactgatgacgatgatatagacatcgaacttcgcttagcaaggtttgaagatttgattgaaagaagattattgcttctaaattcagttctcttgagacaaaatcctcataatgttcacgaatggctgaaaagggttcagctttttgaaggaaaaccacatgatataatttatacttacactgaagctgttcaaacagttgatccaaaactagctgtcggaaaaccgcacatgctctacgttaattttgcaaaattctatgaagaaaatgggcaagtagaagattctagaatagttcttgaaaaaggaacacaggtaccttatactaaagttgaagatctcgcatctgtgtggtgtgagtgggcagagatggagattagaaatgaaaactgtgatgaagcattaaaaattcttcaaagagctactgtgatgccagctaggaaagttgattatcatgatgactcagaaactgtgcaaatgagattatataaatcactgaaaatatggtcattgtatgctgatctagaagaaagttttggaacattcaaatcttgtaaatcagtgtatgacaggataattgatctgaaaatcgccactcctcaaattattattaactatggtctttttctagaagaacacaattattttgaagaagcttttaggacttatgaaaaaggaattgctttgttcaaatggcctaatgtttttgatgtatggaatacttatttaactaaatttttgaagcgttatggtggaggtaaacttgagaggacaagagatctttttgaacaatgtttggaaaattgtcctcctaagtatgctaaaggtttttatctcttatacgctaaattagaggaagaacatggattagcaaggcatgctatggctgtttatgaaagggctacttctgctgttttgccggaagaaatgtttgaggttttcaatatttatatcaagaaggctgctgaaatttatggtgttcccaaaactcgtcaaatttatgaaaaagctattgaagtgttaggagaagataattcaagagaaatgtgtcttaggtttgctgaaatggaaacaaaattaggagaaattgatcgagccagagcaatttatgcacattgcagccaaatgtgtgatcctcgagttactggttctttttggcaaacatggaaagattttgaagtgcgccatggcaatgaagatactatgagagaaatgctaagaattaaaagaagtgtacaagctacatacaacactcaggttaatatgatgtcagcacagatgttatctgctgcaagtaatgtttctgggacaattgctgatcttgctcctggtgctaaagatggaatgcgcatgttagaagccaaagcagctgaaatgactgtaactacgaaatctggttcatcagcaataatgtttgtaagaggtgaagcccagaacacatcccaggaagtgcagaaggaaataattaatcctgaagctttaaatgttgattcagatgatgaagaagaaaacctggaggatgatgatctgcctgttgaaaagcagattattcctgacgaagtgttttgtggcctgaagaaaggaagtgattctgattaa

SEQ ID NO: 1394 - DNA, 990 bp, Nezara viridula
atggccgctggacctattgccgaaaggaatcaagatgccacgatatatgtcggtggattggatgataaagttactgaaactcttatgtgggagttatttgttcaagccggaccggttgtcaatgttcatatgccgaaagacagagtgacgcaacaacatcaaggctatggctttgttgagtttttgggtgaagaagatgctgattacgccataaaaattatgaacatgataaaagttcatggaaaacctattcgtgtcaacaaggcttcagcacatcagaaaaatttggacgttggggctaatgtgttcattggtaatctggatcctgaggttgacgaaaaattgttatatgacacattttcagcctttggagtcattctgcagacacctaagattatgagggatcctgatacaggaaattcaaaaggttttgcatttatcaattatgcttcattcgacgcttcagatgctgccattgatgcaatgaatggccaatttctctgcaatcgcccagtttcagtttcttatgcctataagaaggatgctaaaggtgaacgacatggatcggcggccgaacgtctcctagctgctcaaaacccattatcacaagccgacagacctcatcatatgtttgcagatgctccccctgcacctctgccacctcctccagtactgccgccacctcctgttttcaatcctccaccccctcctcatatgccacctcctccgttaccacctcaacggatggttgctcctatgcctccacctcctcctggtcctcctccaccaatgcctcctggaatgatgccatggcctccaatgcaaccacactttccacctcctcctcctccaccacctacaaacaaagctccccctcttcctcctccaccccctccacaagcttggcgtcctccaccacctccttacaatcgaccaccatttcctccaccacctccacctccagtcagacctccaccaccaatgttctag

SEQ ID NO: 1395 - DNA, 777 bp, Nezara viridula
atgggacgagttatcagagctcagaggaagggtgctgggagcgttttcagatcccacaccaaacaccgaaaaggtgccccaaaattgaggtctttagatttcgctgagaggcatggttacatcaagggagttgtgaaagatattatccatgaccctggtagaggagctcctttagcagttgtgcattttagagatccttacaggtttaagacccgtaaagagcttttcattgcccctgaaggaatttacactggccaattcctgtactgtggaaagaaagccaacttacatgttggaaatgttatgcccgtcggcactatgcctgaaggtactatcatctgtaatttggaagagaagaccggagacaggggtcggttagctagagcttcaggaaattatgctatcgttattgcacacaatcctgattcaagaaggaccagggttaagcttccatcaggtgcaaagaaagtcattccctctaacaacagagccatggttggtatcgttgctggaggtggacgtattgataagccagtccttaaggctggtcgtgcctattataaatataaggcaaagaggaactgctggcctaaggttagaggtgttgccatgaacccagtcgagcatcctcacggtggtggtaatcaccagcacatcggtaaagcttccaccgtcaagagaggaacttcagccggtagaaaggttggtcttattgctgccaggcgtactggtaggattcgtggtggtaagactgatcagaagaagggagacgattaa

SEQ ID NO: 1396 - DNA, 411 bp, Nezara viridula
atggcccgtaccaagcagaccgctaggaaatcgacaggaggcaaagctccgaggaagcagctggccaccaaagccgccaggaagagtgctccggccaccgggggtgttaagaagcctcacaggtataggcccggtacagtcgctctgagagaaatcaggaggtaccagaagagtaccgagctgctcatcaggaaactcccgttccagaggttggtgagggagatcgcccaggacttcaagaccgacctgaggttccagagctcggcagtcatggccctccaggaggccagcgaagcctatctcgtaggtctcttcgaggataccaacttgtgcgccatccacgccaagagggtgaccatcatgcctaaggatatccagctggctcgccgtatccgcggagaacgagcctaa

SEQ ID NO: 1397 - DNA, 1596 bp, Nezara viridula
atggcggcaattactttattgaatccgaaagccgaagttgtgagaaaaacagaagctttgtctatgaaccagagtgcagctaaaggtttacaagacgtcatgaagacaaatctcggtccacgaggtaccatgaaaatgttagtttcaggtgctggtgacattaaaattactaaagacggtaatgttttgctgaaggaaatgcaaatacagcatcctacagcttctcttattgccagaacttctacagctatggatgacattaccggtgatggaactacctccacagtcttacttattgctgaattattaaagaaagccgacaattatattattgaaggtgtgcatcctaggttaattactgaaggtttcactgttgcttgtaaacacgccatggaagttttggatagtatgaagaaaacagttagtcttgatgataaggaaactcttattgctgttgctagaacagctcttaatacaaaggtagagtctaaagtagccgaggtattaacccagatttgtgttgaagctgtgcaagctatcaaactccctgataaacccctagatttacacatgattgaaattatgacaatgcagagccgtcttgaatctgaaaccagattagttagagggcttgtcttagatcatggttcacgtcaccctaatatgcccaagaaactaaccaatgcttatattctaacgtgtaacgtaagtcttgaatttgagaaaacagagataaatagtgggtttttctataaatcagcacaggaaagagagaaactggtcgcatccgaaagagagttcattgagttaagagttgcaaaaattattgctttgaagaaatctgtatgtgatggaacagacaaaggatttgttgtcattaatcagaaaggtattgatcctgtctctttggatatgctagctagagaaggaataatggctctcaggcgagccaaaagaagaaatatggagagactaactttagcttgtggtggagtagcgatgaatagccttgatgatctcactgaagattgtcttggacgagcaggtctcgtttatgagcatgttcttggagaaactaagtatacatttgtgtctgattgcccaaaccctcatagcgtcactgtacttgttcatggcccgacttcatatgccattactcaaattcaagatgctcttcgggatggtttgagagctgtcaaaaatgcagttgaagatggtggtgtacttccaggtggaggagcagtagaattaaaattacgccatgaattgaaaaaagttgctgagaaaactaaggaaaagtatcgtgttggaattgaggccttctgtgatgcactcctggttattcccaaaaccctcgcaatgaatagtggattcaacactcaagaagtaattacacaacttgattatgatgcaaaggagaatgattcaatcggattggatcttcaaactggcaagtcgatgatccctactgatttaggaatccttgacaactattctgtaaaaaaacagtacatagcttcaagtgtcattgtagcaagtaatctgctccttgttgatgaagttatgagagctggaatgtcatctttaaaaggataa

SEQ ID NO: 1398 - DNA, 3144 bp, Nezara viridula
atgtctagtgctgaagtggccaacaattccatagaacctccagccaagaagcggaaaattgctacaggagagactgctccagcgaactccgtttcaaaggcaatatcagccatggcgaataatggatcttttgattccaatcaagaaattgatgagggactttactctcgccaactttacgttttaggacatgatgccatgcgacgaatggcatcatctgatgttcttatttcaggtttaggaggacttggtgtagaaatagctaaaaacgtaatattaggtggtgttaaatctgttacattacatgatgaaactgtatgcactatatcagatctgtcttcacaattttatttatctgaaaattctattggtttaaaccgagctgaagtatcttgccagttacttgctgaacttaacaattatgttccaaccagatcctacactggacctcttactgatgattttatcaaaggatttagtgttgtagttttaacaaatgcttcagaagaagaaaaattgagagtttctgaaatagctcatgcatctgatgtatcattaattatagcttcaactatgggtgtatttgctcaagttttttgcgattttgggcgagaattcagtgtagttgacacaaatggtgaaaatccagtttctgctatgatagcaagcatttctcgagacgaagaaggtgttatcgcttgtctagatgatactagacatggtctagaagatggagattatgttactttttctgaaattcagggaatgactgaactgaatggctgtgagccgactaaaattaaagttcttggaccatatacatttagtattggcaatacttccaattttggagaatacattagaggtggaattgttcaacaagtaaagatgccaaaagtgcttcaatttaagtcatattcagaagctctcaaatctcctgaatttatatttactgattttggaaaatttgatcacccacagcaacttcatgttgcattcaaagctgttgaatcttataagaaagaatttggtaagttgccatcaccatgggacaacaagaatgctttagattttgtaaactgttgtaaatctgtattatctgacttaagcctagatgtagaattaaatgagaagcttatggagcaatttgctaaaacctgttctggaaatatgaatcctattgatgcatttattggtggtgttgttgcacaagaagtgatgaaagcttgtagcggaaaatttcatccaattttccaatggctgtattttgattctattgaactattgccaaatgaagatctagctcctaatgactgtgcacctactaattctagatatgatggacaagttgcaatttttggtaccgagtttcagaaaactttaggtgccctgaaatattttgttgttggagctggagcaattggatgtgaacttcttaagaatttttcaatgatgggtgtgggagcagatggtggaaaagtaattgttacagatatggaccttattgaaaaatctaatctcaacaggcaatttttatttagacctcatgatgttcagaaacctaaggcagccactgctgcgaaggcaattaaaaagatgaatccattaatgaatgtgatcgctcatgaaaatcgagttggaccagaaactgagaaagtttatgatgatgcctttttcgaggacttggatggtgttgcaaatgcattagataatgtcgatgcaaggatatatatggatcgtcgttgtgtctactatagaaaacctctgttagaatcaggaactcttggtactaaaggtaatacacaaattgttgtacccttcctaactgaatcttacagctcatctcaagatccacctgagaaaagtattcctatatgcacattaaagaattttcctaatgcgattgagcatacacttcaatgggctagggatgtttttgaaggcctgtttcgtcaatctgccgaaaatgctgctctttatctgagtgatcctaattttatcgatcgaactttacgtttgcctggcgtacagccgatggaagtcctagaatctatcaaacaagctcttattgatgacagaccaaaatccatcgaagattgtattacttgggctagaaatcattggcaagaacaatattcaaatcaaatccgtcaacttcttttcaatttcccacctgatcagatgacaactaatggtcagcctttctggtctggtcccaaaaggtgcccagtagctttagattttgatgtgaataatgaccttcatttggattatattttggctgcggctaacctgaaggctgaagtctacggtattccccaggtccgtgatagaagcattattgccaaaatagtccagaatgttgaggtccctgaatttactcctaaatcaggtgtaaaaattgctgtaactgattcgcaaatggccaatggagctggtgggcaagttgatcaagatagaattggacagttgcagaacgaactaccttcaaaagaaatgttcaacggcttaaatatcacacccctcgaatttgaaaaagatgatgacaataaccttcatatggatttcatcgttgctgcatcaaatttgagagctgcgaattacaacatacctccagctgatagacacaaaagtaagttgatagctggtaagattataccagctatcgctactacaacatcagtcgttgctggtctagtttgtattgaactcatgaagttggctaagggttataaagatataagtttgtttaagaatggttttgttaatttggcgcttccattctttggattctctgagcctatattagcacccaaattgaagtattacgaaaatgaatggacattatgggatcgatttgaagttactggagagatgactcttaaggagttcatcgattacttcaaggataaacatcagctggaaataacaatgttatcccaaggtgtttgtatgctgtattccttctttatggctaagagcaaattagaagatagacttaatcttccaatgtcggaagtggttcgtagagtttctaaaagaaaacttgaacctcacgtaaaagcactcgtgtttgaactttgctgcaatgacaccgatggcaatgatgtggaagtaccttatgtgaggtatacattgccttga

SEQ ID NO: 1399 - DNA, 1278 bp, Nezara viridula
atggctgataatgatgatctgttggattatgaagatgaagaacagacagagcaacctattgttgaaggttcaggagatacagctccccgcaaagatgtgaaaggagcttatgtatcgatacatagttctggttttagagatttccttttaaagcctgaaattttaagagcaatagttgattgcggctttgaacatccttctgaagtgcaacatgagtgtataccgcaagcagttcttggtatggatatactttgtcaagcgaagtctggaatgggtaaaacagctgtatttgtgttagctacccttcaacaaatggagttgactgaaaatcaagtaacagttttggttatgtgtcataccagagaattagcatttcaaataagcaaagaatacgaacgattttctaaatatatgccaaacatcaaggttgctgtattttttggtggtttacctatccagaaggatgaagaagtcttaaaaaataattgtcctcatattgtagttggtacaccaggacgtattttagctttagtgaagaataaaaaactaaatttgaaaaacctgaaacattttgtgctagatgaatgtgacaagatgcttgagcagttagacatgaggcgtgatgttcaagaaatttttaggaatacccctcatagtaaacaagttatgatgtttagtgccacactaagtaaagatataaggccagtttgtaagaaatttatgcaagatccgatggaagtgtatgttgatgatgaagcaaagctaaccctacacgggcttcagcaacactatgttaagctaaaagaaaatgaaaaaaacaagaaattatttgatttacttgacatcttagagtttaatcaggttgtaatatttgtaaaatcagttcagagatgtatggctttggctcaactgttatgtgaccagaatttcccagctgtagctattcatagagctatgagtcaagaagagagacttgctaagtaccaagaattcaaagacttccaaaagagaatacttgttgctaccaatttgtttggaagaggaatggatattgaaagagttaatattgtatttaactatgatatgcctgaagattcagacacttaccttcatagagtagcgagagcaggacgttttggaactaagggtctggcaatcacatttgctagtgatgaggcagatgctaaagttctaaataatgttcaagatagatttgatgttaatattactgagttacctgatgagattgacctttcatcttatattgatggacgataa

SEQ ID NO: 1400 - DNA, 1464 bp, Nezara viridula
atgcctgttgaagctatgcaaactgatgtggagatgaaggtagtagattctccttccacagaagatccagtggctacggcagttcaagaaataagggagcacatacgtcaattggaaaaggcagttgctaataaagaacctcgtttcatattaagagttttacgtcttcttccttctacacgtcataaactttctgtatcagtcctccgcaatataatatcttcattttatttaagtagtcctgaaaaagatgctttatttctatatattgaagatgctgtagattcagataccatccaaaaaacaaaactgatcaaaaattctaatgttcctctcttgccagaaattgatgcttacattcatttgttggtacttgtgagactaatagatgctggaaaggaatcagacgctgtgaagtgttctgatgctcttatggccaagataactgctcaaaatcgcaggagtttagatttagtggctgctaaatgttacttttaccattctcgagtttatgaacttactaaccaattggaaaaaatcagaggattcctgcatgctagactcagaactgccactcttagaaatgattttgaaggtcaagcagttttaataaattgccttttgagaaattacttacattataagttgtatgatcaagctgacaaattagtatccaaatcagtatacccagaatcagcaagtaacaatgagtgggctagatttctttattatttaggaagaattaaagcagctcgtttagaatattcagaatcacacaagcacctagttcaagctctgagaaaagctcctcaacatgctgctgtcgggtttaggcagactgttcaaaagcttgctgtcactgttgacttacttcttggtgatattccagaccgacagatatttcgtcaggcaccacttcgtcgttctcttgcaccttatcttcaattaacacaagctgtcagaactggtgatttgcaaagattcggtgaagtattggagatgttcggaccccagtttcgttctgatcatacatttaccttaattcttcgtttaagacataatgttataaaaactgctatcaggtgcattggtttgtcttattcacgtattactccaaccagtatagcttcaaagcttggactagattcaccagaggatgcagaattcattgttgctaaagcaataagagatggtgttattgaagctaccttagatcctgagcatggttatatgcaaagcaatgaagtaacggatatttaccggactagagaaccacaattagcatatcaccaacgtatatcgttttgtcttgatctacataaccagagtgtaaaagctatgagataccctcctaaatcttatggaaaagatttagaatcagctgaagagcgtcgagaacgagaacagcaggacttagagttagcaaaagaaatggccgaagaagatgatgacgtttttccctaa

SEQ ID NO: 1401 - DNA, 1764 bp, Nezara viridula
atggctttaagtaatccttcagtgccagtttctgaaatcttgaagagtagtgctgattcagatgagcccaaaaagaaatctagggaggattggcgtaaagcgaaggaattggaggaagcaagaaaggctggtactgcccctgctgctgtagatgaggaagggaaagatattaacccccacattccacaatacatttcatctgctccttggtactatagtgctaaaggccctacacttaaacatcagagaatacaagaagagagtgttaaaaagttttccggtattgatgaatggtacaagcgaggagttgactcttcaaaagtgataacaaagtatagaaaaggtgcttgtgagaattgtggagccattacccatcaaaaaaaagattgcatggagagaccacggaaaataggtgctagatttactggtgctaaaattgcacctgatgaatttgttcaacctgagctctcacgagattatgatggcaaaagggaccgatgggcaggatatgatccaatacaacataaaatggttattgagagatatgctaggattgatgaggccaaaaggcagttgagggcagataaacttaattctgaacagtcagaagaagctgaagaagaagaaacaaaagaaagtattgctgatgaaggtggtgaagatgaggataaatatgtggatgaagtagacatgccagggacaaaagtagattcgaaacagagaatcactgtgagaaatctcagaatcagagaagacacagccaaatatttgagaaaccttgatcccagttctgcctactatgaccctaaaacaaggagtatgagggacaacccttacgctggatccgcagatactgatgtggactatgctggagaaaattttgtgcgcttcaccggagatacgttagatcatgcaaaagtgcagttgttcgcatgggaggcacataacaagggtgttgacgttcatcctcttggagaacccaccaggctggaagtacttaagaaggaatttgttgggaagaaagaagagttcaaacaaaaaggacaagaagacctcattaaaaaatatggtggagaggaacatctaaaagcccctcctaaagaacttttattggctcagactgaatattatgctgagtatactcgttatggaactgttattaagggacaagaaaaagaagtggtgaggtccaggtatgaggaagatgtgcttataaataatcatacaactgtatggggatcattttggcattcaggaaaatggggatataagtgctgtcattcttttattaaggggtcttattgcactggtgaagctggtagactagcggcatctgctggagaggtagctgtcaagggcccggcatttattcctccacatccgtctacaccatctgcctcctcctcttctacgtcttccgattcttcatcgtcgtcgtcatcatcagaggatgaagaagagaaagaaaggatgaagaagaaacaagaaaagaagaaagcgaagaagaagaagcaaaaagtaaagaaacttaagaacaaaatcaaaaataagaaacctgaagaaaagactgaagaagaaaaacttcaggaagccttgaaaaaggaggaagaagctcagaaagaaggtgaaagactttcaaaaatggatgaccgtaagaggccatacaacagcatgtttgaagtacagaaacctactgacgtggaaatggaagcatattatatgaagaagaagagggatgaggatcccatggcaaacttcttataa

SEQ ID NO: 1402 - DNA, 627 bp, Nezara viridula
atgggtatttcaagagatcattatcataaaagaaggaagactggaggtaagagaaaacccatcagaaagaagaggaagtatgagttaggaagaccagcagccaacactaagttaggcaccaaaagagttcatttggtaagaactagaggagggaatactaaatttagggccttgagattggactatggaaatttttcatggggttctgaatgttgtaccagaaaaactcgtctgattgatgtagtctataatgcatcaaacaatgagcttgtacgtactaaaacacttgtgaagaatgccatagttgtgattgatgctactccattcaggcagtggtatgaagcccactacgctctcccattaggaaggaagaagaatgccaaattgtctgaagctgaggaggctgtcctatacaaaaagaggtccaggaaaacggaaaacaggtataaggcgaggcagaaactggctaaagtcgaacctgcattagaagaacaattccagactggtcgtttacttgcttgcctagccagccggcctgggcaatgtggacgagctgatggttacatccttgaggggaaagagcttgagttctatttgaggaaaatcaaagccaagaaaggaaagtag

SEQ ID NO: 1403 - DNA, 936 bp, Nezara viridula
atggatcgtctcttgcgtttagggggtggaatgccaggattaagtcaagcaccacctccttctgatgcccctgttgtagatactgcagaacaagtctacatttcttctctggctctccttaagatgttaaaacatggaagagctggagtccctatggaagttatggggcttatgttaggagaatttgttgatgactatactgtaagagtaatcgatgtgtttgctatgccacagacaggaacaggtgtgagtgtagaagctgtggatcctgttttccaagctaaaatgttagacatgttgaagcaaaccggtcgccccgagatggtggtaggatggtatcattcccatccaggatttggttgttggttatcaggtgttgatatcaacactcagcaaagctttgaagctctttcagaaagagctgtagctgttgttgttgatccaatccagagtgtcaaaggaaaagttgtcattgatgctttcagattaattaatcccaatatgatggttcttggccaagaaccacgacaaactacctccaatttggggcatctgcaaaaaccctccgtacaggctttaatacacggtttaaatcgccattattattccatcagcatcaactacaggaaaaatgaattggagcaaaaaatgttgttaaatttacataagaagtcatggatggatggactgatgctctctgactattcagagaattgtaaagttaatgaaaccacagtcggggacatgcttgaattagctaagaattacaataaggcattagaagaagaggagaaaatgacacccgaacaacttgctataaagaacgttggtaagcaagatccgaagaggcatttggaagagaaagttgatgtgctgatgtcggcaaatatagtgcagtgtcttggtgctatgctagatactgttgtgttcaaatga

SEQ ID NO: 1404 - DNA, 1218 bp, Nezara viridula
atgacgtacacgacttttgagcaaatggatgttgacgaaaagaagggggaaggctttcgttcttattacatcactaaaattgaagaactgcaattaatagttgcggaaaagagtcaaaatctgagaaggctccaagcacaaaggaatgaactgaatgctaaagttaggatgttaagagaagaattgcaactactccaagaacaaggatcatatgttggtgaagtagtgaaaccaatggataaaaagaaggtactcgttaaagtgcatcctgaaggaaagtttgttgttgatattgataaaaatattgatataaatgatgtgactcctaactctcgagtggctttacgaaatgagagttatactctgcacaaaattctacctaataaggtcgatcctcttgtatcattgatgatggttgagaaagttccagactctacatatgaaatggttggaggtcttgataagcaaattaaggaaatcaaagaagtaattgaacttcctgtaaaacatccagaactgtttgatgcactaggaatagctcagcccaaaggagttttattatatggaccacctggaacaggtaaaacacttttggcaagagcagttgcccatcacactgagtgcacgttcattcgtgtgtcaggatctgagttggttcagaaattcattggggaaggatccagaatggttagagaattgttcgtcatggcaagagaacatgctccatctatcatatttatggatgaaatcgattcaataggttcatcacgtatcgaatctgggagtggtggtgattctgaagtccagagaacaatgttagagttattgaaccaattggatggcttcgaagccacaaaaaatattaaggtcataatggccactaataggattgatattttggaccctgctcttctgcgtcctggaaggatagatcgtaagattgagttccccccaccaaatgaggaagctcgtttagatatccttagaattcattcacgtaaaatgaatcttacccggggtatcaacttgcgtaaaattgccgagctcatgcctggagcttcaggtgcagaagtaaagggtgtctgtactgaagcagggatgtatgccctgagggagaggagaatccatgtcacccaagaagatttcgaaatggctgtggccaaggttatgcaaaaggactccgagaagaatatgtcaatcaagaaattatggaaataa

SEQ ID NO: 1405 - DNA, 603 bp, Nezara viridula
atggttaagttgtatgcgcttcatattttatacaaaaacttaaatagtgcagtatggttgaagacagcttatgatgtccaaagttttgggtattttcaaagaggaactgcccaggacaccatggcttttgccagtaaaacaatagttgaaaggactcaatctgcgaccaggcaatctgtcaaagaaggagattatatttgtcacgtttatgtaagagctgacaacttagcaggggttgtgatatctaatcatgaataccctcatcgagttgcccacactctaataacaaaagtattggatgaatttagtgctaagtatccaccttcaacttgggcatcagcaaatgaagccaacattgattttcctgcattagcagctcaccttcaaaaatttcaaaatccaaaagaagctgatgctcttatgaaaattcaaagtgagcttgatgaaacgaaaatcattcttcataacaccattggagctgttttagagcgaggagagaaattagacgatctcatcatgaaatcagagagtctcagttatcagtccaaagcattttataaaactgctaggaaaacaaattcgtgctgttcgtatgtcggttaa

SEQ ID NO: 1406 - DNA, 747 bp, Nezara viridula
atgtttctcacacgttcagagtacgacaggggggtcaatactttctcacctgagggtagattgtttcaagtggagtatgccatagaagctattaagttaggttccactgcaataggtgtttgcactccagaaggagttgtaatgggagctgaaaagagaattaagtccacattaatggagccagaggctgtagagaagattctgcaagttgatgatcatattggttgtgcagtaagtggtttgatggctgattctagaaccttagtggagcatgctagagtacagtgccttaatcattggtttgtttatgatgaaaagatgcctatagagtcggctgcccaggcagtttcaaatttggctatcagattcggtgatgctgatgaagatgctggcccagcgatgagtaggccttttggagtagctgtcatgtttggtggatttgattatagaggacctcaactctatcatatggacccttcaggtacattcatttattttgatgctaaagccataggttctggaagcgaaggagcacaacaaagacttcaagagttgtatcataagggaatgagcctcaaagaagctacacatatgattttgactattttgaaagaagttatggaagaaaaattgaccgataacaacgtagaaatagcagtagtaactgcagaagagaaacaatttcgtatgtataccaaggaagaagtttctaaagtaataggagaaacgcaggcacaaacttcataa

SEQ ID NO: 1407 - DNA, 1167 bp, Nezara viridula
atgagtgaatactggctaatatcagctcctggcgacaaaacatgccaacagacatgggaaaccatgaacaatcttaccagtaaacagcacaatttgtctgaaaatttcaaatttcatattcctgatttaaaggtgggaactttggatcagcttgttggactttctgatgatttaggaaagcttgacaattttgttgatcaggtcactcacaaagtagctcagtatctgggcgaagttttagaggatcagaaggataaattacaggaaaacctaatggctaataacactgatttatctacctatattacaaagttccagtgggatatggctaagtatcctattaagcaatctcttcgtaatattgctgatattataagcaaacaagtgaatcaaattgatgctgacctgaaaacaaaatctaccgcttacaataatctaaaaagcagccttcaaaatatggaaaagaagcagagtgcaagtttgttgacacggaacttagcagacttagttaaaaaagaacattttattttagactctgaatatctgacgacattattagttgttgttccaaaatcaaacttcaatgagtggaataccagctatgaaaaacttactaatatgatagttccccgttcaagtcaacttgtttatcaggattctgattttggtttgttcactgtctcattatttaagaaggttgtaaatgattttaaattaatggctagagaaaagaaatttgttgtacgtgattttatttataatgaagaggaactagctgctggaaaaaatgaaattacaaaattggtgactgacaagaagaagcaatttggacctctagttcgttggctgaaggtcaattttagcgaatgtttttgtgcttggatacatgtaaaagcattgagagtttttgttgaatctgttttgagatatggtttacctgttaacttccaggctatgttgatccatcctcacaaaaagtccgttaaacgtttgagagatttactgaatcaactatatgcaccattggacagtagtgctcaacagcaaggaaatcaaggtggtggtaatgatagtgtggacattcctggattaggattcggccaatcagattattatccatatgtatattataaaataaatattgatatgttagacacaaaggcttaa

SEQ ID NO: 1408 - DNA, 1653 bp, Nezara viridula
atgtcaactttaggcgttccgttatcggttggaggcacaagacaatcaggagctccagtcagaacccaaaatgttatggcggcatgctccattgcaaatattgtcaaaagctccttgggtccactcggattagacaaaatgctggttgatgatattggggatgtcaccgttactaatgatggagctacaattctacgactgcttgaggtagatcatcctgctgcaagggttcttgtcgatctagctcagcttcaagatgaggagattggtgatgggacaacttctgtggtcatcattgcagctgaacttttgaggaatgcagatgaattggtcaaacagaatattcatccaacttctatcatcagtggttacagacttgcttgcaaggaagctcagaagtatattcaagaacatctgtgcgtcagtgttgaagaattgggaaaagattctatcataaatattgcaaaaacttccttgtccagcaaagttattggaattgatgatgacttctttgcaaccatggtagtcgaagctgcacaggctgtaaaagttagtgatagcaaaggaaaagctacctatcctattaaagctataaacattttgaaagcccacggcggatcagctaaagaaagcattttggttaatggatatgcccttaattgcatggttgcatcaatgggaatgactaagcgagtagaaaatgctaaagttgcttgtctcgatttctctttacaaaaaacgaaaatgaaattaggtgtagaagttttagtagaagaccctaatcagttagaagcgattagagatagggaagctgatattacaaaagacagaattcaaaaaattcttagtgttggaaccaatgtagttcttttgagtgggggcattgatgacatttatatgaaatatttcatcgaagcaaatgctatggtggtaaggagggttaaaaaagctgacttaaaacgaatcgctaaagcaactggtgcctcttttgcaacatccctaactaatatggaaggtgaagaatcatttgatgctagcttattaggagaggccgctgaagtgtctcaagaaagaatttgtgatgatgagcttatccttgttaaaggtccaaaagcacactcagctgcctccataatcctccgtggacctaatgattatttctgtgatgaaatggaaagatcaattcatgactcattgtgtgcagtaaaacgggttctcgaaagtaaaacagttgtggctggtggtggagctgttgaagctgctttatcaatctatttggaaaactttgccacatctttaagttcaagagaacagttggcaatcgctgagtacgctaaatcactattggtaattccgaaaatacttgcggtcaatgcagctcttgattcgactgatttagttgctaaattgagagcctaccacaacaccagccagacgaaaaaagatcatgctcacctgaaatggcatggacttgatttgtatggaggtgcagtgagagacaacaaaaaggctggtgtccttgaaccaactatttcaaaaatcaagtccttgaaattcgccaccgaggctgccatcacgattcttcgaatagatgacctcatccgtctggaagctgagaaaaaagatcatcaaggccatggggatatgaactaa

SEQ ID NO: 1409 - DNA, 777 bp, Nezara viridula
atgttgaatatatctgatgctatgacatcttttgagcgtaattctatcagaagtaacgacagcacacttgaagatcatcaagttaaaattatcaaagctccggattttctaactaggactttatatcctatgacaactacagcatctgtggttggaatcaaattcaataatggtgttgctattgctgcagatgttggtggctattatggatcattaaatcgtttcaaatctcttgataggctctacaaagttaataacaacattgtaatgacaacaactggagattatgctgattttcaatacatgagagagttaattcaacaaaaagttatcagtgaagaaattttagatgatagtttttccttaaaagccttttctcttcatacttggctcactcgcctgatgtacaacagaaggtcaaaatttgatcccttgtggaataatgttattgttgctggttatgataacaatggacccttcctgggaatagtggacaaactaggtatgagttatgaagatagttgtgtagccactggtatgggtggatacctcgctactccgctcttgagggatgtgtttgaacgcggtaaaggaaatttgactaaacaagaggcccatgctgcccttcagaaatgtatggaaatcttgtactacagagatacacaatcacttcctaagttccgaattgcaacagtcaccgaagaaggtgttgaaatatcacctgaattagaagtagaaggtaattgggaaatcgtcaaacattctaagggattttga

SEQ ID NO: 1410 - DNA, 2052 bp, Nezara viridula
atgaatgatcatcttaagaaattttctggtgtcgatttcaaccctgacaaatatgtgaaagaaatatctcaagtctgtgttggtggaattgaacttcaaagccacagagctaaaattcaggctcttgctgaagaaacaagccaaaatttaaagaaaaatgtttataaaaattatatgcagttcattgaaactgcaagagaaatatctcatcttgaaggggaaatgtatcagctatcacacctattatcagaacaacgtgcccttcttggttcaatgagtaattcaggtgctgaaccagttcttcaagcttcaagcaaagcccaagaagaaaaaagaattgcagctttatcatctgttttggagatcatagaatcctgcccggatcttcttgacactccaggtagggaacttttgcacgaaggtgacattgtggaactagatcctctagaaaatacagctcttcatcgaacccgggctttactcttttctgatatgtttctgattgctacctggatatcagaaaggaaaggacaagctaagtataagtttgaaagcagttatgatctgggaagcatggctgttgtaaatgtgagggatcttggacaagttaaacatgcttttaaacttttagtatttcctgatactaggctttttcaatgtgttaataatgaagccagggaggaatggctcaaaaggtttgatgaagctaagaaagctcgattgaattcagaacaaattaaaaaaaaagatgataatgtaaaagaaccgcataccattcatgagcaattggcaaaaccccctgagagaactgattcggttgaatttggatctaatccatttggatttgtgctggatgatgatgaagattgcaatgcactcccagaatggttgactgaagcagctgatgatcttgatgtatctatagctcaaagacattttgaagaagcctatgcaatcattcaaaaagccgaggagtattttgcgtctgcacaagatgatcaatcactaacagatataaagtccaaagtggagaataggaaagatgtattgatcagcgttctcctatcagagttgaacgtcagtgctgaaaaatcattacaaggaggtcttcgagctagccggagagctgttaggctacttaatcagctgaacaaatcaacccaggcatgtgaactgtatttgaaagtttgtacaaacctcctaaaagcacaaagtaaacgagtgaaaagagagggcgcaacagtggcatacgtcaagagattatcagaagtatatttttcaaatctagcgtctataacttctgaatttcaataccgtgcattccctcacaatcaagattgtacatcagcttttgttgtatgggtgtcaatggaagcctctcatttcctttcacacatcataaagcaagtattcatccctcagacacctctcggtacgctagcagagtgcatagacattattaggaagcaatctcagcagatgtgtgagcttggactagatctaagctaccaggttaatggccagactatgaccgcagttacacgcgcagtagctgaagcaggagagaaagctgttgatgccgtcaaggtgagagctgccgaagacccatggagaccgtccaggcagacgcagcaatcagtcaacaagattcagtcagagttagggctccctgtttcagaatatctggctcaggatggagtctttgagctgactgcaaacagcctgtcttttgctaagttgttatcctctttgacggatgagggtcttatgatatcctgtcaggatttggagttcgcactaagtaaagtattgaaggaagtacttaaggcacatttgaaccatctttcagcctcttactctagtaataaatttggttctcagagaagtcttatacagcaaaatgcaaagttcattctcgatcaattattagaatcagtgcagaggaaatatagtgaaaaaatgggccatagatgtaagaaattggacacattaaggaaagaatttaattttattttgaaggagagtaaaacaacaattactggttacatttag

SEQ ID NO: 1411 - DNA, 3780 bp, Nezara viridula
atggatgaagtgaaaaaacttgagcacctttcattggtgtcgaaaatatgtacagaacttgaaaatcatttaggattaaatgacaaagatttagctgaatttatcattgatttggcgtcaaagaataatacttttgaaagcttcaagaaagccttactagataatgatgcagagttttctgattccttcatttcgaacttgctgaggatcatccagcatatgcgacctaagagcgagctaaccgtaacgaaagacatgactaaacaagaaaaactgagcatgaaatttccaggactagctatccccaatgatgtgcagccgatgaagagccataatgagaaaaagttgaatctgtctacgattaaggaagaccctgaagacaatgaagtcgaagatgcgatggcagctcttgaagctttagctccttctaaagaaatgaaattcaattacaagactgaaagagcatccaagtctccagaaaaaattattaaacaagaattggagaagcccagaaaacgtagtcgcagccgtagtagaaatagagacaaaaagagaaataggagtaggagtagaagtagaggaagaggaagaagtaaagagaagacatccagtaaaagcaggcagagaagtgtgagtcgagggagaagaagaagaagtagagacagaagttctagtcgaaatagaaatcatgtaaagaacagggatagagaaaggagagacaaaaatgatcgtaggagtagaagcaggagcaatggtagaaagaggaatgaaagaagtcggagcaggagcactggtaggagaagaaatgacagaagtcggagcaggagctatgacagaaagaaaaatgacaggaaacgagaaaatgaagatgagaagaataagaatgatgaacctcttgaacccgaagttggtaaaatatataatggaaaagttaccaatatcgtttcttttggttgttttgttcaaatcgagggtttaaagagacgttgggaagggctcgttcatatatcgcaactgagaagggaaggaagagttacgagtgcttctgatgtcgtttctcgtggaatgaaagtcatgatcaaagtattgtcggtcgctgggcaaaaggtgtctctgtctatgaaggatgttgatcaggaaactggaaaagatcttaatccaactgttcgtcatgccgccaataaggacagagaagaagaagcttcgatgcgaaaccctgaccgcccgacgacgcttctagacttaggctccttcgatgatcatgacgactttcagagcagaaaaagggttaataggatatcttcacccgagaaatgggagatcaagcagatgttatctgcaagttgcattgataaaagtgagcttcctgatttcgatgaagagaccggattgcttcctaaagaggctgccgaggaagaagatatagaaatagaaatcgtcgaagaggaacctccttttctacaaggacacggaagaaatttacacgatcttagtcctgttaggatcgtgaaaaaccctgatggttctctagctcaggcagccatgatgcagagcgccctcgcgaaggagagacgggaacagaaaatgttgaacagggaacaggaaatggaccaagtaccgacgggcttaaataaaaattggatcgatccacttcctgagagtgatggtagaactctggccgcaaacatgcgtggaattggcctaacgaaccaagatcttccagaatggaaaaaacatgttattggagggaaaaagagttcttttggtatgaagacaaacatgacccttttggaacagaggcaaagtcttccaatttataaactcaaggaggagctcatcaaggctgttaccgataatcaaattttaatcgttatcggtgaaacaggatcaggaaagaccactcaaatgactcagtatttggccgaagcaggtttcacgtccagaggaaaaattggttgtacacaaccgagaagagtcgccgcaatgtccgtggcaaaaagagtggccgaggagttcggttgccgcttaggccaagaagtcggctacaccattcgtttcgaagattgtaccagcccagaaacagtcatcaagtacatgacagatggtatgttacttcgagaatgcctcgtagatttggatctgaaaagttattctgttataatgttggatgaagcccatgaaaggactatacatactgacgtgctcttcggactcttaaagcaagctgttcaaaaaagatctgaactaaaactaattgttacatcagctaccttagacgctgtcaagttctcacagtatttcttcgaagcacctatattcaccattccaggtcgtacattccctgttgaagtgctttatacaaaggaacccgagacagattacttggatgcatcacttattaccgtaatgcaaatacatctgagggaacctcctggagatattttgttatttcttacaggtcaggaagagattgatacagcctgtgaaattttgtacgagagaatgaaatcactaggtcccgatgttccagagcttattattctcccagtttattctgcacttccgagtgaaatgcaaactcgaatatttgaagcagctccacctggatcgagaaaggttgtcatagcaacaaatatagctgaaacatctcttacaattcatggaatcttctacgtcgtcgatcctggatttgttaaacagaaagtctacaattcaaagacaggaatggactctctcgttgttacacctatctcacaggcacaggcaaaacaaagagcgggtagagctggtagaacaggaccaggaaaatgctataggttatacacagaacgtgcctacagggacgaaatgttacccactccggtacctgaaattcaaagaactaacttggccacaactgtgctacaactgaaaacgatgggtattaatgacctcctccatttcgattttatggatgctccgccagtcgaaagtttaataatggctctcgaacaacttcacagcctcagtgcccttgatgacgaggggcttcttacaagacttggaagaaggatggcagaatttcctttagaacctaatttatcaaaaatgttgattatgtcagttcacctgcagtgttcagacgagatacttactgtagtatcaatgttatctgttcaaaatgtattttacagacctaaagataaacaagcgctcgctgatcagaagaaggctaaattcaatcaagcagaaggtgaccatctcacactactagccgtttataattcgtggaagaataataaattcagcaatgcgtggtgttatgaaaattttgttcagataaggacgctgaagagagctcaagatgttaggaaacaattgttgggaataatggatcggcacaaattagatgttgtatcagctggtaaaaatacagtccgtgttcagaaagctgtgtgctctggtttcttcagaaacgctgcaaagaaggatcctcaagaaggatataggacattagtagatagtcaggttgtttatattcatcctagcagtgctctttttaatcgacaacctgaatgggttatttatcatgaacttgttcaaacaacaaaagaatacatgagagaggttacaacgattgatccgaaatggctggtcgaattcgcaccagctttcttcaagttttctgatccgaccaaactcagcaaatttaagaaaaatcaaagactggaacctctctataataagtatgaagaacctaatgcttggagaatatcaagagttcggcgaagaagaaattaa

SEQ ID NO: 1412 - DNA, 1245 bp, Nezara viridula
atggcacctactagaaaatctgaagggctgctggcccgagttaattttcccttatacactttgcaaatgctaacaagtcgtcatgttcttgttggtggaggtggaggttcagctaaaactggggttgccaatggttttgaaatttttgagttatcttatgacggaacccgtttttctgctgaagaagttattcgacatgaaactggccctaaagttgtgatgaactcagcttgttttagtgacaagaaaagtacttttttagttgctgggcaagaaagccactgtcagttatacagagttggtattagcgtggagaaggaggtttccgaagaatcaatgaatggcacatcggatccacctaatctcagacacagaaaaacttctaaaaatcaccagaatgggatcagtgaagtgacaaataatgttaaaaagaaattagtttttaaattcaactctggggatagtatacagtctgattttagtgaaaaggaaccatgccaaagggtagttacaatatctcgttgtggcggttggatggcaactggtggcactgatggtattgtaaggatctggtcatttcctggccttcgaatgattagagctcttaaggcccacacgaaggagctggatgatttacatttcagtcctgattcaaagcaggtagccagtgtggcaaaagatggacaagcaattatttgggagctgaagtcaggaaaacaggttcataaacttgattggactcatcctacaggaatcaaatatctcttcaaacgatgtcggttcggtgtggttgagggtaaaggttgtagattgtttactacagctaaccctgtggctggtgggaaggaagcccaaggctggatccacgcctgggacgatggtcgtatttccaagtcgactgctgtatctgaacctacttcagcacttgctgttagagacgatggtgttttcattgctattggcaccatgttcacaggatctgtatccatttacatagcattctcccttcagagagtgctgcatgttgagggtgcacattcaatgttcgtaactggggttgaactgttaccctgttcttctgcatggggtgcgatagaagctgctgctttaagtatttctgtcgataacagagtctgtattcacagcttaccatttagaaaaacgttaccgccatggttagtgatcatcattattttgttcactctattgtttacttttgtattgtgcagcttcatcggcctttaa

SEQ ID NO: 1413 - DNA, 1251 bp, Nezara viridula
atggcgggtgcaatgttgtttgagaggactgtctcttccagagatagggataatagtcgaattcttccaacttctagcagaaacgttgacgaagaaaatgaagaagacatcaaaaataaggaacaaggaattttgcagttgggagagcaatataagaaagaaggcaaagctaaagagttagcagagcttatcaaggcaagtagaccatttcttagccagattagtaaagctaaagctgcaaaattagtgcgttctttggtagattatttcttggatcttgaagctggaataggaatagaagttcaactttgtaaagagtgtatcgaatgggctaaagatgaacacaggacttttctcaggcagtcactggaagctaggcttatcgctctatatttcgacacaggaatgtttacagaagcactacagcttggctcaagtcttcttaaagaattaaagaaattagatgataaaaatttgcttgttgaagtccttttgttggaatctaaaacttatcatgctttgagcaacctttcaaaagccagggctgctttgacatcagccaggacaactgctaattccatatattgtccacccaaaatgcaagcagccctcgatttgcaatctggtatattacacgcagcagatgaacaagatttcaaaacagcttactcatatttctatgaagcttttgaaggctatgatagtgtagagagcccaaaggctttagttgctcttaaatatatgcttctgagtaaaatcatgttaaacacaccagaagacgtgcagcagttggttagcgggaaacttgctcttaaacatgctggtaaagatattgatgcaatgaaatcagttgctcaagccagccataagagatcacttgctgatttccagctaactttaaaaaattacaagaaagagcttgaggaagatccaattgtacgagctcacttgggtacactctatgataatatgttggaacaaaatttgtgtaggatcattgagccttattccagagctcaagtcgattttatttcaaaatcaattaaacttccccttcctcaagttgaaaagaagctttctcaaatgattcttgataagaagttcaatggtattcttgaccaaggtgagggagttcttatagtgttcgaagatgcgattgttgaaaaaacctacgaaatggccctggaagttattaacagcatgggtaaggttgtagacacattatatcaaaaagctaagaagctctcttaa

SEQ ID NO: 1414 - DNA, 1686 bp, Nezara viridula
atgtctaccaagtcacctaaaaaaactactccagctggtgcttcatcagcaggtccttctagaagttcacctagaaaaagtgaaactcctactcctcaaggtgctagaaagagtcctttaagtcctacaagatatagtagacttcacgaaaagcaggaacttgctaatttgaacgatcgcttagcatgttacattgacagagtcaggaatttagaaacagaaaataaccggttaactcgggaggttaaaagttctcaagaaaatattacgagagaagtaactagtgttaaatctttatatgaaagtgagttatcagaagcaagaaaacttttagatgaattatcgcgggaaaagacaaaacttcaaattgatacacggaggttgtatactgaaaatgaagaacttaaaactgagcttgaaaagaagactaaagattgtaatattctccagacttcactttctgtcagtgaaaatagacttgcagatctcacaacaaaatataatcaactgcaaggtgaaaggaagaagcttgcagatgaaaacaaggcattggaaaatgaaagaaataaactttcaatccagttatcagatacacgaaaacatttggaggaagaaactctccagagagtagatctagaaaatgctgtgcaaaccttacgtgaagatttttcattcaaagaacagttacatgaacagcagttattggaaactcgtactaaaaaacaagtggaaataagcgaacttgatggtagattaacccaggagtatgaagaaagattataccagagtctccaagaaatacgcgatcaatatgaatgtgatattgaaaataacaaggaagagattaaaaaactgtatgaggaaaaaatccgcagtcttggtagtcaattgacacggaacagcaatgcagcagcaatggctattgaagaaatgaaaaatatgcaagctaaacttaatgagcttaataggaaattacttgacttagaagctgacagaaatgcagcccagcaaaaggctagagatttggaaaagattttggaacaggctaaagctcaatatatggaagaatatagtcagagagaagctgaaatcacaactcttcgtgaagagatggctcaccaagttcaagaatatcaagatttaatggatatcaaagttgcattagatttagaaatagcagcttatcgaaagttacttgaaggagaagaagctaggttgaatataacacctgtgagttctcctgctcagacttcttcccgtaaatttttagggaggaaaaggaaacgtactttcattgaagaatctgatgaaacagatctttctaattattctgttacttcttcatcaaaatgtgacgttgccatctcagaagtttgtagtgaaggtcaattcattaaacttcttaataaatctactaaggaagtatcgcttgggggttggcaactaactcgtaaagctggagattcctccacaatttacaagtttcatcgaaatattaaaatggaacctggggctactatcactgtttggtcttcagatgttccagataaatctcatgaaccaccagaaagtttacttatgaaaggtcagcgctggatggttgctgatactatgacaacagttttgttgaatcctgctggagaagaaatggctatatctgaacacaaaaaaacaacaactgagtga

SEQ ID NO: 1415 - DNA, 2409 bp, Nezara viridula
atggctgatatgaaaagtaatgaagatttgtccactgctatcctgaaaaagaaagatcggccgaatagattgattgttgaagatgcagtcaacgatgataattcagttgttgctctttcacaggctaagatggatgaacttcaattatttcgtggagacactgtgcagcttaaagggaaaagaaggaaagaaaccgtttgtattgtgttatctgatgatacctgccctgatgaaaaaattaggatgaacagagttgttagaaataatctacgagttcgtttgtcagatattgtttcaattcaagcttgtcctgaagtaaagtatggaaaaagaattcatgttttaccaatagatgatactgttgagggattaacagggaacctttttgaagtctttcttaaaccatactttctggaagcatatcgtcctattcataaagatgatacatttgttgtcagaggtggtatgcgtgctgttgaatttaaagtagtagaaacggatcctgctccttattgtattgtagcacctgacaccattattcattgtgagggcactcatatcaagagagaggaagaagaagaagctttaaatgctgttggatatgatgatattggaggttgtagaaaacaacttgctcagattaaagaaatggttgaacttcctttgagacatcctagcttattcaaagccattggtgtcaaacctcctcgtggaatattactttatggaccacctggaactggtaaaacattgatagcacgtgctgtggccaatgaaacaggagcatttttctttttaatcaatggtccagaaattatgagtaaactagcaggtgaatcggaaagtaacctgcgtaaagcatttgaacaagctgaaaaacatgcaccttccataatttttatagatgaattggatgctatagctccaaaacgagacaagacccatggagaagtagagcggagaatcgtctcacaattgcttactttgatggatggtcttaaacaaaattctcatataattgttatggctgctaccaacaggcctaattcaattgatgctgctcttagacgtttcggacgatttgatcgtgagattgatattggtattccagatactactggacgtttagaagttcttcgaattcacacaaaaaatatgaaacttgctgatgatgttaatttagaacagattgcagccgaaacacatggtcatgttggtgctgatttagcatctctctgttcagaagcagctcttcaacagattcgtgaaaaaatggatctaattgatttagaagaagaccaaattgatgccgaagttcttaattctcttgctgttaccatggataacttcaggtatgctatgggcaaaagtagccctagtgcccttcgtgaaacagtggttgaagttcctaatattacttgggatgatattggtggtctcgataatgttaaaaaagagttacaagaattagttcagtatcctgttgaacatccagagaagttcttgaagtttggaatgcaaccttcccgtggtgttttgttttatggaccaccaggttgtggtaagactttgttggccaaagctattgctaatgaatgccaggccaacttcatctcggttaagggtcctgaattattaactatgtggtttggagaatccgaagctaatgtccgtgatatttttgataaggctagagctgctgcaccatgtgttctttttttcgatgaactggattccattgctaaatcaagaggtggaagtgtcggagatgctggaggtgcagctgatagagttatcaaccaaatactcacagaaatggatggtatgggagccaagaaaaatgtctttataatcggagccactaatagaccagacataattgatcctgccatactgagacctggtcgtttagatcagctcatttatatacctttacctgatgagaagtcaagagaagccattttcagagcaaacttaagaaagtcacctgttgctaaggatgttgatttacaatacattgccaaagttacatttggttattctggagccgatcttaccgaggtatgtcaaagagcttgtaaacttgccatcaggcagtcaattgaagcggaaattaaaagagaaaaaagtagattagatggagctacacgaatggatatggatgatgaagatcctgttcctgaaataactcgtgaacattttgaagaggcaatgaggtttgctaggcgatcagtcactgataatgatattcgcaagtatgaaatgtttgctcagacattacaacaatcaagaggttttggaactaattttagattccctgctagctcaaatatccctagcgcaccaggaggtggaggaacagaaactaacaactttccagatgatggagatgatgacctttataattaa

SEQ ID NO: 1416 - DNA, 834 bp, Nezara viridula
atgacggaccagcaaatggactgtgctcttgacttgatgcgaagattgcctcctcaagaaattgaaaaaaatttgagtgatctaattgatttagttccaagtctttgtgaagaactgttgtcttcagtagaccaacccttaaaaattgccattgataaaggggttggtaaagattatttgttatgtgattacaatcgggatggtgattcatacagatcaccttggagcaatacatatgatcctcccttagaagatggttcaatgccttctgagaggctaagaaaactagaagtagaagccaatgccgctttcgatcaatatagagagatgtattttgaaggcggtgtgtcttctgtttacctgtgggatttggatatgactggttttgcaggtgctattttaattaaaaaggccggagatggttcgaaaaaaattaaaggttgctgggattctattcacgtagttgaagttcaagaaaagacaactgggcgaaatgctcattacaaattaacttcaactgttatgctttggctgcaaactaacaaaactggctcaggtacgatgaacctgggaggtagtttaactaggcagatggaacaagatgcacctgtttcagaggcttctccacacattgctaatatcggccgaatggtagaagatatggaaaacaaaattaggaacatacttaatgatatttattttggaaaaactaaagacattgtcaatggcttaagaagcacacaggcattatcagaacagaaagcccaggctgctctgaggcaggatcttgctgtagctcttcagaagcggcaggcaaagactgcggaaaattga

SEQ ID NO: 1417 - DNA, 3489 bp, Nezara viridula
atgcagcaaatggactccttgcaacctaacaacgcaacaggactggtgaaaactggactagaggcgggggccggtagcggcatgaaagagcccccgccacgagaggagccggtcctagacccaatcaacggtgttgtccagccaccggtcatacctccatcccacaggcctggccgagtaaccaaccagttgcaatatattcagaaaaatgtcctcaaagcagtctggaaacatcagtatgcttggcccctacagcaacctgtcgatgctaacaaactcaatcttccggattatcataaagttattaaacatccaatggatcttggtactatcaaaaaacgactggaaaacaattattattggtgtggtgcagaatgtattcaagatttcaatacaatgtttaacaattgctatgtttataacaaacctggagaagacgttgttgttatggctcaaacattggaaaaactatatttgcaaaagctggaaacgatgcccaaagaagagattgaactggagcctccaccacctaaaggctccaagccagttaagaagcggcctggagttataggacctggaagaggaggtgggactactggtgccgggagggggaggccttccaattcaaccacagcagccgcagcagtagttgctgcccctgtacctcctgccactcctccgtctcaccttccagcgaccatacctggttcaactgctaccactaccgtacctaccacacaccataactctcttcctccacaggttgggcagccagcagctgtaccctccaacttcaatgccactaccgttgatcctctcttaacacctggattggctcccggtgtgggtccaaaaggtggcaaaggggccgtcgtccagaccccaacggcgcccaaaccgaagaaaggggtcaaaagaaaggctgatctagcaaatgatagccctgccgggtttgacccgacctacaccccaggtgactccaaagctgccaaggttggcactaggagagaatctggaaggcaaattaaaaagcctcaaagacagtcagatgatggtatgccgttttctcaaagcccaatggcaccctattcacattcgaattcaactcaggcttctcacgaaaagccaaaagaaaaactttccgaaacattaaaagcgtgcaatgaaatattaaaagaattgttttctaaaaaacatttcaattatgcgtggccattctataaacctgtcgatgctgaatggctcggtttacatgactatcatgatattattaagaaacctatggatctcggaacagttaagcaaaaaatggacaatcgagaatacaaaacagcgactgaatttgctgcagatgtaaggctgatatttacaaattgttataagtataatcctcccgatcatgatgttgttgcaatgggcagaaaattgcaggatgtttttgaagtcagattcgctcaagtacctgaagactcccctacatcgactgttcccgaaaaggaagacgaatccacctctgggtcatcatctggctctgaatccgaaactgataattcagaagatgaaagggcccgcaaacttagtcaattacaagagcagttaagaatcatgcaggaggagatgagaaaacttgttgaagaaggcaccgtaaaaaagaaaaagaagaaaaaagatgggtcaggttctggtggaagctcttctagtaagaaaaggaaatctgctgatagaacacttggtaaagctgtcgatggtggacttttagctggtgtcggagcgcctgctatcatggaaatgaaggctaccgatggtgtaaaggccgttcctcctccaggcaggaatgctgtcccctcacctcaggttaaaccaaacaagggcaaagcccccggcaggacaccaggaaaaactaattctcagggtaagaggccaaagccaaactccaggtctaccaactcaaagaagaagaatcctgtggtcacatcagagtttaactcagaagatgaagataacgcaaagcctatgtcttacgatgaaaagagacagctaagcttggatattaacaagctaccaggtgataagcttggcagagtagtccatatcattcaggccagagagccctctttgagggattcgaatcctgatgaaattgaaattgactttgagacattgaagccatcaaccctgagggagctcgagtcctacgttgcatcatgtctcaggaaaaagccacataagaaagtttctgcaaaatcaaaagatgaagcgatggcagagaaaaaacaagagctagaaaaaaggcttcaggatgtgactggccagttgggaggatcagcaaagaagcaagctaaaaaacaaggtcagggaaggctttcagcatcttcatcatcaagctcagattctgatactagcagttcaagtctctcaagcagttcttccgactcatctgatagcgaagcagggaaagctgggcgtccaccgagaaagaaaaacaagaaaaatcaccaattagcaacaactgctgcttcagctgtccaacagaatcagacagtccccagcttgaccatgacaacagctaccggtacaattgtaaataaatctgtcggggctacacagcccgtagtaccgttagcaagcaccaataaacttaccgtacctacagtatctgcagtcgcacaccctgaacctgtgaaacctgtcgtggcatctcatagtagcctgcctcaacaacctgcgaggccgaccgctacagcagcccctctcacaaccgctaagagagcgtcaatccctacacctgccacagccttaggtatacctcctcctgcgccaaccagccttgaaacaggtcctgtcgagattaaacaagaattggatgttcctgtttcactagctcctgtgccagaccacttggatttcaaaaaccttttggaagttaagcccgagttgaatgatattgtaacagggatgccttcagtatttgatcctctgcccgactcaccccccataataaaggaagaaaaacatgccatactccctcaccacgctgatggacatctgaataactcacttccccctataagtaacatacctgttcaaccaattataccgagtgctgcacttccaacaacaccacacgtcttagatatgaacaaaaattctcagcctcctcagcttcctcagacaccagttttaccacactcctttaagcctaagactgtcgaacaaaacttgaaaaacgccagttcatggtcttcacttgcccaatctccaacacctgctcttaccccaactccacccactgcagcggcactgaagtcatcgatggctgacagttttcaagcatttaagaaacaagctaaagaaaatgccaaaaagcgtgccctcattgagcagcaagaaatgagacggcatcaaaaagaacaggctgaaagggaaagattacgtgttgaaaatgagaagaggagagaaagagaagaagaagaagctttggaaaaggcc

SEQ ID NO: 1418 - DNA, 1284 bp, Nezara viridula
atgattcccccgtcttctcggccacaggtcactgtatacagtgacaaaaatgaaccaactggtgaattattgactctccctgcagtctttaatgctccaattagaccagatgtagtaaattttgttcatcaaaatattgctaaaaatcatagacaaccctatgctgtcagtgctgaagcaggtcatcagacttctgctgaatcatggggaactggacgagctgtggctcgtatacctcgtgtaaggggtggtggtacccatcgttctggtcagggtgccttcggtaacatgtgtagaggtggacgcatgtttgcaccaactagggtatggcgcagatggcatcgtaaggtgaatgttaatcaaaagaggtatgcaatggtttctgctatagctgccactggagtgccagcactcgtgatgtctaaaggacacatggtgaatgaagttcctgaaattcctcttgtagtgactgataagattcaggagtatactaaaaccaagcaggcaacaatcttcttacatcgcatcaaggcttggacagatattcagaaggtatacaagtctaaaaggttccgtgctggtaaaggtaagatgcgtaataggaggcgcattcagcgtagaggacctctcattatctacggccaggatcaaggcctaactcgtgcttttcgtaacattcctggtgttgatcttatcaacgtttcacgattaaacttacttaaactggcacctggtggtcacgtgggtaggtttgtaatctggacccaatcagcttttgatcaacttaatgctctctatggcacatggaagaaaaaatcaactttgaaaaaggactacaacttgccaatgcccaagatggtgaatactgatctgtcccgactttttaagtctgaagaaatcaagagtgtcctcaaacctccaaggaagaccatagtcaggagggtaaggaaactgaacccattgaggaatacacgagcaatgctgaagctcaacccatttgctgctgttctgaagaggaaagctattttggctgacaggaaacttaagcttgagagggctattgagagatcaaagaaggaaggagttgagcttacccctcatcaaaagaggtatgttgctatgcttgagagaaggaaagctcagatcaaagccgccaaggctgctaagcctaaaaaggttaagaagcctaaggctgaaaaagccgctgctgatgaagcaaagaaagctgctgtaactaaaaaaccagcaaaaaaggctgctgctcccaaacctcccaaaaaatga

SEQ ID NO: 1419 - DNA, 5469 bp, Nezara viridula
atggcagatttcatagattctgaggctgaagaaagtgaggatgaggaagagttggaagtccatgagaaaaaaaagttgaaacggttgaaagctatggaaagtgatgaagatgaggaagaagaagatgatgaggaacgtcttcgggaagaattaaaagatttaattgatgacaatccaatagaagaagaaagtgaaagtgatggtagtggatctgaagaaggaagtggagaagatcggggaggtgagaaacgtaagaagcatgatgaagattttgatgatcgtcttgaagatgaagattatgatttattggaagaaaatctgggacgaaaggttgaaagaaggaaaagatttaaacgattgcgaagaattgaagatgaagagtcagatggtgagagagtcgaagatgaaggtgaagttagagaagctatagccaatgaactcttcgaaggatctgaccatgaaccagaggaccgagaagaagatcggagctcttccagaggcccagcacctgagagatatgaagatgaagaggaagatggtgaatattcagatgctgatgattttattgttgacgatgaaggtagacctattgctgacaaaaggaaaaaaagaaaacctatattcactgatgctgctttgcaagaagctcaggatatatttggagttgattttgattatgaagattttgaaagacttggtgaggatgaatatgaagaagaggaagatgaagatgagtatgttgatgaagaaggaattgaagatagtgagagaaggcggaaacctacaaagaaggctgccaggaagaaaccaactagaaaatctatctttgaaatttatgaacctagtgaattaaagagaggtcatttcactgattttgacaacaaagttcggaatacagatattccggaacgaatgcagcttagagaaatcccagtgacgccagttccagaaggttctgatgagctatctgaggaagctgaatggatttataaacaagcattttgtaaaccaactacatctaatcaggaatggggcaatacgatggagagaggaaaaccaaagaaggagcctcaaacagttgagaagattaaaaaagctcttgattttatgagaaatcaaaattttgaagttccttttatagctttctataggaaagaatatgttcttccagaacttaacatcaatgatctctggagggtcttcaaatatgatgccaagtggtgccagttaagaagcagaaaaatgactttactttcattaatggaaaagatgagggactatcaggctgaacagctgatgaaggacattgatgcacctattccagatcatgttagggtcattaaggatgatgatattgaaaggttgaaagctgtccagacaacagaagaattgaaagatgttcattctcattttctgatgtattatgctgacgaggttaaaatcatgttggaagctacaagaataaaggagcgggaagctgctaaagccaaagctagacaagagaagcaactagatgaaaatggtgatcctatcgaaacagaagtagaagaacaagaagaacctcttcctcctgaaataccttctgtaaagcattctatacgttctggaccttatgcaatatgccgaaaagctggaataggtggcttggctaaacggtttggtttgaaacctgaacagtttgctgaaaatcttagggataattatcagcgtcatgatgttgaacaggagccatccttacctcttgaattggctaaagagtttgtttcatcgaaatttcaagcaccagaagatgttttgaaagctgcaaagtttatggttgcgacacaactgagcagggaacctcttgttcggcgttgtatgcgggatacgttttttgaaaaagcaaaaattgatgttaaacctaccaagaaaggatcaaaggaagttgatgaaaatcatccttgttacgttatgaaatatgtcaaaggaaaaccggtgagagatttaactgctgaccaatatttgaaactgcatattgcccatcaagataaacttttaaatgtttctattagtgatcatattggaggccatacaacaacttcctatattgaggaaattaagcaactctactaccgagatgagttcatgcagcatgtacaagagtggaataatattcgtcaagaatgtgttgacgtagcgattaagaagatgttagtcccagaactgataaaagaactccatactcgtctccttgaagaagctaaagaatttgttctgagatcatgtgccagaaaagtttacaattggattaaggtggctccatttaatgttgaattcggagatgatgatgaagatgactgggatacaagcaagggtattcgtgtcatgggaatcgcttatgtacctgatttagctcaggcctcttttgcctgcatggtggctcctgatggtgaatgtactgattttcttaggctaccctatcttttaaaaagaaaaaatacttggcgagaagatgaaagaatgcaaaaggaatcagatttggctctgatacgtaattttatactaacaaaaaaacctcatgctgttgtcattggaggagaatcaagagatgctcttatggtagcagcagatcttagagaaataatatccaatttggttgaagatgaacaatttcctcaaatcccggttgaaatcatggataatgatttagcaaaagtttatgccaactcattgaaaggagagagtgatttccgagattatccaatgttattaagacaagctgtgtcccttgcccgaagactgcaagatccgttagtggagttttctcagctatgtactccagatgacgaaattctttgccttagatttcatcccttacaagaacaactttctaaagaagagcttcttgatgttgtcacattagaatttgttaatcgaacgaatgaagttggtgttgatataaatgaagttgtagcaaatccaatttgtgggaacttggttcagtttgtttgtggtctgggtccaagaaaaggaactacgcttatcaaaattttgaagcagaccaatcagcgtcttgaaaacaggactcaacttgttacaacgtgtcatatgggacctaaagtttttattaactgtgcaggattcatcaaaattgataccaatgctcttggagacagtactgaagcttatgtagaggtattagatggttctcgtgtccaccctgaaacttatgaatgggctcgtaagatggctgtagatgctcttgaatatgatgatgaagatgctaatcctgctggtgctctggaagagattctggaaaaacctgaaaagctaaaagatttagatctggatgcttttgctgaggaattggaaagacagagttttggaaacaagagcattactctctacgacataagatcagaattaaaccacagatacaaagacctgagggttgcttaccaatctcctgggcctgagttgatgtttgatatgcttactaaagaaacccctgaaacattctacataggaaaacttgtcaccgcaacagttattggtatttctcatagaaaacccgaaaaagatcagctagatcaagccaatccggtacgaaatgatgaaacaggattgtggcaatgcccattttgtctgaaaaatgattttcctgaattatctgaggtttggaatcattttgatgctggaggttgccctggacaagctacaggtgttagaatacgattagataatgggataactggctatattcacattaagaatttgtctgataaacatgtcactgatcctgctcagagagttacacgtggtcaaatgatacattgcagagtaaccaaaatagaggtagagaggttttcaattgaagctacttcaaaatcttctgatctgttagataaaaatcatgattggaggcctcaaaaggatccttattacgatcatgaaaatgaaaagaaagatttacatacagaagaagaggcgaagaaaaacaggcaaaaattgacttatattaaaagagttattgttcaccctgcctttcataatatttcctatattgaagcagaaaaaattatggctacaatggaacagggtgatgtcattgtgaggccttcgagcaagggtgctgatcatctaactgttacttggaaagttgcggatggcatttatcaacatatagacgttagggaagaagggaaagagaatgctttctcattgggtcagtcgttgtggatcggcaatgaggagtttgaagatttagatgaaataatagctaggcatgttaatccaatggcagcctatgtcagagatatgtttgccttcaagtatttaaaagatactgaaggaggactcaaggataaagctgaagaatacttaaaagaagaaaagaaaaagaatccagcaaaaatacactacattgtttctgtatccaagaattatcctggtaagtttctgctttcctacctgccaagagctaggtgtaaacacgagtatattagcataacacctaatggattcaggtttagaggacagttttttgaatctgtgaattcattgttcaaatggtttaaagaacacttctcggatcccatacccggcacacccagtacccctagatctgcaatgtcagcacgtactccttatacaaatactcctgggccaatgccaataaatatgaatgctgaagcaatacagcgtgtagctcagaatatgccaaatcatatgctccatagtctttcacaagttgccagtcatactccccactaccctcatactcctggagcatattctctacatcagtatccagccactccatacactccgtccggccaaactcctttcatgactccatataccactccaaggtacggtagtggtatgacgcctggtcaccagagcatcatgtcttctggttctataacatcacctcaaagttcaacaccaggccaacctgttttcctccaccctggctcaattactccttcccataggactcctgtagctaattttcatagacctggtggtactcatccagaagattggggtaagaaagcagaagaatgggttgcaaagaaaagagaaaatgctagtagaacacctaggtctactccaaattctggcaccccacgccatgggacgccgcgagatgatgccaacaagaatcgaacacccaggtatgctgataatgatttcacctctccacgccctggtgcaaatttcacttccccgaggtattccaattggaacaaagttgctggcactcctaattcacatatatctgcttatgaagatgccaactatgatgccagaagcctcaaatctccacgtcctcctcctgcacagggaaagtatgacccatacgaacttggtcaaggaaaatcacctcggtattcacttactcctcgttccacacctcgtaccatcaattcacctcgttctatgtcacttggtgattcgactccactctatgacgagagcatctag

SEQ ID NO: 1420 - DNA, 2280 bp, Nezara viridula
atggaggaacctaaagaacgaaagaattgcagaaaacatagaagaaatagtgataaaactgaatataaatcgaaaagtgataaagagctttcaggtagggaaagtaaacgcagaagaaattatgattatgataaatctagcaatcattcatcaggagaaagaaggtatgattcagaacatagaaggtatgaaaaattgaaaagatattgggataaagatacaggcaaggatcgtcatgacaaagatgttaaagctgattatctagttggttcaagatattataatgagacccccaaacattctctaattaaaagttcagagggtcctactaaaagtaaggaaaatgtaaacccacttgagagtactcgtaaagaaaaccaagtgaccaggaaaaagaatgatgacatcattacgtccagaactggcggtgcttacataccacccggaaaactgaaattaatgcaagccagtatcactgataaatcaagtgctgaatatcaacgtatagcttgggaagcattgaagaaatcaattcatggtcatataaataaagtcaatacttccaatattggtgtagttgccagattattattcaaggagaatataattcgtggtagaggcctcctttgcagatcaattatacaagctcagtctgcttctataacatttactaatgtgtatgcttgtctggtggctataattaattctaagttcccaaacataggagaactcttactgaagagggttatcattcgattcaaaagagcttataaaagaaatgataaagcagtttgtatttcttcagctacatttatagcacatcttatcaaccagggtgtagctcatgaaattctcggactggaattggttactttattagtagaaaaccctacagatgattcaattgaggttgcagtagcgtttttaaaagaagcaggccagaaattaagtgaagtaacaagcaaaggcacaaatgctatatttgatatgttaagaaatattcttcatgaaggaaagttggagaaaagggtacaatacatgattgaagttatgtttcaagttaggaaagatgattttgctacttttccagcagtaccagaagagctggatcttgtagatgaagaaaatcagttcactcacttaattggacttgatgatgcaatagatacccaagatatactaaatgtattcaagcttgattccgaatatcaggcaaatgaggaacgttacaaagaattgagaagtgaaattcttgatactgattctgaagatagtgggtctgaaggaagtagtactgaagcagaagaggattctgattctgaagatgaagaaaagaaagtcacaattgtagataatacagaaacaaacctgatatcactcagaaaaactatttatctaacaattcaatcaagtcttgactttgaggaatgcgcccataagttgttgaaaatggaaattaagcctggacaagagaaggaactttgtcatatgtttctagattgctgtgctgaacaaaggacctatgaaaagttttttggtctgcttgctcaacggttctgccaagtaaataatacttacatagcacctttcgaacagatatttgctgacacatattctacagttcatcgtttagacactaatagattgcgtaatgtagcaaaattatttgcacatcttctcttcacagatgctatttcttgggctgtgctttctaatattcgacttaacgaagaagatactacaagctcaagcagaatttttatcaaaattttatttcaagagttatctgaatatatgggtttggttaaccttaatgccagattgaaagatccaactcttcaatcagccatggaaggtttattcccgagggacaatccaaagaacacacgctttgccattaactttttcacatctattggtcttggtggtctcacggatgaactgagggagcatttaaaaaatttaccaaaatccattcctgtgtcacaacttattcaagaattatcatctgaatcttccacttcttcatcatctgaatcttcttctgaaactgagtcaacgtcgtctagtgattcatcagaggatgaacgcagtaaaaagaaaaaaaagaaaaaaaggcctaatgcttcaaaggagattccaaataagaaaagggaaaagaaccaaggaaattttcaagaaaataatagatcaaccaaagaaacaaagaaaaaaagttattacaaaacaaaacatgaaagagaggaaaagcatcatcctagaaaatcaaaaaagaaataa

SEQ ID NO: 1421 - DNA, 1725 bp, Nezara viridula
atgaatgaagcgattcggcagaagaaaaaggctaaagaggttgaatggagagttcttgtcgtggatcagttagcaatgcgaatgatttccgcttgctgtaaaatgcatgaaatatccgcagaaggcttgacaattgttgaagatattaataaaaagagagagccacttccaacaatggaagctgtctatttaataacaccgagtgaaaaatcagtacactccctgatgaacgattttgcttcacctaatcgtatcatgtacaaagcagcccatgtctacttcacagaagcttgcccaaatcctttatttgacacactgtgtcatgcgagggtatctagatttataaagactttgaaggagataaatatagcatttattccgtacgaacagcaggtgttctcgttagatgctcctgaaactttccagtgcttttacaatccatcattgagtaacagcagacttgcaaatatggaacgtatcgcagaacagatagccactttgtgtgccacgcttggagaatacccttctgtcagatacaggagtgatttcgataaaaatgtagaattagctcagatagtgcagcagaagctggatgcctataaagccgacgaaccaacaatgggtgaaggacccgagaagtctcgttcccagttgttgattctggatcgaggctttgatgcagtctctcctctcttgcacgaactcactcttcaggcgatggcttatgatctgcttcctattgagaatgatgtatacaagtacgaagctacagccggagctccagaaaaagaggtgttgttggatgaaaatgatgaactgtgggtagaattacgtcatcaacatattgctgtggtctcacagaatgtcacaaagaatttgaagaagttcacagagtcgaaacggatgcctcaaggagacaaacagtccatgagggaccttagtcaaatgattaaaaagatgccacaatatcagaaagaactcagcaagtattcaactcatttacaccttgcggaagattgcatgaatgcctatcaagggcatgtcgataagctctgcaaggttgaacaggatttggctatgggtaccgatgccgaaggagaacgtataaaggaccacatgagaaatattgttcctattctcctcgaccaatccgtctcaaattatgacaagatgagaatcatcctcctttatactctgtccaagaatggtatttctgaagagaacttgaacaaacttgttcaacacgctcagatccagccacatgagaaacaggccattgtcaacttaggaaatcttggcctaaatgttgtagttgatggtactcgtataaagaagccatatgtgcctcctcgcaaagagcgtattactgagcaaacatatcagatgtctcgttggacacctgtaattaaggatctcatggaagattccatagatgacaagctcgacttgaagcatttccccttcctagccggtagggcagcttcttcaggatatcatgctcctgccagcgtgcgatatggacactggcacaaagataagggtcagcagactgtgaagaatgtacctcgtatcatcgtcttcatcatcggcggcatgagcttctcagagatccgatgtgcctatgaagttaccaacgccgtcaagaattgggaagtcataattggttcttcacacatcctgacccctgaagacttcttaagtaacctcgccaacctgagcaactag

SEQ ID NO: 1422 - DNA, 2151 bp, Nezara viridula
atgatgcaacaatatatgaaagaacttgaacaagatccttacagttatgaagactttgttgaacgtttagcttggagaacagtagatgggtttaaggaagatgggattcatggatttgatcctaatttaatgcacgaaacatttctccaagcaattaaggatttgcaagttcttcaagatcgtcagtgtaagaaatgtgaaaaacttgaactcatttgcaaggaagaagaagctaatcatttccaggatatagctcatttgcaggacaaaaataaggaagcttttgctttgtttcaagatttggatgaaagaataaattttgttgcaactaaagtaatacatcttggagatcagttagaaagtgtcaatgttcccagatctagagctgttgaagcacaaaggctaatggtatattttagtgaatttctaagccctggacctgttcttgccagcgtcttttcaaataaagaagaggtctttgaagctgctgatattatacaaaaacttcatatgatctcacaagaacttccatctgacaaatttaaagatgcaagatcaaaaatcagtttaaaatatgatgaaattgaaagatcattaattgaagaatttgtaaagtcacatagggttcatgaaacaaccagaatgaaagaaattgcgaatatccttatgcatttcaaatcttactcacagtgcattgatgctttcattgaagaaagtcagatgggaacatttgttggaaaagatattttcaaggaaatattacctctcacaaaaaaaaattttagcatcatgagagaagtttttagtaacccggaacaagtcatggccaaatttgttttgaatatttaccacttaaaactacagaaacatattgtaagcaacctttctgacaagtctgatacaaataaatatctaagaaacttaatggaattatatactaggactactgaactatctgcagaattgagctgtttcaaaatggggtctgacgattcatatcttcaaaagctaactcataatatatttcaaaaatatttagaatcgtatataagtgtcgaagtcaagggcttaaaggaaaaatgttcaacattgttacaaaaatattatgattccaaagatcaccataaacgacaaatacagtctggaggatttcaagactttagacgtgatcttcaagctgtaattggcacaagagctaatattaacattgctcaaattgaagattatggaggagaaacatttttatctgaagaattggttattagtcttatacaagagtctaagcaggcgttttacagatgtaaattgctctctaaacctgcagacttagcaagtaatgcagtgcagctgttagaagttctattaaattgtattataattgatcatgttgattatgctgtagaattagctttacaagcagtaccgattcctgaaagtaaaacacagtctcagccaatttatttctttgatgttgtaagacaggcaaatactattgtgcatctgattgaaaaacacttcaacgattctgctcttcctttagtaatgtcgacttctaaacatggagaatgtgttatgaaaaaaaagttcctgctaaatcatttagaacagaaattggacagcggtattgatagggcactgaatgctatagtggggtgggtaaaagtatttcttcaatctgagcagaaaaagactgatttcaaacctgaaactgagttgaatacattatcatcccctgcttgtatagctgtagtggagtacttcaatgataacgtcaaacatattagagcctgtctagatggcagaaatattgaatgtgtaatgacagaattgggctgtcgttttcatagagtaatttatgatcatttgcagcaatttcaatacaattcgaccggcgcactttgtgttatatgtgacatgaacgaatataggaaatgtgtgaaggaacttaattcttgtttggttaatacattatttgatactctacatgctctttgcaacgtgctgctagtgaaacctgaaaatttagatcaagtgtgcacaggtgatcagttgtctctcttagatcgttctgtcgtactaaatttcatccagttaaggaatgattacaagactcagaagttatcaaattttcttaaagggatgtctgcttga

SEQ ID NO: 1423 - DNA, 831 bp, Nezara viridula
atggattttcaaaatcgacctggaggtaaaactggaagtggtggtgttgcatcatggtcagagacaaatcgagaccgaagagagaggctaaggcaactagctctcgaaacaattgatataaacaaagatccctattttatgaaaaatcatttgggttcttacgaatgtaagttatgtctcaccctacataataatgagggaagttatttagcccacactcaaggaaaaaaacatcaagcaaacttagcaagaagagcagccaaggaagccaaagattctccacagcaacctgctccagataaaccaagaatagaaccaaaaaaatttgtcaaaattggtagacctggttatcgagtcactaaacaaagagatcccgaaactggtcagcaaagtcttctttatcaagtagattatccagaaattgcagaaggaatcttacctaggcatcgtttcatgtcagcttatgaacaaagagtggaacctccagataggaaatggcaatatcttctatttgctgctgaaccttatgaaactatagcctttaaggtgcccagccgtgaagtagacaaatctgaaaacaagttttggacacattggaacaaagacacaaaacaatttttcctccagtttgcatttaagaatgaacctcttgctcctcctatgggtgcacctcacttaggtcaaatgagacctccacatatgctgccaccacctatgagcgtacctccacctcccatgtttaatcctgttccacctccccctccaaatctaatgcttgctcctcctcctccacctgcaccactcccacctcctccgcagcctatgaaataa

SEQ ID NO: 1424 - DNA, 405 bp, Nezara viridula
atgtctatcggtgttcctattaaagtattacacgaggccgaagggcatatcgttacatgcgagacaaaaactggagaagtctacagaggaaagttgatcgaagctgaagataatatgaattgtcaaatgaccggtttaactgttacctatcgcgacggccgagtggctcagttagaaaatgttttcattagaggctcaaaaatacgttttcttatattaccggacatgttgaagaatgcgccgatgttcaaaaaacaagggaataaaggtaatactggtgcggggagaggtaaatctgcaattctcagagctcaagcagccaggggaagaggttcacagtccagaggaggtgcaacttcttctagaccatcgtggcaaagcggttctaatcaatcaaggaaataa

SEQ ID NO: 1425 - DNA, 1323 bp, Nezara viridula
atggcttcgagtgtttcaaaagttcctcttctccagacattggcgaagagaacatttgctgctgttgctgctcccaaagctgcaggaagtcaaaataaagtagaggtgactactcttcccaataaggccattgtcacttctttgggatgtgggcccaaacccattgtacaagtagcagtggcattcagagccggtagtcgaaatgaaacttctgaaaattatggagctagtcacattctgcggagctctgctggtcttagcacttgtaatgcatcctcgttttatatctgtcgtagtttgcagcaaattggcgctagcctcactgccacttctgaccgagaaacaattgtttatgtccttgaatcttctgctagcaatataaatgaaggacttgatactctgaggaaggctgttactggtcaagaattcaggccttgggaattgtctgataatatttctaggatcaaaattgaattggcatcattgccttcacaggcaaaagtaatagatttgattcataaagcagctttcaggagtgggcttggaaattctatttttgttcgagaattcaatattaagaaacttaacagtgaaacgctgcaacattatgctgctaataatttaactggggacaaagctgccatagctggttgtggtatatcccaatctgatctgacttgtttcgccgaatcccttgggctctgccctggtagtggcagtgcattgcctgcatctaagtatagtggaggagaaatcaggattgaggaaaacattccactccagcataccatcattgctgctgaagcaccaagcttagacaaaagtgatgccctggcctacgctgttctgcgatatgcccttggaactggtccttcagtctaccgtggcacaggatctggaccactttccaaggttgctggtgtgcttgtcggtgctcaggccctttccatggcacactctgacgctgggctctttggtatttatgttgcttctccaggctacaacgctaaagaggctgttgaagcagcagtgaaagttttgaagggtggagttactgatcaagatgttgcacgaggtaaagcgcaattgaaagcagccttattgtattccaacgaaaggtgccggggattagtggatgatcttgttggccaggctttacttgttacaggagttcctcccaaatctgctgctgaattggctgaccaagtttcttctgttaccactcagcaggtgcaacaggctttgcaaaagatccagtctggaaagaaatcacttgctactattggtagtataagcaaagtgccatatttggatgaattgtaa

SEQ ID NO: 1426 - DNA, 339 bp, Nezara viridula
atgaggagagctcatgggaattattaccaaccggtccctacattcgatggacctagcggttcactcgaagaggaaaatgaccagatgacaaataaactgaaagataaaataactgctttaaagcacttgtcaatcgatattggtgcagaagtaaagtaccaggataagatgctacatgggatgtcagaagacttcgaccgtaccggaggctttctaggaaatactatgaatagagtattacgcctcaccaaaggaagtcacaattattatattttgtacctttttatattttctattgttgttttttttgtactgtacataatattaaaatttagataa

SEQ ID NO: 1427 - DNA, 1389 bp, Nezara viridula
aatggacctttagtcattttagatgaagttaaatttccaaagtataatgaaattgttcagctaagacttgctgacggaacattaagatctggccaagttttggaagtcagtggttccaaagctgttgttcaggtttttgaaggtacttccggtatagatgctaaaaacacaatatgtgaattcactggagatattcttcggactccagtgtctgaagatatgcttggacgagtcttcaatgggagtggaaaacccattgacaagggacctccaatccttgcagaagattatttggatattcaaggacagcccataaatccttggtctcgtatttatcctgaggaaatgattcagactggtatctctgcaattgatgttatgaattcaattgccagaggacaaaagatccctatcttctcagctgctggtttaccccacaatgaaattgctgctcagatttgtcgacaggctggtttagtaaaatcacctggaaagtctgttcttgatgaccatgaagataattttgctatagtatttgcagctatgggtgttaacatggaaactgctcgatttttcaagcaagattttgaggaaaatggttccatggagaatgtgtgcttgtttttgaacttggcaaatgacccaactattgaacgtattatcacgcctcgccttgctctcactgctgcagagtttcttgcctaccaatgtgagaagcatgttttggttatattgacagacatgtcttcttatgcagaggccctgcgagaggtatctgctgccagggaagaggtgcccggtagaagaggtttcccaggttatatgtacaccgatttagcaaccatttatgagagagctggacgtgttgaaggcagaaatggcagtataactcaaattccaattcttactatgcctaacgatgatattactcacccaattcctgatttgacgggatatattactgagggccaaatctatgttgaccgtcaattacataacagacaaatttacccaccaattaatgtactgccatcattgtcccgtttaatgaaatctgccattggagagggaatgacccgaaaggatcattcagatgtctcaaatcaattgtacgcctgctatgctattggtaaagatgtgcaagccatgaaggctgttgtgggagaagaggcacttacacccgacgatcttctctacttagagttcttgacaaaatttgaaaagaacttcatttcacaaggtacctacgagaacagaacagtttttgaatcattagacattggttggcaattactgcgtatattccccaaggaaatgttaaagaggatcccagcatctaccctggcagagttctaccccagggactcaaggcatacaaccacaaaataa

SEQ ID NO: 1428 - DNA, 2229 bp, Nezara viridula
atgatgcaacaagctcaaagtaggccaatgtcccatggcaactaccagggcgggccagatttgcccatgggctctgtcaaagaccagacgctcatgtggcagcagagctcatatttggctgattcaggaattcattcaggtgcaactacaacggccccctctctttctggtaaagaagaagagatgtatggggatcaagacatgtttgacctggatcaagggtttactcagggtttcacccaagagcaagttgatgaaatgaatcaacaactctctcagacaaggtcccagagagttcgagctgcaatgtttcctgaaactttagaagaaggtatagagattccatctactcagtttgatcaggctcaagccacagcagtccaaagactttcagaaccgagccaaatgttgaagcatgctgttgtaaatctcatcaattatcaggatgatgcagacttagctacccgtgctataccagaattgataaagttgcttaatgatgaggatcaagtagtggtttcacaggctgctatgatggtgcaccagctgtctaaaaaagaagcctctcgtcatgccatcatgaatagtcctcagatggttgaagctttagtgagggcattatcgaatagcaatgacctggaaacaactaaaggagctgtagggacattacacaatttgtctcatcacaggcagggtctcttggctattttcaaaagcggtggcatccctgctctagtgaagcttttaagttccccagtggaatctgttcttttctatgcaatcactaccttgcacaacctccttcttcatcaagaaggaagtaagaccgctgtgcgagttgctggaggattgcaaaagatggttgttttactacaacgaaataatgtgaagttcttagccattgtgactgactgtctccaaattctagcttacggcaatcaagaaagtaagcttattattttggcatctcagggtcctattgagctagtgcgaatcatgaggagttacgattatgagaaactgctttggacaacatcaagagtacttaaagtattatctgtctgttcgagtaacaaacccgcaatagttgaggctggaggtttacctgcactggcagtgcacctggggcatccatcgcagcgacttgttcagaattgcctttggaccttgagaaatctttcagatgctggaacaaaagttggtggcttagaagggcttcttcagtctcttgttcaactcctggattcctctgatatcaatattgttacttgtgcagctggtatcttatcaaatttgacttgtaacaatcaaaggaataaagtgactgtgtgccaggttggtggtgtcgatgctcttgtccgtacaattatatcagctggagacagagaagaaattactgaacctgctgtttgtgctttgaggcacctaacttctcgccatatggagagtgagcttgcccagaatgctgtccgcctcaactatggcttgcaagtgattgtcaagttgttacacccaccatcaagatggcctctagtcaaggctgttattggtttgattagaaaccttgccttgtgtcaggctaaccacacaccgctgagggatcacggcgcgatacaccacttgatcaggcttctaatgcaagcattccaggatacacagagaagatccagtgttaccagcggaggaactcagtcaggtggtatttatgctgacggtgtgcgcatggaagagatagtggaaggcactgtgggtgctctccatatcttggcaagagagagccacaacagagctatcatcagaggccagatggtcataccgatttttgtgcagcttcttttcgatgagatagagaacattcaacgagtggctgctggcgtgctctgtgagcttgcccaggacaaggaaggtgccgagctcatagaacaagaaggtgcaactgctcctcttacagaattactccactctcgaaatgaaggtgttgctacttatgctgctgccgtgctgttcagaatgtcagaagacaaacctcaggattacaaaaagagactttcaatggagcttaccaactctctttttagggaagatcaaaatttgtggaatggtgatttaggaatggctcctgatttacaggacatgctgggggagcaaaattacgacaccatgtactctcatggaccacctagtgtccatagtagtcacggaggtcggggatatcaaccagggctctga

SEQ ID NO: 1429 - DNA, 834 bp, Nezara viridula
atggctcgaaatgcagagaaagctatgactactttggctcgatggcgggctgctcaattaggggaaggtgatcaagccaaacaaagaagaccatatttagcatctgaatgtactgatcttcagcaagctgaaaaatggagaatgcaaatcataagagaaatagctcgtaaagtttctcaaattcagaatgctggtcttggagagtttagaattcgtgatttaaatgatgaaatcaataaactactgcgagaaaaagggcattgggaagcacaaattcgagaacttggtggtccagaccactcaaggtctgggcctaaaatgctggatgctgaaggaaaagaagtgccaggaaatagaggctacaaatactttggtgcagcaaggcaacttcctggagttagagagttgtttgagcaggctcctcctccacctccgcataagacacgtggggaactaatgagagatattgatgcctcttattatggttatatggacgacgaagatggaatcattataccactagaagaaattgaggaaactaaagctattaaaaaagctgtagcagaatggactgtaaaaaaggaaaaatcaatggaaatagacgaagaagaaaaagaagaagtcgaagaagataacatctacaaagcagcaggaaataaagagggcggagaagatgatgaagaggaagatgcaggggaagacgatgggttcgaactgagtgctaagttactggaagggtacagagctcatattcctgttccttcacaaagagaggtggaagccgcaattcttgaaaggaaaaaacaagaacttctggagagatatgctctctag

SEQ ID NO: 1430 - DNA, 645 bp, Nezara viridula
atggaagaggctgatgtaccatcatttaaatgtgtccttgttggtgatggtggtactggcaaaactacctttgtcaaacgccatttaactggtgaatttgaaaaaaagtatgttgccaccttaggggtagaagtgcatcccttagttttccacaccaacaggggtcctattcgcttcaatgtatgggatactgcaggtcaggagaagtttggtggacttagggatggatactatattcagggtcaatgcgctatcattatgtttgatgttacttcaagggtaacctacaaaagtgttcctaattggcatagagatttagtacgcgtctgtgaaaacattcccatagtactttgtggaaacaaagtagatattaaagatagaaaagtgaaagctaaaagtatcgttttccatagaaagaagaaccttcaatactacgacatcagtgctaagagtaattataattttgaaaagccttttctgtggttggctcgaaaactgatcggtgatccaaatctagaatttgttgctatgcctgctctgttgcctcctgaagttaacatggatcctgaatggaaggaccagattgaaagggatctccaggaagcacaagacacagcacttcctgaagacgatgaggacctgtaa

SEQ ID NO: 1431 - DNA, 480 bp, Nezara viridula
atggacatccaaactattgcaacaatatttattaaagttttaaaacttgtaattaattttatcattcttatgctctaccgttatggcgggaaacaaggatttctgggagtaggtggaacgtggaacttgtatgaagtaaaaagtgctgatgctgaaattattgcatctggagtttttgtgggatttttcatctacacatcagttatcttaatttcatactgctttggaacaacaaagcacaaatatagtgcagtagatataataatgaatgtgagtggaactatattgttcaccgctgtaggaggcatagcattacattactgggttggtttccaggatgaaaaccattatgtgggaatttctcaagaaaaacaaataggacttgcattaggcagtcttagtgtagtatgtgctgctatctaccttctcgatacagttttatcatgtatacatattgcacacaagcatgctattgcttaa

SEQ ID NO: 1432 - DNA, 2337 bp, Nezara viridula
atgccgcgaattatgataaaaggtggtgtctggagaaacactgaggatgaaattcttaaagctgctgttatgaaatatggaaaaaaccaatggtctcgaattgcttctttattacaccgaaaatctgcaaaacaatgcaaagctagatggtttgaatggcttgatccaagcattaaaaaaactgagtggagtagagaggaagatgaaaaattattgcatcttgcaaagttaatgcctactcaatggcgaactattgcaccgattataggtcgtactgcagcacaatgcttagagagatacgaatatttactagatcaagcccaaaaaaaagaagaaggggaagatggagctgatgatcctaggaaattgaaaccaggagaaatagaccccaatcctgaaaccaaacctgctcgtccagatcctaaggatatggatgaagatgaattggaaatgttgtctgaggccagagcaagattagctaacacgcagggaaaaaaagctaagaggaaagcgagagaaaaacagttagaagaagcaaggagattagcagctttgcagaaaaggcgagaattgagagctgcagggattgaatatgcagcacgccataagcgtaaaagaggcatcgattataacgctgaagttccgtttgaaaaaaaacctgctcccggattttacgataccagtaatgaagctattgatcctcatgctcctaattttaataggcttcgtcaacaaaatttagatggtgagcttcgtagtgaaaaggaagaaagagaacgtaggaaagacaaacaaaaaataaagcagaggaaggaaaatgacatgcctcttgcgatgctgcagaaccaagagccagccaagaaaaggagtaaacttgtcttgccacagcctcaaatatctgatcaggaactgcaacaagttgtgaagttaggaagagctagttacgctgcgcgggaggcagtaacagagggctctgaaagtgcttcggacacgcttctcaacgattatgctttagccacacccaatgccggatctactcctcgtacgcctgcgcctacaactgacaggatacttcaagaagcccaaaatatgatggcattgagtcatgtagatactccactgaaaggaggtttgaacacaccactttataactcagagtttagtgttcatccaccgtctgatcagatcacaacaccgaacactgtactgactacgccgttttctaatcgaactcatgaaggaaggactccaggtttccaaactccgcaagacgtaagaaccagcctcaccactcctgtcagagataaattaaacattaatccagaggaaggtggtgatacaccatatgctcctgtaaataatcaaaaacaggtaaaagaggaacttgctgctcgtcttaggtcactaccacagcctaagaacgattatgaaatcgttgttcctgaagatgaagtttcgtccgaaacagctgcagagggttctggtatgctaagtgttgaagatcaagctgatatcgatgctagaaatttgagtttccttgctcaacaacgcgaaaaagaattaaagagtagatcacaggtaattcaacgagctttgcccagacctggagacatcaacatagtactccgcccggctaatacagatccacctctaacagatcttcagaaggctgaagagatgataaaggaagaaatgataacaatgttacattatgatgccattcacagcggtgagccttcttctgcaagaaaaataggaactgtaagtcaggcacagcaccttgcctatctcgaacaacacccataccacacttactcagaagaccaaatagagaaggccaaagaaatgctgaaagccgaaatggaagttgtcaagcaaggtatgaaccatggtgatctgtcgctggaaacatttacgcaagtttgggaagaatgtttagcgcaggtattgtatttgcctaatcaaaatagatatacaagagcaaatttagctagtaaaaaggaccgtctggagtctgtggaaaagagactagaacaaaatcgaacacacatgacccgagaggcaaaaagagcagcgaaaatggaacgaaaaattaaaataatcactggtggatatcagactagagctcaggcactgataaagcaacttcaggatttagctgacgagacagataaggctcatatggagctgtcgacgttcaagctccttcagcagcaggaagagaatgccatccccaagagaatagagtcgatatcagaagacgtaaacaggcagcttgaaagggagaagagcttacaaaaaaggtttagccaacttcagctggtttcgcaatcataa

SEQ ID NO: 1433 - DNA, 474 bp, Nezara viridula
atgatgcagttcatgcttttattcagtcgtcaaggaaagttgcgattacaaaaatggtatgttgcacatccagataaattgaagaaaaaaattaccagagaactaattactacaattttggcaaggaagccaaaaatgtgtagctttttggaatggaaagatttgaaaatagtatacaaaaggtatgcaagtttatatttttgttgtgccatagagcaaaatgataatgaactgcttacattagaagtgattcatcgatatgttgaacttcttgacaaatactttggaagtgtttgtgagttggatattatattcaactttgagaaagcatacttcattctagacgaacttttacttggaggtgaaattcaggaaacaagcaaaaagaacgtcctgaaagctatagctgctcaggatctccttcaggaggaagaaactccacaaggatttttcgaggatcacggtcttggataa

SEQ ID NO: 1434 - DNA, 1314 bp, Nezara viridula
atgtcctacagcatcattctcagtcgtttgagtaggttcccactattctcttactcaagaggatatagtgtcattaccagccaaaatgtgaaaaatatccctgtgagtttcagatattattcatctggtggaaggaggcctaattttttctcccaatttatagaaaatgttaggcaagacttggcaaaaagtaaagagatgaaagaaagtttgaaaaagtttagggaagaagcgcagaaattagaacaatccgaagctttacagaaagcaagagccaagtttcaaactgttgaatcagaagcatcgaaaggtggtgaagttttcaaggagaaattggaccacattaaagataaagtcagtgatgtgctggaggaagcagcaaaatcagaaatcgggaaaaaagcaggtcagctgggagcagaaattggaaagactgcgaggggagctgctgaaacattatcagaaacaggacagcagatcggaaaaagtggagcttttcaaactatcagccaaacagctgcagctgtaaaacaagaattagatcaatccggaattcatgctcatgtttatcagccgccacgaaaactaagaaaaagattggaaatagtaccagataataaagctttaaaacctgacacagaaacattaggtattgatctccataaggactcaaaatttttccaaagttggcaacaattcaaagacaataatgcttatattaacaaagttctcgattggaaaatgaagtatgatgagagtgataatcccgtcatccgagcatctcgagtattcacagacaaagtttcaagtgttatgggtggcctttttcagaaaactgaactttctgaaacactgacggagatatgtcgaatagatccgaattttgaccgagctcactttttgaaagattgtgagaaagatatcatcccgaatattcttgaagctatggtccgtggagatttagacatattgcaagactggtgccatgaaggtccatataatgttcttgctgctccaattaaacatgcaaaagaagcccactttaagttttgttctaaaattttagatattgataacgtcgatttagtaatgggtaaagttatggaccaaggacctgtgttagttattagtttccaatcccaacaattactgtgtatcaaagataaaaatggtaatatagttgaaggtgatccgaacaaagtattaagagttaattacgtttgggttctttgtagagacccctctgaattggacccaaaggcagcgtggcgtcttttagatatgtcagcacaaagcaatgaacagttgttatga

SEQ ID NO: 1435 - DNA, 759 bp, Nezara viridula
atgaagaggccaacgcttagagagctagaattacaagagcttgaaaattatgagggagaaactgattcagaaacagaggcaatacaagaagcttttgccagaggagatcttaagccaggacttaacattcctgttaaagataaagtcaagacaaataatgttcctctcctgaaagacacattaagtgaaatcaagttggaccttccgtggattgaaagattggatgtaacaaacgaacaagcaccattggcccctgaactcgctttgcagatcagggaagaagaacaaggacataatccattagtttatgacgagttgaagagagaaagcgtattctatagacaagctcagaacgcagccatgaaagtgttaccaaaattgaaagaactgggccttagaactgagaggcctgacgactattttgccgaaatggccaagtcagatcagcatatgcagaaggtgaaaggtgaagccatcaagaaaaaactaatgatggaaagaattgaaaaactgagagaaatacgagctcagaagaaagttcagaaagctcttcacgctcaagctaaggttgctaaagttcaaagtaaaaaacaaatgctagaagaagtgaaaaagtacaggaaaggagaaactaagagtttagctttccttgagccaggatttaagccaaaagccaaaccaaacaaatcccaaattaaaagacaacgcaaggatactaaatttggtcatggaggaaaaaaaagaggagctaaaagaaat

SEQ ID NO: 1436 - DNA, 3780 bp, Nezara viridula; identical to SEQ ID NO: 1411

SEQ ID NO: 1437 - DNA, 1998 bp, Nezara viridula
atgaatacaggaccaggaggacctaattaccccatggcatctttatatgtgggtgatctgcattcagatgttaccgaagcaatgctgttcgaaaaattttcatcggctggacccgtactttctattagagtatgcagagacatgatcactcgaagatcattaggttatgcatatgtcaatttccaacaacctgcagatgctgaacgcgctttggatactatgaattttgacaaccttaagggtcgtccaattcgtataatgtggtcacaacgtgatccttctctcagaaaatctggcgtgggcaatgtctttattaagaatttagacaaaagtattgacaataaggctatgtatgacactttctcagcttttggcaatattctcagttgcaaagtggcacaagatgaaaatggcgtttccaaaggatatggttttgtccattttgaaaccgaggaagctgccactaagtcgatagataaagtgaacggcatgttgctcaatggtaaaaaggtttttgttggtaagttcattccacgaaaagaacgtgaaaaggaattaggtgaaaaagccaaactgtttaccaatgtatatgttaaaaattttggggaagactttactgatgacatgctgaaagagatgtttgagaaatatggaccaattaccagtcacactgttgttgtaaacaaagatggcaagtctcgtggctttggttttgttgctttcgaagacccagaagctgctgaaagagcagttgaagatctgaatggaaaagagcttattgaaggaaaaccactatatgtaggaagagcgcagaaaaaagctgagcgtcagcaagaattaaaacggaaatttgaacaactcaaaatggagcgtatgaaccgttatcaaggcgtcaacttatatgttaaaaatctagatgatactatagatgatgaaagattgaggaaagaattctctcctttcggaaccatcactagtgcaaaggtcatgttagaggaagggcgtagtaaaggatttggctttgtatgtttttcatctcccgaagaggctaccaaagcagtaactgaaatgaacggtcgtattgttggtacgaaacctttatatgttgctcttgctcaacgtaaagaagatcgtaaagctcatttagcatctcaatacatgcaaagaatggccaatatgcgtatgcaacagatgggacagatctttcctactggtggtacagggggctattttgttcctactttacctcagccccaaagattttttggacctgctcaaatggcacaaatgcgccctcagccccgttggccagctcagcctcaagtcagacccagcacacaagcagctgcatcaggatttcccaatatgcaaggcccattcagaagtggaccacgaggtccaggtgctgctggcggtggtggcggcccaggaagtgccgccgctgctgctgcagccatgcgctcatctatcagtgctgctgctgcagctgtggcagcggctgggcgaccaacagccaatgctgctgctgctgccgctgccgctgctgcaaacccagctgtcgcccggcaattggcccaaggaggttctcagggtgcccctgtatctgtgtctgctcaaggccgtcctgcaaattacaagtacaccgcgaacatgcgcaacccacccccaatgggaggtggagcaggagcaggtgcaggtggacctccacagcaagccctacacattcaaggacaggaaccactcaccgcaagcatgttgtcatcagcaaaccctcaggaacagaaacaaatgcttggagaaaggctcttcccccttatcagaagtatgtaccccgatctggctggtaagattacaggaatgttattagaaattgataactcagaattgctacacatgctggagcatcatgagtccctcaaggccaaggtcgaagaggctgtcgctgtactacaggcccaccaggctaagcaagctgctgcatctgtcaaaaaagaataa

SEQ ID NO: 1438 - DNA, 2739 bp, Nezara viridula
atgacggactcaaagtatttcacaaccaccaaaaaaggtgaaatatttgaattaagatctgaattgaacagtgataagaaggagaaaaaaagagaagcagttaaaaaagtcattgcttctatgacagttggaaaagacgtgtcagctctttttcctgatgttgttaattgtatgcagactgataatttagaacttaaaaagttagtctatctgtatttaatgaactatgctaagagtcaacccgacatggcaataatggctgttaataccttcgtcaaagattgtgaagatgctaaccctcttataagagctcttgcagtaagaacgatgggttgcattagagttgacaaaataactgaatatctttgcgaaccactcagaaaatgtctgaaagatgaagatccctatgtgaggaaaacagctgcggtatgcgttgcaaaattatatgacatcaatccccagcttgttgaagatcaaggtttcttagatcagctcaaagaacttttatctgattccaacccaatggttgtagctaatgctgttgcagcactctctgaaatgaacgaagcctcagttaatggggcgcccctcattgaaatgtctgctgcgactataaacaaacttcttactgctcttaatgagtgcacagaatggggccaagttttcatattagattctttggccaattatagtcctaaagatgaaagagaagctcaaagtatttgtgaacgtattactccaagactagctcatgctaatgctgctgtcgttttatctgcagtaaaggttttgatgaagtttttagaaatgttgccatctgaatctgactttgtatcaactttgacaaagaagcttgcacccccattggttaccctgctgtcatccgaacctgaggttcaatatgtcgctttgcgaaatataaacttaattgtacaaaaacgaccagatatcctgaaacatgaaatgaaagtcttctttgtgaagtataatgaccctatttatgttaaactggaaaaactggatatcatgattagattagcttctcaagctaacatagctcaagttctttccgaattaaaagagtatgcaacagaagttgatgtagattttgtgaggaaagcagtgcgagcaattggccgatgtgccataaaagttgaacaatctgctgaacgttgtgtttctactcttcttgacttaattcacactaaggtgaattatgttgttcaagaagccattgtcgtcataaaggatatttttaggaaataccctaacaaatacgaaagtattatttcgacattatgtgaaaatttagacactttagatgaacctgaagcaagggcttctatgatttggatagtaggtgaatatgctgaaagaatcgataatgcagatgaattactggagtcatttttggaaggttttcacgatgaaaatacacaggttcaactccaactcctcacggctattgttaaactatttctaaagaggcctactcacactcaggaactagtgcaacaggtattgagtctagctactcaggattctgacaatcctgatctccgagacagaggattcatatactggaggttgttatcaactgatcctggtgctgccaaagaagttgtacttgctgagaaaccactaatttcagaagaaactgatcttctagaaccgactctcttagatgagctcatatgtcatatttcttcccttgcttcagtttatcataagccacctactgcttttgttgaaggcagagctggtttgaggaagtccttaccagcaagatctggatctgctgaagtggtgcaagaaactcctggtgcgcaagttattccttcacaagattcactgataggggacctgttgtctatggatatcggtggggtctcagcccctcctccacctcaaccgacgtctgctcctgttgatcttctgggtttggattcacttcttggaggggtgcctgaacctgctgtctctcagagtacaactggtttgcttggagatatatttggtttaggaacagctgggcctactgcatatgctccacccaaaaccatgtggctctccagcgataggggtaaggggtgtgaaatatctggaactttttctcgaagaaatggccaaatccaaatggatatgaccattgtgaataaagctatgcagccgatgactagctttgccatacaactgaataagaacagttttggtgtgactccagccagagctctccaggttttgagtccattaccacctggagtgtcacatgactgctcattacctttagttactactggagcagttcaaagaatggaaccattgactaatcttcaggttgctataaaaaacaatattgatgttttctattttgcttgtgttattccaatgcatgtattcttcacggatgatggacaaatggataagcgggtgtttctcgctacttggaaggacattccagctcaaaacgaagttcaatacacacttacaaatgtccagtctaatgcagatatagttgtccaaaaaatgcaagaaaataatgttttcactattgctaaacgaaatgttgagggacaggatatgttatatcaatcagttaaactgaccaatggtatttgggtactgattgaattgaaaatacaaccaggaaatccaaatattactctttctttgaaatcgagagctctcgatatagctgctggtatattccaggtatacgatgctattcttcattcttaa

SEQ ID NO: 1439 - DNA, 498 bp, Nezara viridula
atgccaccaaagtttgatcctaacgaagtaaaaacagtcttcttgaggtgtgttggtggtgaagttggagccacatcttctcttgctccaaagattggtcctcttggtctgtcccctaagaaagtgggtgatgacattgctaaagctacagcagattggaagggtctgaaaattacagtttgccttactattcaaaacaggcaagctgctatctcagttgtaccatcagcggcttctctcatcattaaagccctgaaagaaccaccaagggacaggaagaaagtcaaaggagtaaaacataatggtaacctcaccttcgatgaaattctcaccattgccaggtcaatgaggccaagatccatgtctaggaaattagagggtactattaaggaaattctcggcacatgccaatctgttggttgtacagttgatggtaaaactccttccgaagttatctgccaaataaatgatggagaaatagatgtagccgatgaatga

SEQ ID NO: 1440 - DNA, 1110 bp, Nezara viridula
atgtgtggagaagaaccaaatattggagaaatgaaagctcttattttagtcggagggtatggaactcgacttaggcctctgacattaagtaggcctaagccattggttgaatttgctaataaacctatgctgatgcatcaaattgaagcattagtcgaagctggagtaactgaagttgtattagctgtatcatacagagcggaacagatggaaaaggagttgagtgatgaggcaaaaaagttgggtgttaaattaattttttcgcatgaaacagaacccctgggtacagctggacctctggctttagccaaagatattttatcatcgactaatgaaccattttttgttctgaattctgatattatttgtgaatttccgttcaaagaacttgtttctttccataaaaatcatggaaaagaaggaacaattgtagtgacaaaagtggaagaaccatctaagtatggtgttgttgtttatgatgagaaaggttgtattgccagtttcattgaaaaaccacaagaatttgtttctaataaaataaatgcaggcatgtacatactaaacccttcagttttaaaaagaattaaactggaaccaacaagtattgagaaagaagtatttccgtttatggctgaggcaggagaattgtatgctatggagcttagtggattttggatggatgttggacaacctcaagattttcttacaggcatgtgcttatatcttacatctttgcgtcagaaagcacctgaaaagttgtacgctggccctggatgtattggaaatgttctagttcatcctactgctcgaataggttctgggtgttcgatcggaccgaatgtaacccttggtcctggggttgtcgttgaagatggtgtttgtataaaaaggtgcaccattttggaaaatgctattatcaagtctcattcatggctttctgggtgtattgttggatggaaatctgttgtgggacaatgggttcgaatggagaatactaccgttcttggagaaaatgtaaatataaaagacgaactctatgtcaatggaggtcaagtacttcctcataagagcattgctaagtctgtgcaagatccacagattataatgtaa

SEQ ID NO: 1441 - DNA, 864 bp, Nezara viridula
atgactttggacggtgaagaaactatatcggatcaagaaaaggtgcgaatcgtttctaattttatattacattcgccaccgggagaatttaacgaagtttttaatgatgcaaggatattattaaacaacgatactcttctgaaagaaggagctcttggagtcttcgggcagtactgtaaagaccagcttacgcctgtgaagattaagaacagtgagtatccagttttaattacagaacataatgatctaggatccaacaggttttatgatgcaaggtcgaaacagtcatttaaatatgatccattaaggagagagacatctaattatgactcatgggaagcagaacctggtacagaaaagtggagatcagctttagagagtgaattagatgcatatatagctaaacactttgaaagtggctctggtagtgtattttctaaaagagaggatggcaaagtaaacttggttgcgtgcatagaagcccatttattccaaccaaaaaattgctggaatggttgttggcgatctcagtggtttgtgacaatagattcagataatgcggatgtgaaaggtgttttaaaaattcaagttcattattatgaagatggcaatgtgcagcttgtcagtttaaaagatattaaccaaacactgccagttgttgatgaagaacagttaagtaaggctttaattaaaatattcgaagactctgaaacagagtaccaacaagcgatatctgaaaactaccatacaatgtcagacactacttttaaagctttaagaaggcagttacctgttactcggtcaaaaatagattggaataagatggtgtcttacagcattgccaaagaactcaaaccccagtga

SEQ ID NO: 1442 - DNA, 3558 bp, Nezara viridula
atgatggaggtggcgtcgtcgttgttgttgctgctcttagtcgcctttgtggccagcaaagatgtcagcaaagtcagtgagaacttggtccgcccatacggcaagaactactttaccagtaggcgagtcatcggtagtaactttctgccaaatgtcgatgatgaccgaatggctccctccactgaggagccgcgtattccgtatgttattacggaagatcgtctgaagaagataagatcaaatttcatgtattggttttttgaccaagattctaatgatggttatggagatctgcagaaggacataacaccatcgattacccaagttaataagaatttaaatttccaattgccgtttttcggattccgcttcaattatacaagagtttcactaaacggctatttagaattcagtgaccctccggaacaatacagctaccccctcaatttcccaagtgtggactggccacgtaaaaacgaccctgcgttcattggaatattctacagtaagtgcaggattggacaattgggtatcaatgatgtagaccagagagaaccaggagtgtattttaggatggaaagggacttgatgacaagaaaagataaattcggagttgaaatgagagagagggtgaaatgggacatacgagaaagtgttgtcggctccgattcttttgaacccaaacatgctgtgattgttacctggaaaaatgtttcgtttgctggtggcattgaaaactcagtacaaacaacaaacacgtttcaattggttctagcaacagacgaagtattcacttatgctatattcaattatgctcaaattaagtggaccacacatactgaagcacgaggggacacagttaaaggagaaggaggtgtgccagcatacataggatttaatgctggcaatggcacaagaagttacgaatatagaccttattcacagacatcgacaatcagagatttggttggccgtggttgggctaacggtttcccaggaaggcacatttttagaattgatgaaaatattcttccaggaacttgtaacaaggatattgctgcagcaagtttgcctctcgcattcgctcctgaaagtggtaacatgctcggtggtaccatagtgaatataacaggaccttgttttgaaccaactatgaagattgtatgcagatttgacatgaaagctgtatatggtacagttgtggacaggaatagagcaatttgtgttcaacctttcgtcatggcagaaggttacatattgtttgacatcgccatcgatgacggaaaatacgtttggaagggacagtatttcatcgaaacacctgcaacagctgctgaaaaaatatccttcgctgacgacagcgttcaccaaaaatatcctccagaagtcagaataacatggaatcagtataatttaacatcaaatttagctgctccagttcaaatctcaatatggggatacagggaaaaatcaatccgcccacagctactttatatagattctttagacgtgggtgttccaaacaacggcatgtactcaattattccagcaacttataaaaatcgtgataaccatttattcactgatatgagtttcggtttcatacaaatcaacctgacgactgcaacggaatacaatggacttaaagtaaccccagttatatggagcaagccaatacccttaggctggtatttcgccgcgcaatgggaaaggcaactgggttccaattggccagaggggaaatgtaacagttggattatgaacgatcgatatctgaagaactttcctgctgaactgagtatttgtccctgtaaattagaacatgctcttgccgataaaggaagatttatgccggatttcgactgtgacatggacgctaaccctcattgtttttaccatgaaggcgctaggcactgcgtaaaaacaggtgctcccaggcaggaaggttccgaacagcaatgttgttatgacaaaaacaactatttgatgctttcctacgatcagcagtggggttcctcgccaaagaggtccagtaatttaggaatcttgccatggaatgaacctaacaaggttcctactctgtcacaatggtaccatgatatctcacccttttaccattgttgcttgtggcagtttgaacaatcagtcggttgtgaaacattcaggtttgaaagaagaccttcacaggactgcgttggttaccaatcaccttacattgcaactgtttttggagacccacatttcattacttttgatggtttggaatacaccttcaacggcaaaggagaattcgtactgctgcacaccgattctgagaagtttaagctagatgttcaagcaaggttcgaacaagttggaaaaaatatttatggtgatgtggcagcaacacagttgacatctatagcagcaagagacaatacttcaagcatcattgaagtaaggcttagaccaaaggaggcacaatggaggtacagactagatgtttttgcaaacaagaaaaggatatattttgacaggccatctcttcgagtacaacactttagaggtgtcactgtttatcagccttcacatatactcaatcagtctgaaattgttatcatgtttcaatcgggtgttggtgtagaagttgttgaaaatgtaggatatatggcagcaagggtttatttgccctgggaatatattaacagaacaagaggcctgtttggaaattggagtttcgatccttcgaatgacttcactctaccagatggaactgtggccagtgccgattccctgaatgatttggaaagaatacacaaacaattcgctattcattggagattagaagacaacgttgaaccaaataaaggtgaacctctttttgtcagagaatatggaagaacatcaagttattatttgaatagaacttttgttcctgtatggaaatcaactcctcaagaaattatacctcctaacagaactgcacaaatacaacaagctctagcactttgtggtgaatcttatcaatgcagatatgattatgctgtcaccttaaatagagaaatggctttctatactttaaattattacagtgaatatacacaactaagacaaacaaataaagacagagttttgtcttgtggggtgttggaaacaccaagatttgggcgaaaatccaactttttcttcgttcctgattctaaggttatatttgaatgtgatcaaggatttattcttgtgggtgatcaaaggcgaacatgttcctcaaatggaaggtggtcttttgaatatggatacactgaatgtctactggaagaagagtattctttgcgggcatttggttggacttggggtataatagctctagtccttatacccattattattgtacttgtatgtgctggttttcgaattgtaaggcggataatagagcagaaaaagaatgaactacatacagatcaaagaactcagtatcatccagattacactgctggtcctttaaggtacaatgcaagggaagttagtctttcgatcaatcccgaaaatgaaccattgaaaaaagaaacagaagtgaattaa

SEQ ID NO: 1443 - DNA, 342 bp, Nezara viridula
atgcgttacgtggcagcttatcttctctccacccttggtggaaaagaaactccatcagcagctgatattgataaaatattaagctctgttggaattgagtctgattcagaacgagtgaacaaagtaatttcggagctgaaaggaaaaaacattgaagaagtgatagctgcaggtaaagagaagttggcttcagtgccctcaggaggtggtggtgcccctgccgctgctgctgctgcacccgctgcagcctcacctgccaaagcagccgaagagaagaaggaagcaaagaaagaagaatccgaccagtcggatgatgatatgggctttggtctctttgactaa

SEQ ID NO: 1444 - DNA, 2736 bp, Nezara viridula
atgatgactgatcatattggtggaataacccttaaatgggatccaaaaaacctggaaatacgaactttgtcagtggagaaaactttagaaccacttgtcttacaggtgacaacacttgtaaatactaaagggcccagtaaaaagaaaaagggaaggtcaaaacgcgctcatgttttggttgcagctgtcgaaaaagccactgaaaattttattgaaaaaggtgaaatgatagcttatgaaaatcctgatattaagcaagaaatgctgtcagctgtagaagaagtgagaaaaacaggggaagctatgagtgcagctgcaagagaatttgctgatgatccatgctcatcaatcaaacgtggtaatatggtacgagcagcccgcaacttgctctctgctgtgactagactactgattctagccgacatggtagatgtacatctgctgttgaagtctcttagagtagttgaagatgatctggtcaaagttaaaaatgcatcaagccaaccagaactgcttgaaaacattaaagcatttggacgtaacgcttccgagttaatgtctcaggctgccaaacggcagcttgagctaaaggattcacagctgagggacgacttagctgcagcacgtgctgttttgaagaaacatagcaccatgttactgactgcatccaaggtatatgtcagacatccagaacttgctgctgctaaggcaaatcgtgattatgtttttaaacaagtttgtgaagctgtcaatacaatcagtgatgtagctcagggtaaaggaccatcgatcactaccaatccttacgaaggccctggcgagcttgcagctgctttggatgattttgatgaacgtatggtgatggaacctttggcttattctgaggtagctacaagaccatctcttgaagaaaggttagaaagcattataagtggtgcagcgcttatggctgactcttcttgcacaagagacgagagaagggagcgcatagttgccgagtgtaatgctgtacgtcaagctcttcaagatcttctgtcggaatatatggctaatatgagtgttaaagaacaaagcgaaggtctggagagagccattgatcatatgtgtcgcaagacgagagatttaagaagacagttgaggaaggcagttgtcgaccatgtttctgatagctttcttgaaaccagtgtccctctactggttttaattgaagctgctagagcgggtaatgagaaagatgtcgaagaatatgcattggtttttcaggagcatgccaataaacttgttgaggttgctaatttagcatgctctatgtctggaaacgaggatggggttaagatggtgcgttatgctgcggctcagatagatgctctttgcccacaagttattaatgcggctcgtattcttggagctagacctaaatcaaaagttgctcaagaaaatatggacgtcttcagggactcatgggagtctcaagttcgtgtattaacagaagccgttgatgacataacaacaattgatgatttcttagctgtttctgagaaccatatccttgaagatgttaacaagtgtgttatggccttgcaagagggagatggagattctttagatagaacagctggtgctatcaggggtcgttcagctcgtgtagcaaacgttgttactgctgaaatggacaattatgaaccaggaatttacacagaaagagttctggaagctattaaagttcttagagaacaggtgatgcctaattttgctcaaagagtagaagttgctgtagacgctctttcatcaaatcctcctaaagatgttgatgaaaatgaattcattgatgcttcacgtttggtctacgatggtgttagagaaattagaagagctgtcctcatgaacaggagctctgaagatttagacactgacacggaattcgaaccatgtgaggacaacatgactattgatacgaagactagacctagtgcacatactgatcatggtgttgatgagtatccagaaattagtggtattactacagcaagggaagccatgcgtaagatgacagaggaggataagcagaagattgctcaacaggtggaatatttcagaacagagaagttgaagttcgacagagaagtggccaaatgggatgatacgggcaatgacattattgttttagcaaaacatatgtgcatgataatgatggaaatgacggatttcaccagaggtcgaggtccgttgaaaacaacaatggatgtcattaatgctgccaagaaaatctctgaagctggaaccaaactggataaattaaccaggcagatagctgatcagtgcccggaatcatctactaaaaaagatcttttggcctaccttcaacgaatcgctctgtactgtcatcagttgaacatcacttcgaaagtgaaggctgatgttcagaatataagtggtgaactaatagtttcagggctcgacagtgctacatctctaattcaagccgccaagaacttgatgaatgcggttgtactgaccgtaaagtcatcttatgttgctagcacgaagtacccacgacaaggaacagtatcatctccaattgttgtttggaaaatgaaagcccccgaaaagaaacctcttgtcagaccagaaaaacctgaagaagttaaagcaaaagtgagaaaagggtcacagaagaaaatacagaaccctatcaaggctctatctgaatttcagagtcccgcagaatcagtttaa

SEQ ID NO: 1445 - DNA, 1170 bp, Nezara viridula
atgaatgagagtaatcttcaatcgactcccaaaaccaatgccgctactggtttcttccaaaccaccactcctaaacaagcgggcggtgttagctttggttctactaccatgtttatgcctccagcatcttcctctaatacaagtactccaaagactacagcaacaggtaatgcaacattgtttagtttatctactacaacagctacctctgctccaatggctagtggtgcagttacaacatcatcatttcccattagttcttccccattaactactcagcagttcaagcaaccttctacttctcaacctatgcaactgaaaacaactgctagtaccgctatgcctttgggtactggcttatcatcaatcggaggaaatgctccagccagtaccggactgaatttcggaagcactgctaaatctactaatgctggagccactttgttcagtgcaactaaaagcgcacttgcgcctgtcaacacggctgcgacaacttcatctttaacattgccaccttcttccacaacatctctcactagttcattatcaaacaaacctgttactagtactggtccttcaatctctcagcaacaaaatcttacatttcaacaattggaagaattgattttgaataaatggactgcagaattatacgaacaggagaaagtatttttaaatcaagcaacacagattaatatatgggacaaggttattaatgaaaatgctgaaaaattaactcagttacattctactatggagaaagtacggaagcaacaaggaaaaataaatgatgacctagaaattatatttactcatcagaaggacttggaagcatgtcttgttcccatggaaaaggaagacttactttcggtccttaaggctgatccgaatagaaaaaatctgtatataaatgctaagaaaattgattctcagattaaaactatgtcagaggatttgaaggaaacaattgaacatatcaatgaaacgtcacgatcacatgatacagaagatcccgtcatccaggtagggcgaattttaaatgctcacatggaatctttaagatggatagatgagcatactgctagaatgcaagattattttgattctttattaaaaatgcacgatgacttgaggagggaatgtgagataagcaaacatgatgtatattaa

SEQ ID NO: 1446 - DNA, 582 bp, Nezara viridula
atgttcatttgggattggtttacaggagttctaggctatttaggtttatggaaaaagtcaggcaaactgttatttttaggattagataatgctggtaaaacaactcttctccataggttaaaagatgacagattggcacagcatgtaccaacactacacccaacttctgaagaactatccataggaaatatcagattcacaacttttgaccttggaggacacactcaagctcgtcgagtatggaaagattactttccggcagttgatgctattgtttttcttgttgacgcttgtgacacaactcggttacctgaaagtaaagcagaattagatgcccttttgactgatgagagtctcatcaactgtcctgtccttattcttggcaataaaattgatcttccaggtgcagcttcagaagatgatctcaggaattttttcaacttatacgggcaaacaactggcaagagcaaagttccacgaagtgaattgtctggtcgtccattagagctattcatgtgttcagttctgaaaaggcagggttatggtgaaggtttccgttggttagcccaatatatagactga

SEQ ID NO: 1447 - DNA, 1791 bp, Nezara viridula
atgtctggaaacaatgtttatggtgaaatgctcctcaccataacgtctgagaagttttatatcgaacctgttcaagatatggataatagccttattctagatagggttacaggaaatataacaatatcaaatgttccaggaagcagtggggatgcaccagtggttggagaaaaaaaaactatttatggtattcttggtactattaggctactagctgggcaatacctggtagtagtgactggcagaactaaaattggtaatatatggagaagggaagtttttcagatggactctgctgaggttatatgtttttctagaagtaccactcatctgaatgataagcagaaaaggattgaaaaggagtatatatcaatgttggaatccattcttgctacgccttacttctacttttcatattcctatgacctttctcacacagttcagagattgcataatatatcaccagactttttaaaaatgcctatgtaccagagagcagagcagaagtttgtttggaatgaatatcttttatctgactttgccaaaaactcaggggtctctagattctgccttccaatcattcatggctatctttcaattacatcttgcattttaaatggcaaaaccttcagtctcatcttagtctccagaagatctaaggatagagctgggaccagactatttactagaggaattgactctaatggaaatgttgctaactttgttgagactgaacaaattgttgaggcaaaatttgagcgtgctagttttgtccagacacgaggttctatgccattcttctggcagcagtaccctaatctgaaactgaaaccaaggcctagtataatccaagaggaaaatcatactgctgccttcagtaagcattttgaaacacagctgatggactatgggagacaagttatagtgaatttggttgaccattctggctctgagggcaagctggaaggattctatagaaaactagtgaatgaagcaaataatcccaatctgaagtatgaagcttttgacttccacagagaatgttctaagctaaggtatgatagattgaagattctcatagatcgcctggcctatgatttagaacaaatgtcggtgactatgattgttggagatggaactgttatatctcagcaggaaggtgtattcaggacaaattgtattgactgcctggacaggactaatgtggttcaatcgttgttggctagggccaatcttacatatattttacagagactaacaatattaaagaaaggacaaacagttgaggatcaagttggtcttgaaaacacatttaaaatactctggagtgaccatgcagatctaatatcaatccagtattcaggtacaggagcattaaaaacggattatactagaacaggaaaaagaacgaagtccggaataattcgagatgggataaactctcttgtgcgatactacaaaaataattttcagcatggttttcgtaaagatgcattggacctttggcttggtcattaccgggtttcttcagaagaaggaatagtcatcagaagccctcttgatgttaaaagggaattcaaatatacagcttttccacttatccttcttgttgctattgctatgttcttcgcaaatctggttacaccaagtgaatataccactggcactctcctgtctctgatattctggtgctctatggtttcagcaactctcattgccatattttacaatggttcagagtatgtagattgcccaagactgtgccctcttcttaggtcaccatctgtctag

SEQ ID NO: 1448 - DNA, 1362 bp, Nezara viridula
atgtctcctactgttccaactaccacaaatgttgataagaggccaacacttgtcaaaccacactctgctgaaagaagatcagaattagtttgccgtgtcaagtactgcaacactttgcctgatattccgtttgatccaaagtttattcaatatccatttgaatccactcggtttatccaatataatcccacatcgctagaacgtaattataaatatgaagttcttactgaacatgatctcggggttactattgatctcattaacaaagatatgtatgctgctgatcataatgcagtacttgatcctgctgatgagaaactacttgaggaagatatcctcacacctcatgattctaaaaggtctagacatcattctcgatcagtttcatggcttcgtagaactgaatacatttccaccgaacaaacacgttttcaaccgcaagttatggataaagttgaagccaaagttggattcagcattaagaaaagtcttaaggaagaaactctttacatggatagagagagccaaattaaagctatcgaaaagacatatgacgatgctaaactacctatagagaaacatcatagcaaacctaatgtcgttccgatagaggttcttcctgtgtttccagactttcagttatggaagtatccttgcgctcaggttatgttcgattctgatcctgcaccaataggaaagaccgtacctgctcagctagaacaaatgtctcaagctatgatcaggggtgtgatggatgagagtggagaacaattcgtagcttatttcttgcctactgagccaactttagaaaaacgtagaagagattttacaaatggtattgattatgaagacgaggaggaatatgactacaaaatagcaagagagtataattggaatgtgaaaactaaagcttcaaaaggatatgaagaaaattatttttttgttataaggcatgatggagtatattataatgaattggagacaagggtacgtctgagtaaaagaagacaaaaggctggcactgctccaaataatactagattagttgttagacataggccaatggatgctaacgaatttaacattcatcgtctaagggagaagcaacttcagcatccaattgaagaagaagatgaagaagaaagtgctggtgaagaagaaaagaaagaggacgaaaagaaaacaaatagcaaagatactgatgaaagtgacaaggaagaaggtagtgacaaggaaggtggaagtgataaagatgaaggcagtggtaaagaagatggtagtggtaaagaaaatgatagtgctaaagaaaatgatagcggtaaagaaaatgatagtggtaaggaagatggtagtggtaaagaa

SEQ ID NO: 1449 - DNA, 1026 bp, Nezara viridula
atgaaactttatgtgcacatatggcaaaaaaataatgaagtacggttggcagaactagaaaaagaacatgaaaattcagttattgaagatgaagagcaagtgagcggtctgtggcaggcaaagttggactatctgtgtagcattggggacaaggaaaatgctagcgcattagccaacagcaagttacaggacaaaacggttcctaagactcatcgtatcgatgcggtttttgcattatttaggatatcgtatttccacggttgcgatatcaaagggatgtctgcagcaatcgaaaaagcaaccgaactcatcgaagggcaaggggattggagctctaggaataaattaaaagcctacgaaggagtgtggagtttcgccgtgagggattatttgcgtgctgcaaagctatttgttgatgttgttcccacatttgaatcatacgagcttgctgactttgggacaattattaaatacacagtactttcgtgtatgatagcgttgcccaggtgcgagttgaagaagaagctgatgcaccatggcgtgatggcccaggcacttcactctcaatatagaaacttgaaggagtatttccagtcactttacgatggccactatgcagaattcctagtcgcgctagctcaggtggaatccgatatgaaacgtgatcctctacttcatcctcattatcgccactatgtgcaagaaatgagacttagagcttataagcaaatcttgcaagcatatcgttcactctctttagattatatggcggaagcgtttggtgtttcctgtgaatttattgagcgtgaagtagccaaattcgctgcttcagggcgtctacaatgtaaaatcgattctgtggctcgttctgttatcacaagcgtccatctcagtgacgaagctctccgtgttaaagattcatctgatcttgatctcgatcgctctctcctgtataagaccactgtcaagaggggtgacattctgcttaatagactgaaaaagttggccagggttatggatttttag

SEQ ID NO: 1450 - DNA, 11247 bp, Nezara viridula
tggcaatgtatagattgtcgtgtctgccagctctgcagagaaaatgaagagacggggagaatgctagtctgtgactattgtgataaggcatatcatccgcactgtgttaggcctgcgatgtcttctgttccaaaagttggttggaagtgcaagcggtgtcggttatgcagtgattgtggggctagaacccctggaggcggtctttcatcaagatggcactccaattacacagtttgtgactcctgctatcagcaaaggaataaaggcttttcctgtccggtgtgtcacaaagcgtaccgggctgccgcactcagggaaatggtcaagtgttcgcaatgtcgaaggtttgtacatgggacctgtgacaaagaggcagactttgttagttaccacagaaagaaagaagcccatcctgattaccagtatatttgtttatcatgtaaaaataattcaaccattctctacctgaagaggaaagatagcactgaagatgtaaatatggattctgctttgaatatatctcaagaatctctagctacgccagaggatatagacgtggattccgaaaggtctgatgatcctccgtttcgaccatctggtgttggcctaggcaaaggaaaaccattctacgcctctaaaatagcaaagaaaaaactcgggttaggcccaggtcggcccaaaggaagtgggaaaatgtcttctattgcgttatctcactttcaaaagagacctcgttacgcagattttggtaggaagcgaggtgctaaaacgaaaatgagaggaatattcggtgtccccgggcttggtttacagagacctttaatggattctaataccaaacctgaagacgaaccaggacttgaaaataagttggttcttgtatcatctcgtgacaaatacgttttaagtcaagacgtttgtgttatgtgtggtgctttagggcaagaccaggaagcatgtcttatagcttgtgcacagtgtgggcagtcgtatcatccctactgtgtatcagttaaggttaccaaagtgatgcttcagcgtggctggagatgccttgattgcacggtatgtgaaggctgcggccaaagaaatgacgaaggacgattaatattatgtgacgattgtgacatttcataccacatctattgcatggaccctccactcggtgccgtgccttcaggtgtttggaagtgcaagtggtgtgcccattgccagacctgcggatccaacagcccaggtcccaatgcaacgtggcagtccaacttcacccagtgcggaccttgtgcttcaagaactgtttgtccagcttgcctagagctttatacagacggtgatctcataattaagtgtattcactgtgataggtggttacattgcctctgtgatacaatatctaacgaaaatgaagcggaagcgtgctgtgcgcaaggttatacttgcatcctctgtaggccaaataatgctgctttggtattacctgctacgacaccatcaagagctccatcacctgaaattaacttagaaagcaaagctacagactattatgtagatggtgtttgcctatctgaaaccggactgcaattaatcaaaactctttcaatggataatggaaatcaaccagttcggcgtaaaaggccaggtttcagaaggcaggatccctccgttgacctatctgtagatgatatagaaaatgaagggaaagacgcagtctacaaagacggtatgatctggggctctaaagaaaatggtccgatcccaagtccacctgaaggctttacattgtacacccgggaatgtggagtcgtcgtcttgaaacggataaagaagagaaatcttcagaggcttggcattggtggcttcaccactgtaaagatgaggagctccaggttcaaagaagatgatgaacatctttatcctgaagaaaaacccaggaggaaacctagagttcctaagaagaaaagcaaaattgccgagagttatcctagacatctccaagaagctttctttggcaaagaattactcgatacaactaaggaaacctcccaagaattagagagcactggtgatgaatcagatgaaggaaaattaagggttgtcgaagaagagagctctaaccaggaaaatgttagcgataaaaggagggaagtcgccaacagttcatcttcagctaaaataactataaaggaggaagaaggtagcgatggtgagacgttgaaggatattctacatctccctgaaaatcttcttcacaatgatctagtcaacacaatcatgaatgaaagtgcagatagtatcaaatcagaaaatctaatgtcagagagcggacatgaaggtagtggcagccaaaaagacgaactatgtgatattctcggacctcattttaatatagaatctatggtaagagaaacaggtcttccaaacatggacagcaaagatgttgaagaaattttcaaaggagttcttactgatgagagtcgaaatcagagccatcataatcaaccgtccccccatcaacagcatcctgttcctaaaagtacacctacaggaatggcttcttctccgctccaatatccatcagcttctccatataattcagaatatagcaatagccctcagttcagtccagaaagttcgtgggatgattgtggctcttataacaggacaacatcattaaaaatggaagcagatgaatccctcgggagagacgctaccatatctcctgttctgtacgccaacattaatcatccagagtggaagaaagaatatccaagttggaatgaacgtttcaaacaaattttaaagaaatggcgtgctctaccctctgaagagaaagctccttatcttcaacgtgcaagagacaatagaacaaactttcgcagtagaaagcaggagcatgacaaaacattaaataccaaatcttgccgggaagctgaacaagagcgacagtggaaggagttgcaagctctgaggcagcagcagcaacacatgctatctcaaacgagggttcagcaaggtacaaatacaaaggataattacgtgataatgaaccgtgtccgccaagttggtaatgcaggacttgtacaattttcaacaaatgagcagtctccatctccccatttgacgcaacagttacaggtttcaacttccactcaggaggctaatctaggaggtttaggatcgcctagagcacagtttgcttctggtactggtggcacagttaaggtcgcaactcctggtggtaccatttaccgacaggtgaggccgcctcaatcgccttttcagagcccaaggcaacctgctacaccacagcaacagcaggaggaagttaggcaactcagggatctcttacagaggcaacaagttaaacaagaaggaacggaaaccgtcttgtctagtggtgttcttcaaggagtacaaatgagacctcagccccctaggagcagcctgcacccacaggttgttcatggtatggaacctagagtcaggttagtagtacaacaacaggcctccaggtttccaggaaccactcaagtgagattggctgctcctaggacacaacttcaagatcagttcctcatccaacggcagttcgctgtggccgctgctgcccaacatgctcataatgcaagtgcaataattaggaatagtagtactttagttgatcaaacaagattgcaaactctgccagtcgaccaaagaatccaaaccggaggccgaggagaaggagaagaaataccagagagtgttactgcagaacttgaaaagttggaggaagaaggaggtaccattggtggtgaagctgatgaggtttccgcaatcttctctgacctagtggaagatgacgatgaattactcgcggaaatgggcccagattttaacatccttgaatatgctgatccagaacttgacactgtatcgggaggagaaaagacaaatatccttgatgatctagaagacgaagttgagaaaaaaaaacaagttgggagttccagaaaagaagatactgcacgaaggaggtctgcagaaagtattaataaagagcttaccgaacctagaccagaaagtaaaccaagcgaagaagtgaatagggtatctgtaacatccacaccaccccatctacctcaacagatatcactaactggaaaaagcggcattggccaaccaaaaattgttggatcaggttaccaaacacaatttgcaactccaactacgcccctcccaaggatgcaagttttgcaaggtggaaatcaagtgagtcgtggaggcgcaagcttcgtcgggaatcctccaccacctcccccaccttatcctggcccccctcctccatatccggggcagcaagctgcgatacgaggaaggggtgttagatcgcacatcatcccaggcccagcatcgcaggctcaacaaagaagaaccttgctacttcaagagcaaccactactgttggaagaattactggaagaggagaaaagggagcaagagaaagcttcagtaacaccctctccagcgagttccctcatgagtgacgctgactttgagatgctgagggccgatgtcctcggctcaaggaccaccagccctcctcagtctcaatctctcggcactcttaatcttgtcggacaacctcctccgccccctccagaaaatatcgtgaccgaggctgataggcaggcccagatccaatatgaagcatggctcaggacaaccggaagtgcagtcagccaacagatacgatattttgaaacagaagttcaaaaattaagaaaaatacgcaagtcgttaaatagtaaacagcgacaattgagaaaaaatggcaatgaattaaatgagaaagacgctatagaactacagcgtgtaaccggcgaacaaacaactttacagaaacacctggaagcagcccgaaaacaaagcaggcagcataccatggtgatgcaggaatatcaaacgaaacaggatagcaaaggaggtggaggtagcgctggttctgcttctccgcagtctcctcttttgtcgccggctggtggaggcatcggtggacatcagtcccaccaaccttcccctcaaacatcgtcggtctccccagtaagacatagcccagccggaacaccacattcacagagtggtgatgacaaaagcgaaggcagtggtcttccatctcccaggccaccccccatgacacccactccgcctagccctcatcaattccatcagataaggcatccctcgatggtgtcaaggtttgccagatcccctgaaggaggattaaggccacgtttggctcctctccaaacgtctggtttcaattctcccaggggaatgtcgcctcaaccgccatctcctcagacaatgagattgactcaacagcagcaacttctccttcaaagacatcaacttcagcagcaaaaacagcagattctagaacagcatcctgaagcgggggctattctgagtagacaactcttgagacaagaaccacagaggcagtacagaacattcccaggtcctcagagtcctggttctcaaggagggtctccattgtatagtcctcgtgctccacctagtccgatggtttaccaaggacttcagacaccgacatctccgatgcctcagtttacccagcccacatctccaatgcagtctcctcgtttacagtatgcacctagtagtcctcatcaacagcaatatcgtcccaactcccccatggtaccatcccctatgagaaggccatcctcagctagtccacaaggagaaggtggtggaggaaatcccttcaatcctaacaaccctattcctatacctcctgaaatacggaggttaaaattaggcttaaaaggaggttcgcctatgtggagtgataagagaaaaagggtgcaacctagtaccagttcagaaaaagttgctagcttagtttgtgtggactacaacgattttgaagaggaatctcctcctattactccaccatctaaacctgccttaattaaaaaaacagaaaatgttaaagctcgacaatccgaagacacagattcagaattaactgtttatgatgatattgtgttagttgaaggctgcaaagaaactaacttggaagttgcagagttgcggtctgcattagaaggaaatgtcatgtccactgtcgtttccatgccaatggttatagattcgggccagattcagatgatggatgttgaaggggagttgcttgatgaccttgtagttttgggtgtaggaaatggaaccactgacagtgattgtattttagaagtgaacaaagatctcattttggacgatgatgttaaagaagatgaacttgatgatggttctccaccaagagctaggatgcaaggtaaagttcttcctggtggaggctctcataattcaccttctcctgaatctagaaataactgtgatatattcaaaaaagtcgaggaaaagtctaaaaaactggaaaaggagagaaaaagtactgatgaaaggacagttcctgttcaaccaaacattgtagtctcgcgaactccaacaacttttacacctgtcgttactcagaaatcaataccaatagctgacaatcgtcaattagctatgcagcaagcagctgttgctagccttgtccaagatgctgtaaatgctgcaaagttggcagctgaagcccaaaatctgttgaaatcaagtcaggccaatgaacagcacagaaacgcaatttcccgtggcaattttgttccattatcggttattacgagtaaagcagcggatagcgaacctcttgtcaacaattccatcaagtctgatttaagaaagtcagaactgagcaggtttcaagatgttgacaacgggcaaaaagagatgccagaaaataaacaagaacatcaaaagtttcgtttagaaaatgcaagtgatttacgaataattaatactgagagttcaattatcaagtataaaacatcagagtcggtagatcgtcatcatgcccataatgaaataaatgtaattaaagaaaatgaagaaactaatgataagcgagaacacaaaattgttgaaaggattaaccatgtcgctccaaaagtagaaaatgtcactcttccttgtgtcagttcgagtatccttgaggctcagttaacatcgatgttgagaacgagtagtgaacccacttccaatcaaaattttatttatgcagttgttaatcatactgtcaaagaccagaggagggaagaaaataatcaggatgacatgagggtcgaaggtcttgctgctcacttccaaaggactgttaaaaatgaagagcttatgttgactgaaagtgatatttataaaaattctaggaatcctcatctcaataaaaaacatggcaacatatatgtgagttctcagataaagactgatactgtaatggtaggaggaaaatcttataaaatttatcaagctggtccacaatccagtacgagtgatattctgaccttaagggatgacaaggaagaagcaaatggcagagttgcccacaaggtgaatacaatagagagaaggctctctgtcagtaatgaaaaagctgcgaacgaaatgcttcaacagagggttgtttcgagttctgaaacagctgagaaagaaacacatcatttgagtttcggtgggccaaaagcacaagtggttgctcaaaaagaagaaccaaaaaagtttgttgcccttgctacgatgttgttaccacggaataatgaagagaaaagagtaagacctggcgaagactcgcaaaatgttcttcttaaacagctgcttcagaacactgcatgtgctaccaccaccactgcctctctaccaattgtaccatccctggaggctcagctcgctcgtcctgtacctccaaccccttcttctctcttgccatcagttttaaatgaacctcctaaagagatacagcagccaaaacctcaacaccagataatagaatcaccaaaacaagaaacacgcccccacatcggcccatcatcgctagatgagctactgtccccaccaccacctcctcaacagcttcagcaccacccgccttcagctatccaaacaagtccagtaatcaagcgtgaacctgttttttctttgagccagcctggccctgtgatgacacccatggtggatgtcaaaagggaagtcgaagttaaaaaagaagtgatgtcttctgatgaaatgttgtctccaggactacgtttggatcagatcgactcccaaccgcaagatatcaaaaaattgaagaagcgtccttatcaccatcaaaaacgacgccaaagtttaggaaaagaaatgattggaggaacaccgaaaaagaggcctcgaaagagctcgaaagtagaagaagattatgattctttcatagattctgttatgcatcaactgagacagactcccggaatgtcaatttgtgaacccaacctcacttataattttactggatgcccgccatttggggccggcgacatgagcaaagtcaattcatgcacacgccttggagaattacgtggtacttatggcaccgcttatttacctcatgaaaatgatcattataatacattaccttttggtgatcttccacctaaagctccttcgacaccagctactcagcggggattttataacgaggagttcgcacccttaaagttacacactgcaaaggatgactttgatgatcggaaatatgattacaaccgagatcgtgacaatgatacacctgatacaatcataagttcctccagtcctgagtgtatcatgccagaattccatccaaggtttccaggtttacaattaatagactcagataatgaagaagaaagattccgattatccaggttttctccagacattcctatcatcgctccattagctataaggccgaagcctatacgattctatagtgacatggataaggaaaatgaaactcctgacggcgagagaggtagaattagggaaagtgtaacagttactttaacactgactagtcaagcagctgacgacgttctatctgtattacgcaatttagccaatgtactccgaatacctgtacctgcaacgcatagcattacggaaaggagttccgcatcccaccgcctcggaatatatcgactgaagggcaaagatggcaaagaaggagctcaagtcgatatccaatctattctgaatggaactgccaagttttgtaggcattgcgatgtcgtaataatgaacaatcttatgaggaaaaaggcgtcggaaatgcccctagttgccaggcaaggggaagaagatctttacttctgcagtacgtcatgttacatgcagttggccctctctcatccacagggtcccaacaaggaaaaggctttaacaataatagatcatctagaaacaccttccaaaaagacgaaagttgaatcaacaactgattgcaatgctgtaaagatcgaaccaaagaaagaatttaaactttcttcggacccctcttacatgactaccaggggctcagggaaacgtgaaaaacaaagtagtgcttatgataaaacggctgtgacaaattcctatgcctcccatgccctaggaaagaaatctccttcaagatatcggacatggacaacggcaactattccacctccttccgccaggcataagaagcctactgacaaggaaattactgagatgctgttcaagagtggtatcactgtgatgcctttgaagttgcctgaagatagtcgacactgtctcctttgccatcaagttggcgatggtgtcactgatggtcctgcaagattattaaattatgatgtaaataagtggattcatttgaattgtgccctttggtctgatgaagtatatgaaacagtgaatggaggtttgatgaatgttgaaatcgctcttcaaaatggcctttcagttcattgtgcttattgtaacacacctggagctactttaaaatgttacaaaatgcgctgttccttagtttatcacctaccgtgcgcagtcaaagaccaatgtgtatttttcaaaaataagacgctgtactgtagtagtcatgtaccaaagaatgaaaaggaaaatgaattgactactttatccgtaatgaggcgtgtgtatatatctcgagacgaaaatcgccaagtggcagccataatgcaccattctgaacagacatcacttttgagagtgggttccctgatttttttatccgtcggtcaattacttcctcatcaactgcaagcatttcatacaccaaattatatttaccccgttggatataaaatcataagaatgtactggagcatgcgcactgtcaacaagcgctgtagatacatttgctccattgcagatgtggatggcaaacctgagttccgtatcacggtagaggagcgaggtgaggcagatatggaacttcgtgacaccactccaagaggagtttggttgaaggttttagaacctctggctgagcttcggaaagtttcctcggttgttcaattgttttctcgctatgttacgggagaagatctttttggacttactgaacctgcaatagtcagggttcttgaatctttgccaggcgttgaaacacttagtgactataaattcaaatatggaagaaatcctttactggaattacctttggctgtgaacccaactggctgtgctcgttcggaagggaaaccaaaaggttggaaaagagctcatacgcagagagctacgtctcttagggggggaggaagtggtcctgcgtttgctccatctgctccactacccggagaacttgcctgcccctactcgaagcaatttgttcattctaaatcgagtcaatataagaaaatgaaacaagagtggaggaataatgtatttttggccaggtctaagattcaaggattaggattgtatgcagcaagagatttggagaggcatactatggttattgaatacatcggtgaaataatccgatcagagcttgctgaaaccagagaaaaacaatacgaagctaagaatcggggtatttatatgtttcgtctcgacgaagaccgtgttgttgatgctacgttgtgtggaggattggctcggtatatcaatcattcttgtagtccgaactgtgttgcagaaacagtcgaagttgacagagatctcagaatcattatttttactaaaagaagaatttctcggggtgaagagcttgcttacgattacaaatttgatatcgaagacgaccaacataagataccgtgcatgtgcggtgcccccaactgtcgaaaatggatgaattaa

SEQ ID NO: 1451 - DNA, 702 bp, Nezara viridula
gaggttttaagattctactattgggatgccgcagaggaaatgtactcacaaccagggactgtatttttttttggaaagattttgattgaatcagctaatacttatgtaagctgttgtgtctctgtaaaaaatattgaaaggcgtatatttctcctaccaagagaaaggaaaatgaatctcaagacaaatgaaacatatggtgatcctgtgacaatgactgatgtttatcaggaattcagctcaattgtagctgaaaagtataaaataaagcagttcaaatcaagaaaaatttccaagaaatatgcttttggtgataacagtgttcctgcagagtctgagtatctggaaataagatatccgagtacttctccagcactgcccagtgatctcaaaggcgaaaccttttctcacgtatttggaaccaagacatcatttttagaaattcttctgttggaaagagggatcaaaggtcctagttggattgagatcacaaatgctgaacctgttctagctccatttacttggtgcaaagtagaggcatcctgtatgaaagccagcgatgttcatgtgttgaaacctggtttgccgcacattcctccattagttttggttactcttcatccacaagctgtccataatccgaaaacaaaacaaacagaaattgttgctgtaggctgcttaggcagtaactcataccctgtt

SEQ ID NO: 1452 - DNA, 1440 bp, Nezara viridula
gggaaacagtcagtaaggttattgtttttaaaaggcgacatggcggctgggacccaggttaaaaatgtggaagtccgcgacattgcaagaattgaacgaattggagctcattcccatattcgaggtttgggtttggatgacagcttggaagcgagagccgtatcacaagggatggtaggacaacaaatggccagaagagcagctggagttgttttaggaatgattaaagaagggaaaattgctggaagggctgttttacttgctggaccccctggcacagggaagactgccattgctatgggtatttcaaaatcacttggtaaagatactccattcacagctatggctgggtctgaaatttacagtcttgaaatgagtaaaacagaagctctgacacaagcaatacggaagtctattggcatccggataaaagaagaaactgaaatcattgaaggtgaagttgtcgaaatacaggtggaacgaccagctacaggagttggtgccaaagttggaaaactcactttaaagactacagaaatggaaactgtctacgaccttggaacaaagatgattgatgctcttaccaaagaaaaggttcagtcgggtgatgtaattactattgacaaggctactggtaaaattagccgaatcggtagatcatttaccagagcaagagattatgatgcgactggtcctcagactaggtttgtccagtgccctgagggagagttacaaaagagaaaggaagttgtacatactgtatcgatacatgaaattgatgtcatcaattctaggacccatggattcttagctctcttttcaggtgatactggtgaaatcaagccagaagtcagagaacaaatcaatacaaaaattgctgaatggagagaagaaggaaaagcagaaatctcacctggtgttttgttcattgatgaagttcatatgcttgatattgaatgcttctcatttttgaatcgagctcttgaagatgagatggcgcccgttgttattatggctacaaaccgaggtatcactaacatcagaggaactaattatacatcacctcatggaattcctattgatctcttagacaggatgataatcatttccacctcgcaatacagggagagtgagcttagagaaattttgaaaattaggtgtgaagaagaagattgtgaattgtctgatgatgctttgacagttcttactaggatagctatggagactagcctacggtacgccatacaactgataacactagcaggcctggtatccagacggagaaagagtaatgaggtagaaattgaagatgtaaagaaagtctattctttgtttttggatgaaggaaggtcaacacagatcttgagtgaataccaagatcaatacctttacgatcagaagcctgatgttggtggaagtggagaaccaatggatctgtga

SEQ ID NO: 1453 - DNA, 1110 bp, Nezara viridula
atgtctatccgaacttatggtgataagccgatcagtttccaagttgaagaaaatggagaatattactgcattggatctgaagtcggtaattatttgcgaatgtttcgaggatccttatataaaaggtatcctggaatgtaccgaagaactcttggaaatgaagaaaggaaaaggcttatagaacttggactaagctctcattgtttagcctccagtatatctttactaagagcttcagaagtcgaagatatcattgagggaaatgatgaaaaatacaaagctgtttcagttcattcttctgaaactcctattacgagttcttctaaacccaaaaaagctatgccttgggtaccttcgcttccaaatagttcacatttagatgctgtaccacaggcaacaccaattaacagaaatagagttgttagtaaaaaagttagaagctttcctctttgctttgatgacactgatccatcatctataatggaaaatgcttcacaaatggaagtacttgtaccaatacgtcttgatatggaaatagagggacagaaacttcgtgatacatttacttggaataaaaatgaaagtttgataacaccagagcagtttgcagaaatactttgtgatgacctagatttgaatcctctcagttttgtccctgctatagcccaagctattcgtcagcaaattgaaggttttcctactgacaatattttagaagatcagactgatcaaagagttatagttaaactgaatatacatgttggtaatacctctctcgttgatcaaatcgaatgggacatgagtgaaaaagagaatagtcctgaacagtttgctatgaaattgtgtgcggaacttggattaggaggcgaatttgttacagctattgcttattctattcgaggacagcttagttggcatcagaaaacgtacgcttttagtgaatctcctcttcaaactgttgaagtgcctttccgaccgcagtcagaagcagatcagtggtgcccgttcctggaaaccttgactgacgcagagatggagaagaagataagagatcaggacagaaatacaagaagaatgaggcgattggccaacactactcctgggtggtaa

SEQ ID NO: 1454 - DNA, 654 bp, Nezara viridula
acagctgctctttgggctaggaatgtccacttagtactgttgggagttgttctaagtggttattgttttgtgatggctgctatacgtaaaaaattagttatagttggcgatggtgcttgcggaaagacttgtttgttgattgtatttagtaaagatcaatttccagaagtatatgtgcctactgtgttcgagaattatgttgctgatatcgaagttgatggaaagcaagtggaactagcattgtgggatactgctggtcaagaagactacgatcggctaagaccactttcttatcctgatacggatgttattttaatgagtttttctattgattcaccagattcattagaaaacatacctgaaaaatggacccctgaagtaaaacatttttgcccaaatgtacctatcattcttgtaggaaataaaaaagatttgcgaaatgatccaaacacaattaaagagttggcaaaaatgaaacaagaaccagttaaaccagaagaaggtagagctatggctgataaaattaatgcctttgactatcttgaatgttctgccaaaacaaaagatggggttagacaagtgtttgaaacagctaccagagctgctctacaagtcaaaaagaagaagaggaaccgcaaatgtaagcttctttga

SEQ ID NO: 1455 - DNA, 3966 bp, Nezara viridula
atgaatttgagtttgagtaattatgaaagagttccaccactggattgttatcaaccctctgggaatcttttagatttagccgaccgtatgctagaaaaatttactgtagaagataataatttacctcaactgctggacagacttcaaatcacttgtgaaagtggaacaacatcaagcggaacaaaggatactgattatattaataatgtggactccagttacttatctcaaatatctcagttccgattgattaataagataccacttcctcaagaaatatctgaccagtttaccactcttgcagctggttcatcaggagatacaactaccatgggaatgtttccagatattaatagagcctggatggcagttgaaagtgatatatatttatggaacttcgaaacaggaggggatgtggcatactttgatggtttaagtgaccctatagtgagtgttggccttttagctcctagacctggagtttttcaaagttttattagtcatcttcttattcttactacacctgtagaaataactgttcttggagttattttggcatcttcaagtgatcgaaaagttggtgatgaattgcaactcacaccagataccatttacactttatctactgatggtgttcctataagggttattaaaggaacaaagaatggacgaatatttcttggaggaaaagatggaaatctttatgaattagtttacagaaaagaaatgagctggggtggtaagagagcttggaaagtgaatcataccaaggctattctgtcctatcttgttccaacatttgtgtcaggagctttttctgaagaagatcaaataacagaaataacggtcgatgaatcccgaaatattctttatacactatcaataagaggatctattgaagttttcgatcttggtagaaatggagatacaacgtgtagagttgcatcacttcatcattcttttatcaaccgaagtactgttgatcttattaggaatataactcctccagatgttagtcgagtcgtgagtctttgccccatttctgaaaatgattctccacattttggagttgtgggtgttacagaaaatggaattcggttatattttactacaggaagcccacctaggccatctacattgtctcttcttcatgccaggctgcctcctggacatgctcctaatacatcaaatgtgaggattggcagagtagctatggctattcataaatcaggtacatttattatggtatcatccatgggtgactattctcctgaccggttatggtgcttcactatggatggtttatctgctttgaagttacccttaacagaatttgtctttacgaatcctcaaaatgcttcaattgctattgctgaatcacgggaaaatatgagtttgacagatcgaggattacatggacactttctagtttaccagcaaaattatccccaggatagatttattattttaagtcagcagggcacagatatttatgaaaagctgagacctgttgacatatttggtgagctaatgcgagagaaaggtggaccagactgtgaagaagtaaaacaattctttgctcagcatggttcagatcaagcatgtgcaatggctcttatacttgcctgtgacgaaaccaatcaacatatggcagaatgggcaactcgtgctttttttctttatggaggtgaccctaaatatgttctacaaaccattcagcaacctatacaacagccaaccatgaccaaccctcttcagcaaagcataatgcatcatacattacctttaggtttcaaaccaggtaccgtcagtactcctttaggagagaagcaagtgcaaccctcaagaagtatagaaacttatggagtatcaatgtcatccaaacataatgggctctacattttccttagtcggatgcttcgaccagtttggttaagaagagttttagatgtcaattataataaaaaacctatttacctgccaactattacttgtgaagaacttagtttaaagacagttcaactgtatgagcttcgttcatttcttgcaagatacaccttaagctcatcagatgttggtacaagtttgcagccagccaacaatacaactgtggtttctccaagtggccaacgcactcgtttgcaggaagcgctcattcaagaaaaggcctcacttgatgctttaaggaattttgttgagcgaatcacccaagttttctctctttggaagttgttatgtgatcatgaattgcctctaattgtggaatctctttctccggaaagtcaagatcaattaatacacattacatttagagagtttattcttaaaggagaagatttatgtcatgaacttatctcaaaattagtcagtttgtatttgaatgataatgcttctgtcgatccaatcagttcaaaactgagagaagtgtgtcctcttctttataaaaatgaagacgcaacatgtacaaaagtaaatgaaattcttcaaatggcattagatgaagttgatgaggaagctaagttgaacctcttacgatcagcgattgatctttgtaaaaatgtatcaccaaatgttgatattgattcagtgtgcaagagcttagtcaaatgtggatattatgacggagttttagaaatgtgccaggatgtcgctagcaaatctgattcaaattcactggcttcaaagtttatagctagaggtaggcctgtagaagatgttgaaggaagcaaggcatttgaagccagacataaggcttaccaacaaatagttcatttattagacttcctgtaccaacagtgccaattgggaggcaataatattccccctctctttggaagtgctgacttatcttctcactcacaaaaacttttggaggccacccttgaaaaatgcttgtcagtagaagatgaaacttgtcacattgtggtttatgattggcttgttagccgagaactccaagcatcacttgtttcattaggtagaccttcagttgagagatttctttcacgctatcctgtcgatagccctctaagagatcttttatggcaatatcatgagaaatcagggaatcatgctcctgctgctaatatactgtataagattgctactgcccctggagaatttataactctccatcaacgattaacatatcttggaaaggctgttatgtgtatgcgaagtgatggagtgggatgtgcatcacatttaggtgtatttctccatgaattagaagatttagtacatgttgctcgagtgcagaaacagattttagaaaggatcacctcaatgccagatgttagtgacataaatgtacaagatgcttgtagaaaactcaatgccaatttactttcaatcactgagctctatgaatcttttgctgagccttttggactttgggaacagaaacttgccattttagactgtgctggtcatgatgataaagaactcataaattctatttgggacaatataatactaaaagagcttgatcagtgtaattctagagatccttctgggcaaatggttgtactagtatcaaaagttagatcattaggccttcagtttggtatacagtctccatgttttcctattgaatatcttgtttggcaattggaattgatcagctgcaagcttggagtagataaatttcatgtacacaatatcatgacatcattaggtgttccttattcaacacttctggatatctattcaaagatgtattcagcaaatgataactgttggcttgaatctgataatgaatttcatttgattcaagtgattgcaagcttctgtgaatcctttagcgataacaaacagttgacaacctcagcacaagaaagaaaatcaactgctgtactaatgcatgacttgattaatgaatgtataattgttcttcatagcaaaactggattgggtgagctggtcggttatcttaaaagcatacaaactaaattggaaagaatctag

SEQ ID NO: 1456 - DNA, 3633 bp, Nezara viridula
atgtctggaagtgatttttatggggctgatacgttgcacaaagaagtctatataagaaaagggcatgaggactggaatgaaataaatttgaatccaggaggaattgcaagtacccttcaggatgttaaaacccaacaacgagcaggagcttatgcctacaaaaaaattcccaatagattcatatattggaggactgaaggaaatgttcttgaaatggttgaagaatcccttgacgtaacattgcatggtaatcagattagatacaaatttactgatagtcaagtgttggatggtttgactgttacagaaactatgaaaagactgattattcttgttcctactgtgtctagccttcacgttttcacatatccacatcctgagaaactcttgaaaaagggatttggtgaagtgtctagtttgtctgtttttcatggcattagtgaaagtgatgctacggatccacagacctaccatcaactgaattgttcttccagtgcaattgttagctgcacatcttgtattgcaaataatggagaagctatatttgctcttggattagcaaatgcttcagttcttcttgtcattgtagattctgttagtggcttatcttcttctcgtattctttcccatgataacattgttcctagatttctcacaggaattttgggaaaggatggtggagaatgggttccagttagtttgattttgcattatataaaaaaagaactttttctcttcacactttgtagaggaggaagccttcgtgtatggtcagttgatagaggatcatttatcacgtctctatgtgtgaagttaacaagtcaaacaacattgaaagctcagaaacacaagatgtgcaaaggatatataaatggcacttttatattacactgttgtgtacaaggtgctgctattgtaacattagctccagattatggtaatggtgtattcaactttacgaccatttcggaaatacctattcaacctggttttgaagttacaaatatgtgtcctggggaggagggatatttttggtgtagttggttaacattagatgaatcacctgctgttaccaagaataatgtcattcatccaggattttctaaggtggcattaaccagaccttctcttcaagtgccagtgtcagactacattcctagggatccagcttctcattatttagatgccatattttcctctggtttcttcacttctttggatatagctaaagcaatttcactttataaaataactgctgtaataaaaccaaacatcgatgttgctgaacagatttgtgccatagtggaaactgaaatttattcagaaattggtgaacaagaattggatgatgatgaattcttagatattgcttttaggtgttggaatcgattatattcatgttgcagtcagtatattatttcaagtatgcttcctcttggaatggtttggctcggagattacttagttttaattcaagaatgtggtttctcaatagttgttgatattgaaccattagaactttttatgacaactgctgtaaagtcttcacaatttccacaagttggatacggctggcttgtagaaaagcttagggatattaatttagaatctggcattgttaagctggaattgagcattcatactggagaatcaattgatgagctttccatccttcaagaagctgctgatctcattcatccttctaagcaacttgatgatgctctaagtatcttctatgaagaaggtttaggaagaagtttaaattgtcttatagaagaattagctgtgcctgaagattttaataaagatggtacctgggaatcgttttgtagttatagtggcgttggtgctgtgacatctgcatttcgagattatgttgctgtgaggttaaagatttgtgaaaaaatgttattgcttactgagcttgctatgagagatgatgatggtgctgcagataggactcaacacaggagcttagctgccctttgtaaagcgtattatattttaaaatggatctgtacatccaagtccactggaaatgcacccatgattcatgtgttttctttggtcaacccaacatcaattatgcaatcttctcttgaacaatgtgtgcttggccttgctaattgcttatggccattagcaacaaatagtacacttgctcagcatttgctatcaaccaaacagtatgcacttctacaaacatttgcaagattagttggaataaataactggagtttactactagcagaatcatacattctgacaggacagcctggcaaggcatttgatgtttgtttaaaaaatgctggatcagatgttgtgcacttcctgaatgctataagactttttgaaaaacattcgaggtctgatttagtaatagaaatggcaactaaagctttggaactccttattgtttcacattctgatagggaaacactcgaatcagcattatttgttcatgaattaggaatggaaaattatgatgctgcttggagttggattgaatcgtgtagttcttggtcccgcagatctgactttttgcagcgtcttgttgctaacatgatatcagaaggaaaactcactgatcttatctcattttcttatactggtctcctagatgaattagaaaagcttcttgcttcgcgtgctagatctttgactttcggccttgccactaactactataatatcttgtatgctttccatgtcaaacatgaaaactttaagaaagctgctagtattatgttagaaaaagctctacgtgcagacactgctgaagtacaatggaaatgttatggtgcctgcctcagctccttgatgttgataaatgatccccaacaagcttggctagtgcgtcctaatccattctctcaagaggatgctgtagaaatactagaaatcgaggatattcaaagagaatttgagttgtctggagctcgatataatttagatggatgttcaccagatgcttctcaggaagaggtaattgcattatgtgtcacccaaaaactatacaaaacagcacttcggctagctaatatgtgcaaactttcttgtgcaccttgtattcaagctttcacagctagttgtgcagctctctctgaacaatcaatatcctggcattggttgaaagcaaatgaaattgatgatattattataactgaatctaatgcaaatgaaatgttatggaggattttagaaagatgtattttgaagtatgaaaaagaaaatgaaacagtgcttcatcgggcttctgctaaccaacttttaactgttggtttgtttattcctacttggcttcttcaatcttataagaaaagaaatagctcagaattgcttcgcctgtttgttcaacatggatatttggaagaagctgaggagctagcatgtgaatacttaaatgcagctcttgggattggtagagaacatttttcaattgattttccactgcatctttcatctcctcccctttgtctacctttacaaactatagatattttacttctagagctaaaacattataatataggggaccggctgcaaaaaaaattggatacatatgtaaacacaatttcaaggattactttggaaaggcctatgattgtttctacaaaaaaaaataacttgtaa

SEQ ID NO: 1457 - DNA, 2901 bp, Nezara viridula
atggagatttcagaagagaatttacacaccctcactaactatttaatgcagacactaagcccagatcccaatgtcaggagacctgctgaaaggttccttgagtcaatagagataaataaaaattatcctattttactattacaccttatcaataaagaggatgtccattacacgattcgtgtcgctggtgcaatcacttttaaaaattacactcgcaggaattggccaataaatgatgacaacttggaaaacaagatcgatcctgaagaccggcaacgggtcaaagagttgatagtagatgttatgttggttgcaccttctagtattcagaagcagctttctgaagcaattggcactattggaaagtgtgatttcccaaaagattggcctgggcttctgacaaatatggtcgagaagtttgccggaggtgacttccacgtcattaatggaattctacaaactgcccattccatattcaaaagatacagatatgaattcaaatctcaaaagttatgggaggaaataaagtttgtcttggacacctttgcaaagcctttgactgatctggctgtggctacgcaaaatctaactcaagtacatgctacaaatccagatgctctacgagtgatttattcatcactgctcctcatttcaaagattttttactctctaaattttcaggatctgcctgagttctttgaagataatatgaatatttggatgccactatttcatacactccttactactgatgttaagtgtcttcatactgatgttgatgacgaggcaggtttacttgagcaactgaggtctcaagtgtgttcgaatattgcattgtacgcacagaagtacgatgaggaatttcaaccatatctccagggttttgtcactgatatctggagccttcttgtatcagtttcacttcagcctaaaaatgatctgcttgtcagcaatgcactgcagttcttatcaacaattgctgagagacaacagtaccgccatctctttgaagacaaaaatgttctcactggaatatgtgaaaaggtcatcattcctaatatacactttagagacgctgatctggagctctttgaagacaatccagaggagtacatccgaaaggacattgaaggttctgatgttgaatcgcggaggcgatcttcatcagagttggtcaaagtgttggcaggtcactttcctgaaactgtcaggaccatttttggcgctagattacaggaaatgcttggagagtataatagtgatccaggtaaatggaggttgaaaaacacagctgtgtacattgtcacatctctagcggaaaggggttcaacagcaaagcatggtgttacaaaatcatctgaccttgttgaccttcatgattttgctgggcaatatattattcctgaactaaaaaaagaagtgaatacgttgcctgttattaaagccgattccatcaagtacctcatcacctttaggagtcttcttgccccacaggtggttatagctgcctttcctgatatagtaaagcatctttcgtcacccagcctcgtagtacactcctatgcagcttcagctattgagaagttattaattctgaaacagaacaaccaaccactaataacacaggagctcctacgaccaattgctggtgaacttcttactggtctattcaatattctcaacctaaaaggctcagaagagaatgaatatgctatgaaagccataatgagagctttcagcaccttggacgagtctgttatcccatgcttagccgaactgctgcccaagctgacacagaagttgactattgttgctaagaatcctagtcgtccacacttcaaccattatcttttcgaaaccatttctctctctattaggatagtgtgtaaaaataaccctggtgctgtgagtgcatttgaagaagctctctttccaaccttccaaataatatttcaagaagatgttcaagagtttgtaccttattgtatgcaagttttgtctctaacacttgcacggaggtcaccccctctgcctgcgccctatgttgctctatacccatgtctattgtcacctcaactctgggacagaccaggctgtgttcgaggtcttgtttgccttctgcgttcctatgtcagggtctcgtccaatgatgatttcaatcagacagttaaagttaacgggcttcttggggtattccagaagttgatatcttctcggttgaacgatcatgaaggattctatctgatgcagtctctcatagaacactgccctcgagaacttcttgacccgtttatgaaacaggtagttctccttctcttccaaagactgactgcggctaagacaaccaaatatgtcaaaggtctcatcacgttcttctgtttacttgtcgtcaaatatggggcaccaacatttatagaacttgttgactctgtacaacctcagatgttctcaatggttgtagagaggctcattactcctgattgccggaaagtatctggttctgtggagagaaagataactgttgttggattatgtcgccttgttgctgacttaaaacaagttttctctggaccatactcagcctgctggccagctcttgctaaaagtgtggttgaattattagaagccccggaggatgattctgttgctcctgaagatcactttatagaggtggataatttaccaggctatgaaccagcttatgtccatctgactgcaatcggcagtgataagcatgatccttttcctgatattagtgatttgagaagagaacttgctaatgggatcggcagcctcttcaaagtttcaggacaagttgtcacccaagctatcgccaaccttggagaaccttatactagtcacatcaaaagctatctcaccctgataggagttatcatatag

SEQ ID NO: 1458 - DNA, 576 bp, Nezara viridula
atggcgaaagtccagataggtaatgttttggtgctcgataatccctcctcttttttgaatccgtttcaattcgaactaacattcgaatgtatcgaagaattaaaagaagatttagaatggaaaatgatttatgttggttctgcagagagtgaagaatatgatcaagttttagatactatttatgttgggcctattccggaaggaagacacaaatttgtctttcaggcagatcctcctgatgtaactaaaatacctattgaagatgcgcttggtgttactgtggttttactaacttgttgttaccgtggccaggagttcgtgcgagtaggatattttattaataatgaatattccgatcctgagctaagagagaatcctcctgcgataccacagtttgacaaggttgtaaggaacattttaggctctgaaccgagggttacaaggttcaaaatcaattgggacgactcagagtcacaagatcaacctagtcaagaatcggaagaacaacagcaaacgacagaaaatgtaggctttgctgaaaatagcggcagtcataattttatggaagtatcttga

SEQ ID NO: 1459 - DNA, 891 bp, Nezara viridula
atggatcacatgcttgcaagtccgtttaatttacctagtataggtactccagtccatcaacccgaagaagatcaacagatattacctatagcacaacagcaacaacaattacaaccacctttgcaaatgccacctttactaccaatacaatcttcaattaatcagccaaaaccaatgaacacttatgccccttcaatgggtttcacaacaccgcaaagtatgatgcatccacaaacaccacaaaatctcatgtcacctatggtaaatagaatggaccagacgccaaatagtattattaatccaaccactcctggaccaatgacacctatgacaccatcgtctgctgaccctggctttatgccgcagttacagaatatagtgtctactgtcaatttaggttgtaaattagatcttaaaaagattgcattgcatgcaagaaacgctgaatataatccaaaaagatttgctgctgttatcatgaggataagagaacccagaacaacagctcttatttttagttcaggaaaaatggtttgcactggtgcaaagagtgaggatgattctagactagcagcaaggaaatatgcacgaataattcaaaaattaggattccaggctaaatttctagacttcaaagtacaaaacatggttggtagttgtgatgttaaatttcccataagattagagggtttggttttaactcatggacaattcagcagttatgaacctgaactttttcctggacttatttatcgaatggtgaaacctcgcattgttttattaatatttgtatcaggaaaagtcgtactcacaggtgccaaagtacgtcaagaaatttacgaggcatttgataatatctacccaatattgaaaagttttaagaaacagtaa

SEQ ID NO: 1460 - DNA, 483 bp, Nezara viridula
atggcttctgtcggcacaaccagatctgttttgaggcttctctcttcacagcctattttaaaacaagctgttaggggctatgcggatgagatggcattcacatttgctgcagctaataaggttttctatgccaactccaatgtgaaacaagttgatgttccctctttcagtggagcttttggtatcctccctaaacacgttccaactcttgctgttttgaaacctggtgttgttactgtttttgaacaagatggctcctctaagaaagtttttgtttcaagtggaacggtaacaataaatgaggactcttcagtacaagtattggcagaggaagcgcaccctgttgaagaccttgatgcatccgcagctagggagcaactctctaaagcacaaggggacttatcgaaggccacctctgagcaggaaaaagccgaagcactcattgctattgaagtagctgaagcccttgtagcggctgcctaa

SEQ ID NO: 1461 - DNA, 936 bp, Nezara viridula
atgccttcggacgaacaagataaatttgatggtatgttgctggctatggcacaacaacatgaaggaatcaaagatctccttgatactttcttcagttttttggcaaggaagactgatttttatattggtgctcaagccgatgcagcaaaatcattagttttagattcctttgagaaataccagtcaaaagcaaatttggctgctgaaaagaaaagaactgaaagtgttgaagctgaaaagaaaaggaaagaaaagcttgctgccaaggccactcctaaagtaatggaaataactgacgaagaagcaaaagtaattgaagatgaagaaaaaaagagaaaagaagatgaagaaatagctctatcaaaaccaattacagaaaccgaaggcgaagatgaggaacaagataaaggaaaacttatgcccaatgcgggaaatggtgctgaccttgagaattacaggtggacacaaactctccaagagttggaaataagagttcctctgaagactacttttaatgtaaagtcaagggacttggtggtagaccttggtaagacacatctgaaaattgggctgaaagggcatgaaccaattgtggacggcgaattagagcatgaaatcaaaattgaagaatcaacctgggtcattgaggatggcaagactctatttctaactgttgagaaggtaaataaaatggagtggtggtcaaggctgttagcaacggatcctgaaatagctacccgaaaaattaatcctgaaccatcaaagttatccgatttggatggtgaaactaggggtctggttgaaaaaatgatgtatgaccaaagacaacgtgagcttggacttccaacctctgatgagcaaaagaaaaaagacatgctcaaaaaattcatggaacagcacccagaaatggatttctcaaagtgtaaattctcataa

SEQ ID NO: 1462 - DNA, 429 bp, Nezara viridula
atgacgacaccatggagcccagacaaaaagcacagtgacagagagagatggatttgcatatatccagcatatttgaacagcaaaaagacccgtgctgagggtagaattattgcaaaagataaagcaatagaaaatcctacataccaagaaataagggatgtgttatcagcagctggtttgaaagtaggtgttgaaaacaaactttacagtagagaaaaaagtaaagagcttctttacagaggtcgaataagagttcagttgaaaaacgacaatggtactccattaaatccagatttcgctaccagagaatccgtaatacttcatgcttgttcaatgattccgaagttgaaaacacgccagggtgggaagcatacgactgagcagagtcagggtggaacaagcaagaaaaaaggaaaagggagaagataa

SEQ ID NO: 1463 - DNA, 2031 bp, Nezara viridula
atggagaaacctcagaaaatgcctaaagtggccaaggttaaaaacaaagcgcctgctgagatccagatcacagcggagcagcttttgcgagaagcaaaggaaagagatttggaaatagttcccccacctccaaagcagaaaatctctgatcctgaagaattagcagattatcaacatcgtaaaagaaaggcttttgaggataacatcagaaaaagtagaatggtcattagtaactggatcaagtatgcacagtgggaagaaagtcaaaggcaggtcgatagggctcgatcgatctatgaaagagctcttgatgtcgatcatcgaaacatcaccctgtggttgaaatataccgaaatggaaatgaggaatcgtcaaattaatcattcaaggaatctttgggaccgggcagttacaatacttcctagagcaaatcaattttggtataaatacacatatatggaagaaatgcttggaaatattgctggttgcagacaagtttttgacagatggatggagtgggaaccagaagaacaggcatggctcacatatatcaaatttgaattacgttataaagaaatagaaagagctagggaaatatacactagatttgttatggtacatcctgatgttcaaaattggaaaagattcgcaggtttcgaagaaagacatggattcatttctggtgctaggaaagtttatgaaagagcagttgagtttttcggagaggatattatggacgaacgtctatacattgcttttgccaaatttgaagaaggtcaaagagagcatgatagagcaagggtcatttataaatatgctctagaccatcttcctaaagaacgcactgccgaaatatataaggcctatactattcatgagaaaaaatatggagacaggactggaattgaggatgtaatcgtgagcaaaaggaaataccaatatttagaggaagtaagaacaaacccgatcaattatgatgcttggtttgacttgctgaggcttgtcgaagaagagggtaacgtagatactattagggaaatgtacgagagagctattgcaaacataccaccatcaagggaaaaagatatgtggaggcgttatatctatttgtggattaattatgccctatatgaagaattagaagcagaagatgaagacagaacaaggcaaatttataggacatgcctcgacatcattcctcataagacgttcacgttcagtaaaatatggctgttatatgcccagttcgaaataagacataaaaacctttcaacagcaagaaaaactctgggaatggctttaggagtctgtcctagggataagctctaccgtggttacatagatcttgaaatacaattaagagaatttgatagatgtagaacattatatcaaaaatttttggagcatggtcctgaaaactgtattacatggatgaggtttgctgagctagaaacactattaggtgacacagatagagcaagggctatctacgaacttgccgttaatcaaccaaggctcgatatgcctgaaattctctggaaagcttacatagattttgaaataaacattggtgaatcgaggaatgcaaggcaactgtatgaaaggcttttagaaagaactcaccatgtcaaggtttggatgagttacgttaaatttgagatgtctcatagcgaagaagagggaatcgaacctatttcattggcaagaagaatttatgagagaggtaacattgctttgagagaatcgggagaaaaagaagaaagaattttgttgttggaagcgtggagagaaatggaaaaggttcatggtgacgaggaaagtcataagaaggtcgaagccaaacttccaaggcgagtccgaagaagacaagctgtcattgctgcagatgggaccgaagaaggatgggaagaagtatacgattatattttccctgaagacgaagccgtcaagcccaacctcaaacttttggagaaagcaaaagcttggaaaaagaagcaagaagccgatatccaaacaaatgatgaagactga

SEQ ID NO: 1464 - DNA, 1431 bp, Nezara viridula
atggctatcaagtttttggaagtaataaaaccattctgcagtatattgcctgagatagcgaaacctgaacgaaagatccagtttagggagaaagtattatggactgccatcacacttttcatctttttggtctgttgtcaaattcctctattcggaattatgagttcagactcagcagatcccttttattggattcgtgtgattcttgcctcaaacagaggtactctcatggaacttggaatatccccaatcgttacatcaggcctcattatgcaattactagctggagcaaagataatagaagttggtgacacgcctaaagacagggctcttttcaatggagctcagaaattgtttggaatggttattactgttggacaagcgatcgtttatgtaatgactggcatgtatggagacccagctgaaattggagcaggtatttgcttgcttatcatcgttcagctgtttgtagctggccttatagttcttttacttgacgaacttctgcagaagggctacggtcttgggtcaggaatctctttattcattgctacaaacatctgtgaaactattgtttggaaagcattttctccagctactgtcaacactggtaggggaactgaatttgaaggtgctgtcattgcattattccatctcctggcaacaaggcaagacaaagtccgtgctttgcgtgaagctttctatagacaaaatcttccaaatttaatgaacttactggctaccatccttgtgtttgccatagtgatttatttccagggattcagggtagaccttcctattaagtcagctcgttatcgaggtcaatacagcagctatcctatcaagctcttctacacttcaaacattcctattattcttcagtcagctcttgtatcaaatctatatgttatatctcagatgttagctgtgaaattccatggaaatgtgtttgttaacatgcttggagtgtgggcagatgttggaggtggtggtccagcccgagcttatccagtcggcggtctttgttattatctatcgcctcctgaaaatcttggtcatatacttgaagatcctatccatgctatgttatacatcattttcatgcttggttcttgtgctttcttctccaagacttggattgaggtttctggatcatcggcaaaagatgttgcaaagcaacttaaggaacagcaaatggtaatgcgaggtcatcgtgacaattccatgatccatgaactgaacaggtacattccaactgcagcagcgtttgggggtctttgtattggtgccctgtcagtcctagctgactttatgggagcaattggctcaggaactggtatcctccttgccgttaccattatctaccagtactttgaaatatttgtaaaggagcagagtgagactggtggcatgagtactcttctcttctaa

SEQ ID NO: 1465 - DNA, 612 bp, Nezara viridula
cgccattgtttcgataggttattcgtggtagtatttaggtttagctgggacgttactgtttggtgtgtattttattgttcgaatgtgaaatttgtaaaaatgaatctcctgaaggcgatgagtcctacttcggtgactccttccgtcgaactcagtacctacagggaccagcattttaagggctctcggacagaacaggaaagacttcttcgcgtatcaactactttatatattggaaatttatcgttttatacaacagaagaacaaatatatgaactgttttcaaaatgtggtgatattaagaggattattatgggattggataaatataagaaaattccatgtggattctgctttgtagagtattaccaacgaccggatgctgagagcgctatgaggtatattaatggaacaaggcttgacgatcgtattataagaacagactgggatgcagggttcgttgaaggaaggcagtatggaaggggaaagagtggtgggcaggttcgtgatgaatatagaagagaatatgatgctggacgaggtggttatggaaaagtgatgcaacagcctacaacaaaagctgaagctgcatcaatatttaatggacagtga

SEQ ID NO: 1466 - DNA, 936 bp, Nezara viridula
atggctgctgctgtaggtcggatatatggctctagacttttaaaaaataatccggtttcgaagcacctacagataggcagcttttctactactaaatcatggtcaagaggaaagaaagctttgtatacttcacttggtattttaacgggaggaacaggcatgttgatatatgctcttgaaaaaagtcttcaagctggagatcttgaactccatcctcccaaacttccttggagccacagtgggtattttcaatcactggatcatgcaagcattcgacgaggttatgaagtttacaaaaatgtgtgtgcagcctgccacagtttaagatttgtttgctatcgagatcttgtaggtgtttcacatactgaagctgaggctaaagcggaagccgaagaacaactcgttttggatggaccaaatgaagttggtgaaatgtttaaaaggcctggaaaactttctgatcatatgcctagtccttatccaaatgaagaggctgcaagagcagctaataatggagcatatcctcctgatctttcatacatagttcctggacgtcatggtgaagaagattatatattccacttactgactggatactgtgatgctcctgaaggtttgattttaagggaaggccaatattttaacccttattttcctggaggagccataagtatggcacaagcattatataatgagattattgaatactctgatggaactccagccactcaaagtcaattagctaaggatgttgcaactttccttaaatggacttcagagcctgagcatgatgtacgaaaacaaatggccttaaaggtaatttttatcttttcactcttcatcgctgctgcagtttactggaaaagacataagtggagcactctcaagagccgaaaaattgtctttagaccaccaccatctccaccaaaattgtga

SEQ ID NO: 1467 - DNA, 1719 bp, Nezara viridula
atgttagctcttcagcagtatggagaaagtgacagcgataaggaagatgaagaaaaacaaaatattaacgatgaagctttactacatttaaaacctctttctgaatcatctattatacaaacagctatttgtcctgctccaacagctttaccacctgttgagtacaatcctcttaaattcattaaacctggttgcactgaaatgacagtgaatcttaagtatgaagaactctttgctgctgacgttggtcctgaaaatccttttttgacagatcagcaaaaagctcctaaaaacatactttcaggttatgttgaagcagctcacatgagcgaatttcagtttgaaaatcagcgaaagactttccaaagttatggttatgctcttgacccttcaattgataatatgggtcgcactgaagatagtatacctgtcgtcggggctgtagatgttgcaaaagaaactaacctgaagacagtttttgaatctacttcaaaacgacctcttgacaaacggaaaagaaataaaaacgatgatccggctgatatcaatggcttccttggcccatgggggtcctacgtggatgagaaaaaagtagttaaacctgaccctgaagttgctgctgaacttgaagaatatcttgctaagagacaaaagctaggtaaaaaagttgaagacaaacctctggaggaaaagacagtccttcacatcaaagatccagttgattaccaaggccgcaacttcttacatcctcctcaggatgttggagtcaaccttaagtctgattctcctccggacaaatgttttatcccgaagtcagaaatacatgtttggaaaggacacacaaaaggtatttctgctatacggtggttccccaaatatgctcatcttcttctctcttgcagtatggattgtcgtgtcaagttgtgggaggtatataatgaaagacggtgtattagaacctattatggacacaggcaagctgttagagatgtttgttttaataaccgaggaacaaaattcctatcagctgcttacgaccgctacataaaattatgggatacagaaactggagaatgcatatcacgattcaccagcagaaaaattccctattgtgtaaagtttaatcccgatgaagacaaacaaaacttatttgttgctggaacatccgacaaaaagatcatatgttgggacttacggtctggtgaaatagttcaagaatatgaccgccatttgggagctgtaaattctattactttcgtcgatgaaaataggagatttgtcaccacttctgatgataaaagcttacgtgtttgggaatgggacatcccggttgacatgaagtatatagctgacccatctatgcactcaatgcctgccgtgactccatcacctaatcaaaaatggctcgcatgccaaagcatggacaacaagattgtgatattctccgctctcaacaggttcaaactgaatagaaaaaagacatttactgggcatatggtcgctggttatgcctgtactcttgacttctctccagatatgagttatattgtgtcaggtgatgctgatggaaaagcttatgtatgggattggaaaacgacaaaacttttcaagaaatggaaggctcatgatcatgtgtgcattggtgttctgtggcatccgcacgaacatagtaaagtagtgacagcaggctgggacggtcttattaaatattgggattaa

SEQ ID NO: 1468 - DNA, 807 bp, Nezara viridula
atggttcaaaagaagcccaagaagaagactggaaaaaaggttgcagcagcacctcttgctgttaagaagcaagaggttcagaaagttgtcaatccactttttgaaaagcgagccaggaattttggaattggtcaggacatccaaccttcccgtgatttaagcagatttgtcagatggcccaaatatattcgtatccaaaggcagaaatctgttttacagaagaggctgaaaattcctccttcaattcatcaattttctcaatctttagacaagcaaacagctactcaactgtttaaaattctggaaaaacacagacccgaaactgcacttgctaagaagcagaggttgaaggctagggcagaaggaaaaataaaacaaaaggaagaagttcctacaaaaagacctaatgttatcaggtctggtgttaatactgttactagacttgttgaacagaaaaaagctctcctcgttgtgattgcccatgatgttgacccaattgagctggtgcttttcctacctgcactttgcagaaagatgaacgttccatattgtattattaaaggaaaggctcgtcttggcaggttagtcaggagaaaaacctgcacttcaattgcagtaacccagatggagggtaatgatcgtactgctttaaataaggtcattgaagccgtcaagaccaattacaatgacagatatgaagaaatcaagaggcactggggaggtggtttgcttggctccaagtcagcagccaggatagctaaacttgaaaaggctaaggctagagagttggctcagaaacaaggataa

SEQ ID NO: 1469 - DNA, 1005 bp, Nezara viridula
atggctaacatgttaaaagatgttacaattgatgataagatgccaaatgaacttttattggataaacacataaaattcgttttggcttatggagcaaataaggatgaattcgaattttgcactactgaacacttaagaatgtctggtatgtactggattctaacaactttagcagttactaaaaagctggatgaagttgacaagaaagaatttattgacttcatacttgaatgtactgatgagaaaacaggtggcattggtgcttgtgttggtcatgatcctcatattctatatactttaagtgctgttcaaatagcttgtatcttaaggtcattagacctacttcctttagaaaagattgtaagttttgtggccagtttgcaaaaagaagatggtagttttatgggtgacaaatggggtgaagtcgatacgagattttcattctgtgctattgcttgtctgtctcttattggccgcttagatgccataaatcttgaaaaagcagtagattttgtgcttagctgtcaaaactttgatggtggctttggttcccaacaaaattcagaaagtcatgctggattaatctactgttgtgttggtgttttgtcaatcacacagaatttgtatcgaatagatgccgatcaactaggttggtggttatgtgagcgccaactgccttcaggtggattgaatggaagaccagaaaagctaccagatgtttgttattcttggtgggtgttatcatctttaactatgttaggaagactacattggattgataaacagcttttgaagaaatatattcttgctagtcaagattctgatggaggttttagtgatcgaccaggagatatgccagatcccttccatactttatttgggatcgctgctctttcacttttaggagaatcagatctattgaaaattaatcctacctattgtatgccacaatacattattgatgaacttaatttggatccagaaataatgcagtcacaaccttaa

SEQ ID NO: 1470 - DNA, 2688 bp, Nezara viridula
atgatgttgaaaatgaatagcgaagctacagcacagcttatacaaattttagagaagactgtttctccagacaaaaatgaacttgaggctgctcaaaattatctggaacatgctgcacaaaccaatttggctgagttcctgcaaactttgtcacacattcttcagcatggaggtaactccccagttgcacgtatggcagctagtttacagctcaaaaataacctcacttccaaagatcaaaacatcaaagcacagtatcaagccaggtggctcgcctttcccgaggaaactagaatgtatattaagaaaaatatcttaggagctttgggaacagaaaacacaaggcctagctcggctgctcaatgcgtcgcctatgttgcggtagctgagatccctgttggtcagtggcctgatttaattccaacattgtctgctaatgtaactggacccacttcgactgaaatcatgaaagaggctactcttgaagcaattggttatatttgccaagaaatagaacatgattgtttagctagtcaatctaatcaaattttaacagcaatagtccatggaatgcggtctggtgagagaagtaattacgtcagactggcagcaacaaccgcgcttcttaattcacttgaattcactagggctaatttccagcaagatatggagcgtaactacttgatggaagtagtttgtgaagctacacagtcaactgatacacaagtccgtgttgcagctctacaatgtcttgttaaaataatgactctatactaccaatacatggagacctatatgggtcaggccttgtttccaattacattagaagcaatgaaatctgacataaaagaagtggctcttcaaggaattgaattttggtctaatgtctctgatgaagaagtcgacttagcgatagaagaatcagaagctgtagaaatggggaaacctccagctaggacatctcggtattatgctaaaggagctcttcagtatctggttcctgtagttcttaccaaacttactaaacaggaggagtttgacgatgaagatgattggaacccaagcaaagctgctggagtttgcttaatgttactagcgacatgctgtgaagaagacattgtgccacatgtattgccatttgttcaacagaatataaaatcaccagactggaggtacagagatgctgctgtgatggcgttcggttccattctgagtggacttcactccagtaccctgaaacccatggtagaacaagcaatgcctactcttattgaattgatgtatgacagttcagttgcggtgagagacacagctgcatgggcatttggtcgtatttgtgaaatagtacctgaagcagctacaaacgaaacttatattaaaccccttcttgaatctctgcttaacggcctgaaggcagagccgagggtagcagcgaacgtctgttgggcctttactggtttggctgaagccagttatgatcaggctgaaaaccaggtcgaagatggttcccagcctgagacatacatcctctccagatattttgagtacatcgtgcacagccttctagctaccaccgatagggtagacggggcacaggccaatttacgccctgctgcgtacgaagcactgatggagatggtgaagaactcgcccaaagattgctataccgtcgtccagagagccactctcattatattggatcgtctgaatcaggtcctggctatggaacaacaaatacaaagccactcggacagggcacagttcaatgacctccagtcgctcctctgtgccacgctacagagtgtcctacggaaaatgaccccagaagatgcacctcaaatatctgatacaatcatgaatgcacttctacaaatgttcaattccaattcatgcaagtcaggttcagtccaagaagatgcaataatggcagtttcaacactagttgaagttcttggtgatggctttattaaatatatgcctgcattccaaccttttctctgcatgggtctcaaaaatcatgctgaatatcaggtttgttgtgctgccgttggtctcactggagatatttgtcgggccttgaaaaacaaagttcttccatattgtgatgatatcatgaggcttcttcttgaaaatctcagtgataacagtgttcaccgttctgtaaaaccacaaattctatcaacttttggagatgtcgcattaagcattggctctgatttcaaaaagtacttggatgtagtactccacacacttatgcaggctgctcaagcgcaagttgatacgagtgacttcgacatggttgattggttgaatgaattaagggaaggaatcgtggaagcctactctggtatcattcaaggattgaaaggagaagataacaacacggccgtcagtgttgctaatcttgcactgctggagccccatatcccagtgatggcccagttcttaacctgtatttctagagatacctccaagcaggataaagttttggccggctcagctggtctagttggagatctttgttccgctttcggtcctaaggtcatacccctgttggatattgatccaatcaatgagctgctgacacagggaaggaggtcgaggattaacaaaacgaaagctgtttcaaactgggcatccaaagaaatgaggagatacaaagctactatagctaacgcagcctcctga

SEQ ID NO: 1471 - DNA, 1506 bp, Nezara viridula
atggagactatattggagcaacagagaagatatcatgaggaacgggaaaggttgatggatgcaatggtgaaagaaatgttgcataaaaaatcaagttatcgagaacaaataaattcagatcacaggctcaagatgcttcttgatcagtatatggagagtactcataagttaaaggaactgtatgaagacaaggatggtataaggaaagatgaagttgctgcactttcaggtcctaatgaattttccgagttttattcgaggttgaaaactattaaggaattctatcgcagaattcctaatgaaatttcagttcccatgtctgttgaatttgaggaactggcaaaactaagagaaaatcccactgaagaaacatcaaatttagttgaatttacagatgaagaaggatacggaaaatatctcgaccttcatgaatgttatgaaaaatatattaatttaaaaggagtagagaaagtggattatataacataccttactacatttgatcgactttatgaaatccctaaagataggaagagttctgagtacaaacgatatgttattatgctcctgaattatctctgtgattacattgctagaataaaacctctgcttgacctcgaccaggaattaactaatgttcaaaaggacttcacgtcacagtgggaagcaggaacattccctggttggccgaaagaaactggcagtgtgttaagcaatgttggtgcccatcttgacttatctgctttttcatcccctgaagagttggcttctctcggtctggacagacttaaatcagcattaatggctttaggattaaaatgtggagggacattagaagaaagggcccagcgtttattcagcactaaagggaaaaaatcccttgatccaaatttacttgccaagtcaaagccaggtaaatcaaaccgagaacgtgatcttgaaagacagcgggacatagcattcttggaagcacaagcttataagttagctgaattactaagtgaacaacgagctgctactaaagaaaatgttcaaaggaaacaagctagaacaggagaagaaagaggagattcggaaggtgaagcatcatcgtcaggaagtgaaagtgagggagaagatgatggagttccgtataatccaaaaaatttacctcttggttgggatggaaagcccattccgtattggctttacaagttgcatgggctcaacatcagttataattgcgaaatatgtggtaattttatctataaaggaccaaaggcttttcaaagacattttgctgagtggaggcatgctcacggtatgcgttgccttggaattccaaatacagcacatttcgctaacgttacccaaatagaagatgctttggctttgtgggagaagctaaaaacaatgaaacacgatgaacgttggcaacctgaacacgaagaagaatatgaagattccctcggaaacgtagtgaataggaaaacataccaagatttaaaaagacaaggacttttataa

SEQ ID NO: 1472 - DNA, 636 bp, Nezara viridula
atgacggtcggtaagaacaataaaatgcttcaacatatcaactacagggttcggataattttacaagattcgagaacatttattggcacatttaaagcatttgataaacacatgaatctcattcttggagattgtgaggagttcagaaaaattaaaccaaaaaataccaaacagccagagcgggaagaaaagagagtgttaggatttgtattgttaagaggcgaaaatatagtttcccttacagtcgaaggtcctccacctccagaagaagggttgcctagggtgccccttcctggagcaggtggtggaattggttcagcaagacctgcgggacgtggagttccagctcctggtacaccagctgcacctggtctccaaggtccagttcgtggtgtaggtggcccatctgcacaagttatgactccagcggggcgtggaggacaagtttctgctcctcctcagatgcgtgctccacccccaggaatgcccccaatgatgggagctccaccaatgatgaacatggcaccaggaatggcgatgggaagaggtgggccacctcctcaaatgggtgctcctccagctccacctatgcgaggtcccccaccaggaatgatgagaggtccccctcctttttaa

SEQ ID NO: 1473 - DNA, 1437 bp, Nezara viridula
atggcagatgtagaactggttgatgcagtaggtgcaattgttttagaaattcaaaggcgcactattaaaaaaaaacgaagaatatggaccaaaaattggtttctcaaaaggaatcaactaagacaatctcaggtcctagtaaaggaacttctatcagaagatccacttagtttcttaaacatgctaggaatgaatatggtaatgtttgactccttactagagaagattggtcataatatacaaaaatgtgacactgtaatgcgagaagccctaccagctaaagttaaactagaaacagcatgccgttaccttgctacgggtgaatcaatggcctctatgcaatacctgtacagtgtgcctaagtgcacaataagtaaatttttaccagatgtttttgatgccatatatgaaggactgaaggaattcatacagatcccagcaactgaaagtgattggaaagaaattcaaaaaggtttcagtgacttaaggaacttcacggattgtgttggttgcataggtggaaagcatgtcatggtcaaatgtcccaccaatttaggatcacagtatttcaataacaaaggaactttatgtatagtgcttttggcaatggtggactacaactacaacttcacatttattgacattggaaattatggtagtattgaagactatggaatatttgcaaaatcatcccttatgaaagtgattgagcaaaatcagatcaatatgcctgaaggagcagtcatactgggtgattcaacttttccttcaaagtcttattcaataaagcagtatcctacagaaaaaaatttgaatgttgctcaagaaatagataatgacagacactatcatgcaaagcgcttcgttgagaattcatttgatatcttcacatctcgtttccgggtattaaggaaaccaattcacttacttcctgaaacagtggtaaaaatgacaaaagctgcatgtgctttgcataattggattagaaaatctacaaatctgattatgacagcaaataatgaagataatggctgctctggtagaataattcgagagtcttggcagaaagatgactacagagtagatgatgtagctaatgtcatgccattacttcaacataattatgtgccagacacgagagaaaaaagaggtgaatttctaaaatactccaccaagaaagtagctgttagttgtcagatgacagaggagaatgactgtctccttaaagaaacagaacaaaaagaagaaataaacacttcagagcaagcctgcgcaaagaaattaacttcacacccacttcccgtcttgcattcccaacaccaatcctcaccgtctcagccaacagcctttcagcctcccaggcggatcaattttacaaatcaacagaggagaagaaggaagggaggtcttcagagtcaaagaaaaaagaacaaattt

SEQ ID NO: 1474 - DNA, 2058 bp, Euschistus heros
atgagcagcaaacacaaacacaagagatatgaagaagaggaagagaggagaaagaaacacaaatctcgatactctgatgactcagaagatggtaggaagagttcttcatcaaggcatcggtctaagaaaaaaaagcatgaccatagtcataagcataaaaaagaaaacaaaaagaaatcaaagaggtctgaaagctctgattcaagcaccagttccgattcttcttctgacaattcggtgaaacttctaaaaaggttacatgataagcatgaaaaaatgattcagcaaaagaagaaggaaaaagaattgatgaaggcaaatgagacaccagaagaaaaaagaataagacgtcttttaaaaaaagaagcgaaagaaaggaagagaaaacaacgtatgggatgggacaaagattatctgcattatacaaatactgacaatccatttggtgatgccaatttgctttctacctttgtttggtctaagaagctagcaaaagatggacttacggatgtatctcgtgaagagttagaaaggattaatagaattaagcaagaggaaaacaagattgaactagagaaggttaaaaaaagacggcaagagagggagcaagaaaggcaagaacgagaagaagcaatgatgagattgcaacgtgagaaggaggctgaacagtttgaagcatgggccacgcaggaagatcagtttcatcttgaacaagcgaggttgaggtcaaggatcaggatagcagatgcaagagctaaaccaattgatcttcttgctaaatacatcaattcagaagaagaagtagacgctgttgagatgcatgaaccatatacttacctgaatggtttgtccataaaggaccttgaagacttggtggaggatattaaggtctacatgaaacttgagaaaggaaagaatttggattactggaatgatattactgttatcgttgaagatgaactgtataagcttagaaaactggggaaaaaatcagactatgaagcagccgttggtaggagagaaggtatccacgaatcagtagctaaagaagtttcttcagtctttagaggaaaaaccgcctcacaacttgcagccatgcaaaaacagattgaaaaaaaaatcagcgataaaggagaaggcattgatatcgggtactgggagtcacttctttcccagctgaaagcccatatggcacgggctcggcttagagacaaacatcaagaaaatctaaaacagaaattagaactacttaaagcggagcagaggcatcaagaacaagaaatcaaagaagaacctatagatgaatcagaagaacagcaagaggctgtagttagtgatgaaatcaaacaggagaaagatgatagtgaagaagaagaaggaagtggaggtgaagaagatgctggggagtctatgctgaaagaaagctttggagagtatgaagctggagcgtactcacctgtctacgttgatcccgctagccttgaaccaggaactcttataatcggtgaagaggaggatgctcagagactagagtacgccaggcaacaccttacctctcatgagagtcaggctggatctacttcagaagaattggcgatgcaaagggaagcacgtaaaggaatgtcaagcgatgaggccatattttctgttgaatctgctcttgattctcaagtttacctatggtcagataaataccgccctagaaaacctagatattttaatagggtacatactggatttgaatggaacaagtacaaccaaactcattacgatatggataatcctcctccgaaaattgtacaaggatacaaattcaacatatttttcccagatctcatcgataagtcaacaacgccagaatattatctcacaacctgtcctgataatccagactttgctgttcttcggtttcatgctggaccaccttatgaagatattgcatttaagattgttaatagggaatgggagtattcttacaaaagaggattcagatgtcaattccacaacaatatatttcagttgtggttccattttaagagatatagatatagaagataa

SEQ ID NO: 1475 - DNA, 1206 bp, Euschistus heros
atgggagacgctaatataattgacaaatcgatgcgatctgtgttcgtgggtaatattccctatgaagctacagaggaaaaattgaaagatatattcaatgaagttggtcctgttctctcatttaaattagtttatgatcgcgaaactggaaagcctaaaggttatggattttgtgaatataaggatcaagaaacagctcttagtgctatgagaaatttaaatggttatgaaattggtggacgatctttgagggttgataatgcatgtactgaaaaatcaagattagaaatgcaaagtcttttagctggaccaccgattgataatacatatggggaatcagtagagtctgataaggctcctgaagctataagcaaagccgttgcctctttaccaccagaacaaatgtttgagctaatgaagcagatgaagctttgtatacaaaataatccaactgaaggcaaagcaatgctattacagaatcctcaattagcttatgctcttttgcaagcccaggttgtcatgaggatcgtagatcctcagattgctattacaatgttgcacaaggccaacccgagtgtgcctcctcttcaaccacctcctgtcgagacaatacgcccagtgcctgtgcctcagcctgctccagcagttgctcctcctcccgtggtgccaccagttgtgcaggcgaggccagttgaaccagagtgggtacctccagctaggccgcatcagcctcctcatccaccgacatttataccccagccaggtggtgatctggatatgagaacattagacccgagggtaccgcctgtcaggttgaaccaagaccaggatttgaggatacctccgatggtgccagcacctcagcaaccaccggctcagcctcctcagccgtaccctcaggaacatgtgatatcaagtaccgtaagagatccaagacagtatcgtgatcctcgtacaggtgcagcaacagtcccggtgcccccacggccagttgtcgcacaggcagtggttccaccgagaccagtggcccctccggccagtcacattacttcagcacttcctcctgctgcttcagatcaggagaaggctgctttgataatgcaagtgctgcaactgtccgaggaacagatagcaatgctgccaccggagcaacgccagagcattctcgttctcaaggaacaaatagccaagagcactcaacgttaa

SEQ ID NO: 1476 - DNA, 1188 bp, Euschistus heros
atgacggcttctcaaggaatggaaccaaacagagaaaaagcattgcaagattaccgtaaaaaattattagagcataaggaagtagaggttcggcttaaagaaatgagagatcaattaaaagatttgacaaagcaatatgataaatctgaaaatgacttgaaagctcttcaaagtgttggtcagattgttggagaagtattaaagcagcttactgaagaaaagtttattgtcaaggcaacaaatggtccgagatatgttgttggttgtagaagacaactggataaatctaaacttaaatctggtacaagggtagcattggacatgactacattaacaattatgaggcatttgcctagggaagtagatccattagtatataacatgtcccatgaagatccaggagatgtcacgtattctgctattggaggtcttgcagaacaaattagagaacttcgagaggtgattgaactgccacttttgaatcctgaactgtttcaacgtgttggcattactcctccgaaaggatgcctgctttatggacctcctggtactggaaaaactttactggctagagctgtagccagccaattagatgcgaatttccttaaggtagtctccagtgctattgttgataagtatattggtgaaagtgctcgtctcatcagagaaatgtttaactatgcaagagatcatcaaccttgcataatttttatggatgaaattgatgccattggaggccgaagattctctgaaggaacatctgctgatcgtgaaatacaaagaactcttatggagcttttgaaccaaatggatggatttgattcattgggtcaggtgaaaatgatcatggccactaacaggcctgataccctagatcctgctcttctccgtcctggcaggctagatagaaagattgaaatccctctgccaaatgaacaggcaagactagaaatccttaagatacatgctggtcctatttctaagcatggagatatagattatgaggctgttgtgaaattatctgataatttcaatggggctgatttgagaaatgtttgcactgaagctggcctttttgccattcgagctgaacgagaatatgtaatgcaagaagattttatgaaagctgtaagaaaagtagctgacaacaagaagctggagtcaaaactggattataaaccagtttaa

SEQ ID NO: 1477 - DNA, 777 bp, Euschistus heros
atggccagacgatatgattcaagaactacaattttttctccagaaggtcgtttataccaggttgaatatgctatggaagctattagtcatgctggaacctgtcttggtattctagcgaatgatggcattattcttgttgctgaaaaaaggaatactaacaagcttcttgatgaatcagtatactctgaaaaaattttcaaattgaatgagaacatgatatgcagtttagctggtattacagctgatgcaaatgttctaactaatgaactaaggctcatttctcaaagatatttgttacaatatggagaaactattccttgtgaacaacttgtttcttggctgtgtgacattaaacaagcatatactcagtatggaggtaaaaggccatttggagtatctatattatatatgggttgggataagcactatggatatcaactttaccagtctgaccctagtggaaattactcaggctggaaggcaacttgtatagggcataacagtggtgcagctgtttccagtttgaagactgattacaaagaaggagaaatgacagtgaaagatgctttggccttgggaattaaagtcctaagtaaaacattggataccgccaagctttcagttgatagagttgaagttgcaacattatcccagcagaatggaaagtgtgttacttgcattctaccacctgatcaagttcaagaacttattaatgcttatgagaaatcagaagctgaagctaatgctttaaaaaaagaaaaaactccaaaatcttaa

SEQ ID NO: 1478 - DNA, 2643 bp, Euschistus heros
atgactaaagttcaagatccacaaccagaagaaatgtctgaagaagacaaacgacttcaagaagaactgaatatgcttgtggagaaaatcactggaccagacacccacctgtacgtacctgcattagaaagcatgcgagatcttataagaagttctacaacaagtatgacttcagtgccaatgcctctgaagttcctcagatctcattatggcgctctcaaagaagcctgtgctgttatggcagataggaaggctcaggagctttgtgcaagcatagtctctgttctagcaatggggcaggatttaccaggggcacgagaatgtcttaagtattgtttacaatcacatcagaaagatgttggtgactggggccatgaatatgtaagacaattagaaggagaaatcgctgatgaatgggcatctacagaagaaaaagataagctactgggattggttgagagtataatcaaatttgatatggagcataatgcagagattcaagcctgtgatctcttaatggagattgacagacttgatatgctggacaagcacatggatttaactaattattcaagagtttgtctgtacctaattaattgtgctgtgtatgtggaagaaccagaaagaggaaacattgtaagtggagttatgaaacattatatgcgatttaaggaatacccgcgagcactctgtcttgcgatgcaattgaataagcaagatataatgttagacatttttaaccaatgccaagatccgttggttagaaaacagttagcctttatggtcggaaggcaacaattgagccttgaattgagtgatgatttggcagataaatcagatctaactaacatcatgtccaatgcccatgtgaatgatcattttcatagtttagggagagaattggatatcatggagcctaaaactcctgaagaagtttacaaagtttggttggaagggttagtcctgcgtccaacttacaatctggaagtacctcttgattcagctaggcataatcttgcttcaacatttgtaaatgcttttgtaaatgctggtttttcaagagacaagttagtatcggttgaagatggcaacaaatggatgtacaagaataaacaacatggtatgttaagtgctgcagcatctctcggtctgattcacttgtgggatgttgatggagggctaaccccaatcgataaatacctttacacttcggaagattatattaagagtggtgcattacttgctttgggcattgtgaactgtggtgtcaggaatgattgtgatcctgctttggctcttctttctgattatgttcttcatgagagtgtcaccctgagaattggtgctgttttaggtttgggcctagcttacgtcggaacaaaaaggcaagatgccattacccttttactgccagtgctctcagattcaagatcaacacctgaagttgttgcgatggcagcattggcttgtgccctcattacacttggtacaccacatcctgatgtagtatcaaccatcttgcaaactctccttgatcttcctgttgctgaaatgactgacggccattactccaaatttttgccccttgcacttggtctatgttaccttggtcagcgagaaggcactgaagctacaaaagctgctcttgaagcactcccagaacccttgcggtcattatcgcaacatatgttgaagatgtgcgtctatgcggggactggagatgtacttgtcatccaggaacagcttcaagtctgctcagaacattatcccactccagaagaaaagaaagaaagcgataagaaggacaaggataaagacaaagacaaagatgaatctaagagtagtaaagtgaaggacatgacatgcatgcaggcagttgctgccttatctgtggcagtaattgcgatgggtgaggagacaggatctgaaatggccactaggatattcgctcagttgggaaggtatggtgaacctgctgtacggagagctgtacccttggccatagctttatcatcgatatcaaatcctcagttagctgtgatcgatgttcttaataagtattcacatgaccttgatgaagaagttgcacacaatgctattttctcaatgggtctcgttggcgcaggcactaacaatgccaggttggctaccatgctgcgtcagttagcacaataccatgccaagaacactggtcacctgttcatggtgcgcattgctcaaggattgactcaccttggcaaaggtactctctccctttgcccgttccacaccgacaggcaggtcatgaactactcagcagtcgccggcctacttatcacccttgtttcattccttgacactaagacgataatgcttggaaaatcccactatttgctctatacacttgcgactgccatgtatcctaggtggttggtaactcttgatgaacatctagagcctctccccgtatcagtcagagttggacaggcggtgaatgtaattggaaaagctggaactccgaagactatagctggggttcatactcacactacacctgtgctgctagccgttggtgagcgtgctgaactggccactgaggattacactccactcacacctgttatggaaggatttgtcattctcagaaagaaacaaccagcatga

SEQ ID NO: 1479 - DNA, 1257 bp, Euschistus heros
atggagcctcccgcggcagagcagagccagcagcagcaagagcaggagtcgggtgtcatcaggcagcggaccataaccacttctgggaccatcaccaccagtccgcagcacgaggccaccccgtcccccgagcagccggtacaagagcagagcggaaaggaagttgaagtaccatatgaaatagtgcagctgcgacccggaagctacgacgaagggtacagcctggaggatacaacgaggtatagcccaggatccggccggtactacaccactgatggtaccgtcaagtacgaccgggacgacaaaggcgaaggtagctacgttactctagaacctgtcaactatcccccgggcagtgcgtaccaggaacctgcaacgggatactacacctacaaggaagaggaggacgtctacatcaaggctgagactcccctaacccccaagaacttcgcccacttcgatcacccggtcacctctcatccaacacaactcagtgcacaggttacttatgtgactggaggaggtagcagggagtacgtgacaactaaccagcctggctactggtccagcgaatacgtgtaccagcagcctcagcaggaaatccagctgcctcctggaacaccttacgtcttctccagcaatgggcaggctacctgggctattgatgagtcctacgatcccagtatgctgtcggctagcgacatcaaggagtgcgtcaactgtgcggcaagcgtgaccccgctgtggcggcgggacggtaccggacaccacctctgcaacgcctgcggcctctacagcaggatcaacggagtacacaggccaccgattggtaacaggagaaatggcgtaagttgcgccaactgccagacaaataacacaaccctgtggcgcagaaacaacacaggagagccagtctgtaatgcctgtgggctgtattttaaactgcatggtgtaaacaggccacatacaatgaagaaggaaggcatccaaactaggaaacggaaacctaagaaccctcaagttaatataccaagtccaaaaaacgacattaaagcaccaggtgaaaaatcaggcagttgggataaatgtgataatgacctactcgacagtggctatacaatggctacatcatccatctttcttcccagctcgtttttaactaagcctgttggagtcagtgtatctggaatggaaagtgtgccacctagcgttatcatcccacccacatcaagccaagaaacacagagaactgaataa

SEQ ID NO: 1480 - DNA, 5505 bp, Euschistus heros
atgtcgttggcaggagggaaaatggcttgtcctgggaatggaatttatgttatccagggggaaatgtctgttctgcttactgctatgaagaaagtaaacagatggtcttctcatgtccaccaggatgatgaaaatgacattcttattagaagcttcacagatctcaaagatgtgttaaatcagattggtgacctcagggaagtagagccaaaccattttcttagtccatttctggaagtgataagatcagaagaaactactggacctgttaccagtctcgctttatcttctgtcaataagtttctttcgtatggactgatagattctaagtctaagacgattgcggctactgttgaaaatattgctgaagcagtcacaagggccagatttgttgggactgaccaaactaatgattcaattgttttgctaaagattttgcaggttctgcgaactttgttactttctcctgaaggctgctggcttacaaatgaaagtgttttagaaattctattgagttgttttcggatgtgttttgagccccgtttaaatgaattgttaaggagatgcgctgagaattgtttacgtgatatggttcaattgctgtttagtaggctccctagttttactgaggataacaggaaaacatacacaatccagcaaaaactgaaaatgaacactagtgcccctttggatgcagggaaggggaagaaaaagaccagccgaccatcttctaggaaagtatccaggaaaagtcaagaaaaatctcccagtcctgttttaggatcagaagtttcagctgctcttaaagaaagtgaaagccagcaattgtctttacctgatgagccagaaactacatcgcatggtaaatcagaatctgaacgtcttcttgtgcctagtgaagagtcattagctaaaatcccttctactgattccttggaaactaatgttgttaatggtgttccaaatgtgattgctgcagaggaaaaccaaaacataactcctcctgtgatacttgacgatggtgttattatcagtattgaagattcaagttctcaaaatagtgaatcaacagatcagctggcaaccattggtattgtgccagaagctaaaaggccagaagacttagatctgaatcctactgaaactaatatttcttccccttcagatttgaaatcagaagaagagcctttgctaagtcctaccacgccagaaaataatatggaagggcaagattggaccaatcagcaaggggttaggtttactaatactgaaaatgataccttaactccttctgggccatatggactgttaagcgttcatgaacttttgaggtttttggcttcactttgcaatccacttgacaagcagaactctgacagcatgatacatatcggactcaccctaattacagttgctcttgaagttggggcggatagcattgcaaagtttccttcgcttctgtcaactgttaaaaacgatgtctgtagaagccttttagctttgttaaataccgaaaaactacctatatttgcatctgtgctacaagtttcattccttctgtttgaatctcttcgaacacatcttaaatttcaactggagcgttatttgtcgaggcttactgaaataattgtttctgattcttcaaagatttcatatgaacaccgagagatagcattagaatccgttgtacatctttggcgaatacctggcttggtgacagagctctatcttaattacgattgctctctttactgccccaatttgtatgaagaactaaccaacctgttgtctaagaatgctttccctgtaactggtgtctataacacacatttactatctttggatgctttattgacagttatagactctatagaaagtcattgtaatagccgaatattaaatgaaaggcaaaatccatcaaaagatggagaaattaataaattagaatttcacgattttgccagcaattatataaatcggactgggacccgtcaaaagttgtcactgaacattccaagtcatgagcaattaatggctgtgaaaagaaaaaaaaaacttctggctactggaactgaacatttcaattcaaaaccaaaaaaaggaatccagtttttacaggaacataaccttctttcgactcctttagatgcagttgaagtcgttgcctttttgagagaaaacccccacctcgataaaaaaatgattggagaatatattagtaatagagccaacatcgctatacttgatcaatttgtaaaatcattcgactttactgagctgcgcatcgatgaagcattaaggttgtatttagaaactttcaggctacctggagagtctcctctcatatctttagtgatggaacattttgctgaacactggcataaatgtaatggagagccttttgctaatgctgatgcagcatttacccttgcatacgcaatcataatgttaaatgtggaccagcataaccataatgttaaaagacaaaatactcctatgacaacagaagcctttaaacgcaacttgaaaaatgtaaacggagggcaagattttgaagaagaaatgcttgatgatatttatactgcgattaagactgaggaaatagtaatgcctgccgagcagactggtctagtcagggaaaactatgaatggaaagttctgttaagaagaggagctggatccgaaggttactacgtacatgcaccaaatggtttgttggatcatgatttgttttcacttatttggagcccgaccatttcagccttgtcgtatttatttgataagaccaatgatccaactatctatcagaaagctatatctgggttcaggaaatgtgctatgatatcggctcattacggaatgagtaacgatttcgataatctcattgtgtctctctgcaaatataccatgcttcactacacttctgagagcccagaaaatcttactatttcttttggatcgagccccaaggccagacgtgctgccaaaactgtctttgatcttgctcaccgccatggtgatattatcagggaaagttggagaaacattttggactgtattttgcaactgtatagatgtaaactgttacctaaaatccttgttgaggctgaagattttattgaattaagtgggaaaatatctcttattcgtgaagacatacaactcagtccaaaaactgaaactggaattcttagctcgttgtattcttatattgcattaggaacagaaacaaatacacaaaaaggtccatcagttgaagaccaagaggctattaaactcgcacaaaattgtataagagagtgtcacctcgagcagcttattacagaatctaagtttctgcgtattgattctttacaacattttgtgaaggcacttgtcactgcgtcttatggccctgaaggacatgtttcactcggcacatcttatagtgaagacactgctgtatttttcttggaagtccttttgaaagtcgttattcagaatagagatcgtatttcttcaatttggtgttctgtaaaagagcatatttataccctacttatgggtgctgcggcttgtgatcaccacttcttagttgagaggtctgttgttggacttctcaggctggctatccgtttgatgcacaaagaagaaatgggaccgatggtactgcaatctcttcgtatgctgctcctcctaaaaagttcaactctatcacgtgtatctcgccagatttcatatggtacatttgagcttctgaagacgtcagctgcaaatatacattcggctactgactgggcaataatattcactcttctagaatgtgtcggagctggtgctcctcctcccaaagttgtttcaaaacctgtcagctctacagaatcaggtgcccgctcggaaggtgaagcccaggtggatagcggactaggtaacgagaggggctacacttcagattctgagctaagcaaagctggcagtgtccctttgtcgcccagtcttagtcccgaggctcctcttagcaacactcctactggctggattctcgtggggcgagaaggtgaaattcaacctgtaagttgtgtgaggagggcaatgttgccagagctgtctcgctatgatcctttgtcgatggtgaagtgtgttgacagtttatcatttcttgttagggacgttgttcatatcacgccatataattttcatgattgtatccgctgcataagaacatttgttgaagcagctgctaatacagaaaggaaaagcaggaaagctgggagggatactgctcgacaagctaagaggaaaaatgctaaaaggagagaagaaagaggaccaagtccgacaggaagtgcttatgacgcagatgagagtgatcctgaggattcacctggttatcaacaagtttgcattcagcttttggagttgatgcacactcttcacacgagaacagctcagatcttccgttggtgggccgaagagacaggacagaaagaagtcggcagcccctcttattggactcctggttggtgccctctcctccaaggcatatccaggctctgttcccatcctaatagagctgttcggatgtcagcaataacttatcttcaaagagcactcctcatgcaagacttgcaatctctgcctggggaggaatgggaggaatgttttactcaagttttgtttccacttttgtctacattattagctgttaatattccagcaattgaagaaacaagaataagggcagccacggtgctttctaaggtattcctgcatcacttggctcctctgcaaactcttcatagttttgcgcaactgtggctgaccatcctagattatatggataagtacatgcatgcagacaatagtgacctactttatgaggctattcctgaatcattaaagaatctcttgcttgtgatggactcagctggcgtttttaatggattagatggacgcaatgagatttgggtcgtcacgtgggatcgaataagttcatttctccctaatcttcaatcagatttatttaaagatcatctaccagtggtagatgccaatttacttgaaaccaaagaagctttggaaacctctaagagtgaaactgaagtagttcaaaccgagcaacctacactgcaaagacccccttcaagcactcaagttgtgcagtctcctcctcagcctacttcgatgcctaaacctggtgaagccgttgaaatatctggaccaacgagtaacaataatgtcggttcacagaactggcagcctcctgctcctgtttatcctcacctagagcagatggtctcgacacctattggtccatcagttccagtctattctggatttgcgagtatgccacagcagcctcctcccccatcggcccaatttttctatcaggatatgtcttcttcagtcccaactaatatggcccacaattctgagcaacctgcagttggaagctctttattattggcctctgctggattggaacacccaaagcttccagttatatctcctccgacttcttcatga

SEQ ID NO: 1481 - DNA, 618 bp, Euschistus heros
atgtcaatcttatcttataatgggagtgcagtaatagctatgaaggggaaggattgtgttgctattgcttctgacttgaggtttggtattcaaggacagactgtgtcaaccaattttgaaaaaatttttgaaatgggtcctcatctatttattggacttcctggtttaactactgatacttttactgttctaaataagcttcaatttaggaaaaatatgtttgagttaaaagaagataggaaaatagcaccagatgtatttctttctatggtctcaaatcttttgtatgaaagaaggttcggaccatttttcgttgaaccaataattgctggtttgaacccaaaaactatggaaccttttatagcttcgatggatttacttggctgccctaacaaaccggaagattttgttgtggcaggtacagcttctgaacaactttatggaatgtgtgaagctctttgggaaccagatcttggcccagatgatttatttgaaactatatctcaagcacttgttaatgcatgtgacagagatgctctttcaggttggggagcttctgttttcataatagagaaagacaaagtaactcacaggagaattaaaacaagaatggactaa

SEQ ID NO: 1482 - DNA, 2778 bp, Euschistus heros
atggagtcccctccgtctttggaaacagtccatcaggctgtttacgcactgtatcataatcccgaccctgctgaaaaagagaaggcttcattatggctaggccagttacagaaatctgttttctcatggaaaattgccgatgaaatacttcataccagtacagatgtggaatgctgttattttgctgcacaaactatgagaactaaaatccaacattctttccatgaacttcctgcagagtctcatcttccgctccgagattctctgatggatcatattagcaaaattaatgagtcaacaaattctgtgattggtactcagttgtaccttgctctagctgatcttgcattacaaatggtatcttgggaaaaacctgcaattgatttgattgaacgatattctgcgacctcagttcctcctcttcttgaaatgttgacatttttaccagaagaagttaattctcgagcattgcgcttgggttctaaccggaggcgagaacttctcaacaaattttctcttgctgttccaaatgtttctgaatttttgaaaatgtgtcttaacaattcaggaaataatcctcaaattcaagtcaaagttttcaaatgttttacaagttgggtgtcagttcaagcgatgacacttaatgatgttaccgacaatatagttgtggctacagcttttcacgttcttgctaatagaatggcatcctctaatttacacgaagcagctgcagattgtgtttgctcgcttctcgaatgcctcgaagataacaataatcaacagtcgattgagatgcaactgtttaatggcgtcatttcattagaacaaccatttcatatttctgtcgcccatgaagaacatgaaaagtgtgtaaactattgtcgagtattcacagaactagctgagagtttcctggagaaaatagttagcggcagtagtcccaataaagcacattttgccattaagattttcgatcttgttctaacttgtgttggtcatcatgactacgaagttgcggccattacatttaatttatggtatcgcctttcagaagaactatatcaaaagaagaactcagggctaacctcattatttaaaccatacattgaaaggcttatcgaggcattatgtaggcattgtcagatggagccagaccatgaaggaatccttgaagaaggggatgactttcctgacttcaggatgaaggtcgcagaactgatccgtgatgtcgtctttataatcggttcttccaactgctttaggcagatgttcatctccctccaggggccaaataccacctgggacactacagaagctgccttattcataatgcaagctgttgcaaaaaacattcttccggaagaaaacgatgttgtacctaaagttgtagaagcaattttgaaccttcctcctaacacacacatagctgtcaggtgtacatctgttctcctactgggggaattatgcgagtggatcgaaaagcatccccattatttagaaccagtgttgaacatggtgctgttctgcctccaacaacctcagttggccaattcagctgcaaactgtttacaaagtatttgcagtatgtgtaaaaatcatatggtgaccaaatttttagggcttttgcagatacttcaatctctggacaaattcgttctgacaaatgaatcagttgtcggactattgaaaggagtagcttgcatcttgagcattatgcaccccgatcagttacagcaagccatgagggatgtttgtctcatccagatcaagccacttgttcatttaattgagaatgatgttaaactggaaaaagggacaaaaacagatccagcagtgtggatggacaggctttctgctatattccgccatatcaatcttaccgttaggaatggtgaaattcatccttgccaaccagtcattaccgagatttggcctgtcctctcctcagtatgttccaaataccaagccaattctcacgttatggaaaggtgctgtaggtgtctcagattcgctgtccgttgtgttggtaaacagtccgtgaatcttcttgaaccattagtcaaacagattgtaaatttatattctcagcatcaacacagctgtttcctatacctcgggtccatcctggttgacgaatacgcttccgaaccgggctgcatccaggggctgatagacatgcttcaagcatttattcatccgacgttcaccatccttcaaggagaagcgggtctgaagttacatccagatactgttgacgatctctttaggctttgtgcgaggttcttgcagagggcaccgattccgttcctcacctcacccgccatcaactccatcctggagtgtgccctatcgtgcatcccactcgatcacagggatgctaattcttcagttatgaagtttttttatgatctgattcacgctggaaggacagatgaagatcacgaagatttctctttgaggcaaagactggtacaaaatattatccttgaaagaggggcagacatagcgaataatcttctcactgcgtccgttttctatcttcagatctacatgctttcagatgttgctgatgtcttgatggagttaatattacttgacaagcagtctgctggtaattggatcgaacaatcattgaaaagaatgccaacgcacaacagtacaggcagtgttactgcgacacctaagcaaatggaggattttcaccgttccctgctcagtgcgagcagttccaaagcactaacaactacactaaaagaatttactcgtctctaccgctga

SEQ ID NO: 1483 - DNA, 1497 bp, Euschistus heros
atggcgcagaggtttcccccgacacagccgactccgagccctgtccagcagcctcaaagatatccttcgccttcgggacctcccttgaggcaatatgctactcctacgtttcctttgcaacagaggccgggtggctttgtgcagggaggtggaatgggaagcgggatgatgcctcgccctcagcagcaaccatacaaccccatcaggcctccgatacctcagtcacagaaaaggcctagcgatgtcaggccaccacagcagcaaccgaaaggggagtttcctcatacatccgctggtggaagtagtggcaagaagaagaagaagctggcggataagatactaccccagaaggtgcgagacctggtaccagagtcgcaagcttacatggaccttctggcattcgagaggaagctggattctacaattatgagaaagagactcgatattcaggaagcgttaaaacgcccaatgaagcaaaaaagaaaattacgtatttttatttccaatactttctatcctgcgaaagaggcgacggagactgaggaaggcagtgtagcatcctgggagctgagagtcgaaggaaggctattagaagattccaaaaatgatccgaacaagcctccaccgttacaggtgaaaaggaagttttcatctttcttcaaaagtcttgtcatcgagttggacaaagaactgtacgggccagataatcaccttgtagaatggcatagaactcctaccacacaagaaacggatggttttcaggtaaaaagacctggtgataaaaatgtcagatgtaccatcctacttcttttggattatcagcccctacagttcaagcttgatacccgacttgctcgtctcttaggtgttcacactcagacgagacctgtcattataagtgcactttggcaatatattaaaactcataaactgcaagatccacatgaaagagagtatataaattgtgataaataccttgagcagactttcagctgccccaggatgaagtttgctgaaataccgcagcgtctcaaccctctacttcatcctccagaccctattgttatcaaccatattattagtgtggaaggtaccgaacagaaacaaaccgcttgttatgacatcgatgtagaagtcgacgacacattaaaaacacagatgaacaatttcctcttatcaacagccagtcagcaggaaatacagagtctcgacaataagatccatgaaacagttgaaacgataaatcagttgaagaccaacagggagttctttttaagcttcgccaaagacccccaacagttcattaataaatggataatatctcaaactcgagacttaaagacaatgactgatgttgtcggaaatcccgaagaagaaaggcgagctgaattctattatcagaactgggcccaagaagcagtctgtagatacttttacacgaaggtgcaacaaaagagggccgagttagaacaggccctaggaattagaaatacttaa

SEQ ID NO: 1484 - DNA, 435 bp, Euschistus heros
atgcctaaagtaagaagaagtaagaagcctccaccagatggatgggaactgatcgaaccgactcttgaggaattagaacagaaaatgagagaagctgaaaccgaacctcatgaaggtaaaaggaaagtggaatcattgtggcctattttcaaaattcaccaccagaaatctcgctacatttacgatttatactacagaagaaaagctatcagtaaagaattgtatgagcattgccttaatgagaatattgctgataaaaacttgattgccaaatggaaaaaacaaggctatgaaagtctttgctgtttacgatgcattcagaccagagacacgaattttggaacgagttgcatatgtagagttccaaaggccaagcttgaagagggtaagatcgtagaatgcatccactgtggctgcagaggatgttcaggataa

SEQ ID NO: 1485 - DNA, 1029 bp, Euschistus heros
atgaaagtgctacttgagagtgatgtccaactaaccactcatttttgggcagcatcggactacaaggataaacttagcgttgcgataggagaacctctggttctgagctcagatgccagttgggcgaatcacattctcctaggacaccctgctatgcccacagccacaggacacagtggggtcatcccaagtaatgaagaatgcggcattcgtgatgtatgggctcataatttgaaggatgaatttaaagttatcaggaagatcattcataaatataattatgttgcaatggatactgaatttcctggagtggtggcaaggcctatcggtgagttccgtagtacagctgactatcagtatcagcttctgagatgcaatgtggatcttctccgtatcatccaattggggcttactttccttgacgaaaatggaaaagctcctgcgggtccttacagtacctggcagttcaatttcaaatttaatttggcagaggatatgtatgctcaagacagtattgatcttcttcagaattcagggattcaatttaagaaacacgaagaagatggaattgatcctgtggactttgcagaactgctcatgacctcaggaattgtactgatggaaaatatcaagtggttatcctttcatagcggctatgatttcggatatctattgaaactgcttactaatcagaacttacccaatgatgaaagcgaattctttgagcttctgaagatctactttcctactgtttatgatgtaaaatatctcatgaaaagttgtaaaaatctgaaaggaggtctgcaggaggttgccgaccagctggaacttacgagggtaggaccacaacatcaagctggctcagattcattattgacgggaatggcctttttcaaaatgagagagatgtttttcgaagacaatatagacgatggcaaatactgtggtcacttgtacggattgggtgcctcctttgttgtgaacggtaacagttttcacgacaacggtgacaactcaagtaattcatga

SEQ ID NO: 1486 - DNA, 1206 bp, Euschistus heros
atgtctgagtcgcgaagagttcaattgaaagaggacttgtcttttgtggagttcgaaacaagtgaaaatgttgaagttatttcctcttttcaaagcatgggacttaaagaagacttgttgagagggatatatgcgtatggatttgaaaaaccatctgctattcagcaaagagccatcatccccatcgttcgtggtagagatgttatcgcacaagctcaatctggtacaggaaaaacggcaacttttgccattgctattttacaatctttggatacccaaactagagatacccaagttttatgcttgtcaccaacaagggagctggcggtacagatacaaaaggtaattcttgcgttaggtgatctcatgaatgttcagtgccatgcttgcattgggggtacaagcttaggagaagatataagaaaacttgattatggccaacatgttgtatctggcacacctggtcgtgtttttgatatgattaagcgacgaacactgaggacaagatcaatcaaagttttagttcttgatgaagctgatgagatgttgaataaaggtttcaaagaacaaatttatgacgtttatcgtttcttacctcctgctacccaggtggtcctaatttcagctacacttcctcatgaaattcttgaaatgaccagcaagtttatgactgaccctatcaggatcttagttaaacgtgatgaattgacgttagaaggaatcaaacaattttttgtcgctgttgaaagagaagaatggaagtttgatacactctgtgatctatatgatacattgaccattacacaagctgttattttttgcaatacaagaaggaaggttgattggctgactgaaaaaatgagggatgcaaatttcactgtttgttctatgcatggtgatatgccacaaaaggaaagagatgctataatgaaggaattcagatcaggaaaaagccgagtccttataacaactgatgtgtgggctagaggtattgatgtacaacaggtctctcttgtcattaactatgatttacccaacaaccgtgagttgtatattcataggattggtagatcaggaagatttggaagaaagggtgttgccattaatttcgtgaagagtgatgacatcagaattttacgagatattgaacagtattacagtacacaaattgatgaaatgcctatgaacgttgctgatctgatttaa

SEQ ID NO: 1487 - DNA, 1599 bp, Euschistus heros
atgaagaacgctgctggagatggacacagatcacatagcaatgtatataaggacaaaagcaaacctcaagatgttcgcagcagtaatatgactgcagctaaaggcctcgccgatgctatccgtacaagtcttggtcctaaaggcatggacaaaatgattcaaaaaggaaatggagaagttaccataacaaatgacggtgctactattttacaacagatgaatgtcacccatcctgctgctaaacttttggtcgaactgtctcaagcccaagatgttgaagctggtgatggaacaactacagttgtcatattggctggtgctataatggaagctgctgaaaaacttatgaaccgtggtattcatcctacaacgatttctgatgctttcagcattgctgttgaaaaagccttaccaattttaagagaaatgtcaattcccctacaacagaatgacaatgaaagtctcattagaagtgcatcaacatctcttaactctaaggttgtttctcagcattcctcaattttagcaccattagctgtgaatgcagtgcttagaattacagacccaaagaaagataaaaatgttgacctgaaagatatcaaaatcataaagaagcttggaggcactgtagaagacacagaactcatcgaaggcttagtttttactcagaagttggccaatataaatggaccaaaacgtctagaaaaagtcaaaattggtctcattcagttttgtatttccccacccaagacagacatggatcacaatgtggttatctctgactacgcagcaatggataggatattgaaagaggagcgagcttacatactgaatattgcaaaacaaatcaagaaggctggttgcacaatgttattgatacagaaatctattttaagagacgccttgtccgatttagctattcacttctttgacaagttaaagattatggtcgtgaaggacattgaaagagaagatattgatttcgtctgtaagactcttggttgccgccctattgcatctttagatcactttacaagtgaagcacttgtaagcgctgagcttgcagaagaagtatcagcaggatcttcccgtatcgtcaaagtcacaggaattcacaatcctgcaaagactgtcacaattctagtccgtggatccaataatcttgtcctggaagaggcagatcgttcaattcacgatgccctttgtgtcatccgatgtcttatcagggaaagggcacttctgcctggaggaggagctcctgagatcgagttgtctcttcggttaggacagcatgcacaggttttggcatcagtagaggcttattgtttaagagagtatgcaaaagctttagaaattgttccttatacccttgccgagaatgctggtctcaatcctgtagctacagtgacagaactgaggaataagcacgttcacggccaaaccagtgctggtatcaatgttaggaagggccaagtaactgacattcttgaagaaaatgtcttacagccgatgctggtcaccgcaagtgctatcaccttagcaacggaaaccgttaggagtattctaaagatagatgacattctgaatgtcgcccattaa

SEQ ID NO: 1488 - DNA, 1248 bp, Euschistus heros
atggaagaaattggtatcgttctccctgagaaagaagaaaatagtcaagatgggaagcttagcaccattctaggacaaaatctgtctgatgacagcgacagtagtgatttattcaccaagtttaagaaattgcaaagacagctcgagtttttggcagttcaggaagagtatatcaaagatgaacaacgtaatctgaagaaggaatatttacacgctcaggaagaagtaaaacgaatccagagtgttcctttagttattggtcaatttctagaagcagttgatcaaaatactggaatcgttggtagcactacaggttctaattattatgtaaggattttatcgacgattgatagagaactgttgaagccttcagcgagtgttgctctccataagcacagcaatgccctcgtcgatgtgcttccacctgaagcagattcctctatttcaatgcttcaagcagatgaaaaaccagatgtgcaatattcagacattggtggtatggacatgcaaaagcaggaaatccgtgaagccgttgaattgccgctaacacactttgaactatatcgtcagattggtatcgatcccccaagaggggtgctgatgtatgggcctcccggctgtggcaaaactatgctcgctaaagctgttgctcatcataccactgctgcgttcattcgagtggtcggctctgaattcgttcagaaataccttggagaagggcccagaatggttcgtgatgtttttagacttgctaaagaaaatgctccagccatcatctttattgatgagattgatgccatcgcaacaaaaaggtttgacgctcaaactggtgcagacagagaagtgcagaggattctattggaactgcttaaccagatggatggctttgaccagacaacgaacgtaaaggttataatggctacgaacagagcagatacattggatcccgccctgctgcgacctggtaggctggacagaaagattgaatttcctcttcctgacaggcggcagaagaggcttgtcttttcgacaatcactgccaagatgaacctctccgaagaggtggacttggaggactacgtggccaggccagatagggtatctggtgctgacattaatgccatttgccaagaggctggaatgcacgctgttagggaaaatcgttatattgtccttgcgaaagattttgaaaaaggttataagaacaatattaaaaaggatgaatccgaacatgagttctataaataa

SEQ ID NO: 1489 - DNA, 519 bp, Euschistus heros
atgcctaacattaagttgcagagttctgatggagaaatatttgaagtggatgtggaaattgcaaaatgttcagttactattaagactatgttagaagatttaggcatggatgaagatgaggaagaagtagttccattgccaaatgttaattctgccattctgaagaaagtaattcaatgggccacataccacaaggatgatccacctccaccagaagatgatgaaaataaggaaaagaggaccgatgatatttcctcttgggatgctgactttctgaaagtcgatcaaggaactcttttcgagttaattcttgctgctaattatcttgacattaaaggcttacttgatgttacctgtaaaacagtagctaacatgattaaaggaaaaacccccgaagaaatacgtaaaacctttaatattaagaatgatttctctgctgctgaagaggaacaagtacgtaaagaaaatgaatggtgcgaagagaaataccttccaacagtaacgtttttacctcaatga

SEQ ID NO: 1490 - DNA, 930 bp, Euschistus heros
atggaagataagacttcgttaaaagaactggatcagtggatagaacagctgaatgaatgcaaacaacttaccgaaagccaagtcaaaactctttgcgataaggcaaaagaaatattagctaaagagtcgaatgttcaagaagttaaatgtcctgtcacagtttgtggagatgtacatggacagttccatgatttaatggaactgtttcgaataggaggaagatcaccagacaccaattatctgtttatgggtgactatgttgatagaggatactattctgtggaaacagtgactttactagttgctcttaaggtaagatatcgagaaagaatcaccatcttaagaggtaaccatgaatcgcgccaaatcacacaagtatatggtttttacgatgaatgtttacgtaaatatggaaatgcgaatgtatggaaatatttcacagatctatttgactatttgccattgacagctctcgtaaatggtcaaatattttgtcttcacggtggtctttcaccgtctatagacactcttgatcatatccgtgcactagatcgtttacaagaagttccgcacgagggtcctatgtgcgacttactttggtcggaccccgacgataggggtggttggggcatatctccaagaggtgctggttacaccttcggtcaagatatttcagaaacatttaaccattcaaatggcctcactctcgtatctagggcccatcagcttgttatggaaggctataactggtgtcatgatcgtaatgttgtaacaatattttctgcacctaattattgttatcgttgtggtaatcaagcagccataatggagttggatgatgcgcagaaatattcattcctgcaatttgacccagcgccgaggagaggagaaccacacgttactaggagaactcctgactacttcctataa

SEQ ID NO: 1491 - DNA, 951 bp, Euschistus heros
ttagtacttcgtcttagaggaggtatgcagattttcgtcaaaactcttactggcaagacaataaccctggaagttgaaccttcagatacaattgaaaatgttaaagctaaaattcaagacaaagagggaattcccccagatcagcaaaggctgatctttgctggaaaacagttagaagatggtcgtactttatctgactacaacattcaaaaggaatctactctgcacttggttttacgtttacgtggtggtatgcaaatttttgttaagactctgacaggaaagaccattactttagaagttgaaccctctgatactatagaaaatgttaaagcaaaaattcaggataaggaaggtattccgccagatcagcaaagactgatctttgcaggaaaacaactagaagatggccgaacactttccgattacaatatccaaaaagaatccactttacatctagtgcttcgtctgcgaggtggtatgcaaatttttgttaaaactcttactggcaagaccatcaccctggaagttgagccctctgacacaattgaaaatgttaaagctaagatacaggataaagaaggtatccctccagatcagcagcggttgatttttgctggtaaacaattggaagatggacgtactctgtctgactacaacattcagaaagaatctaccttacatcttgtgttaaggcttaggggaggtgcaaagaagcgtaagaagaagaattactccactccaaagaaaatcaagcacaagaagaagaaggttaagctagctgtgcttaaatattacaaggttgatgagaacggtaaaatcagcaggttgagaagggaatgcccctctgagcagtgcggtgctggtgtctttatggccgccatggaggataggcactactgtggaaagtgtgcctacacccttgtcttcaataagccagaagataaataa

SEQ ID NO: 1492 - DNA, 1629 bp, Euschistus heros
atgcaaccacaaataatacttttgaaggaagggactgagagctctcagggaaagcctcagctagtttcaaacataaatgcttgccaaattattgcagatgcaattcgaacaactcttggcccaaggggcatggacaaacttattgtggatggtggtggaaaagccacaatatctaatgatggtgctactatcttaaaacatttagatattgtgcatcctgctgccaagtgtttagtggatatagcaaaatcacaagatgcagaggtcggagatggtactacaagtgttgtcttgatcactagtgaaattttgaaacagctgaaaccatatgttgacgagggtgtccatcctagaataatgatgaaagcagtaaggaaggcgactcaattatgtttagacaaaatcaacagcttagctgttaagatcgaaaagagtagtgcggagcagcaccgctctctgctggagaggtgtgcagcaacagcactcagttccaaattgattcatcaacagaaagatttcttttcgaaaatggtcgtagacgctgtactattgttagatgaactccttccactcgatctcatcggtatcaagaaagtacctggtggagctttggaggaatccttgttggtctctggtgtggctttcaagaaaaccttttcctatgcaggcttcgaaatgcaacctaaaaagtatacaaacccaaaaatagctattctcaacattgaattagaattgaaagcggagagagacaatgctgaaatcaggcttgacaacgtagaggagtatcaaaaagttgtagatgttgaatggcaaattttgtacgaaaaattagatacaatcgtcaaatctggagctcaggtcgttctgtcaaaacttcccataggagatgtagctactcagtattttgcggacagagatatgttctgtgctggacgtgttgctgatgaagacataagaaggacacaaaaagcttgcggtggcaccatgatcaccactaccaaagacatgtcctcttctgtccttggatcttgtgaattgtttgaagaaaaacaaattggtggagacaggtataactttttctctggctgcccgaatgcaaagacctgtacaatgatacttagaggtggtgctgaacagttcctagaggagacggaaaggtctcttcatgatgctattatgatcgtcaggagaacaattaaaaatgatgcagttgtcgcaggtggtggcgctattgaattagaactttccaaaatgctccgtgactattcaagaactattgctggcaaagaacaattgttaatcggagctgtcgctaaagctcttgaaatcataccgaggcaattgtgcgacaatgctggttttgatgctactgctattcttaacaggctcaggcagaagcacgctcaaggaagctgctgggaaggtgtcgatgtaacactcgaagatatctctgataacatggagaagtgtgtttgggaaccgtcagtcgtcaagagaaatgctttggaagcagcttgtgaagcagtatgcctcattttgtccgttgacgaaacaattaagaaccccaagtccggaggcggcggacagggagaccagccgatgatgcccccaagaggcaggcctatgtga

SEQ ID NO: 1493 - DNA, 13965 bp, Euschistus heros
atgatgactgattccttggaatcaaatgatcctcccccggaggagcagccagtgtcgataatagatataacggattttttagactatcttcgtgaaaatattaaattgaatttattaggtgttaaaagtgtaccttcttctttagattctgctttagatgataatggaaatttggattgtattaagaagtttcttagtgacccacaatttgctacactaatagtgcaaaagaattcaaccaaagatgatgacccagaacagggtggtgagggtgaagatgaaaaggaaacacccaccataacgatatctaacatggttcagttctgtagtcccaaggcatctagtcttctatttatgaagaatggagcgattatggatgctgacaaaagcattcagtcacaattacacatgattgaattttctgagggtactgcgtatgaaagtcttcatgccattgttagcaaagggatgtcaccttattttaaaagttatgttaaagaatctggccgggctgatagggatggagataaaatggtgccatctgttgaaaagaagattgatgagttagaaatgggcctgttgcatttacagcaaaacatagatattcctgaaataacacttgtagttcatccaatagtatcaaatgttattaaaaagtgtgctgaagaaggaaggaagcccaaagtagcagattttggagaccgtgttgaagattcgaccttccttaaccagctacaacatggtgttaatcgatggatcaaagaaattcaaaaggtaacaaaactggatcgggatccagcatctgggactgcactgcaggaaatatccttttggttaaatcttgaaagggcattgcatcgaattcaagaaaagagagaatctattgaagttgggcttacattagagattctgaagcatggaaaacgttttcatgctactgttagctttgacacagacactgggttaaaacaggccttggcaactgtaaatgactacaacccattgatgaaggattttcccattaatgacctcttgagtgccactgaacttgaccgaataaaacttgctgttcaacagatcttcacccatctgagaaagattcgtaatactaagtatccgatgattagaggattacgactaattgaagccatatccagagatctcacgactcaactcttaaaagttttaggcactcgccgcttgatgcacattccatttgatgagtttgagaaagtaatggcacagtgcattagcgtatttgtcacatgggatgatgagtatgaaaaactacaaaatcttttgagagatatagttaaaaaaaagagggatgaacaacttaaaatggtttggagggttatgcctgctcataaaaagctccaaacaaggatggaacagatgcggaagttcaggcatcaacatgaacaactgaggactgttatattaagagttcttcgacctgtgcctgcctcccttatcaacggtcaagaggttactgggcaggataaagtagttgatgatgcacctaatatttctgctgttgaagaagtaaaccttgcctatgaaaacgtgaaagaagttgattgtttggacatgtcaaaagaaggaggcgaagcttgggaagcagctgtagcacgttatgaagaaaagattgataaagttgaaacacgtattactgctcatttacgggaccagttgggacaggcaaaaaatgctaatgaaatgtttaggatattttctcgttttaatgccttgtttgtgaggcagcatattcgaggtgccattagagagtaccagacacagcttatacaaagagtaaaagacgacatcgaagcacttcatgagaaatttaaggttcagtatggacaaagtaaaggctgtcggatgagttctatcagggatttagcaccagtttctggttctataatctgggtaaaacagattgatcgccaacttacgacataccttaggagggtggaggatgttttaggtaaaggctgggaaaatcatattgaaggccaagccctgaagtctgatggagacagttttcggcttaaacttaatactcaagaaatatttgatgactggtctcgttctgttcaacagaggaacctttcagtatctggtagaattttcgctattgagagtacacgttcacgttctggaagaggcaacttactgaagctcaaggtgaattttctcccagaaattattactctgtacaaagaagtgagaaacttgaagaacttaggatttcgagttccgctagccatagtaaataaagctcaccaggctaaccagctttacccttttgctgtctctctgatagaaagtgtcagaacatatgaaagaactcttgaaaagttagacgataaagctagtattattccattggttgctggtctgagaaaagaaatgcaacaacttgtagctgaggggatacaattggtttgggagagctacaaactagaacaatatgtccatcgatttgctgaacaagtctgtacattccaggagaaagttgaggatcttctggttgttgaagaacagcttgatgttgatgttagatctttggaaacatgtccatattctgcatcaacccttcgagatattcttgctaaagtccagcatgcagtagatgatctttcattaaaacagtattccaatctccatatatgggtcagcagacttgatcaagctgttgagaaaaatctcggaggaaggcttcaggcaggcattgatgcttggactgatgcattagaaggcaagagccatgagctagatctgagtatggacactgatgcgccagcgagaccaacccatgcacctggtggtgacccacatgtgcagacagtgactcatgaagttcgcattaccaatcagattatgtacctttatccgagcatagaggaagcaagattccagataatgcaacagttgtttcagtggcaggctgttgtaacttcccagcaaagacttcagagctcacgatatcagcttggacttgaaaggctcatgtcccagtcatatagagacttgttgactaagctacctaatggttcccaagccctcatcaatgcatatgattcaatagacaggaaaatcaaagatgttgtcaactatgtagatgagtggttgaggtaccaatctttgtgggatctccaatcagataccctgtacagtcggttgggagatgacattaccatgtggatgagatgtctttctgatgtcaagaaatcacgaactacatttgatacatctgagactcgccgacaattcggccctattgccatagattatgctaaagttcaaagtaaagtagcactgaaatatgattctcttgataaggaaatcttggctaaatttggtggccttttaggccaggatatgtctggatttcattcccaaatttctaagtcccgaagtgaattggaacagcagtcaattgaagcagccagcacttcagatgcagtctgctttattacttatgtccagtcattgaaaagaaacatgaaatcttggcagaaacaggtagaaatttacagagaaggacagagaatacttgagcgtcaaagattccaatttcctaataactggctgcatgtggacaatgttgaaggagaatggtcagcttttaatgaaatcatcaagaggaaggacctatctattcaggctcaggttgtgagcctgcagcagaagatggtggctgaggaccgtgcggttgaggccaggactaatgatcttctttctgattgggaacactccaagccaatagaaggtagactaaggccagatgaagctcttgctcagttaaatgaatttgaagtgaagtttgctcgacttaaagaggagagagacaatgttgctaaagctaaggaggcacttgaactacaatatacaggtgctagcagtggtagcgaggagagagtggctgtggtatttgaagagatggaagatctgaaggaagtatggactgaattatctggcatttggcgacgtttagatgagactcgagaaataccatggctttcagttcagcctagaaagcttcgtcaacagttagatggtctgtctcaacaactgaaagagttaccagcacgcgtcaggcaatactcctcgtatgagtatgtcaagaaactcttacaagggtatacaaaggtgaacatgctgatcgtcgagttgaagagtgatgcgcttaaggagaggcattggagagccctgatgagaaagctgcgtgttaactgggttctttctgagctttcactgggtcaagtttgggatgtcgaccttcaggccaatgagagtgttgtcaaagacattattcttacagcccaaggtgaaatggcacttgaggagttcctgaggcaggtcagagaatcttggcagaactatcagctagatttgatcaattaccaaaataagtgtcgtcttatcagaggttgggacgatcttttcacgaaagtcaaagaacacattaattctgtggccgccatgaaactgtcaccatattataaggtgtttgaagaagaggccctcacttgggaagaaaaactgaatagaataaatgctctgtttgatgtttggattgatgttcagaggcgttgggtttacctggaaggtattttttctggaagtgcagacattaaaacccttcttcccattgaaacctctcgtttccataatataagctcagactttcttggattgatgaagaaagtggctaaatctcctatggtaatggatgttctcaatatccaaggtgtgcaaagatcattagaaaggttagctgatttgttagaaaagatacagaaagctcttggagagtatcttgaacgggagaggatgtcattccctagattttactttgttggtgatgaagacttacttgaaattattggtaattcaaagaacattgcaaggctacaaaagcatttcaagaaaatgttcgccggtgttgcttcaattttgttgaatgaagataatacaattatcactggaatcgcatcaagggaaggcgaagaggttatctttactaatccagtttctactgtagatcatcctaaaataaatgaatggctctcattggtggaaaaagagatgcgattgacattagctgctactctagtttctgctgttggtgaacttagggctttcaaagatgcacctttggagccttcgaattacatggcttgggttgataggtaccaaggacagatagctgtcttagctgctcaagttctttggtcagaggacgttgaagcagcactatcagggaaatctgggggcttgcaaggtgtgcttacccaagttgagggcactctcactgttctcgctgactgtgtccttcacaagcagccaccgctcagaaggaggaagctagaggcattgattaatgagtttgttcacaagaggacagtaactcgtcgattaatacaagcaaatatatcttctcccaaatcatttgagtggctttgtcaaatgaggttctatctggatccaacgcagactgaagctctctcacaactctctattcacatggcaaatgctaagttctattatggctttgaatatttaggagttcaagatagactagttcaaactcccttaactgataggtgttacctgactatgactcaagccttggaagcacgtttaggtggatcaccatttggtccagctggtacgggaaagactgagtcagtcaaagctcttggtcaccagcttggacgtttcgttcttgtttttaattgtgatgaaacctttgacttccaagctatgggtagaatatttgttggtctctgtcaggttggagcatggggttgctttgatgaattcaacaggcttgaagaacgaatgttgtcagctgtctctcagcagattcagaccatccaagaggccttaaaatatcacatggattcaaacaacagagatagcactttaacagttgaactagtcggcaagcaagttcgtgtatcaccagatatggcgatatttattacaatgaatcctggatacgctggacgttccaaccttcctgataacttaaagaaattgttccgatcacttgccatgacaaaaccagataggcagctcattgctgaagttatgctgttttctcagggtttcagatctgcagagaaattggcatctaaaattgtaccattctttaaactatgtgatgaacaactgtcgaaccagtctcactatgattttggcctcagagccctcaagtctgtgcttgttagtgccggtaatgttaaaagggataggattcagagaataaaggaaaagagggaaggaggctctggagatgaagcaaccattgctgaaaaccttcctgaacaagagatcttgattcagtcagtttgtgaaacaatggtacctaaattggtggctgaagatattcctctgttgttttcacttcttaatgatgttttccctcaagtccaatataccagggctgaaatgacaaaattaaaggaagagataaggaaagtatgccaggaagaataccttgtttgtggagaaggagatgagcagggaggaccttggatggaaaagtatatgggagaaacatggattgaaaaggttttacagctttaccagatctcaaacttaaatcatggtttgatgatggttggaccatctgggtctggcaagtcttcagcttggagggtgttattaaaagcattggagcgctttgaaggaactgagggagtcgcccatgttatagatccaaaagcaatgtcgaaggaagccctctatggtgtcctagatcccaacactcgggaatggacagatggtctctttactcatgttcttaggaagataattgacaatgttagaggagagattaacaaaagacaatggattatatttgacggagatgttgatccagaatgggttgaaaacttgaactcagtgcttgacgataacaaacttcttactttacctaatggtgagagattgtctctaccaccaaatgtcagagttatgtttgaggtacaagatttgaaatatgctacccttgcaactgtttctcgttgtggtatggtatggttttctgaagatgtactatcaacagagatgatatttgaaaattatctctctcgccttagacacattccattagaggaagcagaagaagaatcttctttccctcagctgaagaagataggtggagagaggaaagaagaaggaatatcaccagcgatgcaggttcagacagatgttgccaacatcttgcagagctatttctcaccagatgggcttgtcgtcaggtgcctggagtatgctctcaagcaggaacatataatggatctcactaggcttagggctctcggctccttgttttccatgctcaatcatggtgttagaactgtcattcagtataaccagagccactctgactttccattaccatcagagcagctggatagatttattcctaaaattttaatctactcacttttgtggtcatttggaggagatgcgaaactcaaagtgcgctcagacctgggtgattttattcgatctgttaccacaataccattaccaccaaacaatcctaacataccaatcatagattatgaggttaatatatctggggaatggagcccatggtcagccaaagtacctcagattgaagtggaaactcataaagtggcagcaccagatgtggtggttcctactcttgacacggtccgccatgagtctcttttgtatacatggctcgctgagcataggcctttagttctctgtggtccacctggttcaggtaagaccatgaccctattttctgcactaagggctcttccagatatggaagtcgtcggccttaatttcagctctgcaaccacaccagagcttctcctgaagacttttgatcattattgtgaatatagaaagactcctaatggagttgtattagcacctgttcagttgggaaaatggttggttcttttctgtgatgagattaacttgcctgatatggactcttatgggacccaacgagttatatcctttttgagacagctagtcgaacagcgaggattctacaggtcttctgaccttgcttgggtttccctcgaaagaatccagtttgtaggtgcttgtaatccacccacagatcctggcaggaaacccttgtcccatagatttctcaggcatgtacctgtcatatacgttgattatcctggtgaaacatctctcaaacagatttatggaacattttcacgagcgatgctcaggcttattccttcattgcggggatatgcagaacctctcacaaatgcaatggttgaattctacctctcatcacaggaaaggtttactcaggacatgcagcctcactacgtctattcacctagggaaatgacaagatgggttaggggtatatgtgaagctataaggccattggatagcttgaaagtagaaggacttgtaaggttatgggctcatgaagctctccgccttttccaagacaggcttgttgaagctagtgaacgagaatggacaaatgaaaatattgacaaagttgctctaaaacattttccatcagtggacaaggaatcttctcttggccgaccaatcctttattccaattggctgtcaaaggactatattcctgttgaaagggaccagctgagagattatgtcaaggcaagactgaaagtattttatgatgaagaattggatgtacctcttgtcttgtttgatgaggttctcgaacatgttctcagaatagacaggatattcaggcagccacaggggcatttgctccttataggtgtctctggagcaggcaaaacaacactttctcgctttgttgcctttatgaatggactgtcagtatttcaaatcagggttcacaataagtacactagtgaagattttgatgaagacttaagatctgtgctaaggagatctggttgtaaaaacgagaaaatagctttcatccttgatgaatcaaatgttttagaatctggttttctagagaggatgaacacactgctggctaacggtgaagtgcctggtctatttgaaggagatgaatacagtacattgatgacccagtgcaaggaaggagctcaaagggaaggactcatgctggattcgaacgaggagttatataaatggtttactggtcaagtaatgagaaacctccacgtcgttttcacgatgaaccctagccatgaaggactcaaggatagggctgctacatcacctgctctcttcaataggtgtgttctcaactggtttggagattggtcagatggcgccttgtatcaggtgggtagagagttcactaatactcttgaccttgatggaccgcccacctggaaagctcctgactttttcccaatcgcttatgcaaatttaccatcacctcctaatcacagacaagcagttataaatggatgtgtttttgtacatcaaacattgcacaaagccaatcaaaggcttgcaaaacgtggagcgcgcacaatggccatcactccaagacattacctagactttatcaatcattttgtaaagttgtatagagagaaatgttcagagctcgaagaacagcaacttcatttgaatgttggtttaggaaagatagcagagactgttgaacaggttgaagaaatgcaaaaatccttggctgttaaatctcaggaacttcaagcaaagaatgaagctgccaatgccaagcttaagcagatggtcaaagaccaacaggaggcagaaaaaaagaaggtacagtctcaggaaatccagtcgcagatagaaaagcagaaactacttatagctcaaaagagagaaggtgtaatggctgatcttgctcaagttgaaccagctgttattgatgcccagcaggctgtgaaggaaataaagaagcagcagctggtagaggttaggtcaatggccaaccctcctgctgtagtcaagttggcactcgagtcgatctgcctcctcctaggggagagtgccactgactggaaatccatcagggctgtcgttatgagggacaacttcatcaattctattgtcaacaatttctccacagaaaacatatctgacgaagttagagagaagatgcatactcgttatcttagcaacccagaatatacatttgaaaaggttaacagagctagtatggcatgtggtcctatggtgaagtgggctgtagcacagataagttatgcagacatgttgaaaaaagtggaaccactgagagaagaattacggtctttagaagagcaggctggtgaaaatgaacagaaaggagaagacacaaaagcactcattgcacagttggaaaagagtattgcagcctacaaggaagagtatgctcaactgatacaggaagggctcgctatcaagcaagatttagaaaatgttcaagctaaggttgatcggtctatcgctctcctgaaatctctcggcctagaaaggtcaaggtgggaagcaacatcagagacatttaagtctcaaatggcaaccattattggtgatgtcttactctcttcagcctaccttgcatatgctggttactttgaccaacattcccgacacaatcttctgtcccggtggacagagcaccttagttctgcaggtattcaatacaggcaagacatagccctcacggaatatctttcaaatccagatgaaagacttaggtggcaggcaaatagtctgcctacagatgacctatgcaccgaaaatgctattatgctaaagaggttcaaccgatatccactcatcatcgatccatctggacaggctacagaatttattatgaatgaatacagagacaagatcacaaagactagtttccttgatgattcatttagaaaaaatctggaatcggctcttcgatttggcaatcctttacttgtgcaggatgtcgaaaactatgatcctattttgaatcctgtacttaaccgtgaagtgaggcgaactggtggcagagtattgatatcattaggagatcaggatattgatttgtcgccatcatttgtgatattcctctctacaagagatccaactgtagaattcccaccagatatctgctccagagttacatttgtcaatttcactgtcacaagatcctcattgcagtcccaatgtttgaaccaagtacttaaagctgaaagatctgatattgatgaaaagagatctgacctccttaaattgcaaggcgagttccatttaagattgagacagctggagaaatccttattgggagctttgaatgaagccaagggtaagatcttagatgacgattctgtgataactacattggaaacattgaaacaagaggctgcggagattagtaagaaggttgaagaaacagacagagtaattggagaaatagagacagtttcacaacaatataaacctctttcacaggcatgcagcaatatgtacttcactcttgattccttgcaccaaatacatttcctctaccagtatagcctcaagttcttcctggacattttctcagctgttctcttctccaatccatctctggatggtcttactgaccacactcaaaggctgggtgttataacgaagcagctgtttgctgtttgctatgagagagttgctcgaggtatgcttcatacggaccgattgacacttgcattattattatctagaatataccttcgtgggttgccacaagaagaccaattggaggctgaattccatcatttcctcagaggaaaggagggagtcattgtttcaggtggaggggcatcccatctggaagggttgtccagtgaccagttggaagccctcattaggttgggcaacaggctacctcagttcaaggaattaatgaagaaggttaacgaaatgcctgagtttgttgcttggctccagcagtcgacaccagagcaaaatgtaccaacattatggcatgaggataagcccttatctccgatcgctactgctatgaaccggcttctccttattcaagctgtgcgaggagatagggttactgcagcaggtgctggacttgtcagtgctgtgcttggtgaaggttttacagctcgagctgagagggaattagatctggcccatattgttgagtctgaaatgactgctggtgtacctgttctgttatgttctgtgcctggttttgatgctacctcaagggttgatgacttggctgctgaatctggcaaacagttggcatctatagctatcgggtctgctgaaggattctcgcaggcagactcaataatcaacatggctgtgagatcaggaagatgggtactactcaagaatgtccaccttgcacctcaatggcttgtacaattggagaaaaagcttcactcactgcaaccgcactcaggcttccggcttttccttactatggaaatcaatcccaaagttcctgttaatcttctgagagcaggtcgtatctttgtatttgaaccacctcctggaattagagcaaacctattaagaacattcagcactgttcctgcctcaagaatgatgaaggcacctagtgaaagagcaagattgtacttcttgttggcttggtttaatgcaatagtacaagagagattgcgatatgctccccttggatgggccaagcactatgagttcaatgagtcagatcttcgagtggcatgtgatacattagacacttggatagatgccacagctgtgggaagaacacagttgccgcctgaaaaggttccttgggatgcattagttacacttttatcgcaatgtatctatggtggcaaaatagataatgactttgatcagaggttattatcttcattcctttcgaaattgttcacaccaagaagctttgaggcggactttgctttagtagctaatgttgatgctggagctccaggaggtcaaaggcatataacaatgccagatggaacaagaagggaccatttcttgcattggatagaatctctggctgatagacaaacaccatcttggcttggcttgcctaataatgcagagaaagttcttttgaccaacaagggtactgatttggtgattaaactcttgaagatgcaacaactggaagatgaagatgagcttgcttacaccgaacaggagtcaggacctccttcttcccttcagccaggacctgatcctggcaggcctgcgtggatgaggacactgcacaactcagctctgacatggctccagttgttaccaactaatcttcagacattgaagaggacagtagaaaacatcaaggacccactttaccggtactttgaacgtgaagttaactcaggcgccaaacttctcagggatgttattcatgatctcactgatgttgttgccatttgtcagggagagaagaaacagaccaactatcatagaactatgctcagcgatctggtcagaggaatcctcccatcaggctggaggaggtatactgttccaagagggtgtactgttattcaatggataacagactttagcaacagggtgaaacagttggacaccatttctcaacttgcgtcgcaaagaggaccatctgaaattaagaacactccaatctggttgggtggtttgatgaaccctgaggcttatattactgccactaggcagtgtattgctcaggctaacagttggtctcttgaggagttaatcctggatgttactattcctgaaccatcatcgacttcctctgttgctactgatgaatgcagtttttctgtcactgggctcaaattgcaaggtgcacagtgcaggaacaatcaacttctgctcacttcaacaattatgatggatctgccaacaacattactcaggtggcacagggctggtggagagggagactctgggaagctatctttaccggtataccttaattcaacacgtagcgagcttcttttcactgttgacttaaacattgctcctggtcaagaaccacatagcttctatgagagaggagtagcccttctcacttctacagcgctcaactag

SEQ ID NO: 1494 - DNA, 2640 bp, Euschistus heros
atggccgactcaagtactgattctagtgatagtgaagaggatagaaaacaaagagatgaattcgctgcacgtcttagaaaaaaagataaagaaaatatgaggaaaattacaactattcattctgataaaagagcatatgaggaagcagctaaaagattaaaaattgattctgaacatcaagaaaaattgattcctaggttaagagttgaatcaagaaggaagtatttagaaaaacgtaaagaagataaagttcttgagcttgaagcagacattattgatgatgaatatctgtttaatgatgatgaactcacggagagggaaagaaaagatagagatcataaaaagaaattattggtcctcgcaaaggaacatgaaaaagctagagaactagaaaaagttcaaagatatcatatgcctagagatgtcaaagagggtgttgaacaatatgaggaagttgatgagagagaaaacaagcctaattatgagcaaaggaaatgggaggaagaacagatgtcttcagctgtgtttcactttggtgcaaaacaaaaagataaataccaagaagaatatgacttggttcttgataatcaaattgaatttatccaggctatgagtctagctgggactaaagaaaagcctgatcagcagttaacagagaaagaaagaaaaaggttgactattgaagaaacacaaaaaagcctccctgttttcaagtttaaagatgaacttgtgcaagcaatcaaggatcatcaaatcctgattattgaaggtgaaacaggctcaggtaaaactactcagattccacagtatttataccaggcaggatttactaaagatggtaagaaaattggatgcactcaaccaaggagggttgctgcaatgtcagttgcagccagagttgctgaagagatgtctgttaagttaggaaatgaggttggctacagcattcgttttgaagattgtacatcagaaagaactgttataaagtatatgactgatggtactcttcacagagaatttctctcagaaccagacctccaaacttacagtgtcatgataattgatgaagctcatgagagaacattgcatacagacatactgtttgggctagttaaggatattgctaggtttaggtcagatcttaaacttttaatctccagtgctacactagatgcagaaaaattctcaacattttttgatgatgctcctatatttaggattccaggaagaaggtttccagttgatatatactacaccaaagcacctgaagcagactatattgatgcttgtgtggtctcaattctacagatacatgctactcaaccattaggtgatattctagtgttccttactggtcaggaagaaattgaaacctgtcaagaaattctacaagatagagtaagacgtcttggaagcaggatcaaagaactactaatccttccagtttattctaatctaccatctgacatgcaggctaaaatctttcagcctacacctccaaatgcgaggaaggttgttttagccacaaatattgctgagacctctctcaccatagacaacattatttatgtcattgatcctggtttctgtaaacagaataattttaactcaagaactggtatggaatcattgatagttgtgcctgtttcaaaggcttcagccaatcagcgggctggaagagctggtcgtgtggctgctggaaaatgctttcgactttatactgcatgggcatacaaacatgagttggaagataacactgttcctgaaattcaaaggatgaatctgggaaacgttgtacttaccctaaaagcattaggaatcaatgatttgatcaattttgatttcttagatccacctccccatgaaacattggtacttgctttagaacagctttacgcattgggggccttgaatcatcatggggagttaactaagttgggtcgaagaatggcagaatttccattagatccaatgatggggaaaatgttacttgcttctgaaaaatataaatgtagtgaggaaatagttactattgcagcaatgttatctgtaaatggtgccatattctatagacctaaggacaaagttgttcatgctgatactgccagaaaaaatttcttccttcccggtggtgatcatcttgttctctggaatgtttataagcaatgggcagatactgacttcagtacacaatggtgctatgaaaattatattcagtacagatccatgaaaagagctcgagatgttcgagaacaactggtaggtctaatgcaacgtgtagaaatggactttatttctaatcctacagatactattgcaatacgaaaaacaattacttctggttatttctaccacattgcaaggctttctaagggaggtcattacaaaactgttaaacataatcaaactgtaatgatccatccaaacagttgtctatttgaggatcttcctcgctgggttgtgtatcatgagcttgtcttcactaccaaggagtttatgaggcaggttgctgaaattgaaagcaaatggttgcttgaagtagcaccacattattataaacctcgtgaattggaagattctacgaacacaaagatgcctaaagtattaggaaagactagagcacagctaggggaacattaa

SEQ ID NO: 1495 - DNA, 1371 bp, Euschistus heros
atgaagattgaagaagttaaaagtactgtaaaaactcagaggatatctagtcatagtcatattaaaggtttgggcctagatgaaaatgggataccaattcaaatggcagccggtttagtgggccaagaaaatgccagagaggcagctggaatagtagtggaaatgattaagtcgaagaagatggctggaagagctgttttgatggctggaccaccaggaactggaaaaacagctattgcgcttgctatggcccaagaactaggaaataaagtaccattttgtccaatggtaggatcagaagtgtttagctctgaaattaagaagacggaagtgttaatggaaaattttagaagagctattgggcttagaatcaaagaaactaaagaagtttatgaaggtgaagttacagaacttacacctgtagaaacagaaaatcctatgggaggatatggtaaatctgtatcccacgtagttattggcttgaaaacagcaaagggtacaaaacagttaaagctagaccctagcattcatgaaagcttaaccaaggagaaggttgaagtaggagacgttatatacatagaggcaaacagcggtgccgttaagaggcaaggaaggagtgatacctatgctacagaatatgatctggaggcagaagaatacgtcccacttcctaaaggagatgtccacaaaaagaaagaagtgatccaagacgtgacattacatgatcttgacgtagctaacgcgaggccgcaaggaggtcaagatgtactgtctataatgggacagctgattaagtcaaagaaaactgaaattaccgataaattaagagctgaaattaacaaagtcgtcaacaggtacatcgaccaaggtatcgctgaacttgtgcctggcgtcctatttattgatgaagtacacatgctagatatagagaccttcacttaccttcatcaggctcttgagagtgcaatagctcctatcgtagtctttgctacaaatcgtggtcgttgtcaagttagaggtgctgtggatattatttcaccccatggattaccgttggacctcctggataggttgctcataattcgtaccgcaccttacagccaaccggaaatgtgccaaattctaaaattgagggctgtaactgaggggcttagcatcgacgaggatgcattatcagagctcagtgatattggaagcaaaacaactctaaggtatgcagtccagttgttgaccccttctaacttaacagccaaagtgaacggtcgttcaacgattacaagggaagatgtagcagaggtgggacaactgtttctggatgcaaaatcttctgccaaaattcttgcaaaacatcaggatcaatatatgaaataa

SEQ ID NO: 1496 - DNA, 2196 bp, Euschistus heros
atgacctccatcattaagttccatgccttgtcaggagttatggatgaatctccaccctgttatattttgcaagttgatgagtttcggtttttactagattgtggttgggatgaacacttcaatcaggactacattaaagaacttaagagacatgttcatttaattgatgcggttttacttacttatcctgatcatttacacttaggagcattaccatatttagttggaaaatgtggacttagctgccctgtttatgctactattccagtttacaagatgggacaaatgtttatgtatgatttataccaatctcgctacaacatggaagactttaatgtgtttagtcttgatgatgttgatgctgcatttgataaagttgttcaattaaaatataaccagtcagtaacaatgaaggggaagtgctatggactcagcattgttccaatgccagctggtcatatgattggaggaacaatgtggaaaattatgaagacaggagaagaagatattatatatgccattgattttaatcataaaaaggaaagacatcttaacggctgtgatctagaaagattgcagaggccatcattgctaataactgacgcatttaatgctacttatcagcaagaaagaagacgagcaagagatgaaaaactcatgacaacaattcttcaaacattgagtagcaatggaaacattcttattgctgttgatactgctggtcgccttttagagttggcacatatgctggatcaactttggaggaataaaaattctggtttacagattcatcctttgtgccttatcaataatgttagttataatgtagttgagtttgctaaatctcaaatagaatggatgagtgataaattaatgaaaagttttgaggcagttcgtaataatccatttcaattcaaacacatacgtttatgtcatagtgtttcagaacttaataaaataccttcagccaaagtagtacttgccagtatgcctgatcttgaatgtggatttgcccgtgaaatattttttcagtgggcatctgattccaaaaacagtattgtactaacatccagatgttgtgaaggaacattagcaagagatttattagacaatggtgttggaaggaccatccaaatcactgttaaaaaaagagtccgtcttgaaggggaagaattaaaagaatacttaaaagcacataaaaaaacaaatgataaaaatgaagagaaggaaagttctgagtcagaagatgaaattcaattgcttagtgtcactaaaggtagtcatgatctcgttattaagcaagaaagaagaaaaaagaatcaaaaatctttaaagaaattttatcccatgtttccttttattgaccgtaaagttaaatttgatgaatatggtgaatttgtacgtatagaagattataaagctcctgatgccactaaacgtcctcctgagaaaaagtccaaaaagaaggatgatgatgttttagatcctgctgatattccaaccaaatgtgtttcttatgagaaatcactaactgtgaatgcccaggttcagtacatagattttgaaggaagatctgatggagaatcagttcagaaaataatcactcagttgaggccaagaagagtgatacttgttcgtggtacctcagaaaacacagaagctttggaaaagcatcttttgcaatggtctgaggcaaaaattttctgtccgaaaaagggtgatattgtggatgccacaactgaaagtcatatatatcaaataagattgactgattctttagtttcttctttacatatgcaaaaaggtaaagattcagagcttgcatggattgatgccattacaaaataccgtcagaaaccctctgatactatgcaatcggcagaagaaatggaggttgaagatgatggtaattatagtatttacaatgatgattatttaactctagaacctcttccattaactgaagtcaatccccatcaagcagtatttataaatgagttaaaattatctgatttgaaacaaattttgtctcgtaatggaatagagtctgaattttctggtggtgtgttgtggtgctgcaatggtactattgctattcgaagattagagtcttctaaagtgtacttagaaggatggatttctgaaaattactatagaataagagaaattttatatggacagtatgcgattttataa

SEQ ID NO: 1497 - DNA, 2424 bp, Euschistus heros
atgccctcaatagatgttatccagcctcctcctcctcctccttccatggagaaggaggaacctatacttcaaccgacaactaagccgattgtcggtattatttatcctccaccagaagtgagaaatatcgtcgataaaactgccagttttgtcgcccgtaatggaccagaatttgaatctcgaatcaggcaaaatgaactgggaaatcctaagtttaactttctcaatacaggcgacccttatcatgcctactaccagcataaagtaaaagaatttaaggatgggaaaggagccgaaccaccaccgcctccagcgcctgtccaacagaaaaccgttgcttccgctacacagttgaaacagcaagaaatcctaaaacaagtcactgaacagccatttgtaccgaaagatcctccaccagattatgagttcatggctgatccgccttcaatctctgctttagatttggatattgtaaagctaacagcacagttcgtagcaagaaatgggcgacagttcttaactaacctcatgaacagagaacaaagaaattaccaatttgattttcttcgaccacagcattctctctttttgtacttcacgaaacttcttgagcaatatacaaaggtcttgattcctccaaaagacctaatgtctcgtctaaaagaagagtgttctaatcctactggagttctggagcaagtcaggtaccgtgcggactggcttcactatcaagaactgcagaagaggaaagaggaacaagcactggagaaagaaagggtggcttatgctcagattgattggcatgactttgttgttgttgagactgtagactatattccgggtgaggtaggcaacttccctcctcctaccactccagatgaagttggagctagagtcctgatgcaggagagaatcttggaaaatggaggagaagatcttacggaaggagccggtagcgatgaagagagggagaaggaagacagtgaaagagaggaggcaactggtgacaagggagacaatactcaggttcaagacatggaggaagagtcatctagcgatagcgatgatgatgatgaaagagatcaatctcttggggagaaacaaccagcaacacaagctcagaaacaacaaatgttacaacaaaatcaacagctggcctcagcagatggcaaaaaaccatctacacagccttcaatgcaacctcccctgcctccggcacctgataaagttatcgtcaaaaaaggctataaccctaagcagaaccagaagatatcgaaaggtgcagataattatcttatctctccactgacaagtgagaagatacctgccaacaaggtgcaggaacacatgagaattggtctgttggatcctcgctgggttgagcaacgagacaaacacatccaagatagaatcaatcaggagactgtttatgctggaggttctgctattgaggccagcttgaaacaacttgcggagagaagaactgatatttttggtgtcggtgatgaagaaactgccattggtaagaagattggtgaagaggataagaagaaagatgataaggtgacatgggacgggcacacttcaagcgtggaggctgctactcgcgctgcgagggctaacatcaccattgaggagcagatccaccaaattcacaaggtgaagggtttgcttccagatgaggaaaaagagaagataggaccgaagccagtcccaggatcagtgagtacaagttcagcgaatccaatgattggtggtcctccgattgttgtccaagctaaagcacccccacttcctcctcctccgaaggtacctccacttccacctccagctcctttgccgcctccaccaggtcttgtcccgcagccacccattatgatggtacctgcaccgctccgccctccactcatggttcctcctggagcgttccccgtagtcgctgctactccacctgcttttatggctcctccaggaactgcacccctgccacctgctccacagccaccacctcaggttactcaggttggaaacttattaaaacatgttgcttctgctgctgcgggagagactgaggatgagccaatgactaaaaaggccaaaacagaagattgccttatcccggaagctcagttcctcatgcagaacaagagccctgttacattcaaagtggtggtgccgcttttggctgacaaaccagaatggaagttgaatggccaggcattgacatttactctaccactaacagacaccatcgcctcggtcaagagcaacatttcagagaccataggaatgccagctgccaaacagaagctacagtgtgatggcattttttacaaggattcaaactctttagcattctacaatatctctcctgctacggttgtgtacctgcagctcaaggaaagaggtggcagaaagaaataa

SEQ ID NO: 1498 - DNA, 942 bp, Euschistus heros
atgccaggagtagagcttgttactaacaaagtagtggttcaccctttagtcctattaagtgttgttgatcatttcaatagaatgggtaaaattggtaatcagaagagagtagtaggtgtattattaggttgctggaaagcaaaaggtgttttggacgtatctaatagttttgcagtgccatttgatgaagatgacaaggataaatcagtttggtttttagaccatgattatttagaaaacatgtatgggatgtttaagaaagttaatgctcgagaaaaagttgttggctggtaccacactggtccaaagcttcatcaaaatgatgttgcaattaatgaacttattcgtcgctactgccctaattctgttttggtgataattgatgcaaaacctaaagaccttggtttacctacagaagcctacagagcagttgaagaagttcatgatgacggctcccctaccacaaaaacatttgaacacgttcccagtgaaataggagctgaagaggcagaagaagtgggtgttgaacatctgttgagagatattaaggacacaactgtaggctcattatctcaaagggttactaatcaatttctgggcctcaaaggccttaatcagcaaattcaagatatcagagattaccttatgcaggtagttgaaggaaaattacccatcaaccatcaaataatataccaactgcaagacatctttaacctacttccagacatgaatcatggaaactttgttgattcattgtacattaaaacaaatgatcagatgcttgtcgtttacctcgctgctcttgtacgagcaatagttgctttgcataatctgattaataataaactcagtaatcgtgatgctgagaagaaagaaagcaccaaaaaagaagaaaagcctaaagaagaagaaacggtaaaaaaagaattgaaggccaagtaa

SEQ ID NO: 1499 - DNA, 1623 bp, Euschistus heros
atgtttcagccgattttcgtgttaagtcaaaactccaaaagggaatccggcaataaagttcgatcggagaatattgccgcagctaagatgattgccgaagttataagaacttgtcttggaccacaggctatgcttaaaatgttgatggatccgatgggtggtatagttatgacaaatgatggaaatgctattttgagagaaataactgttcagcatcctgctgcaaaaatgattattgaaattgcgagaacacaagatgaagaggttggagatggtacgacatcagttgttattctctgtggtcaaattatggctgaaattgagaggcatatagacgaagtccatcctactacaatcattaaagagtttaaaagagctttagatgatattttaaaaatacttccagatataagtacatctcttgacttgaaggataaatctaaggttattgaagttgttaaaggatgtctaggaaccaaatttttaggtacttggtctgaaatggcttgccaaatggcaattgatgctgtcgatactgtcagagacctgaaaggtcatggaatcgacttaaagaactttgctaaaatagagaaggttccaggaggtttcattgaagattccaaagtattggaaggtgtgatgctcaacaaagatgtcactcatcccaagatgtctcggtttattaaaaatccacgaattttgttactagattgttctcttgaatataaaaagggagaaagtcagaccaatgtggaaatcataaaagaaggagattatacaagacttttacaaatcgaagaagaatacattgaaaaaatgtgtaatcatattattgagcagaaaccaaatgttgtcattactgaaaagggtgtttctgatctagcccaacatcatcttttcaaggctggtattacaaccatccgtagggtaaagaagactgataataacagaatagctcgagctgtagatgcaactattgttagtcgtgttgaagaaatcaagccctatcatattggatgtggtgctggtctctttgaagttaagaagattggagatgagtatttcactttcattactgaatgcaagaatccaaaagcttgtacaatattattgcgtggtcctagtaaagatgtattaaatgaggttcagagaaatttacaagatgcaatgaatgttgttagaaacttgtacttggatcctaggatacttccaggaggaggtgctgtagaaatggcccttcatagagctctaattaaagctaattttactgtagatatggatgaagactgttatgctgccattccatctgctttaagaattattccgagaacccttttgcaaaatgctggtgggaaagtaatcaggtctatgaatgaactcgagaaacaacataattctggtgttcttaaaggagttgatgggattactggcgagttaaagacagttgatgaattaggtgtatgggaaccatactcagttaaagttcagatttataaaactgctattgagtctgcaatcctattgttgaagattgatgacattgtttctggtgcgaagaataaagatagagaacgaaattcaggtccaatagcacagccttctgaagaatcgcttaaagaataa

SEQ ID NO: 1500 - DNA, 819 bp, Euschistus heros
acggtggtttatcagatagggcattgcgatcttagtcatatcctctccagaaaggttatatttgaaaacgttggtcattctttgggtgacttagttgtttatcaagaattagtctttacaatggcaatgccaagaacttacggtggtttatcagattatagaaatgttcctgcaccttcctttagtccatattctgaaaatggaggaagtgtagttgctgtagcaggtgatgattttgcaattattgcatctgatacacgtttaagtactggttttcaaatttacaccaggaaccagtccaaactgtttaaactttctgataaaacaatacttggtagtactggatgttggtgtgatgtcctttctctgactaggctggttcagacccgaataaaaatgtatcagtatgatcataacaaagttatgtctaccccagcagttgcacaaatgttgtctgttctactctattacaagcgatttttcccttattatgtagctaatattcttgctggaatagatgacaatggtaaaggtgttgtttatagctatgaccctattggtcatcatgaaagctcaaaattcagagctggtggaacagctggagctttattgcaaccattgttggacaatcagcttggtatgttgaatcaagaaaatgttcaagataaaacttatactttggagaaagcccatgcaattgtgaaagatgtctttatatcagctgctgaaagagatatatttactggtgacaggatatcaattaacatattaacaaaggatgggataagagaagattcttttgagcttagaaaagattaa

SEQ ID NO: 1501 - DNA, 900 bp, Euschistus heros
atgttcgggttcagtatgtttccattccctcctaggccttttaaggtccagtattattgcttttctgttgcaatgataccaggtaatgaacgggatgacgttgaacgtggaggaaagattattatgcctccttcagcacttgaccacttgactagattaaatataaattatcctatgctttttaagctgcataactcaaagacaaatagaacttctcatagtggtgtgttagaatttgttgcagatgagggaaaagtgtatctcccgcactggatgatgcggaatttaatgcttgaagaaggtgatgttattgagatagaaagtgtttcattacctgttgccactttttctaggtttcagcctcagtctccagattttttggatatatcaaacccaaaagcagtgttagaaaactgccttagaaactttgcttgtttaactactggtgacataataaacattaagtataaccaaaaagactatgagctttctgttttagaaacgcaaccaggtgctgctgtgacaattatagaatgtgatatgaacgtagaatttgcaccacctttagggtataaagagccaaattctgaacaggaggctttggatgaatcatccgaaagatctgaaaacttaacaaatgaaggaagtgggttcattccattctttggtgaaggatatcggcttgatggtaaacagaagaaagctatcgaagatgagagtgtaggatttaaaatacctactgtgagagggattcctgattatgactggaaagttggtgtgattacctttatgagaaatgtacgccaacctgtaaaggaagcccagaaagatgatgaagataaattccaacctttttatggacaggggcatgtattaagtacaaatcgcaaccggaaataa

SEQ ID NO: 1502 - DNA, 1629 bp, Euschistus heros
atggctgcatttccaggatctattgcatttgatgagtatggtagaccgtttattataatcaaagaccaagataaacaaaaacgtttaaccggcaatgatgctattaagagccacattctatcagctaaagcaatttcaaaaattgtcagaacttcactgggtccaaaaggtttggataagctccttgtatcacaagatggtgatgttatggtaagcaatgatggagctaccatcatgaagcaaatggatgtggataatgaaatcgcaaaattaatggtgcaactttcacaatctcaggatgatgaaatcggtgatgggacaactggagttgttgttcttgcaggtgctttattagaacaagctgacattttactggataaaggaattcatcctatcaggattgctgatgggtttgaattagctgctagagctgccatacaacatttagattcaatcgccacaaaatttcctgttgatcctaacaatttagagccccttataaagaccgctatgacaactcttggatcaaaaattgttaacaaatgccatcgtcaaatggcagaaatagctgttaaagcggtattatcagtggctgatcttgaaaaaagggatgttaactttgaactgataaaagtagacggcaaagttggtggaaggcttgaagattcgatgctcgtaaaaggggtagtaattgataaggacttctctcatccacaaatgccaaaggtattgaaggatgttaaaatcgcaattttaacctgcccatttgaaccacccaagccaaaaacaaagcataagttggacgtaacttccattgatgattatagggcattgaggaagtacgaagaagagaaattcaacaccatggtttctcaagtcaaagatgctggtgccactcttgctatttgtcaatggggattcgatgatgaagctaaccatcttcttttgaagagagaacttcccgcagttagatgggttggtggtcctgaaatcgagttaattgccattgcaactggtggacgcatcgtaccccgatttgaagagctgagtcctgagaaacttggtcgagctgggcttgttagagaaatatctttcggtaccaccaaggacaaaatgcttgtgattgaagaatgtgccaattctcgttctgtcacaatcttcatcagaggctcaaaccagatgataatcgatgaggctaagagatcaatgcatgatgcactctgtgttgtcagaaatttgatttgtgatgacagtattgtatacggcggaggtgctgctgaactttcttgctccattgccactgccaaacaagcagataagatttcatcaattgaacagtatgcattccgtgcattttctgaagctctggagtccattccttttgcactcgcagagaattctggcttacctccaatgcaagttgtaacacatgtaagaggaaggcaaattcaagaaaacaacccagctcttggtgtagattgtatggggaaaggaaccaatgatatgaaagagcagcatgttattgaaacactaaaaagcaaaaaacaacaaataatgcttgctacacagttagtgaaaatgatacttaaaattgatgatgtcagaacacctaatgatattcagttctaa

SEQ ID NO: 1503 - DNA, 342 bp, Euschistus heros
atggcttcagcaatggacgttgacgatgaagagaacgaggttccgacctccagtagtggaaaaggtgaaaaaaagaggttcgaagttaaaaaatggaatgctgttgcactgtgggcctgggacatagttgttgataactgtgctatttgtcgaaaccatataatggatttgtgtattgaatgccaagcaaatcaagcctctgctacaagcgaagaatgcacagtggcctggggagtttgtaatcatgcatttcattttcattgtatatcgagatggttgaagactaggcaagtttgtccactagacaaccgtgaatgggagtttcaaaagtatggacattga

SEQ ID NO: 1504 - DNA, 1605 bp, Euschistus heros
atggtgtctttaaatccgattagaattcttaaacatgaagccgaagaagaaaagggtgaaatggctagattgtcaaatttcattggtgcgattgcggttggtgatttagtgaaaagtactcttggtccgaaaggtatggataaaattctggtatcttacggccgaaatcgtggaaacattgaagttaccaacgatggagctactatcctgaaatcggtgggttttgacaaccccgcagctaaaatcctggttaatatgtctaaagtacaagatgatgaagtcggtgacggtacaacctcagtaacagttctggctgctgaacttctgcgagaagctgaaagattgatcgaaaggaaaatccatccccagaccatcataggtggatatcgccgtgcaactaatgttgctctagccgcattagataaatgtgctgttgacaacagtagcaatgatgccgagttcgccgaagatttgctcaaaatagctcgtacatcattaagttccaaaattttgaatttacatactgaaaaattcagcaagttggctgttgatgcagttcttcgccttaaaggatcaggaaatttaagcgcgatacagatcattaaaaaaacaggtggctcattggatgattcatttctagatgatggcttccttctggacaaaaaagttggccagtttcaacctaaaagagttgaaaatgctaaaattcttattgcaaatactcctcttgatactgataaaattaaagtttttggttcaagaatacgcgttgactctttagccaaggtggccgatttggagttggctgaaaaagaaaagatgaaagaaaaaattgataggattataagtcataaatgtaatgttttcgtcaaccgtcagctgatctataattatcctgaacaattgtttgctgatgctggaataatggctattgagcatgcagattttgatggtattgaacgtttagcccttgttacaggaggtgaaatagtttctacgtttgatacaccagaactagttaaattaggagaatgtgacttaatcgaagaaatcatgatcggtgaagacaaattattgaggtttagcggggtgaagttgggagaggcttgcagtattgtcattaggggagcaacacagcaaattgtcgatgaagcggaacgatctttacatgatgcattatgtgtgctcgttactactgttagggataagaaaacagtttttggtggtggctgttcggaaataattatggctagtgctgtaagtgatgatgctattaatgtaactggcaaggaagcagttgctatggaatcctttgcaaaggcattgttggagttgcctaccacaatttcagacaacggtggctttgattctgcatatttagttacagcattaagagcagcacacaataaaggtcagataacttatggtttggatatgaaaaatggtggagtagcttgtatgagagaacttggaattgtcgaatcccattctgtaaaacgccaaatgcttctgtccgcttctgaagccacagaagtcatcttgagagtagatgatattcttaaagctgcacctcgcaaacgaacagaagatagaggctactgctaa

SEQ ID NO: 1505 - DNA, 834 bp, Euschistus heros
atgttccgaaatcaatatgattctgatgttacggtatggagccctcaaggccgattacatcaggttgaatatgctatggaagccgtgaaactcggagcagcaacagttggtgtaaagaataaacaatttgcagtccttgttgctcttaaaagagcatcttctgaactttcagctcaccaaaaaaaaattattcctcttgataatcatataggcatgagcatttctggtttaactgctgatgctcgtatattgagtcggcaaatgagaagtgaatgcctttcttattcatattcttatggaactgaaatacccattatcaggcttatgaataaaatatctaacatgatgcagagttcaactcagcgctatgacagaagaccatatggtgttggtctactggttgctggatatgatggagatggtcctcatatttttcaaatttgcccttctgctaatttatatgaatgccgctcaatggccatcggtgctagatcccaaagcgcaaggacatatttggaaaagcatctggtagacatctcaaactctccgactctgacagaccttctcaagcacgcacttcgtgctcttagagattcttcacccaatgatacagaacttagctccaagaacgtagccatagcggtagttgggaaagataccccgctcaaggaattatctgaagccgatacccaaacttatctggacatgatcctcagcgaggagagaagaagcggcgatacaggtggagctagtgatgacgctcctcctcctcccccaccttccgatccaccagctcaagatcctactccagttgttgctatggaaacacaataa

SEQ ID NO: 1506 - DNA, 2538 bp, Euschistus heros
atgccaatttaccagcacaaaatagtgattaatgaagaagatttgccttatgaagaggaaattttacgaaatcctttctctataaagcattggttaagatatatagaattcaagaaggatgcccccaaaaatggggtgaatattatatatgaaagagcattaaaagagcttcctggaagttataaactatggtacaattatttaattcttagaaaaaggcagattaaaggacggtgcattactgatccttcttttgaacatttaaataatacatatgaacgttctttggtatttatgaataagatgcctcgaatatggatggaatattgtcagtttcttgtcgatcaatgtaaaattactaaagcacgacatgtttttgatagatccttaagagcactgcctatcacccaacatcaccgcatttggcctttatatataaaattcttaaagaagcacaatattccagaaactgcggttcgtgtgtttcgaagatatctgaagctttgtcctgaagatacagaagaatacattgattacttaactgccatcagtcgtctagatgaggctgctgttagattggcagatattgtaaatactgatgattttgtttcaaaacatggaaaatcaaatcatcaattatggactgaattatgtgatttaatatctaaaaatcctcaagaagttaggtctctgaatgtagatgcgataataagaagtggtttgaaaaaatatactgaccagttaggccacttatggaattccttagctgattattatatcagaagtggactttttgaaaaggcaagggacatttatgaagaagcgatacaaactgttactactgtcagagattttactcaggtttttgatgcgtacgcccagtttgaagaactttctttgagcaagaaaatggaagaagtatctcagaaggcttttcctactgatgatgatgatatagacattgaacttcgcttagcaaggtttgaagatttgattgagagaagattattacttctaaattcagttctgttacggcaaaatcctcataatgtccatgaatggctgaaaagggtccaactgtttgaaggaaaaccacatgatattatttatacttatactgaagctgtccaaacagttgatccaaaactagctgttggtaagccacacatgctgtatgttaatttcgctaaattctatgaagagaatggccaagtagaagattctagaatagttcttgaaaaaggaacacaggtaccatacactaaagttgaagatctcgcatccgtttggtgtgagtgggctgaaatggaaattagaaatgagaactgtgatgaagcattaaaaattcttcaaagagcaacagtgatgccagctaggaaagttgattatcatgatgattctgaaactgtgcaaatgagattatataaatcgttgaagatatggtcattgtatgctgatttagaagaaagttttggaacatttaaatcttgtaaatcagtttatgacagaataattgatctgaaaattgctacacctcaaattattatcaactatggccttttcttagaagaacacaattattttgaagaagcttttaggacttatgaaaaggggattgctttgttcaaatggccaaatgtatttgatgtgtggaatacatatttaactaaatttttgaagcgttatgggggaagtaagcttgaaagaacaagagatctatttgaacaatgtttagaaaattgccctccaaaatatgcaaaaggtttctacctgttatatgcaaaattagaagaagaacatggattagcaaggcatgcaatggcagtttatgaaagagctacttctgctgttttgccagaagaaatgtttgaggttttcaacatttatattaaaaaagctgctgaaatttatggggttcccaaaactcgtcagatttatgaaaaggctatcgaagtgttgggtgaagataattcaagagaaatgtgtcttagatttgctgagatggaaactaaattaggagaaattgatcgagccagggcaatttatgcacattgtagccaaatgtgtgatcctagagtcactagtacattttggcaaacatggaaagattttgaagtgcgtcatggtaatgaagatacaatgagagaaatgctacgaatcaaaagaagtgttcaagctacttataacacacaggtcaatatgatgtcagcacagatgttatctgctgcaagtaacgtttctgggacagttgctgaccttgcgcctggtgctaaggatggaatgcgaatgttagaagcaaaagcagctgaaatgactgtaactacaaaatctggttcatcagccatcatgtttgttaggggtgaaacccaaaacacccctcaagaagtacagaaagaaataattaaccctgaggctttgaatgttgactcagatgatgatgatgatgaaaacttggaagatgatgatctgcctatagaaaaacagattattccagatgaagtattttgtggtctaaagaaaggaagtgattctgactga

SEQ ID NO: 1507 - DNA, 990 bp, Euschistus heros
atggccgctggacctattgccgaaaggaatcaagatgccacgatatatgttggtggactggatgacaaagttactgaaactcttatgtgggagttattcgttcaagccggtccagtcgtcaatgttcatatgccaaaagacagagtaacacaacagcatcaaggatatggttttgttgagtttttgggtgaagaagatgctgattatgctataaaaattatgaacatgataaaagttcatgggaaacctattcgtgtgaataaggcttcagctcatcagaaaaacttggatgttggagctaatgtgttcattggtaatctggatcctgaggttgatgaaaaattattgtatgacacattttcagcctttggagtaattctgcagacaccaaagattatgagagatcctgatacagggaattcgaaaggttttgcattcatcaattatgcttcctttgatgcatcagatgctgctattgatgctatgaatggtcagtttctctgcaatcgccctgtttctgtttcctatgcttacaaaaaagatgctaaaggtgaacgacatggatcggcagctgaacgtctcctagccgcacaaaatccattatcacaagccgataggccccatcatatgttcgccgatgctccccctgcacctctcccacctcctccagtcctgcctccacctcctgtcttcaatcctccaccgcctccccatatgccgcctcctccattgccaccccaaaggatggttgctcctatgcctccacctccacctgggcctcctccaccaatgcctcctggaatgatgccgtggccaccgatgcagccccactttccccctcctcccccacctccacctacaaacaaagctcctcctcttcctcctccaccccctcctcaagcttggcgtcctccaccacctccatacaatcgaccaccgtttcctccaccacctccacctccagtcagacctccgccaccaatgttctaa

SEQ ID NO: 1508 - DNA, 777 bp, Euschistus heros
atgggtcgagttattagagctcagaggaagggagctgggagcgtctttagatcccacacaaaacaccgtaaaggtgcccctaaactgaggtcattagattttgctgaaaggcatggttacatcaaaggtgttgtgaaagacattatccatgaccctggtagaggagctcctttagcagttgtgcatttcagagatccttacaggtttaagactcgtaaagaacttttcattgctcctgaaggaatatacactggtcagttcttgtactgcggaaagaaagctaacttacacgttggcaatgttatgcccgttggtggtatgcctgaaggtaccatcatctgtaacttagaagaaaaaaccggagacaggggtcgtttagctagagcctcaggaaattatgctattgttatcgcccataatcctgattcaagaaggacaagggttaagcttccatcaggcgcaaagaaagttatcccctccaataacagggccatggttggtatcgttgctggaggtggtcgtatcgacaagccagtccttaaagctggtcgtgcgtactataaatataaggcaaagagaaactgctggcctaaggttaggggtgttgctatgaacccagtcgagcatccccacggtggtggtaatcaccagcatattggtaaagcttccactgtcaagagaggaacttcagccggtagaaaggttggtcttattgctgccagacgtactggtaggattcgtggtggtaagactgaccagaagaagggagaagattaa

SEQ ID NO: 1509 - DNA, 411 bp, Euschistus heros
atggcccgtactaagcagaccgctaggaaatcgacaggaggcaaagctccgaggaagcagctggccaccaaagctgccaggaagagcgctccggcgactggaggagtcaagaaacctcacagatacaggcccggtaccgtcgctctcagagaaattagaaggtaccagaagagtaccgagttgctcattaggaaactcccgttccagaggttggtgagggagatcgcccaggacttcaagacagacctgaggttccagagctcggccgtcatggccctccaggaggctagcgaagcctacctcgtaggtctcttcgaggataccaacttgtgcgcaattcacgccaagagggtcaccatcatgccaaaggatatccagttggctcgccgtatccgcggagaacgagcttaa

SEQ ID NO: 1510 - DNA, 1596 bp, Euschistus heros
atggcggcaattactttattgaatcctaaagcagaagttgttagaaaaacagaggcattgtctatgaaccaaagtgcagctaaaggtttgcaagatgtcatgaagactaatctcggtccacgaggcaccatgaaaatgttagtttctggtgctggtgacattaaaataactaaagacggcaatgtcttgttgaaggaaatgcaaattcaacaccctaccgcttcgctcatagctagaacttctacagctatggatgacataaccggcgatggcactacttcaacagtcttgcttattgcagaattattgaagaaggccgacagttatattattgaaggtgttcatcctaggttaataactgaaggtttcactgtagcttgtaaacatgccatggaagttttggataaaatgaagaaaacagtaagtcttgatgataaggagactcttctttctgttgcaagaacggcgcttaatacaaaagttgaatctaaagtggcagaggtattaactcagatttgtgttgaggctgtgcaagcaattaaattgcctgaaaaacctcttgatttgcatatggtagaaattatgacaatgcaaagccggcttgaatctgaaactaggctggttagagggctcgtcttagatcatggctcacgtcaccctaatatgcccaagaaactcactaatgcttttattctgacatgtaatgttagtcttgaatttgaaaaaactgaaataaatagcggatttttctacaaatctgcagaggaaagggaaaagcttgtggcatctgaaagagagtttattgagttaagagtcaagaaaattatagctttgaagaaatctgtatgtgatggaactgacaaaggatttgttgtcattaatcaaaaagggattgaccctgtctctttagatttactggccagagaaggtataatggctcttaggcgagctaaaagaaggaatatggagagactaactttagcttgtggtggtgtagcaatgaatagtctcgatgatctcacagaagaatgtctaggtcgagcaggtctcgtatatgaacatgtacttggtgaaactaagtatacatttgttactgattgtccaaatccacatagcgttactgtacttgttcatggccctacttcatatgccattactcaaatccaagatgcgcttcgagatggtttgagagctgttaaaaatgcagttgaagatggtggtgtccttcctggtggaggagcagttgaattaaaaatacgtcatgaattgaagaaagttgctgagaccactaaagaaaagtaccgtgttggaattgaggccttctgtgatgctctcctgattattcccaaaactctcgcaatgaacagtggatttaatacccaagaagttattacacaacttgattatgatgcaaaagagaacgattcaattggattggaccttcaaagtggaaagtcaatgatccctactgatctaggaatcctagataactattcggtcaaaaaacagtatatagcttcaagtatcattgttgctagcaatcttctccttgtggatgaagttatgagagcaggaatgtcatctttaaaaggataa

SEQ ID NO: 1511 - DNA, 3144 bp, Euschistus heros
atgtctagtgctgaagtggccaacaattccatagaacctccagccaagaagcggaaaattgctacaggagagacagctccagcgaactccgtttcaaaggcaatatcagccatggcgaataatggatcttttgattccaatcaagaaattgatgagggactttactctcgccaattgtatgttttaggacatgatgctatgcgacggatggcatcgtctgatgttcttatttcaggtttaggaggacttggtgtagaagtagctaaaaatgtcatattaggtggtgttaagtctgttacattacatgatgaaactttatgcactatttcagatctgtcttctcaattttatttatccgaaaattctattggtttaaatcgtgcagaagcttcttgccagttactttctgaacttaaccattatgttccaacaagagcttacactggccctctgacagatgagtttattaaagaatttagtgttgtagttttaactaatgcttcagaagatgaaaaattaaggatttctgaaatagctcatgcatctgacgtttcgttgattatagcatcaactgtgggtgtatttgctcaagtattctgtgattttggccgagaattcactgtagttgacactaatggtgaaaatcctgtttctgctatgatagcaagcatttctcgagatgaagaaggtgtaattgcttgtttagatgatactaggcatggtcttgaagatggtgattatgtcacattttctgaaattcagggaatgactgagttgaatggttgtgagccaaccaaaatcaaagtgcttggaccttatacatttagtattggtaatacttctaagtttggagaatatatccgaggtggaatagttcaacaagtaaaaatgcccaaagttttgcaattcaagtcatattcagaagctctcaaggctcctgactttatagcaacagattttggaaaatttgaccacccagatcaacttcatgtggcatttaaagctctagatgcttacaagaaagaatttggcaagttaccttcaccatggaacagcaaggatgcttctgattttctgaactgttgtaagactgtaatgcctgatgtaagagaaaatctagaattaaatgaaaaacttatggagcaattttccaaaacttgttctggaaatatgaatcctattgatgcattcattggtggtgttgttgcccaagaagtgatgaaagcttgtagtggaaagtttcatccaattttccagtggctatattttgattgcattgaattattgccaaaagaagatttaagtcctaatgattgtgcacccaccaattctcgatatgatggacaagttgctatttttggaaaagagtttcagaaaactttaggcgctctcaaatattttgttgtaggtgctggagccattgggtgtgaacttctcaagaatttttcaatgatgggagtaggagcagatggtggtaaagtaattgtaacagatatggatcttattgaaaaatctaaccttaacaggcaatttttatttagacctcatgatgtacagaaacctaagtcagctactgctgctaaagcaataaagaaaatgaacccattaatgaatgtgattgctcatgaaaatagagttggccctgaaactgaaaaagtttatgatgatgcgttttttgaagatttagatggtgttgctaatgcattagataacgttgatgcgaggatatatatggatcgacgttgtgtttattataggaaaccattgctagaatcaggaacactgggtactaaaggtaatacacaagttgtcgttcctttccttactgaatcctacagctcttctcaagatccacctgagaaaagcattcctatatgtactttaaagaattttcctaatgcgattgagcatactcttcagtgggctagagatgtttttgaaggtctgtttcgccaatctgctgaaaatgctgctctttacttaagtgattctaattttattgatcgagcattgcgtttgcctggagttcagcctatggaagtgttagaatctatcaaacaggcacttattgatgacagacccaaatcaatagatgattgcgttgcttgggctagaaatcactggcaagagcaatattccaatcaaattcgccaacttcttttcaatttcccacctgatcagatgactacaaatggccaaccattctggtcaggtcccaagaggtgtccagtacctttagtttttgatgtgaataatgacttacacttggattatattatagctgctgctaatcttaaggctgaagtctacggaatacctcaggtccgcgatagaagtgttatcgctaaaattgtacagaatgtagaagttccagaattcactcctaaatcaggagttaaaattgcagtcactgattcacagatggccaatggagctggcgggcaaatagatcaagataaaattgttcagttatacaatgaacttccttccaaagaaatgttcagtgactttaatatcacacctctggaatttgagaaagatgatgataataattttcatatggatttcattgttgctgcatcaaatctgagagctgcgaattataacatacctccagctgatagacataaaagtaaattgatagctggtaagattatcccagcaatcgcaactacaacctcagttgttgcaggcttggtatgtatcgaacttatgaagctagctaagggctataatgatatagaaatgtttaagaatggctttgctaatttggcactcccgttctttgggttctccgagccaataacagctcctaaattgaagtattatgagaatgaatggacattgtgggatcgatttgaagtcacaggagagatgactctcaaagagtttattgattacttcaaagataaacatcaactggaaataaccatgttgtctcaaggtgtttgtatgctgtattcattctttatggctaagagtaaattagaagataggctcaatcttcctatgtctgaagtggttcgtcgagtttccaaaagaaaattggaaccccacgttaaagctctggtgtttgaactttgctgtaatgacaccgatggcaatgatgttgaagtaccttatgtaaggtatacattaccttga

SEQ ID NO: 1512 - DNA, 1278 bp, Euschistus heros
atggctgataatgatgatttgttggattacgaagatgaagagcagacagagcagcctattgtggaagggtcaggagatacagctccgcgtaaagatgtgaaaggagcttatgtatctatacatagttcaggttttagagattttctgttaaagcctgaaattttaagagccattgttgattgtggttttgagcatccttctgaagtccaacatgagtgcattcctcaagcagttcttggcatggatattctatgtcaagccaagtctgggatgggtaaaactgctgtatttgtattagcgacccttcagcagatggagttaactgaaaatcaagtaacagttttggttatgtgccatactagggaattagctttccaaataagcaaagaatatgaacgattttcaaaatatatgccaaatatcaaggttgctgtattttttggtggtttacctattcagaaggatgaagaagttttaaaaaataactgtcctcatatcgtagttggtactcctggacgaattttagctttagtgaagaataaaaaactgaatttgaaaaaccttaaacactttgtgttagatgagtgtgacaagatgcttgagcagttagacatgaggcgtgatgttcaagaaatttttaggaataccccacatagcaagcaagtcatgatgttcagtgccactctaagtaaagatattaggccagtttgtaagaaattcatgcaagatccaatggaagtttatgtagatgacgaagccaagctgaccctgcatggccttcagcaacactatgttaagcttaaagaaaatgaaaaaaataagaaactgtttgatctgcttgacatcttagaatttaatcaggtggtgatatttgtaaaatcagttcagagatgtatggctttggctcaactgttatgtgaccaaaatttcccagctgtagctattcatagagctatgagtcaagaagagagacttgccaagtaccaagagttcaaagattttcagaagagaattcttgttgctaccaacctgtttggaagaggaatggatattgaaagggttaacattgtatttaactatgatatgccagaagattcagatacctacctccatcgagtagcaagagcaggacgttttggaactaagggtctggcaattacttttgctagtgacgaggcagatgctaaagttctgaataatgttcaggataggtttgatgttaatattactgagttacctgatgagattgacctttcatcttatattgatggacgataa

SEQ ID NO: 1513 - DNA, 1464 bp, Euschistus heros
atgcctgttgaagctatgcaaactgatgtggagatgaaggtggttgattctccttcctccgaagatccagtggcttcagcagtccaagaaataagagaacacatacgacagttagaaaaggcagttgctaataaggaaccccgtttcatattaagagttttgcgtctgctaccttccacacgtcataaactttcagctttagtactccgcaatgttatctcttctttttatttaaatagtcctgaaaaagatgctttgtttctttatattgaagatgctatggattcagataccacacaaaaaacaaaattgatcaaaaattctaatactcctctcataccagagattgatgcttacattcatttgttggtacttgtgagactgattgatgctgggaaggaatcagaggctgtgaagtgttctgatgctcttatggctaaaataactgctcaaaatcgcaggagtttagatttagtggctgctaaatgttatttttaccactctcgagtttatgaactcactaaccagttggaaaaaatacgagggtttctgcatgctaggctgagaactgctactctcagaaatgattttgaaggtcaggcggttctaattaactgtttattgagaaattacttgcattataaactgtatgaccaagctgacaagttagtatccaaatcagtatatccagaatcggcaagtaacaatgaatgggctagattcctttattatttaggaagaattaaagcagcacgtttagaatattcagaatcacacaaacatctagttcaagctttaagaaaagctcctcaacatgctgctgttggatttaggcagacagttcaaaagcttgctgtcactgttgacttgcttctaggtgacattccagacaggcagatctttagacaagcacctcttcgtcgttctcttgcaccatatcttcagttaacacaagctgttagaactggtgatttacaaagatttggtgaagtgttagaaatgtttgggcctcagtttcgttctgaccatacatttacattaattcttcgtttaagacataatgttataaaaacagcaataagatgtattggtttatcttattcacgcattactcctaccagcatagcttctaagcttgggttagattcaccggaggatgcagagttcattgttgctaaagcaattagggatggtgttattgaagcaaccttagatcctgagcatggttatatgcaaagtaatgaagtcacagatatttacagaactagagaaccacaattagcatatcatcagcgtatatcattttgtcttgatttacataaccagagtgtgaaagcaatgagataccctcctaaatcttatggaaaagatttagaatcagctgaagagcgtcgagagcgggaacaacaggacttagagttagctaaagaaatggcggaagaagatgatgatgtgtttccttga

SEQ ID NO: 1514 - DNA, 1761 bp, Euschistus heros
atggctttaagtacaccctcagtacctgtttctgaaattttgaagagcagtgctgattcagatgagcccaagaagaaatctagggaggactggcgtaaagccaaggaattggaagaagctagaaaggctggtactgctcctgctgctgttgatgaagaaggtaaagatatcaaccctcacattccacagtacatttcttcagcaccttggtactacagtgctagaggtcctacattaaaacatcagagaatacaagatgaaagtgttaaaaaatactctggtattgatgaatggtacaaacgaggagttgacaattcaaaagtggttacgaaatatagaaaaggggcatgtgagaattgtggagccctcacccatcaaaaaaaggactgtatggaaaggccacgaaagattggtgccaaatttactggtgctaaaattgcacccgatgaatttgttcaacctgaactctcacgagattatgatggcaaaagagatcgatgggcaggatatgatccatcacaacataaaatggttattgagagatatgccaggatcgatgaagctaaaaggcagttgagggcagataagcttaattctgaacagtctgaagaagccgaagaagaagaggcaaaagacaatatcgctgatgaaggaggtgaagatgaggataaatatgtggacgaagtcgatatgcctggtacaaaagtagattcgaaacagagaattactgtgagaaatctcagaatcagagaagacacagccaaatatttgagaaaccttgatcccaattctgcatactatgatcctaaaaccaggagtatgagggacaacccttacgctggatctgccgatactgatgtggactatgctggagaaaactttgtgcgtttcactggtgatacattggagcatgcgagagtgcagttgtttgcatgggaagcacacaacaaaggagttgatgttcatcctcttggggaacccactaggttggaagtacttaagaaagaattcgttggaaagaaggaagagttcaagcaaagggggcaagaagatctcattaaaaagtatggtggagaggaacacctgaatgccccacccaaagaacttttattggctcagactgaatattacgctgaatacactcgttatggaactgtcattaagggccaagagaaagaagtggtgaggtctagatacgaggaagacgtgcttataaacaaccatactaccgtatggggatcattctggcattctggaaaatggggttttaaatgctgccattcttttattaaggggtcatattgcactggggaagctggacgattagcttcttcagctggtgaggttgctgtcaaaggtccagcattcattcctccgcggcctgcaacaccatctgcatcatcctcttcatcttcttctgcttcttcttcatcgtcatcgtcttcatcagaggatgaagaagagaaggagaggaagaagaagaagcaggaaaagaagaaagcaaagaagaagaagcaaaaagtaaagaaactcatgaacaagaacaagaaacctgaagaaaaaactgaagaagaacaactgaaagatgccttgaaaaaagaggaagaggcccagaaagagggcgagaggcttatgaaattggatgatcgtaagagaccgtacaacagtatgtttgaagtgcagaaacctaccgatgtcgaaatggaagcatattatatgaagaagaagagggacgaggatccaatggccaacttcttataa

SEQ ID NO: 1515 - DNA, 627 bp, Euschistus heros
atgggtatttcaagagatcattatcataaaagaaggaagactggaggtaagagaaaacccatcagaaagaagaggaagtatgaattaggacgaccagcagccaacactaagttgggtcccaaaagggttcatttggtaagaaccagaggtggaaatactaagtttagggccttgaggttggactatggaaatttttcatggggttctgaatgctgtaccagaaaaactcgtctgattgatgtcgtctataacgcttcaaacaatgaacttgtacgtaccaaaaccctcgtgaagaatgccatagtagtgattgacggtaccccgttcagacagtggtatgaagcccactatgcgctcccattgggaagaaagaagaatgccaaattgtctgaagcggaggaagccgtactttataagaagaggtctaggaaaacagaaaataggtacaaggcaaggcagaaactcgccaaggttgagcctgctttggaagaacagttccagactggtcgtattcttgcatgtttagccagccgacctgggcaatgtggacgagctgatggttatatcctcgaggggaaagagcttgagttctatttgaggaaaataaaagccaagaaaggaaagtag

SEQ ID NO: 1516 - DNA, 936 bp, Euschistus heros
atggatcgtcttttacgtttagggggtggaatgcctggattaagtcaagcacaacctccatcagatgccccagttgtagacacagcagaacaagtctacatttcttctctggccctgcttaagatgttaaaacatggaagagctggggttcccatggaagttatgggacttatgttaggagaatttgttgatgattacactgtaagagttattgatgtgttcgctatgccacagacaggaacaggtgttagtgttgaagctgtggatcctgttttccaagctaaaatgttagacatgttaaaacaaactggccgaccagaaatggtggttggatggtaccattcccatccaggatttggttgttggttatctggtgttgatatcaacactcagcaaagctttgaagctctttcagaaagagccgtagcagttgtagttgatccaatccaaagtgtcaaaggtaaagttgttatagatgctttcagattaattaatcccaacatgatggttcttggtcaagaaccacgacaaactacttctaatttagggcatcttcagaagccttctgttcaggcgttgatacacggattaaatcgccattactattctatcagcattaactacaggaaaaacgaattggagcaaaaaatgttgttgaacttacataagaagtcatggatggatggtctgatgctctccgattattctgaaaattgtaaagtaaatgaaactacagttggtgatatgcttgaattagctaagaattacaacaaggcattggaagaagaagaaaaaatgacgcctgaacaacttgctattaagaatgttggaaaacaagaccctaagaggcatttggaggagaaagtcgatgtactaatgtcagccaatatagtgcagtgtcttggtgctatgctagatactgttgtgttcaaatga

SEQ ID NO: 1517 - DNA, 1290 bp, Euschistus heros
atggattcgtttttaaaaacagttggttgttacatccatcgtcctcatcatgacaaagaagttcttgttcatggaaaagcaaatattctggagcaaatggatgtggatgagaaaaagggggagggttttcgttcttattacatcactaaaattgaagagcttcagttgatagttgcagagaaaagtcaaaaccttaggaggctccaagcacaaaggaatgaacttaatgccaaagtaaggatgttaagagaagaattgcaactacttcaagaacaaggctcttatgttggtgaagttgtgaaacccatggacaaaaagaaagtgttagttaaagtgcacccagaaggaaagtttgttgttgatatcgataaaaatattgatattaatgatgtgactcctaattcaagggtggcccttcgaaatgagagctatactctgcacaaaattctacccaacaaggtcgatcctttggtatcattgatgatggttgagaaagttcctgactcgacgtacgaaatggttggaggtcttgataagcagattaaggaaattaaagaagtaattgaacttcccgtaaaacatcccgagctatttgatgcgttagggatagctcaacccaagggagtattgctatatggacctcctggaacaggtaaaacacttctagcgagggcagttgcccatcacactgaatgcacattcattcgtgtgtcaggttctgagctggtacagaaatttattggtgaagggtcaaggatggttagagaactcttcgtcatggccagggaacatgctccatccatcatatttatggatgaaattgattcaataggttcctcaagaattgagtcaggcagtggtggagattctgaagtccaaagaacaatgctggagttattgaaccaattggatggttttgaagccaccaaaaatattaaggtcattatggcaactaacaggattgatattctggacccagctcttctacgccctggaaggatagatcgtaagatcgagtttcccccaccaaatgaggaagctcgtttagatatccttagaattcattctcgtaaaatgaatcttaccagaggcatcaacttacgaaaaatcgctgagctcatgcctggagcttcgggtgctgaagttaagggtgtctgcactgaagcaggaatgtatgctctgcgagagaggaggatccacgtcacccaagaagatttcgaaatggctgtcgccaaggtaatgcagaaagattcagagaagaatatgtctatcaagaaattatggaaataa

SEQ ID NO: 1518 - DNA, 603 bp, Euschistus heros
atggttaagttgtatgcccttcatattttatacaaaaatttaaatagtgcagtatggttgaaaacagcttatgatgttcaaagttttgggtattttcaaagaggaactgcccaggacactatggcttttgccagtaaaacgatagttgaaaggactcaatctgcaaccaggcaatctgtcaaagaaggagattatatatgtcatgtgtatgtgagagctgacaatttagctggggttgtaatatctaatcatgaataccctcatcgagtggctcatactcttataactaaagtgttagatgaatttagtgcaaagtatccaccttcaacttgggcgtctgctaatgaagccaacattgattttccggcattggcagctcaccttcagaagtttcaaaatcctaaggaagctgatgctttaatgaagattcaaagtgagctggatgaaactaaaatcattcttcacaacaccattggagctgttttagaacgtggcgagaaattagatgatctcattatgaaatctgaaagtctcagttatcagtctaaagcattctacaaaactgctaggaaaacaaattcgtgctgttcctatgttggttaa

SEQ ID NO: 1519 - DNA, 750 bp, Euschistus heros
atgtttctcacacgttcagagtacgacagaggggtgaatactttctctcccgagggaagattgtttcaagtggagtatgctatagaagctattaagttaggttccacggctataggtgtttgtaccccggaaggagttgtcatgggagctgaaaaaagaatcaagtcacctttaatggaaccagaagcagtggaaaagatccttcaagttgatgatcatattggttgtgctgtaagtggtttgatggctgattccagaaccttagttgagcatgctagagtccaatgcctaaatcattggtttgtatatgatgaaaagatgccaatagagtctgctgctcaggctgtctccaatttagctatcagatttggcgatgctgatgaagatgctggtcctgctatgagcaggccttttggagttgctgtcatgtttggaggatatgactacagaggacctcagctgtatcatatggatccatcaggcacatttatttattttgacgctaaagctatcggctctggaagtgagggagcacaacaaagactccaagaattgtatcataaaggaatgagccttaaggaggctatccagatgattctgaccatcctaaaagaggtaatggaagaaaagttaactgataacaatgtagaaatagcagtagtaactgcagaagagaaacagtttcgcatgtataccaaggaagaggtttctaaagtaataggagaaacacaatcggccccaacttcataa

SEQ ID NO: 1520 - DNA, 1167 bp, Euschistus heros
atgagtgaatattggcttatatcagcacctggcgataaaacatgccaacagacatgggaaacaatgaataatttaaccagtaaacagcacaatttgtctgaaaatttcaaattccatattccggatttaaaggtagggactttggaccagcttgttggactttcagatgatttagggaaacttgacaatttcgtcgatcaggttactcacaaagtggcccaatatcttggagaagtattagaagatcaaaaagataaattacaggaaaatttgatggctaataacactgatttatctacttacattacaaagtttcagtgggatatggctaaatatcctataaagcagtcacttcgtaacattgctgatatcataagcaaacaagttaaccaaatagatgcagatctaaagacgaaatctactgcttataataatttgaaaagcagccttcaaaatatggaaaagaaacaaagtgcaagtttgttgacccgaaacttagcagatctggttaaaaaggaacattttattttagactctgaatatttgactacattactagttgttgttcccaagtcaaactttaatgattggaattccagttatgaaaaactgactaatatgattgttcctcgttctagtcaacttgtttatcaagattctgattttggtttgttcactgtatcattgttcaagaaggttgtaaatgattttaaactaatggcaagagaaaagaaatttgttgtacgtgattttatttacaatgaagaagagttagctgctggaaaaaatgaaattacaaaattggtgactgataagaagaagcagtttggacctcttgtacgttggttgaaggttaattttagtgagtgcttttgtgcttggattcatgtaaaagcattgagggtttttgttgaatctgtcttgagatatggtttaccagtaaatttccaggctatgttgattcatcctcataaaaagtctgttaaacgtttgagagatttactgaatcaactatatgcgcctttggatagtagtgcccagcagcaaggagggcaaggtggtggtaacgatagtgtggacattcctggtttaggatttggccagtcagattattatccttatgtgtattataaaataaatattgatatgttagatacaaaagcttaa

SEQ ID NO: 1521 - DNA, 1650 bp, Euschistus heros
atgtcaactttaggtgttccattatctgttgggggtacaagaacctcgggagctcctgtcagaactcaaaatgttatggcagcatgctccatcgcaaacattgtcaaaagttccttggggcctcttgggttggacaagatgttggtggacgatattggggatgttactgttactaacgatggagcaactattctaagactgcttgaagtagatcatcctgctgcaagggttcttgtcgatttagctcaacttcaagatgaggagattggtgatggaacaacttctgtggtaatcattgcagcagaacttctgaggaatgctgatgaattagtcaaacagaatatccacccaacttctattattagtggttatcgacttgcctgcaaggaggctcagaagtatatccaagaacacttatgtgtcagtgttgatgaattgggaaaagattctatcatcaatattgcaaagacatccttgtccagcaaagttattggaattgatgatgacttcttcgcatcgatggttgttgaagctgcacaggctgttaaagtcagcgatagcaaaggaaaagctacttatcccattaaagccatcaacatccttaaagcccatggtggatcagcaaaagaaagcatattggttaatggatatgccctcaactgcacagtcgcctcaatgggaatgattaaacgagtagaaaatgctaaaattgcttgccttgacttctctttacaaaaaaccaaaatgaaattaggtgttgaagtcctggtagaagacccgaatcagttagaagctattagagatagggaagccgatataacaaaagataggatacagaaaattctcagtgtcggcaccaatgtagttcttttgagcggaggcatcgatgacatttacatgaaatacttcgtggaagccaatgcaatggttgtaaggagggtgaaaaaagcagacttgaaacgaatcgctaaagcaactggtgcctcctttgcaacatccctaactaatatggaaggcgaagaagcatttgatgctagtttgttaggtgaggctgctgaagtatcacaagaaagaatatgtgatgatgagcttattcttgtcaaaagtccaaaagcacattcagctgcttccataatcctccgtggaccaaatgactatttctgtgacgaaatggaacgttcaattcatgattcactgtgtgcagtcaaacgagttcttgaaagtaaaacagttgtggccggtggcggagctgtcgaagctgctttatcgatctacttagaaaactttgctacttccttaagttcacgggaacagttggcgattgctgagtatgctaaatcacttttagtaattccaaaaatccttgctgtcaatgcagctctcgattcgactgatttagttgctaagctgagggcctaccacaacactagccagacaaagaaggatcacgcacatttgaaatggcatggacttgatttgtatggaggtgctgtgagggacaacaagaaggctggcgtccttgaaccaactatttcaaaaattaagtccttgaaattcgccaccgaggctgcaatcacgatactccgaatagatgatctcattcgcctggaagctgagaaaaaagatcagggccacggagatatgcactaa

SEQ ID NO: 1522 - DNA, 777 bp, Euschistus heros
atgttgaatatagctgatgcctcaatggcttttgagcacagttctctcagaagtaataataacacacttgatgatcatcaagtaaaaattattaaagctccggattttttaactagaactttatatcctatgacaactacagcttctgtggttggaatcaaatttagtaatggcgtagctattgctgcagatgttggtggatattacggatcattgaatcgttttaaatctcttgataggttgtacaaagttaataacaacattgtaatgacaacaactggtgattatgctgattttcagtacatgagagaattaatacaacaaaaagttattagtgaagagattctagatgacagtttctccttaaaagcttcttctcttcatacttggcttactcgcctgatgtacaataggaggtcaaaatttgatcccttatggaacaatgttattgttgctggatatgatagcaatggaccctttttgggaattgtggataaattaggtatgagttatgaagacagttgtgtagcgacaggtatgggtggatatctagctacacctcttttgagggatgtgcatgaacgaagtaaaggaaatttgactaaacaagaagcccatgcagctcttcagaagtgtatggaaattttatactatagagatactcagtcacttcccaagttccaaattgcaacagtcactgaagaaggtgttgaaatttcacctgaaatagaactagaaggaaattgggaaatcgtaaaacattcaaagggattttga

SEQ ID NO: 1523 - DNA, 1881 bp, Euschistus heros
atgcagtttattgaaactgcaagagaaatctcccatcttgaaggtgaaatgtatcagttatcccatctgttatctgagcaacgtgcacttctcggttcaatgagtaattcaggcgctgaacctgttcttcaagctggtggaagcaaagcccaagaagaaaaaagaattgcagctttatcgactgttttagaagtcatagaatcttgtccggatcttctcgacactcctggtagggaacttttgcatgaaggtgaccttgtggaactagatcctcttgaaaatacagctcttcatcgaacccgtgccttactcttttctgatatgtttatgatcgctacctggatgtccgaaaggaaaggacttgccaagtataagtttgaaagcaattatgatctgggtagcctagctgttgtaaatgtgagggatcttggtcaggttaaacatgcttttaaacttctagtttttcctgataccagactttttcaatgtgtgaataatgaagccagggaggaatggttgaaaaaatttgatgaagctaagaaagctagattgaatacagatcagaccaaaaaaaaagatgaaaatgaaaaagaatctcatcctgttcatgaacatttgactaaaccccctgatagaactgactcggtcgaatttggatctaacccattcgggtttgtactggatgatgatggagacagtgacgctctgcctgaatggttgactgaagcagctgatgatcttgatgtatccattgctcagaggcattttgaagaagcttatgcaatcatacaaaaagccgaggagtactttgcatctgcgcaagatgatcagtcactggccgatataaagtccaaagtggaaaacagaaaagatgtattgataagcgttcttctatcagagttgaatgtcagtgctgagaaatcattacaaggaggtcttcgagctagccgaagagctgttagactccttaaccaacttaacaagtcaacccaagcatgtgaactatatctgaaagtttgtacgaacctactaaaagcccaaagtaaacgagtgaagcgagaaggtgcaacagtggcatatgtcaagagattatctgaagtatatttttcaaatctagcatctataacttccgaatttcaatatcgtgcatttcctcataatcaagattgtacctcagcttttgttgtatgggtatcaatggaagtctcacattttctatcacatatcataaaacaagtatttattcctcagacacctctcggtacgctggctgagtgcatagacattattcggaaacagtctcaacagatgtgcgagcttggacttgatctcagctatcaagttaatggtcaaacgatgactgcagttacacgtgctgtagcagaagctggagagaaagctgtcgatgctgttaaggtgagagctgctgaggacccatggagaccatcgaggcagacacagcaatcagtcaataaaattcagtcagaaatagggctccctgttacggaatatctcgcagatgatggggtctttgagctgactgcaaacagcctttcttttgccaagttgttgtcctccttgacggatgaaggtctcatgatatcctgtcaggatttggagtttgcacttggaaaagctctgaaagaagtacttcaggcacacttgaatcatctttcagcctcctactctagcaataaatttaattctcagagaagtctgatacagcaaaacgcaaagtttattcttgaccagctattggaatcagtgcagaggaaatataatgaaaaaatgggccataggtgtaagaaattggatacattaaggaaagaatttaattttattttgaaggagagtaaaacaacaatcactggttacatttag

SEQ ID NO: 1524 - DNA, 1248 bp, Euschistus heros
ctcattattctaccagtttattctgctctacccagcgaaatgcagactagaatatttgaggcagctccacctggctcgagaaaggtggtaatcgcaactaatatagccgaaacatctcttactatccatggtatattctatgttgttgatccaggattcgttaaacagaaagtgtacaattcaaagacaggaatggattctcttgttgttactcctatttcacaggctcaagcaaagcaaagagcaggtagagccggtagaacaggaccagggaaatgttatcgactatacaccgagcgtgcctacagggatgaaatgttacctactcccgttcctgaaatccaaagaacaaacttagccactactgtgctacagctgaagacaatgggcattaatgatctccttcattttgattttatggacgctccgccagttgaaagtttaataatggctcttgaacaacttcacagtctcagcgctcttgacgatgaaggactccttacaagactaggaagaaggatggcggaatttcctttagaacccaatttatcaaaaatgttaattatgtctgtacatctccagtgctcggacgagatacttactgtggtctcgatgctttctgtccaaaacgtattttatagaccaaaagataaacaagcccttgccgatcagaagaaggcgaaattcaaccaagccgaaggagatcatctaacactccttgctgtttataattcatggaaaaataataaattcagtaatgcctggtgttatgaaaattttgttcagattaggacgctgaagagagcccaagatgttaggaaacagttgttaggaataatggacaggcacaaattagatgttgtatcagctggtaaaaatacagtgcgtgttcagaaagctgtgtgctctggtttcttcagaaatgctgcgaagaaagatcctcaagaaggttataggacactagttgacagtcaagttgtttatattcacccgagcagtgctctctttaaccgacaaccagaatgggtcatttaccatgaacttgttcaaacaacgaaagaatacatgagggaggttacgacaattgatccaaaatggctggtcgagttcgctccagctttcttcaagttttccgacccgaccaaacttagcaaatttaagaagaatcaaaggcttgaacccttgtataataaatacgaagagccaaatgcatggagaatttctagagtccgacgaagaagaaattaa

SEQ ID NO: 1525 - DNA, 1248 bp, Euschistus heros
atggcacctacaagaaaaactgaagggctacttgcccgtgtaaactttcctttatacacattgcaaatgctaactagtcgtcatgttcttgttggaggaggaggaggctcagccaaaacaggagttgctaatggatttgaaatttttgagttatcttatgatgggaaccgtttttctgctgaagaagttattcgtcatgaaactggtcccaaagttgtaatgaattctgcttgttacagtgacaaaaaaagtacatttttagttgctggacaagaaagccactgtcagttatacagagttggaattactgtggagaaggagttttccgaagagccaatgaatggtgttgtggaatctcctaacctcaggcatagaaaatcttccaaaaatcaccaaaatggtatcagtgaaacaacaaaaaactctttaaggaagaaattagctttcaaattcaactctggtgacagtatacaatctgactttagtgaaaaagaaccatgccaaagggtagttacaatatctcgttgtggtagttggatggcaactggtggcactgatggtattgtaagaatctggacgttccctggccttcgattaattagagctctaaaggcccataccaaagagctggatgatttacatttcagtcctgattcaaagcaggttgccagtgtggcgaaagatgggcaagccattatttgggaaataaaatcaggaaaacaggttcataaactcaattgggctcaccctacaggaattaaatatatttttaaaagatgtcgctttggaatgattgagggtaaaggaagtagactatttaccactgttaatcctgtggctggtggaaaggaagcccaaggttggatccacgcctgggatgaaggccgtatctcgaagtctacatctgtatctgaacccacttcagcacttgctgttagagacgatggagttttcttagctattggtacaatgttcacaggatcagtatccatatacatagcattttctcttcagagagttctgcatgttgatggtgctcattcaatgtttgttactggtgttgaactgttgccctgttcatcttcatggggtgctatagaagctgctgctttaagtatttctgttgataacagagtttgtattcatagcttaccattcagaaaaacgttaccaccctggctagtgatcatcattattatgttcactttaatgtttacttttatactttgcagttgcctcggcctttaa

SEQ ID NO: 1526 - DNA, 1254 bp, Euschistus heros
atggcgggtgcaatgttgtttgagaggtctgtctcttccagagatagagataatagtcgaattcttccaacttctggcagaagtgtcgacgacgacaatgatgaagaagagatcaagaataaggaacaaggaattttgcagttgggagagcaatataagaaagaaggtaaagctaaagagttagctgaacttatcaaggcaagtagaccgttccttagtcaaattagcaaagctaaagctgcaaaattggtgcgttctttggtagattatttcttggatcttgaagctggtataggaatagaagttcaactttgtaaagaatgtatagaatgggcgaaagatgaacacaggactttccttaggcagtcactggaagctaggctcattgctctatattttgacacaggaatgtttacagaagctctacagcttggctcaagtctccttaaagaattgaagaagttagatgataaaaatttgcttgtagaagtacttttgttggaatctaaaacttatcatgctttgagcaatctctcaaaagccagggctgctttgacatcggccaggacaactgcaaattcaatttattgtccacccaaaatgcaagcagcccttgatttgcaatctggtatacttcatgctgcagatgagcaagatttcaaaactgcctattcatacttttacgaagcttttgaaggttatgatagcgttgaaagcccaaaagctttggttgctcttaaatacatgcttttgagtaaaattatgttgaacacaccagaagatgtacaacaattagtcagcggtaaactcgcacttaaacatgcaggtaatgacatcgatgctatgaaatcggttgctcgagctagccataagagatcccttgctgattttcaacaaaccttaaaaaaatacaagaaagaacttgaagaagatcctattgttcgagcacatttgggaacactgtatgacaatatgttagaacagaacttgtgtcggataattgagccctattccagagttcaggttgattttatttccaaatcgattaaacttcctctgcctcaagtagaaaagaagctttctcaaatgattcttgataagaagttcaacggcattcttgaccaaggtgacggagttctaatagtgtttgaagatgcaattgttgaaaaaacctacgaaatggcgcttgaagtcattaacagtatgggtaaggttgtagacactttatatcaaaaagctaagaagctttcataa

SEQ ID NO: 1527 - DNA, 1800 bp, Euschistus heros
atgtccaccaaatcacctaaaaagactactccagctagtacatcatcagcaggcccctctagaagttcaccaagaaaaagtgaaactccaacacctcaaggggccagaaagagccctttaagccctacaagatacagcagacttcatgaaaagcaagaacttgctaatttgaatgatcgtctagcatgttacattgatagagttcgaaatttagaaactgaaaataaccggctaacccgcgaagttaaaagttctcaagaaaatatcaccagagaagttactagtgttaaatctttgtatgaaagtgagttatcagaagcaagaaaattgctagacgaattatcgcgggaaaaaacaaaactccaaattgatacacgaagattatatacagaaaatgaagaacttaaaactgagcttgaaaagaagactaaggactgcaacattctccagacttcactttcagtcagtgaaaacagactggctgatctcacaacaaaatataatcaactgcaaggtgaaaggaagaagcttgcagaagaaaacaaggcattggaaacagaaagaaataaacttgctgcccagttatcagatacgagaaaacttttagaggaagaaaccctccagagagtagatcttgaaaatgctgtacaaactttacgtgaagatttttcattcaaggaacagttacatgaacagcagttattggaaactcgtaccaaaaagcaagtggaaattagtgaacttgatggtagattaagccaagagtatgaagaaagattgtaccaaagtcttcaagaaatacgtgatcagtatgaatgtgatttagagaataacaaggaagaaataaaaaaattatatgaggaaaaaattcgcagtcttggaagtcaattgacacggaacagcaatgctgcagcaatggctattgaagaaatgaaaaatatgcaagctaaactgaatgagcttaataggaaattgcttgacttagaagcagatagaaatacagcccagcaaaaggctagagatttggaaaaaatcttagaacaagctaaagcccaatacatggaagaatatagtcagagggaagctgaaataacaactcttcgtgaagaaatggctcatcaagttcaagaatatcaagatttaatggatattaaagtagcattagatttagaaatagcagcttatcgaaagttgcttgaaggagaagaagctaggttaaatataacacctgtcagttctcctgcacagacttcttctcgcaaagtcttaggtagaaaaaggaaacgtactttcattgaggaatctgatgaaacagatgtttcaaattactctgttacttcttcatcgaagtgtgatgttgcaatctcagaagtgtgtagtgaaggacaattcattaaacttctgaataaatcaaataaggaggtatcacttggtggttggcaactagctcgtaaagctggagaagcttctaccaattacaagtttcaccgaaatattaaaatggaacctggtgctactgttacaatatggtcttcagatgtcccagacagatctcatgaacccccagaaaatctgcttatgaagggtcagcgctggatggttgctgatactatgacaacagttttgtcaaatcctgcaggggaagagatggctatatcagaacacaaaaaacaactgctgagtgacagaacatcatcaagacaaagagaaggtagtttttatcaaaagagaacatttttatcatcttccatgcgtcctcctagtgaaactcctggtgaagaaaggtgtgtgatttggtaa

SEQ ID NO: 1528 - DNA, 2409 bp, Euschistus heros
atggctgatattaaaagtaatgaagatttgtccactgctatcctaaaaaagaaagatcgaccaaatagattaattgttgaagatgctgtcaatgatgataattcggttgttgctctttctcaggctaagatggatgaacttcaattgtttcgtggagacactgtacagcttaaaggaaaacgaaggaaagaaactgtttgtatagtattatctgatgaaacctgccctgatgaaaagattaggatgaatcgagttgtaagaaataatctacgagttcggttatcagatattgtttcaattcaagcttgtcctgatgttaaatatggaaaaagaattcatgttttaccaatagatgacactgttgaagggttgactgggaatctgtttgaagtgtttcttaaaccatattttctggaagcatatcgtcccattcataaagatgatacatttgttgtcagaggtggtatgcgtgctgtagaatttaaagttgtagaaacagaccctgctccctattgtattgtagcaccagatacaatcattcattgcgagggtaatcatatcaaaagagaggaggaggaagaagctttaaatgctgttggatatgatgatattggaggttgtagaaaacagcttgcccagattaaagaaatggttgaacttcctttgagacatcctagcttattcaaagctattggtgttaaacctcctcgtggaatcctactttatggaccacctggaactggtaaaactttaatagctcgagctgtggccaatgaaactggtgcatttttctttttaattaatggcccagaaataatgagtaaattagctggtgaatctgaaagtaacctgcgtaaagcatttgagcaagctgaaaaacatgctccttccatcatttttattgatgaattggatgccattgctccaaaacgagacaagacccatggagaagtagaacgaagaattgtctcacaattgcttactttgatggatggtcttaaacaaaattctcatataattgttatggctgccaccaacagacctaattcaattgatgctgctcttagacgttttggacgatttgatcgtgaaatcgatattggtattccagatactactggacgtttagaagtactccgcattcacactaaaaatatgaaactagctgatgatgtcaatttagaacagattgctgctgaaacacatggtcatgttggtgcagatttagcgtctctctgttcagaagcagctcttcaacagatccgtgaaaaaatggatcttattgatttagaggaagaccaaattgatgctgaagttctcaattcactagctgttaccatggataacttcaggtatgctatgggcaaaagcagtcccagtgcccttcgtgaaacagtggttgaagttcctaatattacttgggatgatattggtggtttggataatgttaaaaaggagttacaagaattggttcagtatccagtggaacatccagaaaagttcctgaaatttggaatgcagccgtcccgtggtgttctattctatggaccacctggttgtggtaagactttgttggctaaagctattgctaatgaatgtcaggcaaatttcatctcagtaaagggtccagaattattaactatgtggtttggagagtctgaagctaatgtccgtgatatttttgataaggctagagcagctgcaccttgtgttctattttttgatgaactggattcaattgctaaatcaagaggggggagtgttggggatgctggaggtgcagctgatagagttattaaccaaatccttacagaaatggatggtatgggagccaagaaaaatgtttttattataggtgctacaaatagaccagacataattgatcctgctatcctgagacctggtcgtttagatcagctgatttatatacctttacctgacgagaagtccagagaagctattttcagagcaaacttaaggaagtcacctgttgcaaaggatgttgatttacaatatattgccaaagtcacatttggttactctggtgctgatcttactgaggtatgtcaaagagcatgtaaactcgctatcagacagtcaattgaagctgaaattaaaagagaaaaaagtagattagatggagccacacgaatggagatggatgatgaagatcctgttcctgaaataacccgtgaacattttgaagaggcaatgaggaatgctaggcgttcggtcactgataatgatattcgcaagtatgaaatgtttgctcagacattacaacaatcaagaggttttggatctaattttagattccctgctagctcaaatattccaagtgctccaggaggtgggggaacagaaaccaacaactttccagatgatggagatgatgacctttataattaa

SEQ ID NO: 1529 - DNA, 834 bp, Euschistus heros
atgacggaccagcaaatggactgtgctcttgacttaatgcgaagactaccacctcaggaaattgaaaaaaatttgagtgatctaattgatttagttccaagtctatgtgaagaactattgtcttcagtagaccaacccttgaaaatagccatagataaaggggttggtaaagattatttattatgtgactacaacagggatggcgattcatacagatcaccttggagcaatacttacgatccaccccttgaagatggctcaatgccttcagaaaggctaagaaaactagaaatagaagcaaacgccgcttttgatcaatatagagagatgtattttgaaggcggagtgtcatccgtctacttgtgggacttggatatgactggttttgctggtgcaattttaataaaaaaggccggcgatggttcaaagaagatcaaaggttgttgggattccatccatgtcgttgaagttcaagaaaagacgactggacgaaatgctcattacaaattaacttcaactgttatgctgtggctccaaactaacaaaacaggttcgggtacaatgaacctggggggtagtttaacgaggcagatggaacaagacgcagctgtttcagattcttcaccacacattgccaatattggccgaatggttgaagatatggaaaataagattaggaatatcctgaatgatatctattttggaaaaactaaagacattgtcaatggcttaagaagcactcaggcattatcggaacagaaagcacaggctgctcttcgacaggatcttgctgtagctcttcagaaacggcaggcaaaaacagcggaaaattga

SEQ ID NO: 1530 - DNA, 3705 bp, Euschistus heros
atgcaacaaatggactccttgcaacctaacaacgcaacaggactggtgaaaagcggactagaggcgggggccggtagcggcatgaaggagcccccgccacgagaggagccggtcctagacccaatcaatggtgttgtccagcctccggtcatacctcctccccacaggcctggccgagtaaccaaccaattgcaatatattcagaaaaatgtccttaaagcagtctggaaacatcaatatgcttggcctctacagcaacctgtcgatgctaataaactcaatcttcctgattaccataaagttattaaacatccaatggatcttggtactatcaaaaaacgactggaaaacaattattattggtgtggtgctgagtgtattcaagatttcaacacaatgtttaacaattgttatgtttataacaaaccaggagaagatgttgttgttatggctcaaacgctggaaaaactttatttgcaaaagctggaaacaatgcccaaagaggaaattgagcttgagcctccaccacctaaaggttctaagccagttaagaagcgacctggagttataggtccaggtagagggggcgggaccactggcgcaggaagagggaggccttccaattcaacgccagcagctgcggcagtagtcaccactcctgtaccgcctgtcactcccccatcacaccttccagcaaccatacctggttcgactgctactaccactgtacctactactcaccataactctctcccccctcaggttgggcagccagcagctgtaccctccaacttcagtacaactactgttgatccccttttaacacctggattggctcctggtgttggtccaaaaggtggcaaaggggccgtcgtccagaccccaacggcgcccaaaccgaaaaaaggggtcaaaagaaaggctgatctagcgaatgatagccccgctagttttgacccaacatacaccccaggtgactccaaagctgccaaggttggcactaggagagaatctggaaggcaaattaaaaagcctcaaagacagtcagacgatggtatgccattttctcaaagcccaatggcaccttattcactttcaaattcaacgcaggctgcccatgaaaagccgaaagaaaaactctctgaaacattaaaagcatgtaatgaaatattgaaggagttattttctaaaaaacattttaattatgcttggcccttctataaacctgttgatgccgaatggctaggtttacatgactaccatgatattattaagaaacctatggatctcggaactgtaaagcaaaaaatggacaatcgagaatacaaaacagcaactgaatttgctgctgatgtgagactaatttttacaaattgttacaagtataatcccccggaccatgatgttgttgcaatgggccgaaaattgcaggatgtttttgaagtgagattcgctcaagtacctgaagactcccctatatcgactgttcctgaaaaggaagaagaatccacctctgggtcatcgtctggctctgaatccgaaacagataattcagatgacgaaagggcccgtaaacttagtcaattacaagagcagttaagaatcatgcaggaagagatgagaaaactcgtcgaagaaggaactgttaaaaagaagaagaaaaagaaagaaggttcaggttctggtggaagttcttctagtaagaaacggaaatctgctgataggacattaggtaaaacagccgatggtgggcttatagctggtgccggagcacccgctatcatggaaataaaggctactgatggcgtaaaggctgtccctcctccaggcaggaatgcagtcccttcaccccaggtcaaaccaaacaagggcaaagcccctggaagggcaccaggaaaaaccaattctcagggtaagaggccaaagccgaactccaggtctactaactctaagaagaagaatcctgttgtcacttcagagtttaactcggaagatgaggataatgcaaagcctatgtcttatgatgaaaagagacaacttagcttggatattaacaagctaccaggtgataaacttggaagagtagtccatatcattcaggccagagagccctctttgagggattcaaaccctgatgaaattgaaatagactttgagacattgaagccatcaaccctgagggagctcgagtcctacgttgcatcatgtctcaggaaaaagccacataagaaaaatgtatcagcaaaatcaaaagatgaagcgatggccgagaagaaacaagagctagaaaaaaggcttcaggatgttactggtcaattgggaggatcagctaagaaaacagctaaaaaacaaggtcagggaaggctttcagcgtcatcgtcatcaagctcagattctgatacaagtagttcaagtctctctagcagttcttccgactcatctgatagcgaagcagggaaggcagggcgtccaccgaggaagaaaaataagaaaaatcaccaaatagcaacaactgctgcaacaactgtccaacagaatcaaactgtaccaagcttgaccatgacaactgccactggtactattgtaaataaaaatgctggggctccacagcccgtagtaccgttagcaagcaccaacaaacctactgtacctccggtctctgcagtgacacagcctgaacctgtgaaacctgttgtagcatcacatagcttgcctccccaacctgcgaggcctaccgcaacggctgcccctctgacaactgctaagagggcatcaatccccacgccagcgacatcgatgggcatacctccgcctgctccgactggtcttgaaacaggtcctattgagatcaaacaggaattggatgttcctgttccactagcacccgttccagatcatttggatttcaaaaaccttttggaggtgaagcccgagctaaatgatatcgttactgggatgccttctgtatttgatcctttgcctgactcacctcccatcattaaggaagaaaagcatcctatactcccccatcacacagatggacacttgaacaattctcttccccctgtcagcaacgtacctggtccgccaatcataccgagtgctgcacttccaactacaccacatcacttagatatgaataagaattcccagcctcctcagcttccccagacgccaactttacaacaccccttcaaacctaagactgttgagcagaacttgaaaaatgccagttcatggtcttcacttgcccagtccccaacaccagctctcaccccaactccaccgactgcggctctgaagtcctccatggctgacagctttcaagcttttaagaaacaagctaaagaaaatgccaagaagcaacgagccctgattgaacagcaagaaatgaggcgacatcaaaaagaacaggctgaaagggaaagattacgtgttgaaaccgaaaagaggagagaaagagaagaagaagaagctctggagaaggctaggaaggctgctgtagtggcttctggaagagttgaagaggttaaaaatgctgctatcgaggaaggtaccagcccaggttcggcagacaaagctgctgcagagcgagaacgtctaaggcaacgagagcaagagaggcggcgaagagaagcattggctgggcaaattgatatgaacaggcaaagtgatttaatggctgcttttgaacagaccttgtaa

SEQ ID NO: 1531 - DNA, 1293 bp, Euschistus heros
atgattcccccgtcttctcggccacaggtcactgtgtacagtgacaaaaatgaaccaactggtgaattattgactctccctgcagtctttaatgctccaattagaccagatgttgtcaattttgtacatcaaaatatagccaaaaatcataggcaaccttatgcagttagtgctgaagcaggtcatcagacttcagctgaatcatggggtactggacgagctgtggctcgtatacctcgtgtaaggggcggtggtactcatcgttctggtcagggtgcttttggtaacatgtgtagaggtgggcgtatgttcggtcccacaagaacatggcgcagatggcatcgtaaagtgaatgtgaatcaaaagaggtacgcaatggtttccgccattgctgctactggagttccagctcttgtcatgtctaaaggacacatggtcaatgaagttccagaaatccctcttgtagtaactgataagattcaggaatatactaaaaccaagcaggctacaattttcctgcatcgtatcaaggcttggtctgatattcagaaggtctataagtctaagagatttcgtgctggtaaaggtaagatgcgtaacaggagacgcattcaacgtaggggccctcttatcatctatggtcaagatcaaggcctaactcgtgctttccgtaacattcctggtgttgatcttatcaatgtttcacgattgaacttgcttaagctggcacctggtggtcacgtaggtagatttgttatctggacacaatcagcttttgatcaactcaatgctctctatggcacatggaagaaaaaatcaactttgaaaaaggactacaacttgcccatgcccaagatggtaaacaccgacctttctcggctgttcaaatcagacgaaatcaagagtgttcttaaacctccaaggaagaccatagttaggagggtaaggaaactgaacccattgagaaatactcgtgcaatgttgaagctcaacccattcgctgcagttctgaagaggaaagctgtccttgctgacaggaaactgaagcttgagagggctattgagagatcgaagaaggaaggaattgagcttactcctcatcaaaagaggtatgttgctatgcttgagcgaaggaaggctcagattaaagctgccaaagcagcaaagcccaaaaaggttaagaagcccaagggggaaaaaactgctgctcctgaacccaagaaagctactgtgactaaaaaaccagcaaaaaaagcaacaacagctgctgcacccaaaccagccaaaaaatga

SEQ ID NO: 1532 - DNA, 5457 bp, Euschistus heros
atggcagatttcatagattctgaggctgaagaaagtgaggatgaggaagaattggaagttcatgagaaaaagaagttaaagcgtttgaaagctatggaaagtgatgaagatgaggaagaagaagatgatgaggaacgcctgcgagaagaattgaaagatttaattgatgacaacccaatagaagaagaaagtgaaagtgatgatggcagtggatctgaagaaggaagtggggaagatcggggaggggagaaacgtaaaaagcatgatgaagattttgatgatcgccttgaagatgaggattatgatttgctggaagaaaatcttgggcgaaaggttgaaagaagaaaaagatttaaacggttgaggagaattgaagatgaagaatctgatggtgagagagctgaagatgaaggtgaagtgagggatgctatagccaatgaactttttgaaggatcagatcatgaagaagatcggagctcttctagaggaccagcacctgagcggtacgatgatgaagaggaagatggtgaatactcagatgcagatgattttattgtagatgatgaaggtagacctatagccgataaaaggaaaaagagaaaacctatattcactgatgccgctttacaagaagctcaagatatttttggagtcgactttgattatgaagattttgaaagactcggtgaagatgagtatgaagaagaagaagatgaagacgaatatgttgatgaagaaggcatcgaagacagtgagagaaggcgcaaacctacaaagaaggctgctagaaagaagccaacaagaaaatcaatctttgaaatttatgaacctagtgaattgaaaagaggtcattttacggattttgacaacaaagttcggaatactgatattcctgagcgaatgcaacttagagatattccagtgacaccagttccagaaggttctgatgagctgtctgaggaagctgaatggatttataaacaagcattttgtaaaccaacaacatctaatcaggaatggggcaacacaatggagagaggaaaaccaaagaaggaacctcaaacagttgaaaagataaagaaagcactagattttatgaggaatcaaaattttgaagtcccttttatagctttttacaggaaggaatatgttcttccagaacttaacatcaatgatctctggagagtcttcaaatatgatgcaaagtggtgccagttaagaagcagaaaaatgactttactttcattgatggaaaagatgagggattatcaggctgaacagctgatgaaagacattgatgcacctattccagatcacgttagggtcattaaagatgatgatattgagaggttgaaagctgtgcaaactactgaggaattgaaagatgtccattctcattttctgatgtattattctgatgacgttaaagttatgttagaagcaacaagaataaaggagcgggaagctgcaaaagcaaaagcaagacaggagaagcaggttgacgaaaatggtgaccctattgaaaccgaagtagaagaacaagaggaaactcctcctcctgaaataccttctgtaaaacattctatacgttctggaccttatgcaatttgccgaaaagctggaataggtggtttggcaaaacgatttggtttgaaacctgaacagttcgctgaaaatcttagggataattaccagcgccacgatgttgaacaggagccatccttacctcttgaactggcaaaggagtttgtttcaacgaaatttgttacaccagaggatgttttaaaagcagcaaaatttatggttgctacacaactgagcagagaaccccttgttcggcgttgtatgagggacactttctttgaaaaagctaatattgatgttaaaccaaccaagaaaggttctaaagaagttgatgaaaaccatccttgttatgtcatgaaatatcttaaaggtaaaccagtgagagatttaactgctgaccagtatctaaaactacacattgctcatcaagataaactattaaatgttactattagtgatcatattggtggccatacaacaacatcttatattgaggaaattaaacaactctactatcgtgatgagttcatgcagcatgtgcaagaatggaataatattcgccaagaatgtgttgatgttgctattaagaagatgttaattccagaattgattaaagaactccatactcgtctgcttgaagaagctaaagagtttgttttgaggtcatgtgctagaaaagtttacaactggattaaggtagctccatttactgttgaatttggagacgatgatgaagacgattgggatacaagcaaaggaattcgtgttatgggagtagcttatgtacctgatttagcacaggcctcttttgcttgcatggtggctcctgatggtgaatgtactgattttcttagactacctcatctcttaaaaagaaagaatacttggcgagaagatgaaagaattcataaggagtcggacttagcactgattcgaaattttatactgaccaaaaaacctcatgctgttgtcattggaggggaatcaagagatgcactaatggttgctgcagatcttagggaaattatatcaaatttggtcgaagatgaacagtttcctcaaattcctgtggaaatcatggataatgatttagcaaaagtttatgccaactcactgaaaggagagagtgatttccgagattatcctatgttactcagacaagctgtatctcttgctcgaagattacaggatccattagtggaattttcccagctatgtacaccagatgatgaaattctttgtcttcgattccatcccttacaggagcaactatcaaaagaagaacttcttgatgtggtcacattggaattcgttaatcgtaccaatgaagttggtgtcgacataaatgaagtggtagcaaatccgatttgtggaaatttagtgcagtttgtttgtggtcttggtccaagaaaagggaccacacttattaaaattttaaaacagaccaatcagagacttgaaaacaggactcaacttgtaacaacatgccacatgggacctaaagtttttatcaactgtgctggatttattaaaattgatactaatgctcttggagatagcactgaagcttatgtagaggtattagatggttcacgtgtccaccctgaaacttatgagtgggctcgtaaaatggcagtagatgctctggaatatgatgatgaagatgctaatccagctggggcattggaagagattctagaaaagcctgaaaagcttaaagatttagatctggatgcatttgctgaagaactggaaagacagagttttggtaacaagagcattaccctctatgacataagatcagaattgaaccacaggtataaagatctgagagttccttaccaatctcctggaccagagttgatgtttgatatgcttactaaagaaactcctgaaacattctacatcggaaaacttgttactgcaacagttattggtatatctcatagaaaacccgaaaaagatcaactagatcaagcaaatcctgtaagaaatgatgaaacaggactttggcaatgtccgttttgtctgaaaaatgattttccagaattatcagaggtatggaatcactttgatgccggtggttgtcctggacaagcaacaggagttagaatacgattagataacggcattactggatatattcacattaaaaatttgtcggataagcatgtcaccgatcctgctcagagagttacccgtggtcaaatgatacattgcagagtaaccaaaatagaggttgagaggttttcaattgaagctacttcaaaatcttctgatctactagataagagtcatgattggaggcctcaaaaggatccttattatgaccatgaaaatgaaaagaaagatttacatacagaagaagaagccaaaaaaaataggcaaaaactgacgtacatcaaaagagttattgttcaccccgcttttcataatatttcctacattgaagctgaaaaaatcatggctacaatggagcaaggtgatgttattgtaagaccttcgagcaagggtgctgatcatcttactgtgacttggaaagtagcagatgggatttatcagcatattgatgttagggaagaggggaaagagaatgctttctcattgggccaatcattatggatcggaaatgaggaatttgaagatttagatgaaataatcgctaggcacgttaatccaatggcagcctatgttagagatatgtttgcctttaagtatttaaaagatacagaaggaggtcttaaggataaagccgaagaatttttgaaagaagaaaaaaaaaagaatccagcaaaaattcattatatagtttctgtatccaagaattatcctggcaaattcttgctctcttacctgcccagagctaggtgcaaacatgagtatattagtgttacacctaatggatttaggtttagaggacagttcttcgaatctgtcaattcattattcaaatggtttaaagaacatttctcggaccctatacctggtacacccagtactcctagatctgcaatgtcagctcgtactccatatactaatactcctggaccaatgccaataaatatgaacgctgaagctatacagcgtgttgctcaaaatatgccaaatcatatgctccacagcctttcacaagttgccagtcatactcctcattaccctcatactcctggagcatattctcttcatcagtacccagctacgccatatactccatctggccaaactcctttcatgactccatacacaactccacggtatggcagtggtatgactcctggccaccaaagtattatttcttctggatctataacgtcacctcaaagttcaacaccaggccagcctgttttccttcatccaggctcaattactccttctcacagaactcctgttgccaattttcataggcctggtagtactcatcctgaagactggggtaagaaagcagaagaatgggttgctaagaaaagagaaaatgctactagaacacctaggtctacaccaaatgctggcactccacgccatgggacaccacgagatgatcccaataagaatcgaacaccaaggtatgctgataatgattatacctctccacggccaggtgctaatttcacttccccgagatattccaattggaataaagttgctggcactcctaattcacatatatctgcatatgaagatgccaactatgatgctcgaagcctgaagtccccacgacctccacctgcgcagggcaagtatgatccctatgaacttggtcaagggaaatctcctcggtattcattgacacctcgttctacacctcgtaccattaattcacctcgttccatgtctcttggtgattcgactccactgtatgacgagagcatctag

SEQ ID NO: 1533 - DNA, 2286 bp, Euschistus heros
atggaggaatctaaagagcggaagaattgtcgaaaacatgagagaaatagtgataagtctgatctaaaatcgagagatgaaagagatagttacagtagagaaggtaaacataggcgatatcatgttaatgacaaaacaatcaattattcatcaagggatagaaagtatgactcagaacataaaagatatgaaaaattggaaagatattggggaagaggcgctgacaaggatcgtcatggtaaagatatgaaagctgattacctagttggttcaaggtactataatgaaacgctgaaaaattctcaaatcaaaacttcagagagttctactaaaagtaaagaaaatgttaatccactagagagtggtagtaaagaaaagcaagcccctaaaagaaagaatgatgatatcataacatctagaacaggaggtgcttacatacccccaggaaaactgaaattgatgcaagcaagtatcactgataaatcaagtactgagtatcaacgtattgcttgggaagcattgaagaagtctattcatggtcatataaataaagtcaatacatctaacattggtgtcgttgctaggttattattcaaggaaaatataattcgtgggagaggccttctttgcagatcaattatacaagctcagtctgcttctattacatttaccaatgtatatgcttgtttggtggctataattaattctaagtttccaagtataggagaacttttactgaagagagttattattagattcaaaagggcttataaaaggaatgataaagctgtctgtatttcttcagcaacatttatagcacatcttatcaatcagggtgttgctcatgaaattcttggattggaattagttactttattagttgaaaatcctacagatgattcaatagaggtagcagtagcctttttaaaagaagcaggacagaaattaagtgaagtaaccagcaaaggcactaatgctatatttgacatgttaagaaatattcttcatgaaggaaagctcgaaaaaagggtacaatacatgattgaagttatgtttcaagtaaggaaagatgattttgccacttttccatcagtaccagaagagcttgaccttgttgatgaagaagatcagttcactcatttaattggacttgatgatgctattgatacccaagatatattaaatgtgttcaagcttgattcagaatatcaggcaaatgaggaacgttataaagaattgaggagtgaaattcttgatactgattctgaagatagtggctctgaagctagtagttcagaaggagaagaggattctgatgaggaagatgaagaaaagaaaatcacaattgttgataatacagaaacaaacctaatatctctgaggaaaactatctacctaacaattcaatcaagtcttgattttgaagaatgtgctcataagttgttgaaaatggaaattaagcctggtcaagagaaagaactttgtcatatgtttctagattgctgtgctgaacaaaggacatatgaaaaatttttcggtcttctttctcaacggttctgtcaagttaataatacttacatagctcctttcgagcagatatttgctgacacttactctactgttcatcgtttagatactaatagattgcggaatgtagcaaaattgtttgcacatcttctcttcactgatgctatttcttgggcagtgctttcaaatattcgactaaatgaagaagacacaaccagctcaagcagaatttttatcaagattttgtttcaagaattatcagagtatatgggtttagttaaccttaatgccagattgaaagacccatctcttcaatctgccatggaaggtctgtttcctagggacaatccaaagaatacacgctttgctataaacttttttacatctattggtcttggtggtcttacggatgaattgagagaacacctaaaaaatttaccaaaatccattccagtgacacaactcatccaagaattatcatctgcatcctccacttcttcatcatcttcatcttcctctgaaactgagtcatcatcatctagtgattcatcagaggatggtagaaagaaaaggatgaaaaagaaaaaaaggcctattattccaaaaaaggattcacatttaaataagaaaaagcacaaaaaacttggaaactctcaagaaagtgatagatctactaaagaaaccaaaaggaaaaatgagtacaaaaaatcacatgatagagacgaaaaatctcatggtagaaaatcaaaaaggaaataa

SEQ ID NO: 1534 - DNA, 1758 bp, Euschistus heros
atggcgctgaaagctctcgttggtcaaaaaattatgaacgatgcgatcaggcaaaagaaaaaagggaaagaggtagagtggagagtccttgtcgtggatcagctagcgatgcggatgatctctgcttgctgtaaaatgcatgaaatttctgccgagggcttaacaattgttgaagacattaataaaaagagggagccacttccatcaatggaagctgtttatctaataaccccgagtgaaaaatccgtacatgccttgatgaacgattttgcctcaccgaatcgtatcatgtacaaagctgcccatgtctatttcacagaagcatgcccaaatcctttatttgacaccctgtgtcatgcgagaatcgctaaatttataaagactctgaaggaaataaatatagcatttattccatacgaacagcaggtgttttcccttgatgctccagaaacattccagtgcttctacaacccatcattggctaacagccgacttgctaatatggagcgtattgcagaacagatagccacattgtgcgccacgcttggtgaatacccatctgtcagatataggagtgattttgataaaaatgtagaattagctcagatagtgcagcagaaattggatgcctacaaagctgatgaacctacaatgggtgaagggcctgaaaaatctcgttcccaattgttgatccttgatcgaggttttgatgcagtttctcctcttcttcacgaactcactcttcaggcaatggcctatgatcttcttccaattgagaatgatgtatataagtatgaagctactgctggagctccggagaaagaagtattgttagatgaaaatgatgaactatgggtagaactacgccatcagcatattgctgttgtctcacagaatgtcacaaagaacctgaagaaattcaccgagtctaagagaatgccacaaggagacaaacagtcaatgagggatctcagtcaaatgattaaaaagatgccacaatatcagaaagaacttagcaagtattccactcatttacatcttgcggaagattgtatgaatgcttatcaggggcatgttgataagctctgcaaggttgagcaggatttggcaatgggtaccgacgctgaaggagaacgtataaaggaccacatgagaaatattgttccgatactccttgaccaatccgtatctaattatgacaaaatgaggatcatccttctgtatacattgtcaaagaatggtatttctgaggaaaacttgaacaaactcgttcaacacgctcagatccagccacacgagaagcaggccatcgtcaacctaggaaatcttggcctaaatgttgttgttgatggtactcgtataaagaagccatacgtaccccctcgtaaagagcgtatcacagaacaaacttaccagatgtctcgttggactcctgtcataaaggatcttatggaggactgtatagatgacaagctcgacctcaaacacttcccctttctcgccggtagggctgcctcttctggatatcatgctcctgccagcgtgcgatatggacactggcacaaagataagggccagcagaccgtgaagaatgtgcctcgaatcatcgtcttcatcatcggtggtatgagcttctcagagatccgatgtgcctatgaagttaccaatgctgtcaaaaattgggaggtgataattggttcttcacatatcctgacacctgaagacttcctaagtaacctcgccaacttgagcaactag

SEQ ID NO: 1535 - DNA, 2118 bp, Euschistus heros
gacccttacagctatgaggactttgttgaacgtttagcttggagaactgttgatggcttcaaggaagatggcattcatggatttgatccaaatttaatgcacgaaacatttctccaagcaattaaggatttacaagttctacaagatcgtcagtataagaaatgtgaaaaacttgaactaatttgcaaggaagaagaagctaatcatttccaggatatagcccatttgcacgataaaaataaggaagctgttgctttatttcaagatttggatgaaagaataaattttgttgctactaaagtaatacatttaggagatcagttggaaagtgttaatgttccaagatctagagctgttgaagcacaaaaactaatgacttattttagtgaatttttaagtcctggacctgttgttgcaagtgttttttctagtaaggatgaggtatttgaagctgctgatattatccagaaacttcatatgatctcacaagaacttccctctgataaatttaaagatgctagatcaaaaatcagtctaaaatatgatgaaattgaaagatcattgattgaagaatttgtaaaggcacacagggttcatgaaacaatgagaatgaaagatattgcaaatattcttatgcatttcaagtcttattcacagtgcattgatgctttcattgaagaaagtcaaatgggaacatttgttgggaaggatattttcaaggagatattgcctctcacaaaaaaaaattttagtattatgagagaagtttttagcaacccggaacaagttatggctaaatttgttttgaatatttaccatttaaaactgcagaaacatatcgtaagcaacctttctgacaagtccgatactaataaatatctaagaaacttaatggaattatacactaggacgactgaactatctgccgaattgagtggcttcaaaatgggatctgatgattcttatcttcaaaaactaactcaaaacatatttcaaaaatatttagaatcttacataagtgttgaagttaagggcctgaaggaaaagtgctcaacgttgttacaaaaatattatgactcaaaagatcaccataaacgacaaatacagtctggaggattccaagattttagacgtgatcttcaggctgttattggcactagggctaacatcaatattgctcaaatcgaagattatggaggagaaacatttttatcagaagaattagttattagtctaatacaagagtctaagcaggcattttacagatgtaaattgctgtctaaacctgctgacttggcaagtaacacagtccagctgttagaggtactactgaattgtattattatcgatcatgttgattacgctgtagaactagctttacaagcagtaccaattcctgaaagtaaaacacaggctcagccaatatatttctttgatgtcgtaaggcaggcaaacaccattgtgcatctgattgaaaaacacttcaatgattctgctcttcctttagtaatgtcaacttctaaacatggggaatgtgtcatgaaaaaaaaattcttattaaaccatttggaacagaaactggacaatggcattgacagggcactaaatgcaatagttggttgggtaaaagtattccttcaatctgagcagaagaagactgatttcaaacctgacactgagttaaatacattatcatctgctgcttgtatagctgtggtgcagtattttaatgataatgtaaagcatataagagcctgtttggatggtagaaatattgaatgtgttatgacagaattgggctgtcgttttcacagagtcatctatgaccatttgcagcaatttcaatacaattcaaccggtgctctttgtgtaatatgtgacatgaatgagtatagaaaatgtgtgaaggaacttaattcatatctagttaatacattgtttgatactttacatgctctttgcaatgtgctactagtaaaacctgaaaatcttgaccaagtgtgcacaggtgatcagttgtctctattagaccgttctgttgttcttaatttcatccaattaagaaatgattacaagactcagaagttatcaaattttctgaaaggaatgtctgcttga

SEQ ID NO: 1536 - DNA, 831 bp, Euschistus heros
atggatttccaaaatcgtcctggaggtaaaactgggagtggtggtgtagcatcatggtcagaaacaaaccgagaccgaagagagaggctaaggcaactagctctcgaaactatagatataaacaaggatccctattttatgaaaaatcatttaggttcctatgaatgtaagttatgtctcaccttacacaataatgagggaagttatttagcccatacccaaggaaagaaacatcaagcaaatttagcaagaagagctgctaaagaagcgaaagattctccacaacagcccgcaccagataaacctagaatagaacctaaaaagttcgtaaaaattggtagacctggttatcgagttaccaaacaaagggatcccgaaactggccaacaaagtcttctttaccaagtggattatccagaaattgcagaaggaatcttgcctaggcatcgttttatgtcagcttatgaacaaagagttgaacctccagacagaaaatggcagtatctcctttttgcagctgagccttatgaaacaatagcctttaaggtgccaagtcgtgaagtagacaagtctgaaaacaagttttggacccattggaacaaagataccaaacaattttttctccagtttgcatttaagaatgaacctcttgctcctcctatgggcgcaccacatctaggccagatgaggcctccacacatgctgcctcctccaatgagtgttcctccacctcctatgtttaatccagttccacctccccctccaaatctaatgcttgctcccccgccaccacctgctccacttccgcctcctcctcaacctatgaaataa

SEQ ID NO: 1537 - DNA, 405 bp, Euschistus heros
atgtctatcggtgttcctattaaagttcttcatgaagccgaagggcacatcgtcacatgtgaaaccaaaactggagaagtctacagaggaaaactaattgaagcggaagataatatgaattgccaaatgactggtttaactgttacctaccgcgatggcagagtggcacagttggaaaatgttttcattaggggttccaaaatacgttttcttatactgccggacatgctaaagaacgcgcctatgtttaaaaaacaaggcaataaaggaaatacgggtgcggggagaggtaaatcagcaatattaagagctcaagctgcccggggtagaggttcacaatcaagaggaggtgccacttcttcacgaccgtcttggcaaagcggctctaatcagtcaagaaaataa

SEQ ID NO: 1538 - DNA, 1428 bp, Euschistus heros
tataatcagttgaatcgtaatttagtgttggcagaactaccatattttctctctgataatccaattctatctcgaagttctgcactcttgaaaagtttcagaatttttatacaaatggcttcgagtgtttctaaagttcctctgcttcagacggtggcgaagagatcatttgctgctgttgctgcgcctcaatctggaagatgtaagaacaaagttgaagtaactactcttccaaataaggctgtagttacttctttaggatgtgaacccagctccttggtaaaagttgctgttgcattcagagctggaagtcgtagtgaaacctctgataattttggagctagtcatattttgcgaagctctgctggtcttagcacttgctctgcatcttcgttttacatctgtcgcagtttgcagcaaaatggtgccagtctcactgccacttctgatcgtgaaactattgtttatcttctcgaatcttctgctaccaatataaaagaaggccttgatgtaatgaagaaagcgattactggacaagagtttaggccctgggaattgtctgacaatattcctcgaatcaaacttgaattggcatcattgcctccacaagctaaagtgattgatttgattcacactgctgcattccggagtgggcttggaaattctatttttgttcgagaattcaatattaagaaaattaactgtgaaacgttgcaacatttttatgctagcaatttcactggtgataaagctgctgtagctggttgtggaatacctcatagttttctgacttcttttgctgattcactggggctgtgttctggaattcccagtcaaatacaagcatccaagtatagaggtggtgaaataaggattgaggaaaacattccattccatcataccatcattgctgcagaagcaccaggtttagacaaaagcgatgcacttgcttatgctgtcttacgatatgccctgggcactggtccttctgtgcaccgtggtcaaggatctggacctctttccaagattcctgctaaggctatggcgctttccatggcccactctgacgctggtctttttggtgtttacgtttcttctcttggtacagatgctaaagaggctgtggaaggagcagtgaaagctttaaagtgtggagtcactgaacaagatgtcgcacgaggtaaagcacagttaaaatcagaattgttatattccggcgaaacctgtcggggaatagtggatgaccttgttgggcaggctttacttgtcaaaggggcacctcccatgaccattgttgaattggccgaaaaagtttcttcagttactactcagcaggtgcaacaggcattgcaaaagatccagtctggaaagaaatcatttgcttctattggtaacataagcaaagtgccatatttagatgaattgtaa

SEQ ID NO: 1539 - DNA, 339 bp, Euschistus heros
atgaggagagctcatggcaattattaccaaccggttccaacgtttgacggacctagcggttcccttgaagaggaaaatgaccagatgacgaataaactcaaagataaaataactgctttaaagcacttatctattgatatcggcgcggaagtcaagtatcaggataagatgctgcatggcatgtcagaagactttgatcgtactggtggcttcttaggaaatacaatgaatcgagttttacgcctgaccaaagggagtcacaattattatattttgtacctttttatattttctattgttgttttttttgtactgtacatagtattaaaatttagataa

SEQ ID NO: 1540 - DNA, 1491 bp, Euschistus heros
atggctatatcttctaatcaagctgttaaagaacatgttttggctgtttcaagggatttcgtctctcagcctagattaacttacaaaactgtatctggagtgaatggacccttagtcattttagatgaagttaaatttccgaagtataacgaaattgttcaactaagacttgctgatggaacattacggtctggccaagttttggaagtcagtggctccaaagctgttgttcaggtttttgaaggcacctctggtattgatgcaaaaaacacaatatgtgagttcactggagatattcttcgtactccagtgtctgaagatatgcttggacgagtcttcaatgggagtggaaaacccattgataaaggtcctccaattcttgccgaagattatttggatattcaaggacaacccataaatccttggtctcgtatataccctgaggaaatgattcagactggtatctctgcaattgatgtaatgaattcaattgctagaggacaaaaaataccaatcttctctgctgctggattgcctcacaatgaaattgctgctcagatttgtcgacaggctggtttagtaaaattacctggaaaatctgttcttgatgatcaagaagataattttgccatagtatttgcagctatgggagttaacatggaaactgcccggtttttcaagcaagattttgaggaaaatggttccatggagaacgtttgcttgtttttgaacttggcaaatgatccaactattgaacgtattatcacacctcgtcttgctcttactgctgctgaatttcttgcttatcaatgtgagaaacatgttttagttatattgacagatatgtcctcttatgcagaggcccttcgagaagtatcagctgccagggaagaggtgcctggtagaagaggtttccctggttacatgtacactgatttggccaccatttatgagagagctgggcgtgttgaaggcagaaatggaagtattactcaaattccaattcttaccatgcctaacgatgatattacccaccctattcctgatttgacgggatatattactgagggccaaatttatgttgaccgtcaattacacaacaggcagatctaccctccaattaacgtattaccatctctgtcccgtttgatgaaatctgctattggagagggaatgactcgaaaagatcattctgatgtctcaaatcaattgtacgcctgttatgctattggtaaagatgtgcaagccatgaaagctgttgtgggagaagaggcccttactcctgatgatcttctctatttggagttcttgacaaaattcgaaaagaactttatttctcaaggtacttatgagaacagaacagtatttgaatcattagacattggttggcaactacttcgtatattccccaaggaaatgttgaagagaatcccagcatctactctggcagagttctaccccagagattcaaggcatacaaccacaaaatag

SEQ ID NO: 1541 - DNA, 2229 bp, Euschistus heros
atgatgcaacaagctcaaagtaggccaatgtcccatggaaattaccagggtggaccagatttgcccatgggctctgtcaaagaccagacactcatgtggcaacagagctcatatttggctgattcaggaattcattccggtgcaactaccacagccccctcactctcaggtaaagaagaagaaatgtatggggatcaggacatgtttgacttggatcaaggttttgcccagggtttcacccaagaacaagttgatgaaatgaatcagcagctctctcagacacgatctcagagggttcgggcagcaatgttccctgagacattagaagaaggtattgaaattccatctacccagtttgaccaagctcaatccacagcagttcaaagacttgctgaacccagccaaatgctaaaacatgctgttgtgaatctcataaattatcaggacgatgcagatctagctactcgtgctattcctgaattgataaaattactcaatgacgaggaccaagtagtagtgtcacaggctgctatgatggtacaccagctgtctaaaaaggaagcctctcgccatgccatcatgaacagtcctcagatggttgaagctttggtgagagcattatcaaacagtaatgacttggaaacaaccaaaggagctgttgggacattacacaatttgtctcatcacaggcagggtcttttggctattttcaaaagtggtggcatccctgctctagtaaaacttttaagttcgcccgtggaatctgttcttttctatgcaatcacgactttacacaacctccttcttcatcaagaaggaagtaaaacggctgtgagagttgctggaggattgcaaaagatggttgctttgctccaacgaaataatgtcaagttcttagccattgtgaccgactgtctccaaattctagcttatggaaatcaagaaagtaagcttattattttggcatctcagggtcctattgagctagtgcggatcatgaggagttatgattatgagaagctcctttggacaacatcaagagtacttaaagttttgtctgtctgctcgagcaacaaacccgcaatcgttgaagctggagggttacctgctctggcaatgcacctggggcatccatcacagcgacttgttcagaactgtctttggaccctgagaaatctctcagatgctgggaccaaagttggtggtttagaaggccttctccaatccctcgttcaacttttagactccactgacataaacattgttacttgtgcggctggtattctatcaaatttaacatgcaataatcaaaggaacaaggtaactgtgtgccaggtcggtggtgtcgatgctcttgttaggacaattatttcagctggagacagggaggaaataactgaacctgctgtttgtgctttgaggcacctgacatctcgccatatggagagtgagcttgcacagaatgctgtccgcctcaactatggcttgcaagtgattgtcaagttgttacacccaccttcaagatggcctctagtcaaggcagttattggtttgattagaaaccttgccttgtgccaggctaaccacacaccgcttagagatcacggtgcaatacaccatctgatcaggctccttatgcaagcattccaggacacacataggaggtccagtgttacaagtggaggaacacaatcaggtggtatttatgcagacggtgtgcgcatggaagagatagtggaaggcactgtgggggctcttcatatcttagcgagagaaagccataacagagctatcatcaggggccaaatggtcatacctatttttgtacagcttctttttgatgagatagagaatattcaacgagtggctgctggtgtgctttgtgagcttgcccaggacaaagaaggtgccgagctcatcgaacaagaaggtgcaacagctccacttacagaattactccactctcgaaacgaaggtgttgctacttatgctgctgctgtcctgttcagaatgtcagaagacaaacctcaggattacaaaaagagactttcgatggagcttaccaactccctttttagggaggatcagaatctgtggaatggtgatttaggaatggcaccagatctacaggacatgctgggagagcaaaattatgataccatgtactctcatggaccaccaagcgtgcatagtagtcacggcggtaggggatatcagccagggctctga

SEQ ID NO: 1542 - DNA, 822 bp, Euschistus heros
atggccagaaatgctgagaaggctatgactactttagctcggtggcgagctgcacaattaggagaaggtgatcaagctaaacaaagaagaccgtatttagcatctgagtgcactgatcttcaacaagctgaaaaatggagaatgcaaattataagagaaatagctcgtaaagtttcacaaattcaaaatgctggtcttggtgaattcagaattcgtgatttaaatgatgaaatcaataagcttttacgggaaaaagggcattgggaagcccaaattcgagagcttggtggcccagaccactctaggtctgggccgaaaatgctggatgctgaaggaaaagaagttcctggaaatagaggttacaaatactttggtgcagcaaggcaactccctggagtgagagagttattcgagcaggctccacctcctcctccacataaaacacgtggtgagctaatgagagatattgatgcttcttactatggttatatggatgatgaagatggaatcattattcccctggaagaaattgaagaaagtaaagctattaaaaaagctgtatcggaatggactgttaaaaaggaaaaatcaatggaaattgaggaagaagagaaagaagaagtcgaagaagacaatatctacaaaatagggaataaagagggtgaggaagatgatgaagaagtagaagatgatggatttgaattaagtgccaagttactggaagggtaccgagctcatattcctgttccttcacaaagagaggtggaagctgcaattcttgaaagaaaaaaacaagaacttttggagagatatgctctctag

SEQ ID NO: 1543 - DNA, 645 bp, Euschistus heros
atggaagaggctgatgttccatcatttaaatgtgtacttgttggtgatggtggtactggaaaaactacctttgtcaaacgccatttaactggtgaatttgaaaaaaagtatgttgcaactttaggggtagaagtacatcctttagttttccacacaaatagaggccctatccggtttaatgtttgggatactgcaggccaagagaagtttggtggacttagagatggatactatattcagggtcagtgtgccattattatgtttgatgttacttcaagggtaacatacaaaagtgtccccaactggcatcgagacttagtgcgagtttgtgaaaacattcctattgtactttgtggaaataaagtagacattaaggataggaaagtgaaagccaaaagcattgttttccataggaagaagaacttacaatactacgacatcagtgctaaaagtaactacaacttcgaaaaacccttcctgtggttggctcgaaaacttattggtgatccaaatctggaattcgttgctatgcctgctttgttgcctcctgaggtcaacatggatcctgaatggcgtgaccaaatcgaaaaggatctccaggaagcacaagacacggcccttcctgaagacgatgaagacctctaa

SEQ ID NO: 1544 - DNA, 480 bp, Euschistus heros
atggatatccaaactattgcaacaatatttattaaagttttaaaacttgtaattaatttcatcattttgatgctttaccgctatggtggaaagcaaggatttttgggggtaggtggaacatggaacctgtatgaagtaaagagtgcagatgctgaaattattgcatcgggtgtttttgttggattttttatatatacatctgtcattttgatttcctactgcttcggaacaacaaaacacaaatatagtgcagtggacataataatgaatgtgtgtggaactatactgtttactgcagtaggaggaatagcattacactattgggtcggcttccaggatgaaaaccattatgtgggaatctctcaagaaaaacaaatcggccttgcactgggcagcctttgcgtcgtctgtgcagctatttatcttctagatacagttttatcttgtattcatatcgcccacaagcatgccattgcttaa

SEQ ID NO: 1545 - DNA, 2337 bp, Euschistus heros
atgccgcgaataatgataaaaggtggtgtttggagaaacaccgaggatgaaattcttaaagctgcggttatgaaatatggaaaaaaccaatggtctcgaatagcttccttactgcatcgaaaatcagccaaacaatgcaaagctaggtggtttgagtggcttgatccaagcattaagaaaacagagtggagtagagaagaagatgaaaaattattgcatcttgctaagttaatgcctactcaatggcgaacaatagcaccaattattggtcgtactgctgcacaatgtttagaaagatacgaatacttactagaccaagctcaaaaaaaagaagaaggggaagatggagctgatgatcctagaaaattgaaaccaggagagatagaccccaacccggaaactaaacctgctcgtccagatcctaaggatatggatgaagatgaattggaaatgctatctgaggcaagagctagattagcaaacacacagggaaaaaaagcaaaaaggaaagcaagagaaaaacaattagaagaagcaaggagattagcagctttacagaaaaggcgagaattaagggcagcagggattgaatatgcggcacgccataaacggaaacgaggcatcgattataacgctgaagttccattcgaaaaaaaacctgcgtctggtttctacgatactagtaatgaggctattgatcctcatgctcctaattttaataggcttcgtcagcaaaatttagacggtgaacttcgtagtgaaaaggaagaaagagagcgtaggaaagacaaacaaaaaataaaacagaggaaagaaaatgacatgcctctagcgatgctgcagaatcaagagccagccaagaaaaggagtaaacttgtcttgccacagccacaaatatctgaccaagaactccaacaagttgtgaaattaggaagagctagttatgccgctagggaagccgtgacagaaggatctgagagtgcttcagacacacttctcaacgattatgctttagccacacccaatgctggctcaactcctcgaacaccagcgccaaccactgacaggatacttcaagaagcacaaaatatgatggcattgagccacgtagatactccattgaaaggaggattgaatacacccctttacaactcggagtttagtgttaatcctccagccgagcagatcactacaccgaatactgttctaactacaccattttccaatcgaactcatgaaggaaggactccaggtttccaaactccgcaggatgttagaaacagccttaccactcctgtcagggataaattaaacatcaacccagaggaaggtggtgatacaccttatgcacccgtaaataatcagaaactggtaaaagaggaacttgctgctcgccttaggtcattaccccagcctaagaacgattacgaaattgtcgttcctgaagatgaagtttcatctgaaacagccgcggagggttctggtatgccaagcatcgaagatcaagcagatatcgatgccagaaatttgagccttctcgctcaacaacgtgaaaaagagttgaaaagtagatcgcaagtaattcaacgaggtttgcctcgacctggagacatcaatatagtactgcgcccagctaacacagatccacctctaacagatcttcagaaggctgaagagatgataaaagaagaaatgataacgatgctgcattatgatgctatgcacagtggtgaacctccttcctcgaggaaaattggaactttgagtcaggcacagcaccttgcctacctcgagcaacatccgtatcaaacttactcagaagatcaaatggaaaaggccaaagaaatgctgaaagctgaaatggaagttgtcaaacaaggtatgaatcatggcgatctctcgctggaaacttttacgcaagtttgggaagaatgtttagctcaggttttatatttgccaaatcaaaatagatacactagggcaaatttagcaagtaaaaaggaccgactggagtccgtcgaaaagaggcttgaacaaaataggactcatatgactcgagaggctaaaagagctgcgaaaatggaacgaaaaattaaaataatcactggtggatatcagacaagagctcaggcactgataaagcaacttcaggatttagctgacgaaaccgacaaggctcatatggagctgtcgacattcaaacttcttcagcagcaagaagagaatgctattcctaaacggatagagtcaatatcagaagatgttaataggcagcttgaaagggaaaagagtttgcaaaagaggttcagccaactccagctggtctcgcaatcatag

SEQ ID NO: 1546 - DNA, 474 bp, Euschistus heros
atgatgcagtttatgcttttatttagtcgtcaaggaaaattgcgattacagaaatggtatgttgcacatccagataaattgaagaaaaaaattacaagggaattaattacaactattttggcaagaaaacctaaaatgtgtagctttttagaatggaaagatttgaaaatagtttacaaaaggtatgcaagtttatacttttgttgtgctattgagcaaaacgataatgaactgttaacattagaagtgattcatcgctatgtagaacttcttgacaaatactttggaagtgtttgtgagttggatatcatattcaactttgagaaagcatactttatccttgatgaactcttacttggaggcgagatacaggaaacaagtaaaaagaacgtcctgaaagctatagcggctcaggatctcctccaggaggaagaaacaccacaaggatttttcgaagatcacggtcttggataa

SEQ ID NO: 1547 - DNA, 1116 bp, Euschistus heros
atgaaagaaagtttgaaaaaatttcgagaagaagcacagaagttagagcagtctgaagctttacaaaaagcaagagcaaagtttcaaacagttgaatcagaagcatcgaaaggcagtgaagtttttaaggagaaattagatcacattaaagatagagtcagtgatgtgctagaggaggcagcaaaatcagaaataggaaaaaaagctggacagctgggagctgaaattggaaagactgcaaggggagctgctgaaactatatcagaaagagggcaacagattggaaaaagtggagcttttcaaaccattagccaaactgctgcagctgtaaagcaggaattagatcaaactggaatccatgctcatgtttatcagcccccacaaaaactaagaagaaggttggaaacaatgcccgataacaaaacattgaaacctgacacagagacattgggcatcgatcttcataaggattcaaaatttttccagagttggcagcaattcaaagacaataatgcttatatcaacaaagttcttgattggaaaatgaagtatgatgagagtgataatcctgttattcgggcttctcgagttttcactgataaggtttcaagtgttatgggtggcctttttcagaaaactgaactttctgaaactttaacagagatatgtagaatagatcccaattttgatagagctcatttcttgaaagattgtgagaaagacatcatcccaaatattcttgaagctatggtccgtggtgatttagatatattacgagactggtgtcatgaaggtccttataatattcttgctgctcctattaaacaagcaaaagatgcccattttaagttttgttctaaaattttagatattgataatgttgatttggtaatgggtaaagtaatggatcaagggccagtcttagttattagtttccaatctcagcaattactatgtatcaaagataaaaatggtaatattgttgaaggtgatccaaacaaggtgctgagagtaaattatgtttgggtgctttgtagagacccttcagaattggaccctaaggcagcatggcgtcttttggatatgtcagcacaaagcactgaacagttgttatga

SEQ ID NO: 1548 - DNA, 903 bp, Euschistus heros
atgaagagaccgacgtttagagagcttcagttggaagaacttgagaattatgaagaggagactgattcagatactgaggctcttcaagaagcttttgttaaaggggaactgaagccaggtcttaatataccagttaaagaaagaacaaaaactaataatgttcctcttctaaaggaagtattaaatgatatcaagttggatctgccttggattgagagattggatgtaactaatgatcaagcacctctggctccagaacttgcccttcagatcagagatgaagaaaaaggccataatccattagtttatgatgagcttaagagagaaagtgtattctaccgacaagctcagaatgctgcaatgaagattcttccaaaattgaaacaattaggtttgagaactgagagaccaggggattattttgctgaaatggctaaatcagatcagcacatgcaaaaggttaaaggcgaagctataaagaaaaaattaatgatggaaaggattgagaaattgagagaaatacgagcacagaagaaagttcaaaaagctctccatgcacaagctaaagttgccaaagtacaaaataaaaaagaaatgcttgatgaagtgaaaaagtatagaaaaggagagaccaaaagtttagcttttctagaaccaggctataaggcaaaaccaaaagccaataaatcacaaattaaacggcaacacaagaatgccaaatttggtcatggtggaaagaaaaggggagctaagaggaatacacgagacagcaccagtggtattgaaaggcgccagagcaaaccatcttttgccaattcagcaggaaaagggaaaaaagcgatgaaacagaaaaggcctggtaaaaatgctcgcctgaaacagaaatcaaggagaaagaattaa

SEQ ID NO: 1549 - DNA, 2550 bp, Euschistus heros
atggatgaagtgaagaaacttgagcacctttcgttggtgtcaaaaatatgcacagagcttgaaaaccatttagggctgaatgataaagatttagctgaatttattattgatttggcatcgaagaataacacatttgaaagcttcaagaaagccttattagataatgatgccgagttttcagattctttcatttccaacttattacgaatcattcagcatatgagacctaagaatgagccagttttgactaaagacttgactaaacaagacaaattgagtatgaagtttccaggactcgccatccctaatgacgttcaacagcctaagaaccataacaataaaaagttcaatttgtctgtaattaaagaagatcctgaagacaatgaagtcgaagatgccatggcagctcttgaagcgttagctccttctaatgaaaagaaattctctagcaaggttgaaagagcatcacattctccagaaaagattgttaaacaagaagtggaaaaacccagaaaaagaagtcgcagccgtagtagaaatagagacaggaagaggaatagaagtagaagtaggagtagaggaaggggtagaagtaaagagaaaacatacggtaaaagcaggcagaggagtgtgagtcgtggaagaagaaggaggagtagagacagaagttcaagtcgtaatagaaatcaggtgaagaactgggaaagagacaggagaggtaaaaatgatcgaagaagcagaagcaatggtaggaagagaaatgaaaggagtagaagcaggagcgttggtaaaaggaggaatgatagaagtagaagcaggagctatgatagaaaaaaaaatgataagaaaagggaaaacgatgatgagaagaataagtctgatgaaccactcgagccagaagttggaaaaatatataatgggaaagttacgaatattgtatcgtttggatgttttgttcaaatcgagggtttgaagagacgatgggaaggactcgttcatatatcgcaactgagaagagaaggaagagtaacgagtgcctctgatgtcgtttctcgtggaatgaaagtcatgatcaaagtattgtcggtggctggacaaaaggtatctctgtcaatgaaagatgtcgaccaagaaactggaaaagatctgaaccctaccgtccgacatgctatcaataaggacagggaagaagaagcttcgatgcgaaatcccgatcgccctacgacacttctagatttaggctcctttgatgaccatgatgactttcagagtagaaaaagggttaataggatatcttcacctgaaaaatgggaaatcaagcagatgttatctgcgagttgtattgataaaagtgaacttcctgattttgacgaagagactggcctgcttcccaaagaggctgccgaggaagaagatatcgaaatagaaattgttgaagaagaaccccctttcctccaggggcacggaaggaacttgcatgatcttagtcctgttaggatcgtgaagaatcccgatggttccctcgctcaggcagctatgatgcaaagtgcgcttgccaaagagaggcgtgaacaaaagatgttaaacagggaacaggagatggatcaaatgccgactggtttgaataaaaattggatcgacccccttcctgaaagtgatggaagagcattggctgcgaatatgcgaggaatcggacttactaaccaggatctgcctgaatggaaaaaacatgtgattggagggaaaaagagttcatttggtatgaagacaaatatgacacttttggaacagaggcaaagccttccaatttataaactgaaggaacagcttatcaaggcagttactgacaatcaaattttgattgttatcggtgaaacgggttcaggaaagacgactcaaatgactcagtatttggcagaagcaggtttcacttcgaggggaaaaataggttgtacgcaacctaggagagttgctgctatgtccgttgcaaaaagagtggcagaggaattcgggtgtcgcttaggtcaagaagtcggttatactattcgtttcgaggattgtaccagccctgaaacagtcattaaatacatgacagacggtatgttgcttcgagaatgcctcgtggacttggatctgaaaagttattcagttataatgttggatgaagcgcacgaaaggacaatacatacagatgtactgtttggacttttaaagcaagctgttcaaaaaagatctgaattaaagttgatcgttacatcagctactttagatgctgtcaagttctcacagtatttcttcgaagcccctatattcaccattccaggccgaacgttccctgtcgaagtgctgtatacaaaagaacccgagacagactacttagacgcatcgctcataactgtaatgcaaatacatttaagagaaccgcctggtgatattttgttatttcttacaggtcaggaagaaatcgatacagcctgtgaaatattgtacgagagaatgaaatcgctaggtcccgatgtaccagagctcattattctaccagtttattct

SEQ ID NO: 1550 - DNA, 1998 bp, Euschistus heros
atgaatacaggaccaggaggaccaaattaccccatggcatctttatacgttggtgatctgcattcagacgttactgaagcgatgctatttgaaaaattttcatcagcaggacccgtactttctattagagtttgcagagatatgatcacacgacgttcattaggttatgcatatgtcaatttccaacaacctgcagatgctgaaagagctttggatacaatgaattttgacaacctaaagggtcgtccaattcgaataatgtggtcacaacgtgatccttcccttagaaaatctggtgtgggcaatgtctttattaagaacttggacaaaagtatcgataacaaggctatgtatgacactttctcagcttttggcaatattctcagttgcaaagtggcacaagatgaaaatggagtctcaaaaggttatggttttgtccattttgaaaccgaggaagctgccactaagtctattgataaagtaaatggaatgttgctcaacggtaaaaaggtttttgttggcaagttcatccctaggaaagaacgtgaaaaggaattaggtgaaaaagccaaactgttcactaatgtatatgttaaaaacttcggagaagactttactgatgatatgctcaaggaaatgttcgagaagtatggaccaattaccagtcatactgttgttgttaacaaagatggaaagtctcgtggttttgggtttgttgcttttgaagacccggaagctgctgaaagagcagttgaagatctaaatggaaaagagcttattgaaggaaaaccattatatgttgggagagcacaaaaaaaagctgagcgccaacaagaacttaaacgaaaatttgaacaacttaaaatggagcgtatgaaccgttatcagggtgtcaacttatatgttaaaaatttggacgatactatagatgatgaaagattaagaaaagaattctctccctttggaaccatcactagtgcaaaggtaatgttagaagaagggcgtagtaaaggatttggttttgtatgtttttcatctcctgaagaagctactaaagctgtaactgaaatgaatggtcgtatcgttggaactaagcctttgtacgttgctcttgcccaacgtaaagaagatcgcaaagctcatttagcatctcaatatatgcaaagaatggctaatatgcgtatgcagcagatgggacagatctttcctactggtggtactggaggctactttgttcctactctgccacagccgcaaagattttttggaccagctcaaatggcgcagatgcgtcctcagcctcgttggccagcacaacctcaagtcagacccagcacgcaagccactgcatcaggttttcccaatatgcaaggcccattcagaagtggaccacgaggcccaggtgctgcaggcggtggtggtggcccaggaagtgccgccgctgctgctgcggctatgcgctcctccatcagtgctgctgctgcagcggtggctgcggctggccgcccgacagccaatgcagctgctgcagccgccgctgctgctgccaacccagctgttgcccggcaattggcccaaggagcttctcaaggtgctccagtatctgtgtctgctcaaggtcgtcctgcaaattacaaatataccgcaaacatgcgaaaccccccacaaatgggaggtggggctggagcaggtgctggaggtcctccgcaacaagcattacacatccaaggacaagaaccccttaccgcaagtatgttatcatcagcgaatccccaggaacagaaacaaatgcttggagaaagactcttcccacttatcagaagtatgtatcccgatcttgctgggaagattacaggaatgttgttagaaatagataactcagaattgttacacatgctcgaacatcacgagtccctcaaggccaaggttgaagaggctgtggctgtactacaggcccaccaagctaagcaagctgctgcatctgtcaaaaaagaataa

SEQ ID NO: 1551 - DNA, 2739 bp, Euschistus heros
atgacggactcaaagtattttacgaccaccaaaaaaggtgaaattttcgaattaagatctgaattgaacagtgataagaaagagaaaaaacgagaagctgttaaaaaggtcattgcctctatgactgttgggaaagatgtgtcagctctttttcctgatgtcgttaattgtatgcaaactgataatttagaacttaaaaaattagtttatttatatttaatgaactatgcaaagagtcaacctgacatggcgataatggctgtcaacacctttgtaaaagattgtgaagatgcaaatccacttataagagcccttgccgtaaggacaatgggttgcattagagttgataaaataactgaatatctttgtgaacccctcaggaaatgtcttaaagatgaggatccttatgttagaaaaacagctgcagtatgtgttgcgaaattatatgacattaatccgcagcttgttgaagaccaaggttttcttgatcagcttaaagaacttttatctgattccaacccaatggttgtagcaaatgctgttgcagcattgtctgaaatgaatgaagcctcagttaatggtgcacctctcattgaaatgtctgctgcgactattaacaagcttcttactgctcttaatgagtgcacagagtgggggcaagtcttcatattagattcactggccaattacagtcctaaagatgaaagagaagctcaaagtatttgtgaacgtattacaccacgactggctcatgccaatgctgctgttgttttatctgcagtgaaagttctgatgaagtttttagaaatgttaccatctgattctgaattcgtatcaactttgacgaagaagctcgctcccccattagtcactctactctcatctgaaccagaggtccaatatgttgcattgagaaacataaatttgattgtacaaaaacggccagatatccttaaacaggaaatgaaagttttctttgtgaaatataatgatcctatttatgttaaattggaaaaactggatattatgatccggctggcttctcaagctaatatagctcaagtgctttctgaattaaaagagtatgcaacagaagttgatgtagattttgtgaggaaagctgtccgagccattggtcgttgcgctataaaagttgaacaatctgcagaacgttgtgtttccactcttctggacttaatccacaccaaggtgaattatgttgtacaagaagccattgttgtcataaaagatatattcaggaaataccccaataaatatgaaagtattatttcaacattatgtgaaaatttagatactttagatgagcctgaagcaagggcttcaatgatttggatcgttggagaatatgctgaaagaatcgacaatgcagatgaattattggaatcatttttggaaggtttccacgatgagaatacacaggttcaacttcagctacttacggctattgttaaactgtttttgaagaggcctacgcatacacaagaacttgtacaacaggtgttgagcctagctactcaggattctgacaatcctgacctccgagacagaggatttatctactggaggctgctatcaactgatcctggtgctgcaaaggaagttgtcttagccgagaaaccactaatttcagaggaaactgatcttcttgaaccaactctcttagatgagcttatatgtcatatttcttcacttgcctctgtttatcacaagccacctactgcttttgtcgaaggtagagctggtttgaggaaatccctaccagcaagatctggatctgctgaagtggttcaagaaactcctggtgctcaagtcattccatcacaagattcactgattggggacctcctatccatggatataggcggggtttcagctcctcctccacctccaacgacatctgctcctgttgacctcttggggctggattctcttcttggaggggtccctgaacctacagtatcacagagtactactggattgctcggtgatatattcggtttaggatcagctggaccgacaacatattctccaccaaaaaccatgtggctctccagtgaaaggggtaaaggttgtgaaatatcaggaactttttcacgaaggaatggacaaatccaaatggatttgacaattgtaaataaagctatgcagccaatgaccggctttgccatacaattgaataagaacagttttggtgtgactccagcaagagcactacaagttttgagcccgttaccacctggcacatcacatgactgctcattgcctttagttactaccggagctgttcaaagaatggatccattaactaatcttcaggttgccatcaaaaacaatattgatgttttctactttgcttgcattatcccgatgcatgtatttttcaccgaagatggacaaatggataagcgggtattcctggctacttggaaggacattccagctcaaaatgaagtacaatacacacttaccaatgttcagtctaatgcagatatggttgtccaaaaaatgcaagaaaacaacatttttactattgcaaaacgaaatgttgaaggacaggatatgttatatcaatcagttaaactgactaatggtatttgggtactcattgaacttaaaatacaaccaggaaatccaaatattactctttctttgaaatcaagagcacttgatatagctgctggcatattccaggtatacgatgccattcttcattcttaa

SEQ ID NO: 1552 - DNA, 498 bp, Euschistus heros
atgcctccaaagtttgatcctaacgaagtaaaaactgttttcttgaggtgtgttggtggtgaagttggagctacatcttctcttgctcccaaaattggacctcttggtttgtctcctaaaaaggtgggtgatgatattgctaaagccacagcagattggaagggtctgaaaattacagtttgtctcacaattcaaaacagacaagctgctatttctgtagtaccttctgcagcttcacttataatcaaggctctcaaagaaccaccgagggacaggaagaaagtcaaaggagtaaaacataatggtaacctcacttttgatgaaatcctcagcatcgccagatcaatgagaccaaggtccatgtcaaggaaacttgagggtaccgtaaaagaaattcttggtacatgtcagtctgttggttgcacagtagatggaaaaacaccttcagaggttatcagccaaataaatgatggagaaatcgatgttgcagatgaataa

SEQ ID NO: 1553 - DNA, 1110 bp, Euschistus heros
atgtgtggagatgaacccaaattaggagaaatgaaggctctgattttagtcggagggtatggaactagacttagacccctgacactaagcaggcctaagccgcttgttgaatttgcaaacaaaccaatgctaatccatcagatagaagcattagttgaagccggcgtgactgaagttgttttagccgtgtcatatagagcggaacaaatggaaaaagaattgagtgaggaagctaaaaaattgggtgttaaattgattttttcccatgaaacagaacctcttggtacagctggacctctcgctcttgccaaagatattctaacatcgagtaatgaaccattttttgttctcaattccgatattatttgtgaattcccattcaaagagcttgtttcttttcataaaaaccatgggaaagaaggtactattgtagtgacaaaagttgaagaaccttcgaagtatggtgttgttgtttatgatgaaaaaggttgtattgccagttttatcgaaaagccacaagaatttgtttcaaataagataaacgctggcatgtacattctcaatccttcggtcttaggaagaatcaaactagagccaactagtattgagaaggaagttttcccgtttatggctgaagaaggggagttgtatgctatggagttgaaaggattttggatggacgtaggacagcctcaagattttctcacaggcatgtgcttgtatcttacatctctacgtcagaaagcccctgaaaagttatactctggccctggatgcatcggtaatgttttgattcatcctaccgctcgaataggttctggctgttcgatcggaccgaatgtaacactcggtccaggagtcgtcgttgaagatggcgtgtgtataaaaaaatgcacagttctagagaatgccactatcaagtcgcactcatggctctccggctgtatagtcggttggaaatccgttgtaggacaatgggttcgaatggaaaacaccacagtccttggagagaatgtaaatattaaagatgaactctatgtcaacggaggccaagttcttcctcacaagagcatcgctaagtctgttcaagatccacagattataatgtaa

SEQ ID NO: 1554 - DNA, 864 bp, Euschistus heros
atgactttggacggtgaagaaactatatcggatcaagaaaaggtgcgaatcgtttctaattttatattacattcgccaccgggagagtttaacgaagtttttaatgatgcaaggatattattaaacaacgatacccttttgaaagaaggagctctcggtgtcttcgggcagtactgcaaagaccaacttacgcccgtgaagattaagaacagtgagtatccagttttgattaccgaacataatgatctaggatccaacaggttttatgatgcaaggagtaaacagtcgtttaaatatgatcctttaaggagagagacctctaattatgattcctgggaggcagaaccaggtactgaaaagtggcgatcagcattagaggttgaattagatgcatatatagctaaacattttgaaagtggttcaggtagtgtattttctaaaagggaagatggaaaggtaagcttggttgcctgtatagaagcccatttatttcagccgaaaaactgctggaatggttgttggcgatctcaatggtttgtcacgatagattcagataatgctgatgtgaaaggtgttctgaaaattcaggttcattattacgaagatggcaatgtgcagcttgtcagtttgaaagatattaatcaatcactccaggttgcggatgaacaacagttaagtaaggctttaattaaaatattcgaagactctgaaacagagtatcaacaagcaatatctgaaaactaccatacgatgtcagacactacttttaaagctttaagaaggcagttacctgttactcgttcaaaaatagattggaataagatggtgtcttacagcattgccaaagaactcaaaccccagtga

SEQ ID NO: 1555 - DNA, 3804 bp, Euschistus heros
atggaggtgggattgctgttggtgatccttgtcgggcttgtggccagcaaagaggtcaaccaagtgagtgagaagttagtccgtccctttagcaggtatcccactagattgcgtgggttcgccaatgggctacagccaaatgcggatgatgatcgagtggcaccctccactgatcaaccgaacattccgtacgtgataacggaagatcggctaaagaagattagatcgaacttattgtactggttttttgaccaagatcttgagggaggttatggagacctgcagaaggatataacaccatcaattacacaagttcataagaatttaaattttcaacttccattttttggatttcgattcaattacacaagagtatcactaaacggctatttggaattcagtgatccaccagaacaatattcgtatcctttgactttcccaaccgtagaatggcctcgtaaaaacgatccttcatttattggaatattctacagtaaatgcaggattgggcagttgggtgtcaatgatgtggaccaaagagaacctggagtttattttaggatggaaagggatttgatgacaagaaaagacaagttcggagtagaaatgagggagaggctaaagtgggacatacgagagagtgttgttggttccgattcatttgaacctaagcatgctgttattgtcacgtggaaaaatgtctcatttgccggtggaattgaaaactctgttaaaactacaaactcattccaattggttcttgcaacagatgaagttttcgcttatgccatattcaattatgttcaaattaagtggactacacacactgaagcacgaggagacactgttggaggggaaggaggtattccagcattcattggctttaacgcaggaaatggtacgaggtcttacgaatatagaccatactcacagacatccactatcagagatctggttggccgtggttgggctaatggtttccctggaagacacatttttagaattgacgaaaatatcctccctggaacgtgtaacaaggatattgctgcagcaagtttgcctctatcatttgcacctgaaagtggtaacatgcttggtggtaccattgtcaatatcacaggaccatgtttcgaaccaactatgaagatcgtatgcagatttgacatgaaatcagtttttgggacagttgtggacaggaacagggccatttgtgtacaacctttcgtgatggcagagggttacatattgtttgacattgctattgatgatgggaagtacatttggaaagggcaatatttcatagaaacacccgcaacagctgctgaaaaaatatcttttgctgacaatagtgttcatcaaaaatatcctccggaagtcagaataacatggaaccagaataatttaactacaaatttagctgctccggtgcaaatatcaatttggggatacagagaaaaatcgactcgcacagagctgcactatatagattctttagacgtgggggttcctaacaacgggcagtactcaatcattccaggaacttacaaaaatcgtgataacagttttttcagtgatatgacttttggattcatacaaatcaacctgacaactgcaatggattacaatggacttaaagttacaccagttatctggagcaaaccaatacctttaggctggtactttgccccacaatgggaaagacaactcggtaaaaactggccggaagggaaatgtaataattggattatgaatgatagatatttgaaaaacttcgctgctgaactgagcatatgcccttgtaaactagaacaagcacttgctgacaaaggaaaattcatgccagattttgactgcgatatggatgccaatccacactgcttttaccacgaaggtgctaggcattgcgtaaaaactggagctcccagacaagaaggagctgaacaacaatgctgctatgacaaaaacaattatttgatgctttcctatgaccagcagtggggctcatcgccaaagaggtgcagtaatttaggaatcttgccatggaatgaagcaaacaaggttccaacattgtcacaatggtaccatgatatctcgccattttatcattgttgtttatggcaatttgaacaatcagttggttgtgaaacctttaggttcgaaagaaggccttctcaggattgcgttggctaccaatctccttatattgcaactgtttttggagacccacatttcattacatttgatggtttggagtatactttcaatggcaaaggagagtttgtgctactgcacactgattctgaaaggtttaagctagacgttcaagcaaggttcgagcaagtaggaaaaaacatttatggcgatgtggcagcaactcagttgacatctatagcagcaagagataatacttcaagcatcattgaagtaaggcttagaccaaaggaggcacaatggagatacagactagatgtctttgcaaataagaaaaggatatattttgacaggccatctcttcgtgtacagcactttacaggtgtcacagtttaccaaccttcacatgtacttaatcagtccgaaatcattatgatgtttcaatcaggtgttggagtagaagttgttgaaaataaaggatacatggctgcaagggtttatttgccctgggaatatataaacagaacaagaggcctgtttggaaattggagtttcgatccatctaatgatttcactcttcctgatgggactgtggtcagtgctgaaaacctcaatgacttcgagagaatacacaagcaattcgcaatttactggagattagaggacaatgttgaacccaataaaggtgaacctctctttgttagagaatatggaagaacttcaagttattatttgaatagaacatttgttccagtatggaaatcaactcctcaagaaattattcctcctaacaggaccaaagatatacaacaagccttggcactttgtggtgaatcttaccaatgcagatatgattatgctgtcactttaaatagggaaatggccttttatactctgaattattatagtgaatacactcaattaagacaaacaaataaagaaagagttttgtcttgtggagtgttagaaacaccaagatttgggcgaaaatccaactttttctttgttcctgattccaaagttatatttgaatgtgatcaaggatatattctagtgggagatccaaggcgaacatgttcttcttcaggaagatggtcatttgagtatggatacacggaatgtctacggtatatcgaatatgatgcacaacaaattgcaaagactgtgatggttattggactgatcttggtacctctaattatgattgtaatatgcgctgcagtatacataattaagaaagccaaaggagatagttcacaagcttcctggaaattttccaaagtttattccgccccttcaagctcatacataccagctaaaacacatccctctcaagatcctcatcaggcttcagcacccttcatgaaaaatgatgatagtagccctgacactacaagaagtattggatatcctggtcattcaaacatgtctcttgataaaagtcaaggattaaagccaatactatctttgccatatgacaaaacatattacactcatgaaccattgcgaaatagacctccaattgactttgaagattatgaagaagaaggagtacaactttcaggagatttcaatgatcgtaatgatgccccaactttgaaagtcaaagatgattttagaaggcacaatagtgttgaaacagatatcttctga

SEQ ID NO: 1556 - DNA, 342 bp, Euschistus heros
atgcgttacgtggcagcttatctactctcttcccttggtggaaaagaatctccatcagcagctgatattgacaagatattaagctctgttgggattgagtctgattcagaacgagtgaacaaagtaatatcagagcttaaaggcaagaatgttgaggaagttattgctgcaggtaaagagaagttagcttcagtaccatcaggaggtggtggagcacctgccgcagctgctgctgcccccgctgcagcctcacctgctaaagcagctgaggaaaagaaggaggcaaagaaagaagaatccgaccagtcggatgatgatatgggctttggtctctttgactaa

SEQ ID NO: 1557 - DNA, 2748 bp, Euschistus heros
atggtcgtgatgatgtctgatcatattggtggaattacccttaaatgggatcccaaaaacctagaaatacgaacgttgtcagtggaaaaaactttagaaccacttgtcttacaggtgacaacacttgtaaataccaaagggcctagtaagaagaaaaagggtaggtcaaagcgagctcatgttttggttgctgctgttgaaaaagccactgaaaactttattgagaaaggtgaaatgatagcttatgaaaaccctgatataaaacaagaaatgctttctgctgttgaagaagtgagaaaaacaggtgaagcaatgagtgcagctgctagagaatttgctgatgacccatgctcatcgataaaacgtggtaatatggtaagagcagcacgaaatctgctctcagctgtgacaagactattaattctagctgatatggttgatgtacatctgttgttgaaatctcttagagttgttgaagatgatcttgttaaagttaaaaatgcatcaagtcagcctgaactgcttgaaaatattaaagcatttggacgtaatgcttcggagttaatgtcacaggctgcgaaacgacaacttgagctgaaggattcacaattaagggatgatttagctgcggcacgtgctgtattgaagaaacattctaccatgctacttactgcttcaaaggtctatgtcagacaccctgaacttgctgctgcaaaggcaaatcgtgattatgttttcaaacaagtttgtgaagctgtcaatactatcagtgatgtagctcaaggtaaaggaccatccatcactaccaacccctatgaaggccccggtgagcttgcagccgctctcgatgattttgatgaacgcatggtgatggagcctctggcctattctgaagtagctacaagaccttctcttgaagaaaggttagaaagtattattagtggtgccgcactcatggcagactcttcttgtactagggatgagcggagggagcgcattgttgctgaatgtaatgctgtacgtcaagctcttcaagatcttctgtcagaatacatggctaatatgagtgttaaagaacaaagtgaaggtctggagagagccatcgatcatatgtgtcgtaagaccagggatttacgtagacaattaaggaaggcggttgttgaccatgtttctgatagctttcttgagaccagtgttcctctgctagttttaattgaagctgctagagcgggtaatgagaaagatgtcgaagagtatgcccttgtttttcaggaacatgctaataaacttgttgaggtcgccaatttagcatgttctatgtctggaaatgaggatggggtgaaaatggtgcgttatgctgctgctcaaattgatgctctttgcccacaagtcattaatgcagctcgtatacttggagctaggcctaaatcgaaagtcgcacaggaaaacatggatgttttcagagattcgtgggagtcacaagttcgagtactaactgaagccgtagatgatataacaactattgatgacttcttagctgtttctgagaaccacatcctagaagatgttaacaaatgtgttatggccttacaagaaggagatggagattctttagacaggacagctggtgcaattaggggtcgttcagctcgtgtagccaatgttgttactgctgaaatggacaactatgaaccaggaatctacacagaaagagttctagaagcaattaaagttcttagggagcaggtgatgccaaattttgctcaaagagtggaagttgctgtagatgctctttcttcaaatccacctaaagatgttgatgaaaatgagtttattgatgcctctcgtttggtgtatgatggtgttagagaaattcgaagagctgttctcatgaacaggagttcagaagagttagacactgatacggaattcgaaccatgtgaggacaacatgactattgatacgaagaatagacctagtgcacatactgccgatcatggtgttgatgagtatcctgaaatcagtggtattactactgctagggaagccatgcgtaagatgactgaagaagacaagcagaagattgcccaacaggttgaatatttcagaacagagaaattgaaatttgacagagaagtagccaaatgggatgatactggaaatgatataattgtcttggcgaaacatatgtgcatgataatgatggaaatgacagattttaccagaggtcgaggaccattgaaaacaacaatggatgtcatcaatgctgcaaagaaaatctccgaggctggaactaaattggataaattaaccagacagattgccgatcagtgccctgaatcatctaccaagaaagatctgttggcctatcttcaacgaatcgcgctgtattgtcatcaattaaacataacttcaaaagtgaaagctgatgttcaaaacataagtggtgaactcatagtttcagggcttgacagtgcaacttcccttatccaagctgctaaaaatttgatgaatgctgtagtattaacagtgaagtcatcttatgtggcaagcactaaatacccgcggcaaggaacagtttcatctcccattgttgtttggaagatgaaagctccagaaaagaaacctcttgtgaggccagaaaaaccagaagaggttaaagctaaagtgaggaagggttcgcagaagaaaattcagaaccctataaaggcactttcagagtttcagagccccgcggagtctgtttaa

SEQ ID NO: 1558 - DNA, 1242 bp, Euschistus heros
atgaacgacaataatcttcaatctactccgaaaaccaatgccagcagcagtttctttcaaaccaacacgccaaaaccagcgtccaatgttagttttggttctactatgtccactaatcaaactcaaggcacaggatttttaaattttacgcctccagtgggaacttctaaacagtctacaatgtttatgccacctgcatctttaactaatacaagtactccaaaaactacagcaacaggtaatgcaacattgtttaatattacaactacagcagcaactcctgcttcagttcctggtggtgcagttacaacttcatttactcttggtagttcttcatcattaactacttctcagcagttcaaaccaccttccacatctcaaccaatacaattaaaaacttctaccccaggtgcctctatgccattaggtactggtttatcatctacaggaggaaatgctccaccaactggcctgaattttggatctgctcctaaatcaactaattctggatctactatcttcagttcaacaaaaagttcactcccagcttctaatgctgttacaacctcatctttaacattaactccttcttctaccacttctcttaccaattcattatctaacaaacctgttactagcactggggctacaacctcccagcaacaaagccttacatttcaacaattagaagaattgattcttaataaatggactgcagaattgtatgaacaggaaaaggtattcttaaatcaagctacacagattaatatttgggataaggttattaatgaaaatgctgaaaaattaactcagttgcattctactatggaaaaagtacggaagcaacaaacaaaaataaatgatgacctagagatcatatctacacatcaaaaagacttggaagcctgtcttgtgcccatggagaaggaagacttgttatcagttcttaaagctgatccaaataggaaaaatctttatataaatgccaaaaaaattgattctcagatcaaaactatgtctgaggatttgaaggaaacaattgaacatattaatgaaacttcacgatctcatgatacagaagatcctgtcattcaggtagggcgaattttaaatgctcatatggaatctttaagatggattgatgaacatactgcaagaatgcaagattattttgattccttattaaaaatgcatgatgacctgaggagagaatgtgaaataagcaaacatgatgtatactga

SEQ ID NO: 1559 - DNA, 582 bp, Euschistus heros
atgttcatttgggattggtttacaggagttttaggctatttaggtttatggaagaagtcaggcaaactgttgtttttaggattagataatgctggtaaaacaactcttctccataggttaaaagatgacagattggcccagcatgtgccaacattgcacccaacttctgaagaactatccataggaaatatcagatttactacttttgaccttggagggcacactcaagctcgtcgagtatggaaagattactttccggcagttgacgctattgtttttcttgttgacgcttgtgacacaagtcgattgcccgaaagtaaagcagaattagatgcactcttgactgatgagagtctcatcaactgtccagtcctcatccttggcaataaaattgatcttccaggtgcagcttcagaagatgatctcaggaattttttcaatctatatggacagaccactggcaagagcaaagttccacgaagtgaattgtctggtcgtccattagaacttttcatgtgctcagttctgaaaaggcagggttatggtgaaggtttccgttggttagcccaatatatagactga

SEQ ID NO: 1560 - DNA, 1785 bp, Euschistus heros
atggctgaaaacaatatttatgatgaaatgatcctcaccgttacatcggagaagttttacatcgagcctattgaagatgttgataacaatcttgtcctggacaggttgactggaaatataacatcaaatgtttcaagaaacagtggagatgcaccaataatcggagaaaaaaaacctatttatggaataattggtatcattaggctactagctggccaatacctggttgtggtaactggcagaacaaaaattggtaatatatggaggaaagaaattttccagatgggctcagctgaagtgatatgtatttcaagaagtattactcatttgaatgatatgcaaaaaaagattgaaaaggaatatgtatcgatgctggaatccattctttctacacccaatttttatttttcatattcctatgacctttctcatactgtccagaggctgcataatatttcacctgatttcttgaaaatgcccatgtatcagagggcagaacagaagtttgtatggaatgaatatcttttatctgaattgtccaaaaactgtgcagactctagattttgtcttccagttattcatggttatctttcaattacttcttgcattttaaatggtaaaaccttcagtctgatcttagtctccagaagatctaaggaaagagctggaaccagattgtttactaggggtattgactcagatggaaatgttgcaaactttgttgagacagaacagattgtcgagacaaaatttgagcgtgctagttttgtccagacacgaggctctatgccattcttctggcaacaataccctaatctaaaactgaaaccacggcctgttatacaagaggaaaatcatactgctgccttcactaagcacttcaatacccagataatggattatggaaggcaagttatagtgaatttggttgaccattctggatctgagggaaagctagaagagttatatagaaagttagtaaatgaagcaaatattgcagatctaaagtacgaagctttcgatttccatagggaatgttctaaactacgttatgataggttaaaaattctcattgaccgcctggcctatgatttagaacagatgtcagtgacaatgattgttggaaatgggactgttgtatctcagcaggaaggtgtatttaggacaaattgtattgactgcttggacaggactaatgttgtccagtcaatgttggctagggtcaatctctcttatgttttacaaaagctttcaatattgaagaaaggagaaacagtagaagatcaagttcaacttgagaaagtgtttaaactactctggagtgaccatgcagatctaatatcaacccagtattctggaactggggcattaaaaacagattatacaagaacaggaaaaagaaccacagctggaattgttcaagatgggataaactcgcttgtacgatattacataaataattttcagcatggttttcgtaaggatgcattagatctttggcttggtcattatcgggtttcttctgaagaagggattgtgatcaaaagccccattggtgtcaaaagagaattcaagtataaagcttttccactcatcctactcgttgctgttgctatattcttcgcaaacctggtcactgcaaatgaatatactacaggtactctcctgtctctcatattctggttctcaatggtatcagctactgttatggttatattttacaatggatcagaatatgtaaattgcccaagactgtgtccccttcttaggtcgccatctgtctag

SEQ ID NO: 1561 - DNA, 1551 bp, Euschistus heros
atgtctccaactgtcccaaccaccacaaacgttgttgacaagagaccaacacttgtcaaaccacactctgctgaaagaagatcagaattagtttgtcgtgtaaagtactgcaacactttgcctgatattccatttgatccaaagtttattcaatatccatttgaatctactcgatttattcaatataatcctacatcacttgaacgcaattataaatatgaagttctcactgaacatgatctcggggttactattgatctcattaacaaagatatgtatgctgctgatcataatgctgttcttgatcctgctgatgagaaattacttgaggaagatatccttgcacctcatgattctaaaaggtccaggcatcattctcgagcagtttcatggcttcgtaggacagaatatatttccacagaacaaacacgtttccaacctcaagttatggataaagttgaagccaaagttggatttagcattaagaaaagtcttaaggaagaaactctgtacatggatagggaaagccaaattaaagctattgaaaagacatatgatgatgctaaactacctatagagaaacatcatagcaaaccaaatgttgttccagttgaaattcttcccgtttttccagatttccagttgtggaagtatccttgtgctcaggttatgtttgattcagaccctgcacctataggaaagactgttcccgctcagttagaacaaatgtcacaagctatgattcggggtgtcatggatgaaagcggagaacagtttgtagcttatttcttgcctactgattcaactttagaaaagcgcaggagagattttacaaacggtattgattatgaagacgaggaggaatatgattacaaaatagccagagagtataattggaatgtaaaaacaaaagcttcaaaaggatacgaagagaattatttctttgtcattaggcatgatggtgtttattacaatgaattagaaactagagtacggttgagtaaaaggagacagaaggctggaactgctccaaataatactagattagttgttagacatagaccaatggatgctaatgaatttaacattcaccgtctaagggagaaacaacttcaacatccagtggaagaagaagatgaagaagaaagcgctggtgaagaagataagaaggaggaagaaaaaaagacaaacagcaaagattccgatgagagtgacaaagaggagggtagtagtgagaaggagggaagtgacaaagatgaaggaagtggtaaggaagatggaagtggaaaagaagatggtagtggcaaagaaaataatagtgacaaagatgaagcaagtgacaaagaagctgagagtgaagcttctgataaagaggatagtgacaaagaagccagcgataaagatgataaagaagaaagtggaaaagaaagaggtagtggtagtgaaaaaagtggagatgaaagtgaagcagagtcgagtgcttcaggtggaggaagttctcgaagttctgcaagtggttccagtaagtctggaagcgaggaagaagattaa

SEQ ID NO: 1562 - DNA, 1203 bp, Euschistus heros
atggataacgaaggagttacaccagcatatatgaagctctcccagattaaatttgctttaagtcttccagagtatcagggagatgttgccttaaaagaagaacttctcaatggtattaaagcaggaaatatggcaccatactatcgtgaggtttgcaatgaccttgggtgggtaatggatgaaagtttgtgtgcacatatggtgaaaaataatgaactaaggcttgcagaattagagaaagaacatgagaattcagttattgaagatgaagagcaagtgagtggtctatggcaggcaaaactagactatttgtgtagtattggagacaaagaaaatgctactacattagcaaatagtaagctacaagataaaactgtgcctaagactcatcgtattgatgctgttttcgccctgtttaggatatcatatttccatggttgtgacattaaagggatgtctgcagcgattgaaaaagctactgaattgatagaaggccaaggtgattggagttcaagaaataaattgaaagcttatgaaggagtgtggagttttgcagttagagactatttgcgggctgccaaactatttgttgatgtagtaccaacatttgaatcttatgaacttgctgactttggaacaattattaaatatactgtactttcatgtatgatagcattaccgaggtgtgaattaaagaagaagcttatgcaccatggtgtaatggctcaggctcttcactctcagtaccgtaacttaaaggagtatttccagtccctttatgatggtcactatgcagatttcctagtcgctctggcacaagtagaatctgatatgaaacgggaccctctgctacatccccattaccgccactatgtgcaggaaatgaggcttagagcctataaacaaatcttacaagcgtatcgctcactgtctttagactatatggcagaagcatttggcgtctcctgtgaattcatcgaacgggaggtagccaaatttgctgcttcaggccgtctccaatgtaaaattgattccgtggctcgttctgtaattacaagtgtccatctcagtgatgaagctctccgtgtaaaggattcgtcagatctcgaccttgaccgctctctcttatataagaccactgttaagaggggtgatattctgcttaataggctgaaaaagttagctagggttatggatttttag

SEQ ID NO: 1563 - DNA, 3981 bp, Euschistus heros
atgtcttctattacactatctcacttccaaaagagacctcgatatgcagactttggtaggaaacggggtgccaaaacgaaaatgagaggaatatttggtgtacccgggcttggtttacagagacctttaatggattcaaataccaaacctgaagatgaacctggacttgaaaataagttggttcttgtatcatctcgtgacaaatacgtgttaagtcaagatgtttgtgttatgtgtggtgctttagggcaagaccaggaagcatgtcttattgcctgtgcacagtgtgggcagtcgtatcatccctactgtgtatcagttaaggttaccaaagtaatgcttcagcgtggctggagatgccttgattgtacagtatgtgaaggctgtggccaaaaaaacgatgaagggcggttgatactttgcgatgattgtgacatttcttaccacatctattgcatggacccaccactcggttccgtaccttctggtgtttggaagtgcaagtggtgtgcccattgccagacttgtggatccaacagtccgggtcctaatgcagtatggcaggctaactttacccagtgcggtccttgtttttcaagaactacttgtcccgcttgcctagagctttatacagacggtgatctcataataaagtgtattcactgtgataggtggttacattgcctctgtgatacaatatctaatgaaaacgaagcagaagcgtgctgtgcgcaaggttatacttgccttctctgcaggccaagtcatgtggctttggtgttacctgcaacaaccccatcgagagctccatcgcctgaaattaatacagagagtaaagctacagactactatgtagacggcgtttgcttatctgaaactgggctgcaattaatcaaaactctttcgatggataatggaaatcaaccagtgagacgtaaaagaccagggttccggaggcaagatccttcccttgagctagttgatgacatggataatgaagggaaagagactctctataaggacggcatgttttggggttctaaagaaaatggaccaattccaagcccacctgaaggtttcacgctgtatacaagggaaagtggaatcgttgttctgaaaagattaaaaaagagaaatcttcaaaggcttggcattggcggtttcactactgtcaaaatgaggagcactagattaaaagaagatgacgagcatctgtatcctgaagaaaagcccaggagaaaacctagagttcctaagaagaaaagcaaaattgccgaaagttatccacgacaccttcaggaagctttctttggcaaggaattacttgatacaactatggaaacttcacaaaaattagagagcactggagatgaatcagacgatggaaaattaagggaggaagaaggtagtgatggcgagacgttgaaggatattcttcatcttcctgaaaatcttcttcacaacgatctagtcaacacgatcatgaatgaaagtgcagatagtatcaaatcagaaaatctaatgtcagagagtggacacgaaggtagcggaagccaaaaagacgaactatgtgatattcttggacctcattttagtatagaatcaatggttagggaaacaggtcttccaaatatggattccaaagatgttgaagaaattttcaaaaaagttcttacggacgagagccgaaatcagggccaccataatcaagcttcccctcagcaacagcatcctgctgcgaaaagtacaccagcagcattggcttcttctcctctgcagtatccatcagcttctccgtataactctgaatatagcaatagccctcagttcagtccggaaagttcttgggatgatcttggctcttataatagaactacatcattaaaaatggaagcagacgaatcactcggaagagacgcgaccatatctcctgtactttatgctaacatcaaccatccagagtggaaaaaagaattccccagttggaatgaacgctttaaacaaattctaaaaaagtggcgtgcgctaccctctgaagaaaaggctccttatcttcaacgagctagggataacagagctaacttccgcagtaggaagcaggagcatgacaaaacattgaatacaaaatcttgccgggaagctgaacaagaacgacagtggaaagagttacaggctctaaggcagcaacaacaacacatgctgtctcaaaccagggttcagcaagtgaaccgtgtccgccaagttggcaatacagggcttgtacaattttcaactactgagcaacccccttctccccatttgactcaacaattacaggtttcaacttcgtctcaggaggctagccttggtggcttaggatcacctagagctcaatttgcttctggtactggtggcactgtgaaggtggcgacacctggtggtggtaccactatttacagacaggtgcgaccacctcagtcaccttttccaagcccgagcccgaggcaaccatcaaccccgcaacagcaacagcaggaggaagtgagacagctgagggatctgttgcagaggcatcaagttaaacaagaaggaacggaaactgtcttgtctggaggtgttctccaaggagtacaaatgagacctcagcctcctaggagcagccttcacccacaggctgtgcacggcatggaaccgagggttagactagtggtacaacaacaaccctcaaggtttccaggaaccacccaagtaagattggctgctcctagggcgcaactccaagaccagtttctcatacaacggcagttcgctgcagccgctgccgctcaacatgctcataatgcaagtgcaataattaggaatagtagtaatttagttgaacaaacgaggctgcaatctatacctgtcgaccaaaggatccaaactggaggccgagaaggagaggaaataccagaaagtgttaccgcggaattagaaaagttggaagaagaaggaggtacaattggtggtgaagccgacgaggtttctgcaattttctctggtcttgtggaagatgatgatgaacttctcgcggaaatgggtccggatttcaatattcttgagtatgctgatccagaacttgatactgtatctggaggagaaaagacgaatatccttgacgatctggaagatgaagttgagaaaaaaaaacaaatgtcttccagaaaagaaaatactgctagaagaagttcttcagacagtattaataaagagctaactgaaccaagacctgagagtaagccaagcgaagaagtgaatagggtatcggtaacatccactccacctcatctacctcaacagatttcattaagtggaaacagtggcattacacaaccaaaaattgttggatcaggttaccaaacgcaatttgcgactcctagtacacctctcccgaggatgcaagttttgcaaggtgcaaatcaagtgagtcgtggaaatgcaagctttgttggcaatcctccgcctcctccacccccatatcctggccctcccccaccatatccagggcagcaagctgcgatacgaggaaggggtgttagatcgcacatcatcccaggcccagcggcacaggctcaacagagaagaaccttgctccttcaagagcagcctctactgctggaagaattactcgaagaggagaaaagggagcaagagaaagcgtcggtagcaccctcaccggcgagttctcttatgagcgacgctgacttcgagatgttgagggctgatgtccttggttcccggaccaccagtcctcctcaatctcaatctctcggaactctaaatctcgtgggcccacctccacctccacctccagaaaacattgttacggaagctgataggcaggctcaagtccaatatgaaacatggcttcgaacaaccggaagtgccgtcagccaacagatccggtattttgaaacggaagttcaaaaattaagaaaaatacgcaagtcgttaaatagtaaa

SEQ ID NO: 1564 - DNA, 4308 bp, Euschistus heros
atgtccgaagacagtgaaaaccataaagcccgcccgaaaagaaatttatctgggaagcagaaaaaacttgatctactcgaaaaacttaaaagtggaaagaaaaacaaatatgatattggggaactcgaaaacgtctatgaagaagttgatgagaaagagtatactcgcaaagtattagaaaggcaagatgatgattggattgttgatgatggtggttgtgggtatgtggaagatggaagagaaatatttgatgatgatttggacgaagaatcaatcaaaaagtctcagaatattgttactggtaggaaaagaggccgagatattgctcctgaaaagaaaggaaatattcgtaatatgcttgcaaaaatgccttctaaaaagaaaaaaaaagagactgttgttaaactggaagaagatgatattcttggagatataattggtgaaatagattcaacatcagtggtaccattaaaaaatagtaataagcagcctgaaatatctgaaaaagactatttaaaatcattaaccaattttaaatcaaccaaagttaaaccatcacccgtgaaacgtgtaaaaacaagttctgaagtcaagactcttcctttggttaaggaaactgaaaaacataaaatggcagatttaccagttgagacctctcctattaagataaaagaggaaccgatagatgttgatgagatacaagattacagttgtgatatgtttggtgatgactttgatcatgaagatatagaaatttctgattctaaagccgaggaagtatgttcaagggatatcaaagtagaacctgtttctcctccaagagaggcatctccagttaaaatggaagttgtcaaagatgaaataagtgaagattgggacaagcaaattgaatttgattctccagtgacttatgtcaatgttgataaatctaaattacctctgctgaaaaatgaaactggtcaagaggttttaagattctactattgggatgctgctgaagaagtatactcccaaccaggaactgtatttttttttggaaaggttttgattgaatctgctaacacttatgtaagctgttgtgtctcggtaaaaaatattgaaaggcgtatatttcttctcccaagagaagagaaaatgaaccttaagacaaacgaaacttatggtgattctgtgacaatgacagatgtttatcaagaattcagctcagctgtagctgacaaatataaaattaagcagttcaaatccaggaagatttccaagaaatattcttttggtgatagtagtgtgccttcagagtctgagtatctggaaataaggtatccgagtacttttcctgcattgcctagtgatctcaaaggtgaaacattttctcatgtatttggaacaaagacatcatttttagaaattcttctcttagaacgagggatcaaaggacctagttggattgaaattacaaatgctgagcctgtcctagctccattcacatggtgcaaagttgaggcatcctgtatgaaggcaaatgatgtcaatgtgttgaaaaatggtcttccacccattccaccattagttttggttactcttcatccacaagcggttcataatcctaaaacaaaacagacggaaatcgttgctgtaggttgcttggtcagtaactcttacccagttgacaaacctcctccagataggctatttaatcaacacttctgtgttttttcaaagccatctgatctcacttggccatatgatataaaagaatcactatccaatttcaaaaaaacatcactggagcggatggaatcagaacgtgcactcttgaatcttcttttgacaaaattgtatcgtatagatcctgacataattgtaggtcatgatctttctggatatggaattgaattgcttgtgaaaaggttagcatttcacaaagttcccaattggtcacgtctaggtcgtttgaaacgatcggtgatacctacgactaaggccagaaatcaaatagaaaaaattgctcttactggtcgcttgatgtgtgatataaaagtaactggtaaggaacttcttagagctcgtagttttgatttggattctctctgtcagctggttttacatttccaagaaaataaaagacaagattttactgatgaggaatttaaaagttgttttttttccggagagaatttagtcaaggccttatggtcaataatgacagatgcttcctatatattaagaatttttactgaacttaatgcacttcctttggctttacaaatcactaatattgcaggtaatgtcatgtctagaacattgatgggtggtcgctcagagagaaatgaatttttgttacttcatgcttttcatagcaaagggtatattgttcctgacaaagaatataaaaagactgccaaggatgatgatgtagatggcactgcagaagttacaacgaattccagaaaaaagccatcttatgctggaggtctagtgcttgatccaaaagtcgggttctatgatgatttgattctccttatggattttaattctttgtatcctagcataattcaagaatacaacatctgtttcactaccattcctccatcatctattgatatggatgaagattttaatgaaaattatcaaaaatattttcctgaggagtctatggaaccaggaattttacctactgaaattcgtaaattagttgaaagtcgaaggcatgtaaagaagcttctgaagtcagccgcttctcctgagcagaaaatgcagtatgatattcgtcaaatggctttgaaattgactgctaacagtatgtatggttgcttaggattttcaaattccagattttgtgccaaaggtctcgctgctcttgttacagctaaaggcagagaaatacttttaactaccaaaagaatggtagaatcttttggctatgaagttatttatggagatactgattcaatcatgatcaatactagaaccaaagactttgaacaagtacatcaagttggtaagaagttgaaatttgaggtgaacaaatgttacaaacaagttgaattagatatagatggagttttcaagtatatgcttctgttaaaaaaaaagaagtatgctgctgtaacaattaataagcttccaaatggtgagttcgttgaaaaacaagaaatgaaaggtttggatattgttagaagagattggtctcaactagctgctgcagctggaaggcacattttaaatgaaatattgtcgaacaaatcaagcgatgatagaattgatggaattcacaattatttagaaaaaatccgctctgatttagagactaataaagtaccagttaccttgctaacagtcaccaagcagctgactaaaccaccagaagaatatactgatgctaaaaatcttcctcatgtccaagttgccctcaggcttaacaaaaattctgctaaacggctcaagcaaggagatactgtttcctatgtcatttgtaaggatggtacaaataattctgcagctcaaagagcctatcatgtcgaagaattaaaaaaccaagataatctttcaattgatgtactgtattatcttgaacaacagatccatcctgtgatttcacgtctttgcgacccgatagacggaattgatgcagcgagtgtggccagatgtctgggtcttgatccaacgaaatatgcacgtgtgacaactattactgaagagtctgatgaaataactaaatacacattaggtagagctaatgaagaaagattcaaggattgtgaaaggtttgtttttacttgtaaaaatcctaactgtaaaactgataatactgttgagggattaagacataaagaagataatggtgtagaaggcttgcttatgttagaaaaatgtaaaaatccggagtgcaaagtttcaccagtggagtatttgccaagtatacaaaatcagcttcatttccggattcgttaccacatccagaaatattatgagggttggttaatatgtgaagatccagtttgtcaaaataggaaacgaataattaatcccattttttctaaaggtttccccgagtgtaacaaatgttatcgaagcacaatgaggagagaggtatctaacttgagtttgtatactcaactgacatattttcagtttttatttgacctgagcagggatgctattacaaccattaaagtagaaccggaaatagttaatgcttacaaaaggttgtacgatcaagttggggaagttctgaaacagaataaatactctgttattgatcttggaagcctgttttctcaactctttcctttcaaaagagacaaataa

SEQ ID NO: 1565 - DNA, 1461 bp, Euschistus heros
cgctattatctatggcgaccgagaaaacattcaggaaggttattgttttttaaaagcgagatggcggctgggactcaggttaaaaatgtggaagtccgtgacattgctagaattgaacgaattggagctcattcccatattcgaggactgggtttggatgacagcttggaagcgagagccgtgtcacaaggaatggttgggcagcagatggctagaagagctgctggagtggttttaggaatgattaaagaaggtaaaattgctggaagggccgtgttacttgctggacctcctggcacaggaaagacagctatagcaatgggaatttcaaagtcacttggtaaagatactccgttcactgcaatggcagggtcagaaatttacagtcttgaaatgagtaaaacggaagcccttactcaagccatacgcaagtctattggaataagaataaaagaagaaactgaaatcattgaaggtgaggttgttgaaattcaggtagaaagaccagcaacaggagttggtgctaaagtcggaaaacttacattaaagacgactgaaatggaaactgtctatgaccttggaacaaaaatgattgatgcccttaccaaagaaaaggttcagtccggtgatgtaattacaattgacaaggctactggtaaaattagtaggatcggaagatcatttacaagagcgagagattatgatgcgaccggtcctcagacaaggtttgtccagtgtccggagggagaattgcagaagagaaaggaagttgtacatactgtatctattcatgaaattgatgttatcaactcaaggacacatgggttcttggctcttttctcaggtgatacaggtgaaataaaaccagaagttagagaacaaatcaacacaaaaattgccgaatggagagaagaaggaaaagccgaaatctcaccaggtgttctgttcattgacgaggttcacatgctggatattgaatgtttctcatttttaaatcgagctcttgaagatgagatggcacctgttgttatcatggccacaaacagaggcattaccaatatcaggggaactaattacacttcgcctcatggaattccgattgatctcttggacaggatgatcatcatatccacatctcagtataaggagaatgaacttagagaaattctaaaaattaggtgtgaagaagaagattgtgaattgtctgatgatgctttgacagtccttactaggatagctatggagacaagtcttcggtatgctatacagctaataacactagcgggcctggtttccagaagaagaaagagtaatgaggttgaaattgaagatgtaaaaaaagtatattctttgtttttggatgaaggaagatcaacacaaatcttgagtgaataccaagatcaatacctttacgaccagaagcctgatcctagtggaggaggtgaaccaatggatatgtaa

SEQ ID NO: 1566 - DNA, 1110 bp, Euschistus heros
atgtctatccgaacttatggtgataaaccgattagtttccaagttgaagaaaatggagaatattactgcattggttctgaagtcggtaattatttacggatgtttcgtggatctctgtataagagatatcctggaatgtatagaagaactcttggaaatgaggaaagaaaaagactaatagagcttgggctaagctctcactgtttggcttccagtatatctctgttacgagcatctgaggttgaagatattattgagggcaatgatgaaaaatacaaagctgtttctgttcattcttctgaaactcccattacaagttcttctaaaccgaaaaaagctatgccatgggtaccttctcttccgaatagttcgcatttagatgctgtaccgcaagcaacaccgattaatagaaatagagttgttagcaaaaaagtaagaagtttccctctttgctttgatgacactgatccatcatctatcatggaaaatgcttcgcaaatggaagtactcgtacctatacgtcttgacatggaaatagaaggtcagaaactccgtgatacttttacctggaataaaaatgaaagtttgataactcctgagcagtttgcagaaattctttgtgatgacctagatttaaatcccctaagttttgtccctgctatagcccaggctatccgacagcaaatcgaaggtttccctactgacaatattttggaagatcagactgatcaaagagttatcgttaaactaaatattcatgttggtaatacttcccttgttgatcaaatagaatgggacatgagtgagaaggaaaacagtcctgaacagtttgcgatgaagttgtgtgcagaacttggattaggaggggaatttgttacagctattgcttattcgattcgagggcagcttagttggcatcagaaaacatatgcttttagtgaatctccccttcagactgttgaagtgcctttccgaccgcagtccgaagctgatcagtggtgcccgttcctggaaaccttgactgatgcagagatggagaagaagataagggatcaggacagaaacacaagaagaatgagacgattagccaacactactcctgggtggtaa

SEQ ID NO: 1567 - DNA, 711 bp, Euschistus heros
gggaaatcgcgagtgccatctaaaatgtcaaacttagttatattaaaggcactggaaacagctgctttttgggctaggaatgtccacttagtactgttgggagttgctccaagtggttattgtttagtgatggctgctatacgtaaaaaattagttatagttggggatggtgcttgcggaaagacttgtttattgatagtatttagtaaagatcaatttccagaagtatatgtgcctactgtgttcgagaattatgttgctgatatcgaagttgatggaaagcaagtggaactagcattgtgggatactgctggtcaagaagactacgatcggctaagaccactttcttatcctgacactgatgtcattttaatgagtttttctattgattcgccagattcattagaaaacatacctgaaaaatggactcctgaagttaaacatttttgtccaaacgtacccatcattcttgtaggaaataaaaaagatttgcgaaatgatccaaataccattaaagagttggcaaaaatgaaacaagagccagttaaaccagaagaagggcgagcaatggcagataaaattaatgcctttgattatcttgaatgttctgccaaaacaaaagatggggttagacaagtatttgaaacagcaaccagagctgctcttcaagtcaaaaagaagaagaggaaccgcaaatgtaaacttctttga

SEQ ID NO: 1568 - DNA, 3987 bp, Euschistus heros
atgaatcttagtttaagtaattatgaaagagttccacccttggactgttatcagccctcaggaaatcttatagatttggctgaccgaatgctagaaaaattcactgttgaggataataatttaccccaactgctggacaggcttcaaatcacctgtgaaagtggaactacatctagtgggacaaaagacactgattatattaacaatgtagactcaagttatttatctcaaatatctcagttcagattgattaacaagatacctcttcctcaagaaatatctgaccagttcagcactcttgcagcaggatcatcaggagatacatctatcatgggaatgtttccagacattaacagagcttggatggcagttgaaagtgatatatacttatggaactttgaaacaggaggggatgttgcatattttgatggtttaagtgaccctattgttagtgttggtttaatagctccaaggcctggagtttttcaaagttttattagccatcttcttattcttacaacacctgtagaaataactgtacttggagttattttgtcatcttcaagtgatcgaaaagttggtgatgagttacaacttacaccagataccatttacaccttatctactgacggtgttccaataagggttattaaagggacaaaaaatggacgaatatttctcggaggaaaagatggaaacctttatgaattagtttacagaaaagaaataagttggggtggtaaaagggcttggaaagtaaatcataccaaggctattctttcctatcttgttccaacttttgtatcaggagctttttcggaagaagatcaaattacagaaataactattgatgaatcccgaaatattctttatacactttcgataaaaggatctattgaagttttcgatcttggtagaaatggagatacaacatgtagagttgcatcacttcatcattcttttattaaccgaagcacagttgatctaattaggaaatcatttcatttcaggaatatgactcccccagaagttagtcgagtagtgagtctatgtcctatttctgaaaatgattctccacatttcggagttgtgggcattacggaaaatggtattcgattatattttactacaggaagccctcctaggccatccacattgtcacttcttcatgctaggctaccccctggacatgctcctaacacaactaatgttaggattggcagagttgctatggctattcataaatcaggtacatttattatggtatcatccatgggtgactattcacctgaccgcctttggtgctttactatggatggtatatctgctctgaagttgcccttaacagaatttgtctttacaaatcctcaaaatgcttcaattgctattgctgaatcacgggagaatatgagcttaacagatcgtggattgcatggacactttctagtttaccagcaaaattaccctcaagataggtttattattttaagccagcagggcacagatatttatgaaaagctgagacctgttgacatatttggtgagctaatgcgagagaaaggtggaccagattgtgaagaagtaaaacaattcttcgctcagcatggtacagatcaagcatgcgcgatggcccttatacttgcctgtgaccagactaaccaacacatggcagaatgggcaacacgtgcattttttctctatggaggtgatcccaaatatgttctacaaactattcagcaacctgtacaaccgccaactattactaaccctcttcaacagagtatccttcatcatacattacctctgggtttcaaacctaacacagttagtactccattaggggagaagcaagcacaaccttcaacaagaagtattgaaacctatggggtagcaatgtcatcaaagcataatggtctttacctattcctgagccgtatgcttagaccagtttggtcaagaagagttttagatgtcaattacaataaaaaacctatttatctaccaaccattacctgtgaagaacttagtttaaagacagtacaactttatgagcttcgttcatttctcaccagatacaccttaagttcgtcagatgttgctaccagtttgcagcctgccaacactatgactgttgtttctccaagtggtcaacgtactcgtttacaagaagcactaatacaagaaaaagcatcactggatgcattaaggaattttgtcgagcgaatcacccaagttttctctctgtggaagttactatgtgaacatgaattgcctcttattgtggaatcactttctccggaaagtcaagagcaattaatgcatattacatttagagaacttattcttaaaggggaagatctgtgccatgaactgatttcaaaattagtcagtttgtatttgaatgataatgcatctgtggatccaatcagttcaaaactgagggaagtgtgtcctcttctttataaaaatgaagatgcaacatgcactaaagttaatgaaattcttcaaatggcattagaggaagtcgatgaggaagccaaattgaacctgttacgttcagcaatagatctttgcaaaaatgtatcacctaatgttgatatcgattcagtttgcaagagtttagtcaaatgtgggtattatgacggagttttagaaatgtgtcaggatgttgccagcaagtctgatccaaattcgttggcctcgaagtatatagctagaagtaggcctgcagaagatgttgaaggaagcaaagcatttgaagccaggcataaggcttaccaacaaatcgttcatttgttagacttcctatatcaacagtgtcaattaggaggaaataatattcctcctctatttggaagtgctgacttatcttctcactcacaaaaacttttggaggctacccttgaaaaatgcttatctgttgatgatgaaacatgtcacatagtggtatatgactggcttgttagccgagaacttcaagcatcgcttgtttcgttgggtagaccttcagttgaaagatttctctcacgctatcctgttgatagccctcttagggatcttttatggcagtatcatgaaaaatctgggaatcatgctgctgctgctcaaatattatataagattgctactgctcctggtgaatttataacacttcatcaaaggctgacataccttggaaaagctgttatgtgtatgcggagtgatggagtaggttgtgcttctcatctaggtgtatttctccatgaattagaagatttagtacatgtagctcgagtacaaaaacagatcctggaaaggattacctcaatgcctgatgctagtgacataaatgtgcaagatgcttgcaggaaacttaatgccaatttgctttcaattactgagctttatgaatcttttgctgagccttttggactttgggaacagaaactagccattttagactgtgctggccatgatgataaagaactcataaattctatatgggataatataatactgaaagaacttgatcagtgcaattcaagagatccgtctgggcagatggttgtcctggtatcaaaagttagatcattaggccttcagtttggtatacagtccccatgcttccctattgaatatctagtttggcagttagaattgatcagctgtaagcttggagttgataaatttcatgttcacaatatcatgacatcattaggagttccttattccatactcctggatatctattcaaaaatgtattcagctaatgataactgttggcttgaatctgataatgaatttcatttaattcaagtgattgcaagcttttgtgaatccttttgtgataataaacagttgacaacctcagcacaagaaagaaaatcaactgctgtacaaatgcacgacttaattaatgaatgtataatagttcttcatagtaaaactggattgggggagctggttggatatcttaaaagtatacaaactaaactagaaagaatttag

SEQ ID NO: 1569 - DNA, 3621 bp, Euschistus heros
atgtctggaagtgatttttatggggctgatactttacacaaagaagtctatatcagaaaaggacatgaagactggaatgaaataaatttaaatccaggagggattgcaagcactctacaggacattaaaacccaacaaaaatcaggagcttatgcatacaaaaagattcctaatagattcatatattggagaactgaaggaaatgtacttgaaatggttgaagaatgccttgatgtaactttgcatgggaatcagattagatacaagtttactgatagtcaggtgttggatggtttaacagttacagaaactatgaaaagactgatcattcttgttcctacagtgtctagccttcatgtgtttacatacccacatccagagaaactcctgaagaagggttttggtgaggtctctagtttgtctgtctttcatggtattagtgaaagtgatgctactgatccgcagacttaccatcaactgaattgttcttccagtgccattgtcagctgtacttcttgtatcacaaataatggagaagcaatattcgctcttggtttagcaaatgcatcagttctccttgtcaacatagattctgttagcggctcatcttcttctcgtattctttctcatgataacattgttcctagatttctcactggaattttaggaaaagatggtggagaatgggttccagttagtttgatttttcattacataaaaaaagagctttttcttttctcactatgtagaggaggaagccttcgcatttggtccgtagacagaggatcatttatcacttatctttgtgtaaagttaacaagtcaaacaacactaaaggctcaaaaacacaagatgtgtaaaggatatataaacggtacttttatattgcattgttgcgtacaaggtgctgctattgtaacattagctcctgattacgataatggcgtattcaacttcacgaccatttcggaaatacctattcaacctggttttgaagttacgaacatgtgccctggagaggaagggtacttttggtgtagttggttaacacttgatgagtcacctgctgtgaccaagaataatgtcattcatccaggattttcaaaggtggctttaactagaccttcccttcaagtgccagtatcagactatattccgagagatccagcttctcattatttagatgctatattttcttctggtttctttacttctttggacatagctaaagcaatttctctttataaaatcactgctgttattaaaccaaatatagatgtagctgaacagatttgtgctatagtggaaactgaaatttattcagaaattggtgaacaagaattggatgatgatgaattcttagatatagcttttaggtgctggaatcgactatattcatgttgcagtcaatatataatttcaagtatgcttccacttggaatggtttggcttggggattacttagttttaattcaagaatgtggattttcaatagtagttgatattgagccattagagctttttatgacaactgccgttaagacctcacaatttcctcaagttggatatggctgtttagtagaaaaattgagagatattaatttggaacctggtattgagaagctagaattaagccttcatactggagaatctattgatgaactttctattcttcaagaagctgctgatcttattcctccttctaaacaacttgatgatgctctaagtatcttctatgaggaaggcttaggaaaaaatttaaatagccttatagaagaattagctgtacctgaagattttaataaagatggctcttgggaatcattttgtagttatagtggtgttggtgctgtaacatctgcatttcgagattatgtcactgtgagattaaaaatttgtgaaaaaatattattggttactgaacttgcaatgagagatgatgatggtgctgcagacaggactcaacacaggagcctagctgctctttgtaaagcctattacatattaaaatggatctgtacatctaagtctactggaaatgcacctttgatccatgtgttttcattggttaacccaacatcaataatgcagtcttctcttgaacaatgtgttcttggcctagctaattgcttatggccattagcaacaaatagtactcttgctcaacatttattatcaacaaaacaatatgcccttctacaaacattagcaagattagttggaataaatagctggagtttactactagctgaatcctacattctaacaggtcaacctggcaaggcatttgatgtttgtttgaaaaatgctggatcagatgtggtgcatttccttaatgctataagactttttgaaaagcattcaaggtctgatttagttatagcgatggctactaaagcattagaacttcttattgtttcacattctgatagggaaacacttgaatctgcattatttgttcatgaattgggaatggaaaattatgatgctgcttggagttggattgaatcgtgtagttcttggtcccgcaggtctgactttttgcagcgcttggtagctaacatgatatcagaaggaaaactcactgatcttatctccttttcctatactgggctccttgatgaactagaaaagcttcttgcttcccgtgctagatcattgacttttggacttgctaccaattactataatattttatatgctttccatgtcaaacatgaaaactttaaaaaagctgcaagtgtgatgttagaaaaagcacttcgtgcagaaactgctgaagtacagtggaaatgttatggtgcctgcctaagctcattgatgttgataaatgatccccagcaagcttggctagtccgtcccaatccattttctcaagaggatgctgtagaaatacttgaaattgaggatattcaaagagagtttgaattgtctggagcccgatataatttaggtggatgttcaccagatgcatctcaggaagaagtaattgcactatgtgtaactcaaaagcaatacaagacagcacttcgacttgctaacatgtgtaaactctcttgtgcaccttgtattcaagctttcacagctagttgcgctgctctctctgaacaatcaatatcttggcattggctcaaagctaatgaaattgatgatattatcataacagaatctaatgcaactgaaatgttatggagaattttagaaagatgtataatgaaatatgaaaaaaaaaatgaaactgtgcttcatagagctgctgctaaccaatttttaactgttggtttgtttatccctacttggcttcttcagtcttataagaaaagaaatagttcagagttactacggctgtttgttcaacatggatatctggaagaagctgaggaattagcctgtgattacttgaatgcagctctggggatcggtagagaaaatttttcaattgattttcctcttcatctttcatctcctccactttgtttacctttacaaaccattgatattttacttctagaactaaaacattacaatataggtgaacgattacaaaaaaaactggatacatatattagcacaatatcaaggataactttggagagaccaatgactacctgtaaaaaataa

SEQ ID NO: 1570 - DNA, 2901 bp, Euschistus heros
atggaaatatcagaagagaatttacacacgctctccaactatttaatgcaaacacttagcccagatcccaatgtcagaagacctgctgaaaggtttcttgagtcaatcgagataaataagaactatcctattttactcctgcacctcatcaataaggaagaaatccattacacaattcgtgttgctggtgctatcactttcaaaaattacactcggagaaattggcctataaatgatgataacttggaaaacaagattgatccagaagacaggctgcgagtcaaggagttgatagtagatgttatgttggttgcaccttctagtattcagaagcagctatctgaagcagttggtactattggaaaatgtgacttcccaaaagactggcctggacttctgacaaatatggtcgagaaatttggtggaggggactttcatgttattaatggaatccttcaaactgcccattccatattcaaaaggtatagatatgaattcaaatctcaaaagttatgggaggaaattaagtttgtgcttgacacgtttgcaaaacctttgactgatcttgctgtggctacacaaaatttaacacaagttcatgcttcaaatccagatgctctaagagtgatttattcatctttacttctcatttcaaaaattttttactctttaaactttcaggatctgcctgagttctttgaagacaatatgaatgtctggatgccgctctttcatacattacttactaccgatgttaagtgtcttcaaactgatgatgatgaagaggcaggcttacttgaacaactgaggtctcaagtgtgttctaatgttgcactgtatgcacaaaaatacgatgaagaatttcaaccatatctccagggtttcgtcacggacatctggagccttcttgtgactgtttcacttcagcctaaaaatgatctgcttgtcagcaatgcactgcaattcttgtcaactattgcggaaagaccacaataccgtcacctctttgaagataagaatgttctcactggcatttgtgaaaaagtcatcattcccaacatacacttccgagactctgatctggagctctttgaagataatccagaagaatacattcgaaaggacattgaaggttctgatgtagagtcaaggaggaggtcatcatctgagcttgtgaaagtattggctggacactttcctgaaaccgtcaggaccatatttggtgctaggctgcaggaaatgcttgctgaatatagtagtgatcctgctaaatggaggttgaaaaacactgctgtgtacattgtgacctctctagctgaaaggggatcaactgcaaagcatggtgtcacaaaatcttctgatctcgttgaccttcacgatttcgcggggcagtatattattccagaactcaaaaaagaagtcaatacattgcctgttatcaaagctgactccatcaagtaccttatcacctttaggagtcttcttgctccacaggtactgatagctgccctacctgatatagtgaagcaccttgcatctcctagcctcgttgtacactcatatgcagcttcggccatagacaaaatgctaacattgaaacagaacaaccagccactaattacacaggctctcctgcagccaatcgctggagatgtcctcactggccttttcaatattctcaactttaagggatcagaagagaatgagtatgctatgaaagctataatgagaactttctacactctggacgtgtcagttatcccattcttagcagaacttctccccaagttgactcaaaaactgactatcgttgctaagaatccaagccgtccacatttcaaccattttctttttgagactatatccctctctattagaattgtgtgcaaaaataaccctggtgctgttggcgcatttgaagaagctctctttccaaccttccagattatattccaagaagatgttcaagaatttgtaccttattgtatgcaagtgttgtctctaacacttgcacggaggtcaccacctctgcctgcaccttacgtcgccctctacccatgtctgttgtcgccacagctctgggataggcctggatgtgttcgaggtcttgtttgccttttgcgatcttacgtcagggtctcatctaatgatgattttaatcagacagttaaagttaatggacttcttggagtgttccagaagttgatatcatctagactaaatgaccatgaagggttctacttaatgcaatcacttatagagcactgcccccgggaacttcttgacccatttatgaagcaggtcgttctgcttctattccagaggctgactgcggccaagactacaaagtacgtcaaaggtcttatcacattcttctgtttacttgtcgtcaagtacggggctcctacttttatagaacttgttgactctgtacagcctcagatgttctcaatggtagtcgagaggctaattactcctgactgtcgtaaagtatcaggagccgttgaaaggaaggtcactgctataggattgtgccgccttgtagctgactcaaaacaagtttttgcagggccctactcagcctgctggccagctcttgccaagagtgttgtagaaattttagaagccccagaagatgattcagtcgccccagaagatcatttcgtagaagtagataacttaccaggttatgaaccagcatatgtccacctgactgcagtcggcagtgataagcatgatcctattcctgaaattacagatttgaggagagaacttgcaaatggtatccgggaccttttccaggtttcaggacaagtagtcactcaagctatcgctagcctcggggaaccttatgctagtcatatcaagagctatctcatcctggttggagttaacatatag

SEQ ID NO: 1571 - DNA, 573 bp, Euschistus heros
atggcgaaagtccagataggtaatgttttggtgcttgataatccctcctcatttttgaatccctttcagtttgaacttacattcgaatgtatcgaagaattaaaggaagatttagaatggaaaatgatttatgttggttctgccgagagcgaagattatgatcaagttctagatactatttatgttggccctattccagaaggacgacacaaatttgtctttcaggcagatcctcctgatgtaactaaaatacctattgaagatgctcttggtgttactgttgttttattaacctgttgttaccgtgggcaggagtttgtacgagtaggatattttattaacaatgaatattctgatccagaactcagagagaatcctcctccaatgccacagtttgacaaggttataagaaacattttaggttctgaacccagagttacaaggtttaaaattaattgggatgattcagaatcacaagaccaacctagtcaagaagctgaggaacaacagcaagcaacagaaaatgtaggttttgccgagaatagtggtcataattttatggaagtatcctga

SEQ ID NO: 1572 - DNA, 891 bp, Euschistus heros
atggatcacatgctcgcgagtcctttcaatttacctagtataggtactccggtccatcaacctgaagaagatcaacaaatattgccaatagcacaacagcaacaacaaatacaaccacctttgcaaatgcccccgttactaccaatacaatcttcaattaatcagcaaaagccaatgaatacttatgccccttcaatgggatttactacaccacaaagtatgatgcatccgcaaacaccacaaaatctaatgtcacctatggtaaatagaatggaacagacaccgaacaatattattaatccaactactcctggaccaatgacacctatgacgccatcatctgcagaccctggctttatgccacaattgcagaacatagtttctactgtcaatttaggttgtaaactagatcttaaaaagattgctttgcatgcaagaaatgctgaatacaatccaaaacgattcgctgctgttatcatgaggataagagaacccagaacaacggctcttatttttagttcaggaaaaatggtttgcactggtgcaaagagtgaggatgattctagactggcagcaaggaaatatgcacgaataattcaaaaattaggattccaggcaaaatttctagactttaaagtacaaaatatggttggtagttgtgatgttaaatttcccatcaggttagaaggattggttttaactcatggacagtttagcagttatgaacctgaactttttcctggccttatttaccgaatggtgaaacctcgtattgttttattgatatttgtatcaggaaaagtcgtactaacaggtgccaaagtacgccaagaaatttatgaggcctttgataatatctaccctatcttgaaaagttttaagaagcagtaa

SEQ ID NO: 1573 - DNA, 483 bp, Euschistus heros
atggcttctgtcggcacaaccagatctgttttaaggcttctttcttctcagcctattttaaaacaggctgtgagaggctatgcagatgagatggctttcacatttgctgcagcgaataaggttttctatgccaattctaatgtaaagcaagtagatgttccctctttcagtggagcttttggtatccttccaaaacatgttccaactttggctgttctgaagcctggtgtcgttactgtttttgaacaagatggtagctccaagaaggtttttgtttcaagtggaacagttacaataaatgaggactcatcagtacaagtattggctgaggaagcccacccagttgaagatcttgatgcctccgcagccagggagcagctttctaaggcccaagcagatctatctagggccagcagtgagttggaaaaggctgaggctctcatcgctattgaagtcgctgaagccctcgtagcggctgcctaa

SEQ ID NO: 1574 - DNA, 930 bp, Euschistus heros
atgccttcggacgagcaagataaatttgatggcatgttactggctatggctcaacaacatgaaggaatcaaggatctccttgatactttcttcagttttttggccaggaagactgatttttatgtaggtgctcaagcagaagctgccagatctttggttatagattcatttgagaaataccagtcaaaagcaaatttggctgctgaaaagaaaaggacagaaagtgctgaagctgaaaaaaagaggaaagaaaggcttaatgccaaatccacccctaaagtaatggagataactgatgaagaagcgaaaaaaattgaagaggaagaaaaaaagagaaaagaagaagaaagtctttcaaaaccaattacagaagccgaaggtgaagatgaagaacaagacaaagggaaactaatgccaaatgctggaaatggtgcagatctcgaaaattacaggtggacccaaactcttcaagagttagaagtccgagttcctcttaagacttcttttaatgtaaggtccagagacttggttgtagaccttggcaagacacacctaaagattgggctgaaagggcaggaaccaattgtggacggtgaattagagcatgaaatcaaaattgaagaatcaacttgggtcattgaggaaggcaaaactctatttctgacggctgagaaagtaaataaaatggagtggtggtccaagctgttaacgacagaccctgaaatagctacccggaaaataaatccagaaccatcgaaactgtctgatttggatggcgaaacaagaggtttggttgaaaaaatgatgtatgatcaaagacagcgtgaattaggtcttccaacctctgatgaacaaaagaaaaaagacatgctcaaaaagttcatggaacagcacccagaaatggatttctcaaagtgtaaattctcataa

SEQ ID NO: 1575 - DNA, 429 bp, Euschistus heros
atgaccacagcttggagtccggacaaaaaacacagtgatagagaaagatggatttgcatttatccagcgtatttaaacagtaagaagacccgtgcagaaggtaggattatttcaaaagaaaaagcagtggagaatcctacctaccaagaaataagggatgtcttatctgcagctggtttgaaagttggtgttgaaaacaaactttacagtagggagaaaagtaaagagcttctttatagaggtcgaataagggttcaattgaaaaacgataatggtactccactaaacccagattttgctaccagagaatctgtcatacttcatgcatgtgcaatgattccgaagctgaaaacacgccaaggagggaagcatacgacggaacaaggtcagggtggcacaagcaagaaaaaaggaaaagggagaagataa

SEQ ID NO: 1576 - DNA, 2031 bp, Euschistus heros
atggagaagcctcagaaaatgcctaaagtggcaaaggttaaaaacaaagctcctgctgaaatacagattacagcggagcagcttttacgagaagcaaaggaaagagatttggaaatagtcccccctcctccaaagcagaaaatctctgaccctgaagaattagcagattaccaacatagaaagagaaaagcgtttgaagataatattagaaaaaacagaatggtcattagtaactggatcaagtacgcacaatgggaagaaagtcaaaggcaggtcgatagagctcgatcgatctatgaaagagctcttgatgttgaccatcgaaatatcacactgtggttaaaatacactgaaatggaaatgaggaatcgccaggttaatcatgcacggaatctttgggatcgagctgttacaatacttcctagagcaaatcagttttggtataaatatacctacatggaagaaatgcttggaaacattgctggttgcaggcaagtctttgaaagatggatggaatgggagcctgaagaacaagcttggcttacattcatcaaatttgaattgcgctataaggaaattgaaagagctagagaaatctatactagatttgttatggtacatcctgatgttcaaaattggaaaagatttgcaagttttgaagaaagacatggatttatttctggtgccaggaaagtttatgaaagagctgttgagttttttggagaagatattatggatgaacgtctatatattgcttttgcaaaatttgaagaaggccaaagagagcatgatagagctagagtcatttataaatatgctctagatcatctacccaaggaccgaacagctgaaatatataaggcctacactattcatgagaaaaagtatggagacaggacgggaatcgaagatgtaattgtcagcaaaaggaaataccaatatttggaggaagtaaaaaccaatccaaataattatgatgcttggtttgacttattaaggcttgttgaagaagagggtaacattgacacaattagggaaatgtatgagagggctattgcaaacattccaccatcaagggaaaaagatatgtggaggcgctatatctatttgtggattaattacgctctttatgaagaacttgaagcagaagatgaagataggacaaggcaaatttataggacaagtcttgacataatacctcataaaacattcacatttagtaaaatatggctgttatacgcacagttcgaaattagacataaaaacctttcaacagcccgaaaaaccttgggaatggcattaggagtctgtccaagagataaactctaccggggttatatagatctcgagatacagttaagagagttcgatagatgtagaacattataccaaaaatttttggaacatggtcctgaaaactgcattacatggatgaggtttgctgagttagaaacactgttaggtgacatcgacagggcaagagctatttatgaactagccgttaatcaaccaaggcttgatatgcctgaaattttatggaaagcttacatagattttgaaatcaacgtaggtgaagcaagaaatgctaggcaactgtatgaaaggcttttagaaagaactcaccatgtcaaggtttggatgagttacgttaaatttgaaatgactcatagccaagaagaagaaattgaacctatttcattggccagaagaatttatgagagaggtaacactgctttgagagaatctggagaaaaagaagaaagaattttgttgttagaagcatggagagagatggaaaaagcccatggtgatgaggaaagctataaaaaggttgaagccaaacttccaagaagggtccggcggagacaagctgttattgctgcagatggaagtgaagaaggatgggaagaagtatatgattacattttccctgaagacgaagcagttaagcctaatcttaaacttttggagaaagcaaaagcttggaaaaagaagcaagaaactgagaaccaaacaaatgatgaagactga

SEQ ID NO: 1577 - DNA, 1431 bp, Euschistus heros
atggctatcaagtttttggaagtgataaaaccattctgcagtatattgccagaaatagcaaaacctgaacgaaagatccagtttagagagaaagtactatggactgccatcacacttttcatctttttggtctgttgtcagattcctctttttggaatcatgagttcagactcagcagatcccttctattggattcgtgttatacttgcctctaacagaggtactttaatggaacttggaatatctccgattgttacatcaggcctgataatgcagttgctagctggagcgaagataattgaagttggtgacacacccaaagacagagctcttttcaatggagctcagaaattatttggaatggttattacagttggacaagctattgtttatgtaatgactggaatgtatggagatccagctgaaattggtgcaggtatttgcttgcttatcattgttcagctgttcgttgctggtctcatagttcttttacttgacgaacttctgcagaagggctacggtcttgggtcaggaatctctctgttcatagccacaaacatttgtgaaactattgtttggaaggcattttcacctgctacagtcaatacaggtaggggaactgagtttgaaggtgccgtcatcgcacttttccatcttctggcaacaagacaagacaaagttcgtgcattgcgtgaagctttctatagacaaaatcttcctaatttaatgaacttattggctaccatccttgtgttcgctatagttatttattttcagggattcagggtagatcttccaatcaagtcagcccgctatcgaggacaatatagcagctatcctattaaactcttctatacttcgaacattcctatcattcttcagtcagctcttgtatcaaatctgtatgttatatctcagatgcttgctgtaaaattccatggaaatgtatttgttaacatgcttggagtgtgggcagatgttggaggtggtggtccagccagggcttatccagttggcggtctttgttattatctttcacctcctgaaaaccttggtcatatacttgaagatcccattcatgctatgctttatatcatttttatgcttggttcttgtgctttcttctccaaaacctggattgaagtttctggatcatcagccaaagatgttgcaaagcaacttaaggaacaacaaatggtgatgagaggacaccgtgataattctatgattcatgaactgaacaggtacatcccaactgctgcagcttttggaggtctgtgcattggtgcattgtcagttctagccgacttcatgggagctattggctcaggaactggtatccttcttgccgtcactattatttaccagtacttcgaaatatttgtaaaggagcagagtgagactggtggcatgagtacacttctcttctaa

SEQ ID NO: 1578 - DNA, 513 bp, Euschistus heros
atgaatcttctaaaggcgatgagtcctacttcggtgactccttccgtcgaactcagcacctacagggaccagcattttaagggctctcggacagaacaggaaagacttcttcgcatatcaactacattatatgttggaaatttatcattttatactacagaagaacaaatatatgaacttttttctaaatgtggtgatataaaaagaattattatggggttagataaatataagaaaattccatgtggcttctgctttgtagaatactaccaacgagcggatgctgagagctcaatgaggtatattaatggcaccaggctagatgatcgtattataagaacagactgggatgcaggtttcgtcgaaggaaggcagtatggaaggggaaagagtggtgggcaggtgcgtgatgaatacagaagagaatacgatgctggacgaggtggttacggaaaagtgatgcagcagcccacaacaaaagctgaagctgcatcaatatttaatggacagtga

SEQ ID NO: 1579 - DNA, 942 bp, Euschistus heros
atggctgcagctataggtcggatatatggctctagacttttaaaaaataatccagtttctaagcacttacagataggcagcttttctactactaaatcatggtcacgaggaaagaaagctttgtatacctcacttggtattttgactggtggaacaggcatgttgatatatgctcttgaaaaaagtcttcaagcaggagatcttgaactccatcctcccaaacttccttggaaccatagtgggtattttcaatcactggatcatgcaagtatacggcggggctatgaagtatacaaaaatgtgtgtgcagcctgtcatagtttaagatatgtttgctatcgagatcttgtcggtgtttctcacactgaagctgaggctaaagcagaagctgaagaacaacttgttttagatggtcccaatgaacttggtgaaatgttcaaaaggcctgggaaactttctgatcatatgcctagtccttatcctaatgaagaggctgccagggcagctaataatggagcttatcctcctgatctatcatacatagttcctggacgtcatggagaagaagattacatattccacttattaactggctattgtgatgcccctgctggagtggttttaagggatggccagtactttaatccctattttcctggtggagccattagtatggcacaagcactgtataatgagattattgaatatgctgatggaactccagctactcaaagtcaattagcaaaggatgttgctactttccttaaatggacctctgagcccgagcatgatacacgaaaacaaatggccttaaaggtaatgttcatcttttcattgttcatcgctgcaactgtttactggaagagacacaagtggagcagtctcaagagcagaaaaattatctttaatcctcctaaatcatcgtcgccaccgaaattgtga

SEQ ID NO: 1580 - DNA, 1728 bp, Euschistus heros
atgttagctctacagcagtatggagaaagtgacagtgataaagaagatggagaaaaaagcccagatcctaacgatgacgctttgctgcatttaacgcctctttctactggacattcatctattatccagactgctatttgccctgctcccactgctttaccacctgtagagtacaatcctctgaagtttatcaaacctggttgcactgaaatgacagttaatcttaaatatgaagaactgtttgctgctgatgtaggccctgaaaatccttttttaacagatcaacaaaaagctcccaaaaatatcctttctggttatgttgaagaagctcatatgagtgaatttcagtttgaaaatcagagaaaaacttttcaaagttttggatatgctcttgacccttctattgataatatgggtcgtaccgaagaatctttgtctgtcgttggagctgtggatgttgcaaaagaaacaaacttaaaaactgtttttgaatctacttctaagcgacctcttgataaacggaaaagaaataaaaacgacgatccttctgatatcaatggtttcctcggtccttggggttcttatgttgatgagaagaaagtagtcaaacctgaacctgaagttgctgcagaacttgaagaatatcttgccaagagacaaaaacttggtaagaaagttgaagataaacctcttgaagaaaagactgtccttcacattaaagatccagttgactaccaaggacgaaacttcttacaccctcctcaggatgtaggtgtcaacctgaaatcagactctcctccagacaaatgtttcattccgaagtcagaaatacacgtttggaaaggacatacaaaaggcatttctgctatccgatggtttcccaagtatgcccatctccttctttcttgcagtatggattgccgtgtcaagttatgggaagtatataatgaaaggcggtgcattagaacttattatggccacagacaagctgtaagggatgtttgttttaacaaccgaggaactaaatttctttcagctgcttatgatcgctacataaaattatgggatacagaaactggggagtgtatatcgcgattcacaagtagaaaaattccatattgtgtgaagtttaatcctgacgaagacaaacaaaacttatttgttgctggaacttctgacaagaagatcatttgttgggacttacggtctggtgaaatagtacaagaatatgaccgccatttgggagctgtaaattctattacttttgtggatgaaaatagaagattcgtcaccacttctgatgacaaaagcttacgtgtttgggaatgggacatcccggttgacatgaagtatattgccgacccatccatgcattcaatgccggctgtgaccccatctcctaatcaaaagtggcttgcttgtcaaagtatggacaataagattgtaatattctctgctcttaacaggttcaaactgaatagaaaaaagacattcactgggcatatggtcgctggttatgcctgtacacttgatttctctccagatatgagctacattgtgtccggtgatgctgatgggaaagcctatgtatgggattggaaaacgaccaaactgttcaagaaatggaaagctcatgatcatgtctgcataggtgttctctggcatccccatgagccgagcaaagtggtgacggctggctgggacggcctcattaaatactgggattaa

SEQ ID NO: 1581 - DNA, 807 bp, Euschistus heros
atggttcaaaagaagcccaagaagaagactggaaaaaaggttgcagcagctcctttagctgttaaaaagcaagaggttcagaaagttgtaaaccctctgttcgaaaagagaccaaggaattttggaatcggtcaggatatccagccatctcgtgatttaagcaggtttgtcagatggcctaaatatattcgtattcaaaggcagaaatctgttttacagaagaggctgaaaattcccccttcaattcaccaattttctcaatctttggacaagcaaacagcaactcaattgtttaagattcttgagaaacaccgacctgaatcagcacttgctaagaagcagaggttgaaggctagggctgaaggaaaaattaagcaaaaagaagaagttccaaccaagaggcccaatgttatcaggtctggtgtaaatactgtcactaggttggttgaacaaaagaaagccctccttgttgtgatcgcacatgatgttgatccaattgagttggtgcttttcctacctgcactttgcagaaagatgaatgttccatactgtattatcaaaggcaaggcccgtctaggcagacttgttagaaggaaaacctgcacatcaattgcagtaactcagatggagggtaatgatcgtactgctctgaataaggttgttgaagcagtcaggactaattacaatgaccgatatgaagaaatcaagcgacactggggaggtggtttacttggctctaagtcagcagccagaatagccaaacttgaaaaagcaaaggctagagagttggcccagaaacaaggataa

SEQ ID NO: 1582 - DNA, 1005 bp, Euschistus heros
atggctaatatgttgaaagatgttacaattgatgataagatgccaaatgaacttttattggacaaacatattaaattcgttttagcttatggagctaataaagaagaatatgaattttgcatgacagaacacttgagaatgtctggtatgtattgggttctaaccacattagcagttaccaaaaagttggatgaagttgacaagaaggaatttattgactttatacatgaatgtactgatgagaaaactggtggcattggtgcttgtgttggtcatgaccctcatattttatatactttaagtgctgttcaaatagcatgtattttaaggtcattagaccagcttcctttggaaaagattgtaagttttgtagcaggactccaaaaagaagacggcagttttatgggtgataaatggggagaagttgacaccagattttcattttgtgctattgcttgtctatcactcatcggccgcttggatgctatcaaccttgaaaaagcagtagagtttgtgctgagttgtcaaaactttgatggtggtttcggttctcaacaaaattcggaaagccatgctggattgatctattgttgtgtcggagttttgtcgattacccagaacttataccgaatagatgctgatcaactaggttggtggctatgtgagcgtcaactgccttcgggtggtcttaatggaagaccagaaaagcttccagatgtttgctattcctggtgggtcttgtcgtctttaacgatgttgggaagattacattggattgataagcagcttctgaagaaatatattcttgccagtcaagatcctgatggaggtttcagtgatcgaccaggagatatgccagatccctttcacactttgtttggtattgctgctctttcacttttgggtgaatcagaattaacaaaaattaatcctacttattgtatgccacaatacataattgatgaactcaacttggatccagaaataatgcagtcacaaccatag

SEQ ID NO: 1583 - DNA, 2688 bp, Euschistus heros
atgatgttgaaaatgaatagcgaagccacagcacagcttatacaaattttagagaagactgtttctccagacaaaaatgaactcgaggctgctcaaaattatctggaacatgctgcacaaaccaatttggctgagtttctgcaaacattgtcacatattcttcatcatggtggtaactctccagttgcacgtatggcagctagtttacagctcaaaaataaccttacctccaaagatcccaatattaaagcacagtatcaagccagatggcttgcttttcccgaagaaactagaatgtatatcaagaaaaatattttaggagctttgggaacagaaaacacaagacctagctctgctgctcaatgtgtcgcctatgttgcagtagctgaaataccagttggtcagtggccggatttaatcccaacattatcagctaatgtaactggaccctcttcaactgaaatcatgaaagaggctactctagaagcaattggttatatttgccaagaaattgaacacgattgtttagctaatcaatctaatcaaattttaacagctattgtacatggaatgcggtctgcagagagaagtaattatgttagactggctgcaacaacagcactcctcaactcacttgaattcactcgggcgaatttccaacaagatatggagcgtaactacttgatggaagtagtttgtgaagctacacagtcaacagatacacaagtccgtgtcgcagcacttcaatgtctagtcaaaataatgactctttactaccaatatatggaaacatatatgggccaagctttgtttccaattacattagaagcaatgaaatctgacattaaagaagtagctcttcaaggaattgagttctggtctaatgtctctgatgaagaagttgatttagctattgaagaatcggaagccgtagaaatgggaaaacctccagctagaacatcacgttattatgcaaaaggagctctccagtatcttgttcctgtagtgctcaccaaattgaccaaacaggaggaatttgatgatgaagatgattggaatccaagcaaagctgctggagtttgcttaatgttgctagctacatgctgtgaggaagacattgtaccccatgtgttaccatttgttcagcaaaatataaaatcaccagattggaggtatagagatgctgctgtgatggcttttggctcaattctaagtggacttcactcaagcaccctgaaacctatggtagaacaagctatgcctaccctgattgaattgatgtatgacagttcagttgctgtgagagacacagctgcatgggcatttggtcgtatttgtgaaattgtacctgaagcagcgacaaacgaaacatacataaaacctcttcttgaatccctgctcaatggcttgaaggcagagccaagggtagcagcaaatgtctgttgggcttttactggtttggctgaagccagttatgaccaggctgagaaccaggtagaagatggttcccaaccagagacttacatcctctccagatattttgagtacatcgtacacagccttttagctactactgatagagtagatggggcccaggctaatttacgtcccgctgcgtacgaggcactaatggagatggttaagaactctcccaaagactgctacactgttgtccagagggcgactctcattatactggatcgcttaaatcaagttctggctatggagcagcagattcaaagccactcagacagggcacagtttaatgatctacagtcactcctctgtgcaactcttcagagtgttcttagaaaaatgacaccagaagatgcacctcaaatatccgacacaattatgaatgcacttcttcaaatgtttaattccaattcgtgtaagtcaggatcagtgcaagaagatgcaattatggcagtttcaacactcgtcgaagttctgggagatggttttataaagtatatgccagcatttcaacctttcctctgcatgggtctcaagaatcatgctgaatatcaggtttgttgtgctgctgttggtctcactggagatatatgtcgagcattgaaaaacaaagttcttccatattgcgatgatattatgcggctccttcttgaaaatcttagtgacaatagtgttcaccgctctgtcaaacctcaaattttatcaacttttggagatattgctttaagcattggtgccgatttcaaaaagtacttagatgtagtacttcatacacttatgcaggctgctcaggcacaagttgatacgagtgattttgacatggttgactggttgaatgaattaagagaaggtattgttgaagcttactctggtatcatccaaggattgaaaggggaagacaacaatacagctgctagtgctgctaatcttgccctacttgagcctcatatcccagtcatggctcagttcctgacctgtgtttcgagagatacctccaaacaagataaagtccttgctggctcagctggtttggtcggagatctttgttctgcttttggtgcaaaagttatacctctgttggatatcgatccaattactgagcttctaacacagggaaggagatcaaggatcaataaaactaaagccgtttccaactgggcatctaaagaaatgaggagatacaaagctactattgctaatgcagcctcctga

SEQ ID NO: 1584 - DNA, 1506 bp, Euschistus heros
atggagactatactagagcagcaaaggagatatcatgaggaaagagaaaggttaatggatgctatggtaaaagaaatgctccataaaaagtcaagttatcgagaacaaattaactcagatcacaggctgaagatgcttctagatcaatatatggagagcacccacaagctgaaggaactgtatgaagataaggatggcataagaaaagatgaagttgctgcgctttcaggtcctaatgagttttctgaattttattcgagattgaagactattaaggaattctatcgcaggattcccaatgaaatttctgttcctatgtctgtcgaattcgaagaactggcaaagcttagagaaaaccctactgaagaaacttccaatttagtagagtttacagatgaagaaggatatggaaaatatcttgatctccatgaatgctatgaaaaatatatcaatttgaaaggagtcgagaaaggagattacattacatatcttactacgtttgaccgactttatgaaattcccaaagataggaagagttctgagtacaaaagatatgttattatgctcttaaattatctgtgcgattacattgctagaattaaacctctgcttgacctagaccaggaattaaataacgtccacaaggatttcacatcacaatgggaagcaggcacctttcccggctggccaaaagaaacaggcagcgtgttaagcaatgttggtgcccatcttgacttatctgcattttcatctcctgaagaattggcttctcttggtttggacaggcttaaatcagcattaatggctctaggattaaaatgtggcggaactttagaagaaagggctcagcgtttattcagcacaaaagggaaaaagtctcttgatccaaatttacttgccaagtccaagccaggtaaatcaaatcgagaacgtgatcttgaaaggcagcgggacattgcattcttagaagcacaagtttataagttagctgaattattgagtgaacaacgagctgctactaaagaaaatgttcaaaggaaacaagctaggacaggagaagaaagaggagattcagaaggcgaagcttcatcatctggaagcgagagcgagggcgaagatgatggagttccttataatcctaaaaatctacctcttggttgggacggaaagccgattccgtactggctttacaagttacatggactcaacatcagttataattgtgaaatctgtggtaattttatttataaaggaccgaaagcttttcaaagacattttgctgaatggaggcatgctcacggcatgcgttgcctaggaattccaaatactgcacattttgccaatgttactcaaatagaagatgctttggctttgtgggagaaactaaaaacaatgaaacacgatgaacgttggcaacctgaacatgaggaagaatatgaagattctctcggaaatgttgtcaacaggaaaacttaccaagatttaaaaagacaaggacttttataa

SEQ ID NO: 1585 - DNA, 636 bp, Euschistus heros
atgacggtcggtaagaacaataaaatgctacaacatattaactacagagttagaatcattttgcaagattcgaggacatttattggcacatttaaagcgtttgataagcacatgaatctcattcttggagactgtgaagaattcaggaaaattaagccgaagaacacaaaacagccagagcgagaagaaaagagagtgttaggatttgtattactaagaggtgaaaatattgtctcccttacagttgaaggccctcctccaccagaagaaggattacctagggtaccccttcccggagcaggtggtggaattggtactgcaagacctgctggtcgtggggttccagcacctggtactccagctgccccaggtcttcaagggccagttcgtggtgtaggtggcccatctgcccaagttatgactccagctggccgtgggggccaagtttctgcacctcctcagatgcgggcacctcctccaggaatgcccccaatgatgggagccccaccaatgatgaatatggcacctggaatggcaatgggtagaggtggaccccctcctcaaatgggtgcccctcctgctccacctatgagaggacctccaccaggaatgatgagaggtcccccaccattttaa

SEQ ID NO: 1586 - DNA, 897 bp, Euschistus heros
atgaattctgttgaaaaggcgctcctggtatccctgctgtattaccgatggaaaagacggacaagaaacaggaagatatggattcatccaatagtggaaaaaagaaaagaaaaaggacatttttataatttatattctgaattaaggaatcatccagatcaatttttcaattattctcggatgtccatgtgcagtttcgatgaattactggggcttataaaagatcaaattacaaaaaatgacactaggatgagaagctgcataccacctgaagaaaagctcatcataacattgaggtatcttgcaagtggttgttctttagctgatctgcgcaacaactttcgcgtaggaaaaagtactgctggtgttattgtaagagaagtatgcaacgcattatggatatgtcttcgcgaaatcaccatgcctcctttaactaatgatagatggcttgaaattgctaaagggtttgaaacgtgggcagggttccctaattgtattggcgccattgatggtaaacatataagaatgaagcagccatgtaacagtggatcaatgttttacaacttcaaaaattatttttctactgttctatttgcgatgtgtgatgcaaattattgcttcacatacatagaggttggatcgtatggaaaatccagtgattcaggaatatttaagaattcgttactttacaaaaaaatgtgtgatggtagtttacaaatacctgctccacgctcattcgacaataattcaagtgagcagttttcatatgtcatagtcggtgacgatgctttccctttgtcagataatttgcttaagccttatggaggcccacgcttatcgccagataaacaaatctttaacaaacgtttatccacagcccgacgatacattgaaagc

SEQ ID NO: 1587 - DNA, 2052 bp, Piezodorus guildinii
atgagtagcaaacataaacacaagaaatatgaagaaaaggaggaaagaagaaaaaaacacaaatctcgatactctgatgattctgaagatgaagaaaaatgttcctcatccaggaatcgatcgaagaagaaaaaaagtgatcacagtcgtaaacataaaaaggaaaagaaaaagaaatcaagaaggtctgaaagttcagattcaagtaccagttctgattcatcttcagacaactccgtgaaacttttgaaaaggttacatgacaaacatgaaaaaatgattcaacaaaagaaaaaagaaaaagaattgatgaaggctaatgagactccagaagaaaaaagaattaggcgacttctgaaaaaagaagcaaaagaaaggaagaggaaacaacgtatgggatgggacaaagattatttacattataccaatactgacaatccatttggtgatgcaaatttgctttcaacttttgtttggtcaaaaaagctagcaaaggatggacttacagatgtatctcgtgaagaattggaaagaattaacagaataaaacaagaggagaataaaattgaactcgaaaaggtcaaaaaaagacggcaagagagagagcaagaaagacaagaacgggaagaagccatgatgcgaatgcaacgagagaaggaagctgagcagtttgaagcatgggctacgcaggaagatcagtttcaccttgaacaagctaggctgagatcaaggatcaggatagctgatgcaagagcgaaacctattgatcttcttgctaaatacatcaattctgaagaagaagtggatgctgttgagatgcatgaaccatatacttatcttaatggtttatcgattaaagacttggaagacttggttgaggatattaaggtatatatgaaactagaaaaaggaaagaatttggattattggaatgatataactgttattgttgaggatgaattgtataagctgaggaaaatggggaaaaaatctgactatgaagcagctgttggtaggagagaaggtattcatgaatctgtagctaaagaagtctcttcagtcttcagaggaaaaacagcttcacaacttgcggccatgcaaaagcagattgagaaaaagataagtgataaaggagaaggtattgatattggatactgggagtctcttctttcccaactgaaagctcatatggcacgagctcgtctcagagacaaacatcaagaaaaccttaaacagaaattggaactgcttaaagcggaacaaagacagcaagaacaagaaataaaagaagaacccatagatgaatcagaacatcaggagactatgagtagagaagaaatcaaagaagaaagagaagatagtgatgaagagcacagtggaggtgatgaagatgctggggagtctatgctaaaagagagtttcggagagtatgaagcaggagcttactcccctgtttatgttgatcccgcaagtcttgaaccaggaactcttatcattggtgaagaagaggatgctcagagattagagtatgcaagacagcatctaacttcacaagaaagtcaggtgggagctacatcagaagagttggctatgcaaagggaagcacgtaaaggaatgtcaagcgatgaagccatattttcagttgaatctgctctggattcccaagtttacttgtggtcagacaaataccgtccacgaaaaccaagatatttcaacagagtacatactggatttgagtggaacaagtataaccaaacccattatgatatggacaatcctcctccaaaaattgtgcagggatacaaattcaacatatttttcccagatcttattgataaaagcgcaacaccagaatattatcttaccacctgccctgataatcctgactttgctgttcttcggtttcatgctggaccaccatatgaagacatcgcgtttaagattgttaacagggaatgggaatactcttacaagcgaggtttccgatgccaattccataacaatatatttcagttgtggtttcatttcaagagatacagatacagaagataa

SEQ ID NO: 1588 - DNA, 1209 bp, Piezodorus guildinii
atgggggacgctaatattattgataagtctatgcgatcggtgtttgtgggtaatattccctatgaagccactgaagaaaaattaaaagacatattcaatgaagttggacctgttctatcattcaaattggtttatgatcgggaaactggtaaacctaagggttatggattttgtgaatacaaggatcaagaaacagcccttagtgctatgagaaatttaaatggatatgaaattggtgggcgttctttgagggttgataatgcatgtactgagaaatcaagattagaaatgcaaagtcttttagctgggccgccaattgataatacctacggagaatcggttgaatcagataaggcacctgaagctattagcaaagctgttgcttcgttaccacccgagcaaatgttcgagcttatgaaacagatgaagctttgtattcaaaacaatcctacagaaggtaaagcgatgttattacaaaatccgcagttggcttatgctcttttacaagcacaagttgtgatgaggatagttgatccccagattgctatcacaatgctgcacaaggctaacccgagcgtgccccctctccagccgccccccgtggaagctattcgcccagtgccagtacctcagcctgctccggccgtggctcctcctccagtggtgccacctgtcgttcaggcgaggcctgtcgtggagccagagtgggttcctcctgccaggccccatcaacctccgcatccgccaacgttcatcccacaaccaggtggtgaccttgatatgaggactttggacccgagggttcctccggtgcgactgacccaggaccaagacttaaggatcccgccgatggtgcccgccccacagcagcctccgacccagccgcctcagccctaccctcaggaacacgtgatatccagtaccgtacgagatccaaggcaatatcgtgatcctcgcacaggtgcagcaactgtgccagtgcctccacgacctattgtgacacaggcagtgataccaccgcgacccgtagctcctccgaccagtcatatcacatcagcgcttcctcctgcagcctcagaccaagagaaggctgccttaatcatgcaagtgctacagctgtcagaggaacagatagcgatgctacctcccgagcagcgacagagtatcctcgtcctcaaggagcagatcgccaagagcactcagcgctga

SEQ ID NO: 1589 - DNA, 1188 bp, Piezodorus guildinii
atgacggcttctcaagcaatggaaccaaacagagaaaaagctttacaagattatcgtaaaaaattactagagcataaggaagtagaagttagacttaaagaaatgagagaccagttaaaagatcttactaaacagtatgataaatctgaaaatgatttaaaagccctccaaagtgttggccagattgtcggagaagttttgaagcagcttactgaagaaaaatttattgtaaaggctacaaacggcccaagatacgttgttggttgtaggcgacaactggataagttgaaactgaaatctggtactcgagtagcattggatatgacaacactaactataatgagacacttacccagggaagttgatccattagtgtataacatgtctcatgaagacccaggagatgtcacatattctgctattggaggtcttgcggaacaaattagggaacttcgtgaggtgatcgagctgcctctattgaatccagaactttttcaacgtgttgggatcactccccccaaaggatgtctactttatgggcctcctggtactggaaagactttattggctagagctgttgccagccaattagatgctaatttcctgaaggttgtttccagtgccattgttgacaagtatattggtgaaagtgctcgtctgatcagagaaatgtttaattatgcaagggatcatcagccttgcataatttttatggatgaaattgatgctattggtggtcgaagattctcagaaggtacatctgctgatcgtgaaattcaaagaacccttatggaacttcttaaccaaatggatggatttgattcattaggacaggtaaaaatgatcatggccactaatcggcccgacacccttgacccagctctcctccgtcccggtaggttagacaggaagattgaaataccactgccaaatgaacaggccaggctagagatcctcaagatccacgctagtcctatttcgaagcatggagatattgattacgaggctgttgtgaagttgtctgataatttcaatggagctgatttgagaaatgtttgtactgaagctggtctttttgctattcgagctgaaagggaatatgtaatgcaggaagattttatgaaagccgtgaggaaagtggctgacaacaagaaactggagtcaaaacttgattacaagccagtataa

SEQ ID NO: 1590 - DNA, 777 bp, Piezodorus guildinii
atggcaaggcgatatgattccagaacaacaattttttctccagaaggccgtttatatcaggttgaatatgctatggaagccatcagtcatgctggaacctgcctcggcatcctagctaatgatggaattattcttgtagctgagaaaaggaataccaataaacttcttgatgaatcagtatattctgaaaaaattttcaaattgaatgagaacatgatatgcagtttagctggtattactgcagatgccaatgttcttaccaatgaactaagacttatttctcaaagatatttattgcaatatggagaaactattccttgtgaacaattggtttcatggttgtgtgatatcaaacaagcatacacccagtatggaggtaaaagaccattcggagtatccatattatatatgggttgggataaacactatggatatcaactttaccagtctgatcctagtggaaattactcaggttggaaggcaacatgtattgggcataacagtggggcagctgtttccagtttgaagactgattataaagaaggtgaaatgacagtgaaagatgctttggctttgggaatcaaggttctaagtaaaacattagatacagctaagctttcagttgatagagttgaagttgcgacattgtctcaaaagaatggaaagtgtgttacatctatcctgcctcctgatgaagttcaagaactcatcaatgcttatgaaaaatcagaagctgaagcaaacgctttaaaaaaagaaaaaaccccaaaatcttaa

SEQ ID NO: 1591 - DNA, 2643 bp, Piezodorus guildinii
atgacgaaaattcaagagccacaacaagaagaaatgtctgaagaagacaagaggcttcaagaagaactcaatatgcttgtagagaaaatcactggtcctgacatacacctgtatgtacctgcattggaaagtatgcgagacctgataagaagttctactacaagtatgacatcagtgccaatgcctctgaagtttcttagatctcattatggtgcacttaaagaggcctgtgctgttatggcggataaaaaagctcaggagctgtgtgctagcatagtatctgttcttgcaatgggtcaggatctaccagggtctcgagaatgtttgaagtactgtttgcaatctcatcagaaagatgttggtgattggggtcatgaatatgttaggcaattggaaggagaaatagcagatgagtgggcatctacagaagaaaaagataagctgttaggattggtagagagtatcattaaatttgatatggagcataatgccgaaatccaagcctgtgatctcttgatggaaattgacagacttgatatgcttgataagcacatggatatgactaattattctagagtctgtctttacttgattaattgtgctgtatatgtggaagagccagaaagaggaaatattgtaagtggagtcatgaaacattatatgcgatttaaagaatacccccgagcactttgccttgctatgcaattaaataaacaagatataatgttagacatctttaaccaatgccaagatccattagttaggaaacagttagctttcatggtaggtagacaacagttaagtctggaattgagtgacgatttgccagacaagtcagatcttactaacattatgtctaatgcccatgtgaatgatcattttcatagtttaggaagagagttggatatcatggaacctaaaactcctgaagaagtttacaaagtttggttggaagggttggttctccgcccgacctataatctggaagtacctcttgattcagctaggcataatcttgcttcaacatttgtaaatgcttttgtgaatgctggcttttccagggataagttggtatcagttgaagatggcaacaaatggatgtataagaataagcaacatggtatgttaagtgctgcagcatctcttggcctgattcatttgtgggatgttgatggaggattaactcctattgataaatacctctacacttcagaagattatatcaagagtggagcactgctggctttgggtattgtgaattgtggagtcagaaatgattgtgatcctgcattggctcttctttctgattatgtacttcatgagagtgtcactttaaggattggtgctgttttaggtttgggcctggcatacgttggaacaaaaagacaagatgccataactcttttgctgccagtgctctcagactcgaggtcgacaccagaggtggttgctatggcagcgttggcatgtgctctcattacccttggtacacctcatcctgatgtagtatcgacgatactgcaaaccctccttgatcttcctgtggctgagatgactgatggccactactccaagtttttgccacttgcccttggtttatgttacttaggtcagcgagaaggcactgaagctacaaaggctgcacttgaagcacttccagagcctttgagatctttgtcgcaacatatgttgaagatgtgtgtctatgcagggactggggatgtacttgtcatccaggaacaactacaagtgtgctcagaacattaccctactccagaagaaaagaaagaaaccgataagaaggataaggataaagacaaagacaaagatgagtcgaagagcagtaaagtgaaagacatgacatgtatgcaggcagtcgccgctctgtctgtggcagtgattgcaatgggtgaggagacgggatctgaaatggcaactaggatattcgcgcaattgggaaggtatggtgaacctgcagtacggagagctgtacccttggctatcgcattatcatcgatatcaaaccctcagttagcagtgatcgatgttctcaataaatattcacatgacctagatgaagaagttgctcacaatgctattttctctatgggtctggttggtgctggcactaacaatgccaggttggcgacgatgctgcgccagctggctcagtatcatgctaagaacactggtcacctgttcatggtgcgcattgctcaagggctgacacatcttggtaaaggcaccctctctctatgcccctttcacactgataggcaggtcatgaactactctgcagttgctggtcttcttatcacccttgtttccttcctcgacaccaagacgataatgcttggaaagtcgcactatttgctctacacattagccacagccatgtacccaaggtggttagtaacgcttgatgaacatctggaaccactacctgtgtctgtcagagttggacaggcggtgaatgtgattggtaaagctgggacgcctaagacgatagctggcgtccatacccacactacacctgtgctgcttgctgttggcgaacgtgctgaactggccaccgaggattacactcccctcacccctgttatggaaggatttgtcattctcagaaagaaacaaccagcttga

SEQ ID NO: 1592 - DNA, 1344 bp, Piezodorus guildinii
atggctgaggtactgaggcccgaatattggtggttccagaacatggagcctccagcggcagagcaggtccaggcacagcaacagcaacaagaacagcaggagcctggagtcatccggcagcgaaccataaccacttcggggacaatcaccaccagtccgcagcacgagaccactccatcaccggagcaacccgtccaagagcaagggaacaaggaagtggaggtgccgtacgagatcgtgcagctgcggcccgggacgtacgacgagacgtacagcctggaggagacggcgcggtacagcccgggctccggacggtactacaccacagagggcaccgtcaagtacgagcgggacgacaaaggcgaaggcagctacgtgacgctggaacccgtcaactacccgcccggcggagcctaccaagaacctgccacgggatactacacctacaaggaggaggaggacgtctacatcaaggctgaccctccgctgacgccaaagaacttcgcgcacttcgaccaccccgtcacctcccatccgacgcagctcagtgcacaggttacttacgttacgggaggtggtagcagagagtacgtgacaaccaaccagcctggctactggtccagtgagtacgtctaccagcagcctcagcaggaaatccagcttcctccaggaacaccttacgtcttctccagcaatgggcaggcaacatgggctatcgacgagtcgtacgaccccagtatgctgtctacgagcgacatcaaggagtgcgtcaactgcgcggcgagcgttaccccgctgtggagaagggacgggaccgggcaccacctctgcaacgcctgcggcctctacagcaggatcaacggcgtccacaggccaccggtgaggacgcaccacaagaaagtacacaatattggtaatagaagaaatggcgtgagctgtgcaaactgccaaacgaacaatacaaccctgtggcgtagaaataacacaggagagcctgtgtgtaatgcctgtggactgtatttcaaacttcatggtgttaataggccgcataccatgaagaaggaaggtatacaaaccagaaaacgtaaaccaaagaacccacaagtaaacctaccgagtccaaaaaacgatataaagacaacaggtgaaaaatcagggagttgggataaatgcgacaacgatctactcgacagcgggtacacaatggcaacatcatccatatttctgccaagttcatttttaactaagcctgtaggagtcagtgtatcaggcttagaaagtgtaccacctagcgtgatcatcccacccacatccagccaagaaacacagagacctgaacaataa

SEQ ID NO: 1593 - DNA, 5505 bp, Piezodorus guildinii
atgtcgttgcctggagggaaaatggcttgtcctgggaacggaatttatgttattcagggagaaatgtctgttctgcttactgctatgaagaaagtaaacagatggtcttctcatgtccaccaggatgatgaaaatgacattctcattagaagcttcacagacctcaaagatgttttaaatcagattggtgacctaagagaagtagagcctaatcattttcttagtccttttcttgaagtaattagatccgaagaaactactggacctgttaccagtcttgctttatcctctgtcaacaagttcctttcttatggactaattgattctaagtcaaagacgattgcagctactgttgaaaacatcgcagaagcagttactagggccaggtttgttggaactgaccaaactaatgattcaattgtgttattgaaaattttacaggtgcttcgaactttgttactttctcctgaaggctgttggcttacaaatgaaagtgttttagaaatcctacttagttgttttcggatgtgttttgagccccgtttaaatgaattgttgaggagatgtgctgagaattgtttacgcgatatggttcagttgttatttagtcgacttcctagttttactgaggataatagaaaaatacagcaaaaactcaaaatgaatactagtgcccccttggatgctggtaaaggaaaaagaaagacaagcagaccatcttctaggaaagtttctaggaaaagtcaagagatatctcctagtcctgttttaggtttagaaggttcaaatgcttcaaaagaatgtgatatccaacaaatggctctacgtgatgagccagaaattacatcacacgataaatcagaacctgaaattcttcctgtgcctagtgaagaatcactagctaaagtttcatctattgattcacttgaaactaatgttgcaaatggcatttcaaatgggacgaagtcagaagaacatcaaaactctacttctcctgtcattctggatgatggtgttgttattagtattgaagattcaagttctcaaaatagtgaatcaacagagcagctggcagccattggtaatgtgtcagaaataaagaggccagatgaattagatctaaactctgctgaaactaattttgcttctccatcgtcagattctaaagcagaagaagaacctttattaagtcctaccactccagaaaatattatggaagggcaggattggactaaccagcaaggagttaggtttaccaatactgaagccgataatttaactccttctggaccttacggactgctgagcgttcatgaactcctaaggtttttggcttcactttgcaatccattagacaagcagaattcagatagtatgattcacattgggctaaccctcattaccgtggctcttgaagttggtgctgatagcattgcaaattttccttcacttttatcaactgttaaaaatgatgtctgtagaagccttttagctttgttaaatactgaaaaacttccaatattcgcatcagtgctacaagtttcattcctcctttttgaatctcttcgaacacatcttaaatttcaactggaacgttatttgtctaggcttactgaaataattgtatctgattcttcaaaaatttcatatgaacatagagaaatagcattagaatctgtagtgcatctttggcgaatacctggcttagtgacagagctctaccttaactacgattgtgctttgtactgtcccaatttgtatgaagaactgaccaatttgttatctaagaacgcttttcctgtaactggtgtttataacacccatttactgtctttggatgccttattgacagttatagactctatagaaagccattgcaatagccgaatattaaatgaaagacaaaatccatcaaaagatggagaaattaataaattagagtttcacgattttgccagcaattacatccaccggactggtacccgtcaaaagttatcattgaacattcctagtcatgagcaattaatggctgtgaaaagaaaaaagaagctcctggctactggaactgaacatttcaattcaaaaccaaaaaaaggaatccagtttttacaggagcataacctattatcgacaccactagatgcagtagaagttgttggatttttgcgagaaaatcctcatcttgataaaaaaatgataggtgaatacatcagtaatagagcgaacattgctattctcgatcagtttgtcaagtcatttgacttcactgagatgcgcattgacgaagctttgaggttgtatttagaaacgtttaggttacctggagaatctcctttgatatctttagtgatggaacattttgcagaacattggcataaatgtaatggagagccttttgctaatgctgatgctgcatttactcttgcatacgcgatcataatgttgaatgtcgaccagcataatcacaacgttaaaaaacaaaatactccaatgacagcagaagcttttaaacgtaacttgaaaaatgtgaatggagggcaagattttgaagaagaaatgcttgatgatatttataatgcaattaagactgatgaaattgtaatgcctgctgagcagactggtctagttaaagaaaactatgaatggaaagtactattgcggcgaggttccggatcggaaggttactatgtacatgctccaaatggtctattggatcatgatttgttttcattgatttggagcccaactatttcagctttgtcctatttgtttgataagaccaatgatccaaccatttatcagaaagccatatctggattcaggaaatgtgctatgatatcggctcattatggaatgagtaacgattttgataacctcattgtgtctctttgcaagtacaccatgcttcattatacttctgagagtccagaaaatcttaccatctcttttggatcgagccccaaggctaggcgtgctgcaaaaactgtctttgatcttgctcatcgccatggcgacataatcagagaaagttggagaaatattttggactgtattttacaactgtatagatgtaaacttttacctaagattcttgttgaggctgaagattttattgaattgagtggtaaaatatctcttattcgtgaagacatacaactcagccctaaaactgaaactggaatcctcagctcattgtattcttatatagccctcggagcagaaacgaatactcaaaaaggaccatcagtcgaagaccaagaagctattaaagttgcccagaattgtataagggaatgtcatcttgagcagctgataacagaatctaaatttttgcgcattgattctttacaacatttcgtgaaggctctagtcactgcatcttatggacctgaaggacatgtttcactcggtacctcatatagtgaagacactgctgtatttttcttggagcttcttttaaaagtggttattcaaaacagagatcgtatctcatcaatttggtgctctgtaaaagagcatatctacactctacttatgggcgctgctgcgtgtgatcaccacttcttggtcgagaggtctgttgttggtcttctcaggcttgccatccgtttgatgcacaaagaagaaatgggacccatggtattgcaatctcttcgcatgctgctcctccttaaaagttctaccctgtcgcgtgtttctcggcagatatcgtatggtacatttgagcttttgaagacatcggctgcaaatattcattccgctactgattgggcaataatattcaccctcctggaatgtgttggagcaggtgctcctcctccgaaagtcgtttcgaagcctgtcagttctactgaatcaggtgctcgctcagaaggggaagtacaggtggacagtggactaggtaacgagagaggctatacttctgattcggagctgagcaaagctggtagtgttcctttgtcgcccagccttagtccggaggctcctcttagcaacacacctacaggatggattcttgtgggacgagaaggtgaaatccaacctgtaagctgtgtaaggaggggaatgctcccagagctgtctcggtacgatcctttgtcaatggttaagtgcgttgatagcctgtcatttctcgtcagggatgtcgttcatatcacgccttacaactttcatgattgtattcgatgcataaggacattcgttgaagcagctgctaatacagttgaaaggaaaagcagaaaagccggtagggatacagctaggcaatccaagaggaaaaatacaaaaagacgagaggaaagaggactgagccctacggggagtgcctatgacgcagatgagagtgatcctgaggactcccctggctatcagcaagtttgcattcagcttttggaattgatgcatacacttcacacaaggacggctcagatcttccgatggtgggctgaagagacaggacagaaagaagtgtccaatccctcttactggactccaggttggtgccctcttctccaaggcatatccaggctttgttcacaccctaatagagccgttcggatgtcggcaataacttatttgcaaagagcacttctcatgcaagatttgcaatctttatctggggaagaatgggaagaatgtttcactcaagtactgttcccactcctgtccactctgttagctgttaatattccagcgatcgaagaaacaaggataagggcagctactgtactttccaaggtgttcctgcatcacttgtctcctctgcaaaccctatctagttttgcacagctgtggctgaccatacttgattatatggataagtatatgcacgcggacaacagtgacctgctttatgaggctattccggaatcattaaagaacctgttacttgtgatggactcagctggtgttttcaatggattagatgggcgcaatgagatttgggttgtcacttgggatcgaataagctcattccttcctaaccttcagtcagatttatttaaagatcatctaccagttgtagatgctagttcacttgaaacaaaagaagctttagagacctctaaaggtgaaattgaagtcgttcaaactgagcaaccaaccatgcaaagacctcctacttctcaagttgtacagtcgccacctcagcctccgtcaatgcctaaacctggagaagctgttgaaatatcaggacctacgaccaacaataatgttggttcacaaaattggcaacctcctgcacccgtctatccacatcttgagcagatggtttcaacacccatcggcccatcaagtcaactcccagtttactctggatttgcgagtatgccgcatcagccccctcccccgtcagcccaatttttctatcaggacatgtcttctccaagtcaacctaatgcgaccctcaattctgagcaacctgcagttggaggctctttattattagcgtcagcagagatggaacctccaaagcttcccgtgatatctcccccgacttcttcatga

SEQ ID NO: 1594 - DNA, 618 bp, Piezodorus guildinii
atgtcgatcctagcatataacggcagtgccgtaattgctatgaaggggaaggattgtgtcgctattgcttcagatttgaggttcggtattcaaggacagactgtttcaactaattttgaaaaagtttttgaaatgggtcctcatttatacattggacttcctggattaacaactgatacgtttaccgttcttaacaaacttaactttaggaaaaacatgtttgaattgaaggaggataggaagatagctccagatgtgtttctatcaatggtctcaaatctattgtatgaaaggaggtttgggccattttttgttgaacctataattgctggtttgaaaccaaaaactatggaaccctttatagcttcaatggatttactcggttgccctaacaaaccagaagattttgttgtggcaggaacagcttcagaacaactttatggaatgtgtgaagctctttgggaaccgaatctaggtcctgaagatttatttgaaactatatctcaagctcttgttaatgcttgtgacagagatgcactttcgggttggggagcttctgtttacataattgagaaagataaagtaacccacaggagaattaaaacaagaatggattaa

SEQ ID NO: 1595 - DNA, 2778 bp, Piezodorus guildinii
atggagtccccaccttctttagaaactgtacatcaagctgtttacgctctttatcataatccagatcctgctgaaaaagaggaggcttcattatggctaggccagttacaaaaatcagttttctcatggaaaattgctgatgaaatactccataccagttcagatgtggaatgctgttattttgcagctcaaacaatgagaactaaaatccaacattctttccatgagcttcctccagaatctcaccttcccctcagggattctctgatggatcacatcagtaaaattaatgagtcaacaaattctgtgattggtactcagttgtatctggctctggcagatctcgcattgcaaatgggatcttgggaaaaacctgcaatcgatttgattgaacgattttccatgacttcagttcctccactattagaaatgttgacctttttacctgaagaaataaattctagagctttgcgtttaggttctaatcgtagacaagaacttctccacaagttttcacttgctgttcctaatgtctctgaattcctgaaaatgtgtctcaacaattccggaaacaatcctcaaattcaaatcaaagtcttcaagtgtttcacaagctgggtgtcagtacaggcgatgacactcaacgatgttaccgacaatatagttgtagccacagcgtttcatgttcttgcaaataggatggcatcttccaatttacatgaagccgctgcagactgtgtttgctcacttctcgaatgcctagaagataacaacaatcaacagtcgatcgaaatgcaactgtttaatggtgtcatctctttagagcaaccgtttcatatttccgtagcccacgaagagcatgagaagtgtgtaaattactgtagagtatttacagaacttgctgagagttttctggaaaaaatagttagcggaagtagtcctactaaagcgcatttcgccattaagatttttgaccttgttcttacttgtgttggtcatcatgattatgaagtagctgctattacatttaatttatggtatcgcctttcagaagaactgtatcaaaagaaaaactctggacttacatcgttatttaaaccatatatagaaaggctcattgaggcgttatgtaggcattgtcagatggaacctgatcacgaaggaatcctcgaagaaggggatgactttccagacttcaggatgaaagttgccgaactgattcgtgatgtcgttttcataatcggttcctccaactgctttaggcaaatgttcctatccctccaaggacccaataccacctgggacaccacagaagccgcattgttcatcatgcaagccgtagccaaaaacatcatcccggaagaaaacgatgttgttccaaaggttgttgaagctattttgaaccttcctccaaacacacacatagccgtcaggtgtacatcagttcttctactaggagaattgtgcgagtggatcgaaaaacatccccaatatctagaaccagtgttgaatatggtgctgttctgtcttcagcaaccacagttggcgaactcagctgctaactgtttacaaagtatctgcagtacatgtaaaaatcaaatggtgaccaagtttttaggtcttctgcagatacttcaatccctcgacaaattcgttctgacgaatgaatcagttgtcggactattgaaaggcgtcgcttccatcttgagcatcatgcaacatgatcagttacagcaggccatgagagatgtttgtctcatccagattaagccgctcgttcatttaattgagaatgatgttaaactagataaaggtacaaaaagcgatccagcgatttggatggataggctgtccgctatattccgccatatcaatatcaccgttaggaatggagaaattcatccttgccaacccgtcattaccgaaatttggccagtcctttcctccgtttgtacgaaataccaagccaattcacatgtcatggaaagatgctgcaggtgcctcagattcgttgtccgttgtgtgggcaaacaatcggcgaatttgcttgaaccattagtcaaacaaatagtgaccctctatgctcaacacgagcacagctgtttcctctacctgggctctatcctggtcgacgaatatgcttccgagcagggctgcatccagggattgatagacatgcttcaagctttcattcacccgacgtttaccctccttcaaggagaagcgggtctgaaattgcatccagacactgtggacgatcttttcaggctctgtgcgaggttcttgcagagggcacctgtgccgttcctcaccgcgccagccatcaactccatcatggagtgcgccctgtcgtgcatcccgctcgatcatagggatgctaattcttcagtaatgaaattcttttatgatctgattcacgctggaatgaccaacgaagatcacgaggatttctctttgaggcaaagactggtacaaaatataatccaagaaagaggttcagatttagtaaacaaccttttgacagcatccgttttcttccttcagatctatatgctgtcagatgtagcggatgttttgatggagcttatattattcgataagcagtctgctggaaggtgggtagaacaagcattgaaaagaatgccaacgcacaatagtacaggcagtattactgctacaccaaagcaattggaagatttccatcgctctctactcagcgccagcagttccaaaactctaacgactacactaaaagaattttctcgcctctaccgctga

SEQ ID NO: 1596 - DNA, 1533 bp, Piezodorus guildinii
tggaccttctggcgttcgagagggagtgcttcaaagatggcgcaaaggtttcctccgtcgcagccagctccgagcccggttcagcaacctcaaagatatccatcgccttcggggccacctctcaggcaatatgcaccttctaactttcctttgcaacagaggcccggtggctttgtgcagggaggtggtatgggaagcgggatgatgccacgcccacagcaacaaccttacaaccccattaggccaccaataccccaggcgcaaaaacggccaagtgatgtcaggccaccacagcaacaaccaaaaggggagtttcctcatacatccgctggtggaagtagtggtaagaagaagaagaagctggcggataagatcctaccccagaaggtgcgggacctggtaccggagtcgcaagcttacatggaccttctggcgttcgagaggaaactggactcaaccataatgaggaagaggcttgatatccaggaagcattaaaacgtcccatgaagcaaaaaaggaaattacggatttttatttctaatacattctatccagcgaaagaggcaaccgagactgaggaaggaagtgtagcatcctgggagctgagagtcgagggaagactgttggaagattctaaaaatgatcctaacaagcctccaccgttacaggtaaagaggaagttttcctctttcttcaaaagtcttgttattgagctagacaaagaactttatgggccagataatcacctcgttgaatggcacagaactcctaccacacaagaaacagatggttttcaggttaaaagaccaggtgacaaaaatgtgaggtgtacaattcttctcttgttagattatcagcccttacagttcaagcttgatacccgacttgctcgccttctaggagttcacactcaaacaagacctgttatcataagtgcgctttggcaatatattaagactcataaactgcaagatcctcacgaaagagaatatataaattgtgacaaatacctcgagcagacattcagttgccctaggatgaagtttgctgagatacctcagcgcctcaaccctctgcttcatcctccagatcctattgtgatcaaccacatcatcagcgttgaaggtactgaacagaaacaaacagcttgttacgatattgatgtagaagttgacgacacattgaaaacacaaatgaacaacttcctcttatcaacagctagtcaacaagaaatacagagtcttgacaataagatacatgaaaccgttgagactataaatcagttgaagaccaatcgagagttctttttaagcttcgctaaagacccacaacagtttattaataaatggataatatctcaaactcgagaccttaagacaatgaccgatgttgttggaaaccccgaagaggaaaggagagctgaattttattatcagaactgggcccaagaagccgtctgtagatatttttacacaaaagtgcagcaaaagagagcagagttagaacaagcccttggcattcgaaatacttaa

SEQ ID NO: 1597 - DNA, 435 bp, Piezodorus guildinii
atgcctaaagtacggagaagcaagaagcctccaccagatggttgggaacttatcgaaccgactttagaagagttggaacagaaaatgagagaagccgaaactgagcctcatgaaggcaagaggaaagtggaatccttgtggcctatttttaaaatacatcaccaaaaatctcggtacatttacgacttgtactatagaaggaaagctataagtaaagaattgtacgagcattgccttaatgagaacatcgctgataaaaacttaatcgccaaatggaaaaaacagggctatgaaagtctttgctgcttacgatgcattcaaaccagggataccaacttcggaaccagttgcatttgcagggtccccaaggccaagcttgaagagggaaagatcgtggagtgtatccattgcggatgtcgaggatgctcgggatga

SEQ ID NO: 1598 - DNA, 1029 bp, Piezodorus guildinii
atgaaagtgctacttgagagtgatgtccaactaactactcatttttggggagcatcggactacaaagataaacttagcgttgcaataggagaacctctggttgcgagctcagatgccagttgggcgaatcacattctcctaggacaccctgctatgcccacagccacaggacacagtggggtcatcccaagtaatgaagaatgcggcattcgcgatgtatgggctcataatctgaaggatgaatttaaagttatcaggaagatcatacataaatacaattatgttgcgatggacaccgaatttcctggagtggttgcaaggcctatcggtgagttccgaagtacagccgactatcagtaccagctcctgaggtgcaatgtggacctcctccgcattatccaattggggctcaccttcctcgacgagaacggaaaggctcccgcaggtccttacagcacctggcagttcaatttcaaattcaatcttgcagaagatatgtacgcccaggacagtatcgatcttcttcagaattcagggattcaattcaagaaacatgaagaagacggaatagaccctgtagactttgcagaacttctcatgacctcaggaatcgtactgatggagaatatcaagtggttatcctttcatagtggctatgatttcggatacctattgaaactgcttactaatcagaacttacccaatgatgaaagtgaattctttgagcttctcaagatctactttccaactgtttatgatgttaaatatctgatgaagagttgtaaaaacttgaaaggagggctgcaggaggtggccgaccagctggaacttacgagggtagggccacagcaccaagctggctctgattcattattgacgggaatggcgtttttcaaaatgagagagatgtttttcgaagacaatatagacgacggtaaatactgcggtcacttgtacggattgggggcctccttcgttgtcaacggtaacagtttccacgacaacggcgataactcaagtaattcatga

SEQ ID NO: 1599 - DNA, 1206 bp, Piezodorus guildinii
atgtctgactcgcggagagttcaacttaaggaagacctatcttttgtagagttcgaaacaagtgaaaatgttgaagttatatcttcttttcaaagcatgggacttaaagaagatttgctgaggggcatttatgcttatggttttgaaaaaccatctgccatccagcagagagcaatcatcccgatcgtccgcggtcgagatgttattgcacaagctcaatctggtacaggaaaaactgcaacttttgccattgccattttacaatctttggatacgcaaactagagatacacaagttttatgtttgtcgccaacaagagagcttgctgtacagattcagaaagttattcttgctttgggtgatctcatgaacgttcagtgtcatgcatgtatagggggcacaagcttgggagaagatataaggaaacttgattatggccaacatgttgtatctggtacacctggtcgtgtttttgatatgataaagcggcgaaccctaaggacaagatcaatcaaagttttagttcttgatgaagctgatgagatgttgaataaaggtttcaaagaacaaatttacgatgtttatcgcttcttacctccagctactcaggtggttcttatttctgccacattacctcatgaaattcttgaaatgaccagcaaatttatgacggaccctatcagaattttagtcaaacgtgatgaattgacattggagggaataaaacaatttttcgtcgctgttgaaagagaagaatggaagttcgatactctttgtgatttatatgatacattgactatcactcaagccgttattttctgcaatacaagaaggaaggttgattggcttactgaaaaaatgagggatgcaaatttcactgtttgttcaatgcatggtgatatgccacagaaggaaagagatgctataatgaaggaattcagggctggaaaaagccgagtgcttataacaacagatgtgtgggctagaggaattgatgtacaacaagtctcccttgtcatcaactatgacttacctaacaacagagagctgtacattcataggattggtaggtcaggaaggtttggaaggaaaggtgtagccattaacttcgtaaagagtgatgacatcaggattttacgagatattgaacagtattacagtacacaaattgatgaaatgccaatgaatgttgctgacttgatttag

SEQ ID NO: 1600 - DNA, 1599 bp, Piezodorus guildinii
atgacgaacgctgctggagatggacacagatcgcacagcaatgtatataaagacaaaagcaaacctcaagatgttcgcagcagtaacatgactgcggccaaaggcctcgcagatgctattcgtacgagtcttggtcctaagggcatggacaaaatgattcagaaaggaaatggagaagttacaatcacaaatgatggtgctactattttacaacagatgaatgtgactcatccagcagctaaacttttggtcgaactgtctcaagcccaggatgtggaagcaggtgatggtacgaccacagtcgtcatattggccggagccataatggaagctgccgagaagctgatgaaccgtggaattcacccgacgacaatttccgatgcgttcagcattgcggttgaaaaagccatgccaatcttgagagagatgtccattcctctgcaacagaacgacaatgaaagtctcatcaggagtgcatctacatctcttaactcaaaggttgtttctcaacactcatcgatattggctccgttagctgttaacgctgttcttagaataacagatccgaagaaggataaaaatgttgacctaaaagatatcaagatcattaagaaactcggaggcacggtagaagacacagaactcatcgaaggcttagtattcacccagaagttggccaacataaatggtcccaagcgccttgagaaagtcaaaattggactcattcagttctgcatttctcctcccaaaacagatatggatcacaatgtggttatctctgactatgcagctatggacaggatactcaaagaggaacgagcgtacatcctcaatattgccaagcagatcaagaaggcagggtgtactatgttgctgatccagaagtctattttgagggatgccttgtccgatttagccattcacttcttcgacaagttgaagatcatggttgtcaaggatatcgaaagggaagatatcgatttcgtttgtaagactctcggctgcagaccgatcgcatctcttgaccacttcaccagtgaggccttggtcactgctgagctagcggaagaagtatcagcaggaagctcccgtatcgtcaaagtcaccggaatacacaatcccgcaaagactgttaccattttagttcgaggatccaacaatcttgttctcgaagaggctgatcgttccattcacgatgccctttgtgtcatccgttgtctcatcagggaaagggcacttcttcccggaggaggagctcccgagattgaactttcccttcgcctagggcagcacgctcaggtcttgggctcggtagaggcctactgtttgagggaatatgctaaagctctagaaatcgttccttacaccctagccgagaatgctggtcttaacccagtagctaccgtgacggaactgaggaataagcacgttcatggccaaaccagtgctggtatcaatgttaggaagggccaggtaacagatatccttgaagaaaatgtcctgcagccgatgctggtcacagctagcgcaatcaccttagcgacagaaaccgttaggagtattcttaaaatagatgacattctgaatgtcgcccattaa

SEQ ID NO: 1601 - DNA, 1248 bp, Piezodorus guildinii
atggaagaaattggtatcgttctccccgagaaagaagaaaacagtcaagatggaaagcttagcaccatactaggacagaatctgtcagatgacagcgatagtagtgatttattcaccaagtttaagaaattacaaaggcagcttgaatttttagcagttcaggaagagtacatcaaagatgaacagcgtaatctgaagaaggaatatttacacgcacaggaagaagtaaagcgaatccagagtgttcccttagttatcggtcagttcttagaagcagttgatcaaaatactgggattgtaggtagcactacaggctctaattattatgtgaggatcttatctacgatcgatagagaactattgaagccttcagctagcgtcgcccttcacaagcacagcaatgctcttgttgacgtcctcccgcccgaagcagattcctctatttcgatgctccaagcagacgaaaaaccagatgttcagtattcggacatcggtggcatggacatgcagaagcaggagattcgtgaggctgtggaattgcctttgacacatttcgaactctaccgccagattggtatcgatcctcccagaggagtgcttatgtatggacctccaggatgtggcaagactatgcttgctaaagctgttgctcatcacacaactgctgcattcattcgagtagttggctccgaattcgttcagaaataccttggagaaggaccgaggatggttcgtgacgtttttagacttgctaaagaaaacgctcctgccattatcttcatcgacgaaattgatgcaatcgccaccaaaaggtttgacgctcaaaccggtgcagacagagaagtacagaggattctgttggaactgctcaaccagatggacggttttgaccaaaccaccaatgtcaaggtgatcatggctaccaacagagcagataccctggaccccgccctcctgcgacccggtaggctggacaggaagatagagttcccccttccggacaggaggcagaagaggcttgtcttctcgaccatcactgccaagatgaacctctccgaggaggtagacttggaagactacgtcgctcgcccggacagggtgtctggtgctgacatcaacgctatctgccaagaggctggaatgcatgctgttagggaaaatcgttatatcgtccttgcaaaagattttgaaaaaggttataagaacaatattaagaaggatgaatctgaacatgagttctataaataa

SEQ ID NO: 1602 - DNA, 489 bp, Piezodorus guildinii
atgcctaacattaagttgcaaagttctgatggagaaatatttgaagtggatgtggaaattgccaaatgttcagtgaccataaaaactatgttggaagatttaggcatggatgaagatgaagaagaagttgtaccattgccaaatgttaattctgccattttgaagaaagtaatccaatgggccacttaccacaaagatgatccacctccaccagaggatgatgaaaacaaggaaaagagaaccgatgacatttcttcttgggatgctgattttcttaaagttgatcagggaactctttttgaattgatacttgctgccaactatcttgatatcaaaggtctacttgatgttacatgcaaaactgtggctaacatgattaaaggaaaaactcctgaagaaattcgtaaaacatttaatatcaagaatgatttttctgctgctgaagaggagcaagtacgtaaagaaaatgaatggtgtgaagagaagtaa

SEQ ID NO: 1603 - DNA, 966 bp, Piezodorus guildinii
atgaaaatggaagtagaaaatatgatttccattgagatggaagataagacttcgttaaaagaactggatcagtggatagaacagctgaatgaatgcaaacaacttaccgaaagccaagtcaaaactctttgcgataaggcgaaagaaatattagccaaggagtcaaatgttcaagaagtgaaatgtcctgtcacagtttgtggggatgttcatgggcagttccatgatttgatggaactgtttcgaataggaggaagatctccagacactaattacttgttcatgggtgactatgttgatagaggatactattctgtggaaacagtgacattactagttgctttgaaggtaagatatcgagaaagaatcacaatcttaagaggtaatcacgaatcacgccaaatcacacaagtatatggtttctatgacgaatgtttacgtaaatatggaaatgcaaatgtttggaagtatttcacagatttatttgactatttaccattaacggctcttgtaaatggtcaaatattttgtcttcatggtggtctttcaccgtccatagacactcttgatcatatccgtgcattagatcgcctacaagaagtaccacatgagggtcctatgtgtgacttactttggtcagatcccgatgacagaggtggttggggtatttctccaagaggtgcaggttacaccttcggtcaagatatttcagaaacttttaaccactcaaatggcctcactcttgtgtcaagagctcatcagctcgtaatggaaggctataactggtgtcatgatcgtaatgttgtaacaatattttctgcacctaattactgttatcgttgtggtaatcaagcagccattatggagttggatgatgcgcagaaatattcattcctgcaatttgacccagcgccgaggagaggagaaccacacgttactaggagaactcctgattacttcctataa

SEQ ID NO: 1604 - DNA, 966 bp, Piezodorus guildinii
gatggcagaactttgtctgattacaacatccagaaagaatcaaccctgcatctagtactacgtttaagaggaggcatgcagatttttgtcaagacactcactggaaagactatcactctagaagttgaaccatctgatactattgaaaacgttaaggctaaaatccaagacaaagaaggaattccaccagaccaacaaaggcttattttcgctggaaaacagcttgaagatggcagaactttgtctgattataacatccagaaagaatcaaccctacatttagtattgcgtctgcgaggaggtatgcagatttttgtcaaaaccttgactggtaaaaccatcaccctggaagtagagccttcagatactattgagaatgttaaagctaaaattcaggataaagaaggtattccaccagatcagcaaagattgatttttgcaggtaaacaacttgaagatggtcgcaccctttctgactacaatattcaaaaagaatcaactcttcacctcgtcctccgtttaagaggtggaatgcaaattttcgttaaaactttaactggaaagaccatcaccctagaagtcgaaccatctgacacaatagagaatgttaaggctaaaattcaagataaagaaggaattcccccagatcagcagcgattaatttttgcaggaaagcagctcgaagatggccgtactctttcagattacaacattcagaaagaatccaccttgcatttagtacttcgtctgagaggagggatgcagatttttgtcaagactttaacaggtaaaaccattaccttggaagttgagccttcagacacaattgaaaatgttaaagccaaaattcaagacaaagaaggaattccgccagaccaacagaggttgatttttgcaggaaagcagctggaagatggccgtactctctcagattacaacattcaaaaagaatccaccttgcattta

SEQ ID NO: 1605 - DNA, 1629 bp, Piezodorus guildinii
atgcaaccacagataatacttctgaaggaggggactgaaagttcccaaggaaagcctcagctagtctcgaacataaatgcttgccagattatcgcagatgcaattcgaacaactcttggcccgaggggcatggacaaactcatcgttgatggtagtggaaaagcaacaatatcaaatgatggtgctaccattttaaaacatttggatatagtgcatcctgctgccaagtgtttagtggatatagccaaatctcaagatgctgaggtcggagatggtactacaagtgttgtccttatcactagcgaaattctgaaacagttgaaaccatatgtggacgagggtgtgcatcctagaatcatgatgaaagcagtccgcaaggccacacagttatgcttagataaaattaacagcttagctgtcaagatcgagaagagcagcgcggagcagcaccgctccctgctggagaggtgcgctgccacggccctcagctccaagctgatccaccagcagaaggagttcttctccaagatggtcgtagacgctgttctcttgttggacgagctccttcctctggacctcatcggaatcaagaaggttcctggtggagctttagaggaatccttgttggtctctggagtagcctttaagaagaccttctcctacgcaggctttgaaatgcaacccaaaaagtacacaaatcctaaaatagctattctcaacattgaattagaattgaaagccgagagggacaacgcagaaatcaggctcgacaacgtggaggaatatcaaaaagtcgtagatgttgaatggcaaattttgtatgaaaaattagacacaattgttaagtctggagctcaggttgttctttcaaaacttcccatcggcgatgtagccactcagtattttgcggacagagatatgttctgtgctgggcgtgttgctgatgaagacatcagaaggactcagaaagcctgtggtggcacgatgattaccacaaccaaagatatgtctgcttccgtcctcggaacatgcgaattatttgaagaaaaacagattggtggtgacagatataacctgttcgccggttgccccaatgccaagacctgtaccatgatcctgaggggcggagctgagcagttcctcgaggagactgagaggtcccttcacgatgccatcatgatagtcaggagaacaatcaagaacgacgcagtcgttgcaggtggtggcgctatcgaactggagctttccaaaatgctacgagactactctaggaccatcgctggtaaagaacagctgttgatcggagcggtagccaaggccttggagatcatcccgaggcagctctgcgacaatgctggctttgatgccactgccatcctcaacaggctcaggcagaagcacgctcaaggaagctgctgggaaggtgttgatgtgacattggaagatatctccgataacatggagaagtgcgtgtgggagccttcggtggtgaagaggaacgccctggaagcagcctgcgaggctgtgtgcctggtcctgtctgtcgacgagaccatcaagaaccccaagtcaggtggcggtgggatgggcgaccagcctgtgatgcctccgagggggcgtcccatgtga

SEQ ID NO: 1606 - DNA, 13935 bp, Piezodorus guildinii
atgactgattccttggaatcaaatgatcctcccccagaggagcagccagtgtcgataatagatataacggattttttagactatcttcgtgaaaatgttaaattgaatttattaggtgttaaaagtgtacctcctgctttagatactgcattagatgataatggaaatttggattgtattaagaagtttttaagtgacccacaaattgctactctaatagtacaaaagaattcaaccaaagatgatgacccagaacagagtggtgagggtgaagatgaaaaggaaacacccaccatatcaatatctaacatggttcagttttctagccctaaagcatcaagtcttctgttcatgaagaatggagcgattatggatgctgataaaagcatccagtctcagttacacatgatagaattttctgagggcactgcgtacgaaagtctacatgctatcattagcaaagggatgtcaccttactttaaaagttatgttaaggaatctggccgagctgatagagatggagataaaatggtgccatctgttgaaaagaagattgatgaattagaaatgggcctgttgcacttacaacaaaacattgacatccctgaaataacgcttgtagttcatccaattgtttcaaatgttattaaaaaatgtgctgaagaaggaagaaaaccaaaagtggctgattttggtgatcgtgtcgaagattccacctttctcaatcagctgcaacatggtgttaatcgatggatcaaggaaatccaaaaggtaacaaaattagatcgagacccatcttctgggaccgcattgcaagaaatctccttttggttaaatcttgagagagcgttgcatcgaatccaagaaaaaagagaatccattgaagttgggcttacattagaaattctgaaacatggaaaacgttttcatgctactgttagtttcgacacagacacaggacttaaacaggccctggcaaccgtaaatgattacaacccgttgatgaaggatttccctattaatgacctcttgagtgccactgagcttgatcgaatcaaattagctgttcaacagatcttcactcaccttagaaagattcgtaacactaagtacccaatgataagaggactaaggcttatcgaagccatctcaagagatctcacaacacagctcttaaaagttttaggtactaggcgcttgatgcacattccatttgatgagtttgagaaagtaatgcaacaatgtattaatgtctttgtcacgtgggatgacgaatatgaaaaactacaaaatcttctaagggatattgttaagaaaaaacgagatgaacagcttaaaatggtatggagggttatgcctgcccataaaaagctgcaaacgaggatggaacagatgcgtaagttcaggcatcaacacgaacaactgaggactgtgatattgagagttctccgaccagtacctgcatcccttattaacggtcaagaggttactggccaagacaaagtagtcgatgatgcacccaacatatctgcagtggaagaggtgaacctagcctacgagaatgtgaaagaagtggattgcttagacatgtcaaaggaaggcggtgaagcttgggaagctgcggtagcgcgttacgaggaaaagattgataaagttgaaacacgcattactgcccacttacgagatcagctggggcaggcgaaaaatgccaatgaaatgtttaggatattttctcgtttcaatgccttatttgtgaggcaacatattcgaggggccataagagagtaccagactcagctgatacagagggtcaaagacgatattgaagcactccatgagaaattcaaggttcaatacggccaaagtaaaggctgtaggatgagctctatcagagatttagcaccagtttcagggtctataatctgggtaaagcagatcgatcgacagctcaccacgtacctaaggagggtggaggatgttctaggtaaaggctgggaaaatcatattgaaggtcaagcgctgaagtctgatggagacagttttagactcaaattaaatactcaagaaatattcgatgactggtctcgatccgttcagcagaggaacctttcagtatctggtaggattttcgcaatagagagtactcgttcccgttccgggagaggaaacttactgaagttgaaagtgaattttctcccagaaatcattaccctctacaaggaggtgaggaacttgaagaatttaggatttcgagttccattagccatagtaaacaaagcacaccaggccaaccagctgtatccgtttgccgtctccctgatagagagtgtcagaacgtatgagagaacacttgaaaagttggacgataaagccagtattattcctctggttgctggcctgagaaaagaaatgcaacaacttgtggctgaggggatacaattggtctgggagagctacaagttggagcaatatgtccatcgattcgctgaacaggtctgtactttccaggagaaagttgaggatcttctggtcgtcgaggagcaactcgatgttgatgttagatctttggaaacgtgcccctactctgcatcaactcttcgagacattcttgctaaagtccagcatgcagttgatgatctttcattgaaacagtattcaaatcttcacatctgggtcagcaggcttgatcaagctgttgagaaaaatcttggtggcaggcttcaggcaggaattgacgcttggactgatgcattggaagggaagagccatgagctagacctgagtatggacaccgatgcaccagccaggccgacacacgctcctggtggcgacccacatgtacagacggtgactcatgaagttcgtataaccaaccagatcatgtacctttacccaagcatagaggaagcaaggttccagatcatgcagcagttgttccaatggcaggctgttgtaacatctcagcaaagacttcagagttcccgatatcagcttgggcttgaaaggctcatatcccagtcgtatagagaccttttgactaagctaccaaatggttcgcaagcccttatcaacgcctatgattcaatcgacaggaaaatcaaagatgttgtcaactatgtagacgagtggctgaggtaccaatctctatgggatcttcagtcggataccctgtacagcaggctgggagatgacatcaccatgtggatgagatgtctttctgatgtcaagaaatcacgtactacgtttgatacttctgagacacgcagacagttcggtcctatcgccatcgattacgctaaagtacagagtaaggtagcgctaaaatacgattctcttgataaggaaatcttggccaaattcggtggccttctaggccaggaaatgtctggattccattctcaaatttctaagtcccgaagtgaattggaacaacagtcgatcgaagctgcgagtacttcagatgccgtctgtttcattacgtatgttcagtcattaaaaagaaacatgaaatcctggcagaaacaggtcgaaatttatagagaaggacaaagaattctcgagcgccaaagatttcaatttcctaacaactggttacatgtggacaatgttgagggagagtggtcagcttttaatgagatcatcaaaagaaaggacttgtctatccaagcacaggtggtgagcctgcagcagaagatggtcgctgaggaccgtgcagttgaggcaaggaccaacgacctcctttctgactgggagcactccaagccaatagagggcaggctcaggccggacgaagcgctcgctcagctcaacgagtttgaagtgaagttcgctcgactcaaggaggagagggacaacgtagctaaggctaaggaggccctcgagctgcaatatactggtgcaagcagcggtagtgaagaaagagtggctgtggtatttgaagagatggaggaccttaaggaagtatggaccgaattatctggaatatggaggcgattagatgagactcgggagataccatggctttcagttcagcctaggaagcttcgacagcagctggatggtctgtcccaacaactcaaagagttaccagcgcgtgtcaggcagtactcttcgtatgagtatgtcaagaaactgctccaaggatatactaaggtgaacatgctgatcgtggagttgaagagtgatgcactgaaggagaggcactggagggcgctcatgaggaagctgcgtgtgaactgggtcctgtccgagctgtcgctgggtcaggtttgggacgtggaccttcaagctaacgagagtgtcgtcaaggatatcattctcacggcacaaggtgaaatggcactcgaggagttcctgaggcaggtcagagaatcttggcagaactatcagctagatctgatcaattatcagaataagtgccgtcttatcagaggctgggacgatctcttcaccaaagtcaaagaacacattaattctgtagcggccatgaaactgtcaccatattataaggtgttcgaagaagaggctctcacttgggaagagaaactgaatagaattaatgctctgtttgacgtctggatcgatgttcagaggcgatgggtttacctggaaggtattttctccggaagtgcagatatcaaaacccttttacccatagaaacctctcgttttcataacataagctcagattttcttggtctcatgaagaaagtagctaaatcaccgatggtgatggatgttctgaacatccagggtgtgcaaaggtcattggagagattagctgatttgttagaaaagatacagaaagctcttggagagtatctcgaacgggagagaatgtcgttccccagattttacttcgtcggtgatgaagatttactcgaaattattggtaattccaaaaatattgcaaggcttcaaaagcacttcaaaaaaatgtttgctggagttgcttctattttgttgaatgaagataataccatcataactggtattgcatctcgggaaggagaagaggtcatctttaccaatccagtttcaaccgttgatcatcccaaaataaatgaatggctgtcattggtagaaaaagagatgcgattaacattagctgctacccttgtgtctgctgttggcgagcttaggggttttaaagacgctcctttggatcctccgaattatatggcttgggttgacaggtatcaggggcagatagccgtacttgctgcccaagtgctttggtcggaggacgttgaagcagcactgggaggaaagtcgggaggccttcagggggttctgacacaggtcgagggcaccctcactgtcctcgctgactgtgtcctccacaaacagccaccgctcaggaggagaaagcttgaggcattgattaatgagtttgttcacaagagaactgttactcgtcgattaatacaagcaaatatatcttcccctaaatcctttgaatggctttgtcagatgaggttctatctagatcctacgcagactgaagctctgtctcaactctctattcacatggctaatgccaaattctattatggctttgaatatttgggcgttcaagatcgactagtccaaacacctttaactgataggtgttatttgacaatgacacaagctttggaggcacgtttgggtggatcaccatttggtccggctggtacaggaaagacagagtcagttaaagctcttggtcaccagcttggtcgttttgttctcgttttcaattgtgatgaaacttttgacttccaagctatgggtagaatatttgtcggtctctgccaggttggagcctggggttgtttcgatgaattcaacaggcttgaagaaaggatgttgtctgctgtgtctcagcaaattcaaaccattcaagaggcactgaaatatcatatggattcaaataatagagactctactttgaccgtcgaactggttggcaagcaagttcgtgtatctccagacatggcaatatttattactatgaatcctggatacgctggacgttccaaccttcctgataacttgaagaaactattccgatcacttgccatgaccaaaccagacaggcagctcatcgctgaagttatgttgttctctcagggtttcagatctgccgaaaagctagcctctaaaattgtaccatttttcaaactttgtgatgaacagctgtccaaccaatctcattacgatttcggcctgagggccctgaagtctgtgcttgttagtgctggcaacgttaagagagacaggattcagaggatcaaggaaaagagagaaggcggaagtggtgatgaagcaaccattgctgaaaatcttccagaacaagagattttgattcagtcagtttgtgaaacgatggtaccaaaattagtggctgaagatattcctctgttgttttcactcctcaatgatgttttcccacaagtccagtatacaagggctgaaatgacaaaattaaaggaagagataaggaaggtatgtcaggaagaatatcttgtctgtggagaaggagatgagcagggaggaccttggatggaaaaggtcttacaactttaccaaatctccaacttgaaccatgggttgatgatggtcggaccttctgggtccggtaagtcctcggcttggagagtgctactgaaagcgttggagcgcttcgagggaacagaaggtgtagcccacgttatcgatcccaaagccatgtccaaggaggctctctacggtgtcttagatccaaacactcgagagtggaccgatggtctattcactcatgttcttaggaagataattgacaatgtcagaggagaaataaacaaaagacaatggatcatatttgatggtgatgttgatccagaatgggtcgaaaacttgaactctgtacttgacgataacaaacttcttactttacccaatggtgagagattgtctctacctccgaatgtccgagttatgtttgaggtacaagatttaaaatatgcaaccctcgcaactgtctctcgttgcggtatggtatggttctctgaagatgttttatcgacagaaatgatttttgaaaattacctttcccgccttagacacattccgttagaggaagcagaagaagaatcttctttcccgcagctgaagaagattggtggtgagagaaaagaagaaggaatatcgccagcgatgcaggtacagacggacgttgcgaacatcttgcagagctacttttcaccagacggtctcgtagttaggtgcctcgagtatgctctcaagcaggaacatataatggacctcaccaggctcagagctcttggttccttgttttccatgctcaatcatggtgtcagaactgtgatacaatataaccagagccattctgattttccattaccttcagagcagctggatagatatatccctaaggttttaatttattccctgttatggtcatttggaggagatgctaaactcaaagttcgctcagacttgggcgatttcattcgttctgttaccaccataccgttgccgccaaacaatcccaacataccaatcatagattatgaggtaaatatatctggggaatggagcccatggtccgccaaagtacctcaaatcgaagtggaaactcacaaagttgcagcgccagatgtggttgtgcctacgctggacacggttcgccacgagtctctattgtatacctggcttgcagagcatagacctttagtgctttgtggtcctcctggatcaggtaagacaatgaccctgttttctgcactaagggcccttccagatatggaagtggtcggccttaacttcagctctgctacaacgccagagcttctcctgaagactttcgatcattattgtgaatataggaagactcccaatggggttgtcttggcgccagttcagttgggaaaatggttggttcttttctgtgatgaaatcaacttgcccgacatggactcttacggaacccaacgagtcatctccttcttgagacaacttgtcgaacagcggggattctataggtcttctgatctcgcttgggtttcccttgagaggatccagtttgtgggtgcttgtaatcctcccacagatcctggcaggaagcccttatcacacagattcctgaggcatgtgccggtcatttatgttgattatccgggcgaaacatctctcaaacagatttacggaacattctcacgagctatgctgaggcttattccttcattgcgaggttatgcagaaccgttaacgaatgcaatggttgaattctatctgtcatctcaggaaaggtttactcaggatatgcagccacattatgtctattcacctagagaaatgacaagatgggttaggggtatttgtgaagctataaggccattggacagtttgaaagtagaaggacttgtgaggttatgggctcatgaagctctccgccttttccaagacaggcttgttgaagccagtgaaagggaatggacaaatgaaaatatcgacaaagttgccctcaaacacttcccatcagtggacaaggaatcggctcttggacgaccgatcctgtattccaattggctgtcgaaggactatatccctgtcgagcgtgatcagttgagggattacgttaaggcaaggcttaaagtcttttatgatgaagagttggacgtgcctctcgtcttgttcgacgaggtcctggaacatgtgctgaggatagacagaatattcaggcagccacaggggcacttgctccttataggggtctcaggagctggcaagaccactctctcccgctttgtagccttcatgaatggactctccgtattccaaatcagggttcacaataagtacactagcgaagatttcgacgaagacttgagatctgtgttgagaagatctggttgtaaaaatgaaaagattgctttcattctggatgaatcgaatgtcctagaatctggtttcctagagaggatgaacacccttctggctaacggagaagtgcccggactgtttgaaggtgatgagtacagcaccctgatgacgcagtgcaaggagggagcccagagggaggggctgatgctggactcaaatgaggagctgtacaagtggttcaccggccaggtgatgaggaacctccacgtagtgttcacgatgaaccccagccatgaggggctcaaggacagggctgccacctcgccggctctattcaacaggtgtgtccttaactggtttggggactggtctgatggtgccctgtaccaggtgggtagagagttcactaataccttggatctggacggaccacctacatggaaggctccagattttttcccaatcgcttatgcaaatttgccatcacctccaaatcacaggcaagcggttataaatgggtgtgttttcgtacatcaaacgctgcacaaagccaatcaaaggcttgccaaacgtggagcacgcacaatggctatcacgccaagacattacttggacttcatcaatcactttgtcaagttgtatagagagaaatgttccgagcttgaagaacagcaacttcatttgaatgttggtttaggaaaaatagcagagactgttgagcaggttgaagaaatgcaaaaatccttggcagttaaatctcaggaacttcaagcaaagaatgaagctgctaatgccaagctgaaacagatggttaaggaccaacaagaggcagagaagaagaaggtacagtctcaggaaatccaatcgcaaattgagaaacagaaacttctgatagctcagaagagggaaggtgtaatggcagatctcgcccaagtggaaccagctgttattgatgctcagcaggccgtgaaagagataaagaagcagcagctggttgaggttaggtcgatggccaaccctccggcggtagtcaagctggcattggagtccatctgcctcctcctcggggagagtgccactgactggaagtccatcagggcggtcgtcatgagggataacttcatcaattctatcgtcaacaatttctctaccgagaatatatctgatgaagttagagagaagatgcatacccgttacctgagtaacccagaatatactttcgagaaggttaacagagccagtatggcatgcgggcctatggtgaagtgggctgtggcccagataagttacgcagacatgttgaagaaagtagaaccactgagggaagaattacgatcattagaagagcaggctggcgagaacgaacagaaaggagaagacacaaaagctctcatcgcccaattagagaagagtatagctgcctacaaggaagagtacgcccagttgattcaggaagggctcgcgatcaagcaagatttagaaaatgtgcaagccaaggttgaccggtctattgctctcctgaaatctctcggtcttgaacgatcaagatgggaagcaacatcagagacattcaagtcccagatggcaactattatcggggatgtcttactctcttcagcttaccttgcttatgctggttactttgaccaacattctcgacacaacctcctgtctcgttggacggagcacctcagttctgcaggtatccagtacaggcaagacatagcccttacagagtacctttctaatcctgatgagaggctcaggtggcaagctaatagtctgcccaccgatgacctctgcacggaaaatgcaattatgctgaagagattcaaccgctatccactcattatcgatccatctggacaggctactgaattcattatgaatgaataccgagataaaatcactaagaccagtttcctcgatgattcattcaggaagaatctcgagtctgctcttcgattcggaaatccattacttgtccaggatgttgaaaactatgatcctattttaaatcccgtactcaaccgtgaagtaagacgaactggtggcagagttttgatatcactaggagaccaggatattgatttgtcaccatcatttgtgatattcctatctacgagagatccgactgtggaattcccaccggacatctgttccagagttacgtttgtcaatttcactgtaactagatcctcattacagtcccaatgtctgaaccaagtacttaaagctgaaagatctgatatcgacgagaagagatctgacctcctcaaactacagggtgagttccatctaagattgagacagttggagaaatctttactgggagctttgaacgaagccaagggtaagatcttagatgacgattccgttatcactaccctggagacacttaaacaagaagccgcagagattagtaagaaggttgaagaaaccgacagggtcattggggaaattgagactgtttcacaacagtataaacctctatcacaggcctgcagcaatatgtacttcaccctggactccttgcaccaaatacacttcctctaccagtacagcctcaagttcttcctcgatattttctcagctgttctcttctccaatccatccctcgacggccttacagatcacacccaaaggctgggtgtcattacgaagcagctgtttgctgtatgctatgagagagttgcacggggtatgctgcataccgaccgattgacacttgcgctgctactatctaggatatacctgcgtggattgccccaggaagatcaactggaggctgagttccaccacttcctgagaggtaaggagggagtcgtagcctccggtggaggagcttctcacttggaaggtctctccagcgaccagctggaagcactaattaggttgagcaacaggctaccacaattcaaggaattaatgaagaaggttaatgaaatgcctgagtttgttgcatggctccagcagtcaacaccagaacagaacgtccctacattgtggcacgaggataagccgttatcttctattgcaactgctatgaacaggcttcttttaattcaagccgtacgaggagacagggttactgcagctggtgccggactggttagtgctgtgcttggcgaaggattcacagcccgagctgagagggaattggatctggctcatattgttgagtctgaaatgactgctggtgtacctgttctactctgctctgtccctggttttgatgccacttccagggttgatgacttggctgctgaatctggtaaacagttggcttctatagctattggttctgctgaaggattctcacaggcagactctataatcaatatggctgtgagatcaggaaggtgggtactgcttaagaatgtccacctcgctccacagtggcttgtccaattggagaaaaaacttcactctctacaaccgcactctggattccggctgttccttacgatggaaatcaatcccaaagttcctgttaatctcttgagagcaggtcgtatcttcgtcttcgaaccacctccaggaatcagggcgaacttattgagaacattcagcaccgttcccgcctctaggatgatgaaggcgccaagtgaaagagcaagattgtacttcttgctcgcctggttcaacgctattgtgcaagagaggctgcgatacgctccactcggttgggccaagcactacgaattcaatgagtcggatcttcgtgtggcttgtgacactttggatacttggattgatgcaactgctgtgggaaggacacaattgccgcctgagaaggtaccatgggatgcattggttacacttttgtcacaatgtatctatggtggtaagatagataatgattttgatcagaggttgttatcttcattcctttcaaaattgttcacaccaagaagctttgaggcggacttcgcattagtcgccaatgttgatgctggagcacctggaggccagaggcatattacaatgccagacggaactagacgggaccatttcttgcactggatagagtctttggccgacagacaaactccatcttggcttggtctgcctaataatgcagagaaggttcttttgaccaataagggtactgatttggtgatcaaactgctaaagatgcagcagctggaagatgaggatgagctggcttatacagaacaggaatctggacccccttcgtcactgcagccgggcccagaccctggcaggccggcctggatgaggaccctccacaactcggccctcacctggctacagctcttaccgaccagccttcagacattgaagaggacggtagaaaacatcaaggatccattataccggtactttgagcgtgaagtcaactcaggggccaaacttctcagggatgttattcatgatctcactgatgttgtcgccatttgtcagggggagaagaaacagaccaactatcataggaccatgcttagcgatctcgtcaggggaattcttccttcaggatggaggaggtataccgttccaagaggatgcactgttatccaatggataactgacttcagcaatcgggtgaaacagttggatactatttcacagcttgcgtcacaaagaggaccatctgaaattaagaatactccaatctggttgggtggtctgatgaaccctgaggcttacatcactgctactaggcagtgcatcgcgcaggctaacagttggtcccttgaggagttgatcctggacgttactatacctgagccatcatccaactcctctgttgctactgatgaatgcagtttttctgttactgggcttaaattgcaaggtgcacagtgtagaaataatcaacttctcctcacatctacaattatgatggacctgcctacaacattacttaggtggcacagggctggcggagagggagattccgggaagctgtctttaccagtataccttaattcaacacgtagcgagcttcttttcactgttgacttgaacatcgccccaggtcaagaaccacacagcttctacgagaggggagtagccctcctcacttcaacagcgctcaactag

SEQ ID NO: 1607 - DNA, 2640 bp, Piezodorus guildinii
atggctaagtctagtcctgaatctagcgatagtgaggaggataggaaacaaagagatgaattcgctgcacgacttaggaaaaaagataaagaaaatacaagaaaaatgacaaccattcattcagataaaagagcatacgaggaagcagctaaaagattaaaaattgattctgaacatcaagaaaaattgatccctcggttaagggtcgaatcaagaagaaagtatttagaaaaaagaaaagaagacaaagttcttgagcttgaagctgatataattgatgatgaatatcttttcaatgaggatgaactcactgagagggaaagaaaagacagggatcataaaaaaaaattattggtccttgcaaaagagcatgaaagagctagagaactagaaaaagttcagagatatcatatgccaagagatgtaaaagatagtgttgaacaatatgaggaagtcgatgagagggaaaataagccaaattatgaacaaaggaaatgggaagaggaacagatgtcatctgctgtgtttcactttggtgcaaaacaaaaggataaataccaggaagaatacgatttggttttagataatcagattgaatttattcaagctatgagtctagctggaactaaagaaaagcctgagcagcaactgacagaaaaggaaagaaagagattgacaattgaagaaactcaaaaaagccttcctgtttttaaatttaaggatgagctagtgcaagccatcaaggatcatcaaatcctgatcatagaaggtgaaacaggctctggtaaaactactcagattccacaatatttatatcaagcaggttttactaacgatggcaaaaaaattggctgtactcaaccgaggagagtcgctgcgatgtctgttgcagctagagttgctgaagagatgtctgtgaagttgggaaatgaggtaggttacagcattcgttttgaagattgcacttccgagagaacagtaataaagtacatgactgacggtacgcttcacagagaatttctctcagaaccagatctgcaaacttacagtgtcatgataatagatgaagctcatgagagaacattgcacacagacattttatttgggttagttaaagatattgcaagatttagatcagatcttaaacttttaatatccagtgctacattggatgcagaaaaattttcaacattttttgatgatgctccaatttttagaattccaggaagaaggtttccagttgatatatattataccaaagctcccgaagcagactatattgatgcttgtgtggtctcaattctacagatacacgcaactcaacctttaggcgatattctagtattccttactggacaggaagaaattgaaacctgccaagaaattttgcaagatagagtaaggcgtcttggaagcagaatcaaagagttattaatacttccagtttattctaatctaccatctgacatgcaggccaaaatcttccaaccaactccacctaatgcaagaaaggttgttttagccacaaatattgctgagacctctctcactatagacaatataatttatgtcattgatcctggtttctgtaaacagaataactttaactcgaggactggtatggaatcattgatagttgtgcctgtttcaaaggcttcagccaatcagcgtgcaggaagagctggacgtgtagctgctggaaaatgctttaggctttatacagcatgggcgtataaacatgaactggaagacaacactgttccagaaattcaaaggatgaacttgggaaatgtcgtattgaccctcaaagcccttggaatcaatgacttgattaattttgattttttagaccctcctcctcatgaaacattggtgcttgctctagaacagctctatgctttgggggctttgaatcatcatggagagctaacgaaattgggtcgaagaatggcagaatttccattagatccaatgatgggtaaaatgttgcttgcatctgaaaagtataaatgcagtgaggaaattgttactattgctgcaatgttatcggtgaatggtgccattttctatagaccaaaggacaaagttgttcatgctgatactgctagaaaaaattttttcctttctggtggtgaccatcttgttctctggaatgtttataagcagtgggctgacactgacttcagcactcaatggtgctatgaaaattatattcagtataggtcgatgaaaagagctagagatgttcgggaacagcttgtgggtcttatgcaacgtgtagaaatggacctcatttccaatcctactgatagtattgctataaggaaaacaattacttctggttatttctatcacattgcaagactttctaagggtggccattataaaacagtcaaacataaccaaactgtaatgatacatcccaatagttgtctgtttgaggatcttcctcgctgggtcgtctatcatgagcttgttttcactactaaggagttcatgcgacaggttgctgaaattgagagcaaatggctactagaagtagcaccacattactataaacctcgtgaattagaagattcaaccaataccaaaatgcctaaagtattaggaaagaccagagcacagctgggggaacattaa

SEQ ID NO: 1608 - DNA, 1371 bp, Piezodorus guildinii
atgaagattgaagaagtcaagagtactgttaaaacacaaagaatatctagtcatagtcatattaaaggtttgggattagatgaaaatggagtacctattcaaatggcagccggtttggtgggtcaagaaaatgctagagaggcagctggaatagtagtggatatgattaaatcgaagaaaatggctggtagagctgtattgatggctggaccaccaggaactgggaaaacagcaatagctctagctatggcccaagaattaggaaataaagtaccattttgcccaatggtagggtcagaagtttttagctctgaaattaagaagactgaggtgttaatggaaaatttcagaagggccattggccttaggatcaaagaaactaaggaagtttatgaaggcgaagttacagaacttacacctgtcgaaacagaaaatccaatgggaggatatggcaaaactgtgtcccacgtaataattggattgaaaacagcaaaaggtacaaaacagttaaaactagacccaagtattcatgaaagtttaacgaaggaaaaagtagaagttggagatgttatatacatcgaggcaaacagcggtgctgtcaagaggcaaggaaggagtgatacctatgcaactgaatatgatcttgaggcagaagaatacgttcctcttcctaaaggtgatgttcataaaaagaaagaagttattcaagatgtgactctacatgatctagatgtagccaatgctagaccacaaggagggcaagacgttttgtcaataatgggacaacttatcaagtcaaagaaaacagaaattactgataaattaagagctgaaattaataaagttgtcaacaggtacatagaccaaggtattgctgaactagtgcctggtgtgctttttattgacgaagttcacatgcttgatatagaaaccttcacttaccttcaccaggctcttgaaagtgcaatagcacctattgtagtctttgctacaaatcggggtcgttgtcaagtaagaggtgctgcagacattatttcaccacatggactacctttagatctgctggataggttgctcataattcgtactgcaccttacagccaaccagaaatgtgccaaattcttaagttaagagctgtaacagagggactaagcattgatgatgatgcgttatcagagcttagtgatattggaagtaaaactactctcaggtatgcggtacagttgttgaccccttcaaatttaacagctaaagtgaatggtcgttctacaatcactagggaagatgtagcagaagtaggacaactatttttagatgcaaaatcttccgccaaaatactagccaaacatcaggatcagtatatgaaataa

SEQ ID NO: 1609 - DNA, 2196 bp, Piezodorus guildinii
atgacatcaattattaagtttcatgctttgtctggagtgatggatgaatctccaccttgctatattttgcaagttgatgagtttcggtttttgttagattgtggttgggatgaacactttaatcaggattatatcaaggaacttaagagacatgttcatttaattgatgcggttttgcttacttatcctgaccatttacatttaggagcattaccttatttagttggaaaatgtggacttagttgcccggtctatgctactattccagtttacaagatgggacaaatgtttatgtatgatttatatcagtctcgctataacatggaagactttaatgtttttagtcttgatgatgttgatgctgcctttgacaaagttgtccaattgaaatataaccaatcagtaacaatgaagggaaagtgctatgggctgagcattgttccaatgccagccggccacatgattggaggaacgatgtggaaaatcatgaagactggagaagaagatatcatatatgctatcgattttaatcataagaaggaaagacatttgaatggctgtgacttggaacgattgcagaggccatcattgcttataactgatgcattcaatgcaacttatcagcaagaaagaaggagagcaagggatgagaaacttatgactacaattcttcaaactttaagtaacaatggtaacattcttattgcagttgatactgctggtcgtcttttagagttggcacacatgcttgatcaactttggaggaataaaaattctggtttacagattcatcctttgtgccttattaataatgtaagttataatgtagtcgagtttgccaaatctcaaatagaatggatgagtgataagttaatgaaaagctttgaggctgttcgtaataatccatttcaatttaaacacatacgtttatgtcatagtgtttcagagcttaacaaaattccttcagctaaagtagtacttgcaagcatgccagatcttgaatgtggatttgctcgtgaaatattttttcagtgggcctctgattctaaaaacagtattgttttaacatcaagatgttgtgaaggtacattagcaagagatttattggataacggtgttggaaggaccatccagatcacagttaaaaaaagagttcgtcttgaaggggaagaattaaaggaatacttaaaagcacataaaaaaacaaatgacaaaaatgaagagaaggaaagttctgagtcagaagatgaaattcagttgcttagtgtcactaaaggtagccatgatcttgtaattaagcaggaacgtaggaaaaaaaatcaaaagtccttaaagaaattttaccctatgtttccttttatcgatcgtaaagttaaatttgacgaatatggtgaatttgtgcggatagaagattataaagctcctgatactgctaaacgtcctcctgaaaaaaagtctaaaaagaaggatgatgacattgtagatcctgctgatattccaactaaatgtgtttcttatgagaagtcgctaacagtgaatgcccaggttcaatatatagattttgagggaagatcagacggagaatcggtacaaaagataatcacgcagttgaggccgcgaagggtgatacttgtccgtggtacttctgaaaatactgaagctttagaaaagcatcttcaacaatggtctgaggcaaaaatattctgcccgaaaaaaggtgatatagtggatgctactactgagagtcatatatatcaaattagattgacagattctttagtctcttcattgcatatgcaaaaaggtaaagattcggagcttgcttgggttgatgctattacaaagtaccgtcagaaaccctctgatactatgcaatcagctgaagaaatggaagtcgaagatgatggtaattatagtatttacaatgatgactacttgactctggagcctctccctctaactgaagtcaatcctcatcaagctgtgtttataaatgagttaaaattatcagacttgaaacaaattttgtctcgtaatggtatagaatctgaattttctggtggtgtattgtggtgttgcaacggtactattgctatacggaggttggaatcttctaaagtttacttagaaggatggatttctgaaaattattatagaattagagaaattttatatggacaatatgcaattttataa

SEQ ID NO: 1610 - DNA, 1821 bp, Piezodorus guildinii
atgccatcaatagatgtcattcaacctcctcctcctcctccttcaatggagaaggaggaaactatagttcaaccaacgacgaagcctattgttggtattatttacccaccacctgaagtaagaaatatcgttgataaaactgccagtttcgtcgcccgaaatggacctgaatttgaatctagaatcaggcagaatgaattgggaaatcccaaatttaacttcctcaatacaggcgatccttatcatgcatattatcagcataaagttaaagaattcaaggaaggaaaaggaactgaaccacctccacctccaccgccggtgcaacagaagaccgtagcctccgctacgcaattgaaacaacaagaaatcttgaagcaagtcactgaacagccgtttgtacccaaagatcctcctccagattatgagttcatggcagatccgccatctatctccgctctagatttggatattgtaaagttaacagcacagttcgtggccaggaacgggcgccagttcttgactaacctcatgaacagggaacagagaaattatcaatttgatttccttcgtccccagcattctctgtttctgtatttcaccaaactactcgaacaatatactaaggtgctgattcctccaaaagaccttatgtcccgcctgaaggaagagtgctccaaccctaccggagtcctagagcaggtgaggtaccgtgcggactggcttcactaccaggagcttcagaagaggaaggaggagcaagccctcgagaaggaaagagtggcttacgctcagatagattggcacgactttgttgttgtcgagaccgtggactatatcccgggcgaggtgggcaacttccccccgcctaccacaccagatgaagtcggtgccagggtcttgatgcaggagcgaatattagaaaatggaggtgaagatctggcggaaggagctggcagcgatgaagagagggagaaggaagacggtgaaagggaagaaggagccggtgataagggagataacactcaggtacaagacatggaagaagagtcatcgagcgatagcgatgaagacgacgaacagagagagcagccgccaggagagaagcagcaggcgcagcccggtcagaagcagcagcctcccgacggcaagaagcctcccctccagccgtcgatgcagcccccgctacctcccgcaccggacaaggtcatcgtcaagaagggatacaaccccaagcagaaccaaaagatttcgaaaggtgcagataattatcttatttctccgctgacgagtgagaagatcccggcgaacaaggtgcaggaacacatgaggattggtctgctggatcctcgatgggtcgaacagagggacaagcacattcaagataggatcaaccaggagactgtatacgctggaggttctgcaattgaggctagcttgaaacaacttgctgagagaagaactgatattttcggtgtcggcgatgaagaaactgccatcggtaagaagattggtgaagaggataagaagaaagatgataaggtgacatgggacggacacacatctagcgtggaggctgccacccgcgcagctcgtgccaacatcaccatcgaggagcagatccaccagatccacaaggtgaagggtctcctcccggacgaggagaaggagaagattgggcccaagccggtccctggatcggtgagcagcagtggaggcacccccatgccgggtggtcctccgatagtggtgcaggccaaggccccgccgctgccgccgccacccaaggtcccgctgccaccgcccccagctcctctcccccca

SEQ ID NO: 1611 - DNA, 942 bp, Piezodorus guildinii
atgccaggagtagagcttgttactaacaaagttgtagttcatcctttagttctattaagtgttgttgatcatttcaatagaatgggaaaaataggtaatcagaagagagtagttggtgtattattaggttgttggaaggcaaaaggtgttttggacgtatctaatagttttgctgttccttttgatgaagatgacaaggataaatcagtttggtttttggaccatgattatttggaaaacatgtatggaatgtttaagaaagttaatgcaagggaaaaggttgttggctggtatcatactggtccaaagcttcatcagaatgatgttgcaattaatgaacttattcgccgctactgccccaattcagttcttgttataattgatgccaaaccaaaagatctcggtttacctactgaagcctatagagcagtagaagaagtacatgatgatggctctcctaccacaaaaacatttgagcatgtccccagcgaaattggagccgaagaagcagaagaagtgggtgttgaacatctgctgagagatattaaagacacaactgtaggctcactttcgcaaagggttactaatcaatttctgggcctcaaaggccttaatcaacaaattcaagatatcagggattatcttatgcaggttgttgatggaaaattacctatcaaccatcaaataatataccagctacaggacattttcaaccttcttcctgacatgaaccatgggaactttgtggattcattgtacataaaaacaaatgatcagatgcttgtcgtttacctcgctgccctcgttagggcgattgttgctttacataatctgattaataataaactcagtaaccgtgatgctgaaaaaaaggaaagcaccaagaaagaagaaaagcctaaagaagaagaaaatatcaagaaagaattgaaggctaagtaa

SEQ ID NO: 1612 - DNA, 1626 bp, Piezodorus guildinii
atgtttcagccaattttcgtgttaagccaaaactccaaaagggaatccggcaataaagttcggtctgagaatattgccgcagcaaagatgatagcagaagtaattagaacatgtcttgggccacaggctatgcttaaaatgttgatggatccaatgggtgggatagtcatgaccaatgatgggaatgctattttgagagaaataactgttcagcatcctgctgcaaaaatgatcattgaaattgcaaggacacaagatgaagaggttggagatggtactacatcagtcgtgattctttgtggtcaaattatggctgaaattgaaagacatatagatgaagttcatccaactacaatcattaaagaatttaaaagagctttggatgatattttaagaatacttccagacataagcacttctcttgacctaaaggataaagctaaagtaatagaagtagttagaggttgtttaggaaccaaatttttgggtacttggtctgaaatggcttgtcaaatggcaattgatgcagtagaaactgtcagagatctgaagggtcttggaattgacttaaagaactttgcaaaaatagaaaaggttcctggtggttttattgaggattctaaagtattggaaggtgtaatgcttaacaaggatgtgacgcatcccaaaatgtcccgttacattaaaaatccacgaattttattactagactgttctcttgaatataagaaaggggaaagtcagactaatgtggaaatagttaaagaaggtgattatactagacttttacaaattgaagaggagtacattgaaaaaatgtgcaatcatattattgagcataagccaaatgttgtgataacagaaaagggtgtttctgacttggcacaacaccatctttttaaggctggtataactgccattcgtagggttaagaagaccgataataacagaattgctcgagcggtagatgcaactattgtcagtcgtgtagaagaaataaagccccatcacattggttgtggtgctggtctctttgaagtaaaaaagataggagatgaatactttacttttattactgaatgtaagaatccaaaagcttgcacagttttactgcgtggtccaagcaaagatgtattaaatgaagttcagagaaatttacaagatgcgatgaatgtcgttaggaacttgtacttggatcctagaatactaccgggaggtggtgctgtagaaatggcccttcatagagctctcattaaagcaaataatgccatagatttggaggcagattgttatactgcaatcccatctgctttaagaattattcctagaacactgttacaaaatgctggtgggaaagtaataagatctatgaatgaacttgaaaagcaacataatgctgatgtccttaaaggagttgatggtataactggagagttgaaaacagttgatgaattaggtgtatgggaaccctattctgtcaaagtccagatctacaaaacagctatcgagtctgcaattttattgctgaagattgatgatattgtttctggtgctaaaaacaaagataaggaacgaaattatagctctacaatggcacagcctactgaagaatcacttaaagaataa

SEQ ID NO: 1613 - DNA, 771 bp, Piezodorus guildinii
aggaaggttatatttgaaaacgttggtcattcttggggtgacttagttgttaatcaaaaattattcattaaaatggcaatgcctagaacttatggtggtttatcagattatagaagcgttcctgcaccgtcctttagcccttattctgaaaatggagggagtgtggttgctgtagcaggagatgacttcgcgattatagcctctgatacacgtttaagtactggttttcaaatttacaccaggaaccagtcaaaattatttaaactgtctgataaaacaattcttggaagtactggatgttggtgtgatgttctttctcttactaggcttgttcaaacccgaataaaaatgtatcagtatgatcataacaaagttatgtctactccagcagttgcccaaatgctttccgtactactttattacaaacgcttttttccttactatgtcgccaatattcttgccggaatagatgataatggcaaaggagttgtttacagttatgatcctattggtcatcatgaaagctcaaaattcagagctggaggaactgctggagcattattacagcctctgttggacaatcagcttggtatgttgaatcaagaaaatgttcaagacaaaacatacactttggagaaagcgcatgcaatcgtaaaagatgtctttatatcagctgctgaaagagatatatttactggtgacagaatatcaatcaatatattaaccaaggatgggatcagagaagattcatttgagcttaggaaggactag

SEQ ID NO: 1614 - DNA, 900 bp, Piezodorus guildinii
atgtttggatttagtatgtttccattccctcctagaccttttaaggtccagtattattgtttttctgttgcaatgatacctgggaatgaaagggaagatgttgaacgtggaggcaaaattattatgcctccttcagcacttgatcacttgacaagattaaatattaattatcccatgctttttaaactgcacaactcaaaaacaaataggacttctcacagtggtgtgttagaatttgttgcagatgagggaaaagtttatttaccacattggatgatgaggaatttgatgcttgaagaaggtgatgttattgaaattgaaagtgtttccttacctgttgcaactttttcaaggttccagcctcagtctccagattttttggatatatcgaatccaaaggccgttctagaaaactgcctcagaaactttgcttgtttgactactggtgacataatcaatattaaatataatcaaaaagactatgagctttcggttttagaaacgcaaccaggcacagcagtgacaatcatagaatgtgatatgaatgtagaatttgctgcacctttaggatataaagagccgaattctgaacaggaatcattggatgaatcttctgaaagatcagaaaacttgacaaatgaaggaagtggattcatcccattttttggtgaaggttacaggctagatggaaaacagaagaaaaatattgaagatgaaaatgttggatttagaataccagctgtgagaggaatccctgattatgactggaaagttggggtgattacttttatgagaaatgtgcgccaacctgtgaaggaatctcagaaagatgatgaagacaaatttcaacctttttatggggagggacatgtgttaagtacaaatcgtcaccggaagtaa

SEQ ID NO: 1615 - DNA, 1629 bp, Piezodorus guildinii
atggctgctttcccaggatctattgcatttgatgaatatggtagaccatttataattattaaagatcaagaaaaacaaaagcgtttaaccggcaatgatgctatcaagagccatatcctctcagccaaagctattgctaaaattgtcaggacttctttgggtccaaaaggtttggacaaactgcttgtgtcacaggatggtgatgttatggtaagcaatgatggtgctaccatcatgaagcaaatggatgtggataatgaaattgcaaaactgatggtgcaactttcacaatcccaagatgatgaaattggtgacggaactactggagttgttgttcttgctggtgctttattggaacaagctgatattttgttagataaaggaattcatcctattagaattgccgatgggtttgaattagctgcaagagctgccatacaacatttagattcaattgccacaaaatttcctgttgatcctaacaatttggaacctcttattaagactgctatgacaactcttggatcgaaaattgttaataaatgccataggcaaatggcagaaatagctgtaaaagcagtattatcagtggctgatctggaaacacgggatgtcaactttgagctaattaaagttgacggaaaagtcggtggaagactggaagattcaatgcttgttaaaggggtggttattgataaagatttttctcatccccaaatgcccaaggtgttgaaggatgttaaaatagcaattttaacttgcccatttgagccacccaagccaaaaacaaaacataagttggatgtaacatctattgatgactatagggcattaaggaagtacgaagaagagaaatttaataccatggtttctcaagtcaaagatgctggtgctacacttgctatttgtcaatggggatttgacgatgaagccaaccatcttcttttgaagcgagaacttcctgcagttagatgggtcggtggaccagaaattgagctaatcgccattgcaactggtggacgtatcgtacctcgatttgaagagctgagtcctgaaaaacttggtcgagctggacttgttagagaaatctcctttggtaccacaaaggacaaaatgcttgtcattgaagaatgtgctaattctcgctccgtcacaattttcatcagaggttcaaatcaaatgataattgatgaagccaagagatcaatgcacgatgcactttgtgttgtcagaaatttgatttgtgacgacagtattgtttatggaggaggtgctgccgaactttcttgttccattgccactgctaaacaagcagataagatttcatctattgaacagtatgcattccgtgcattttctgaagctttggagtcgattccttttgccttagcagagaattcaggcttgcctccaatgcaagtcgtgaccagcgtaagaggaaggcaaattcaagagaacaatcctgctcttggtgttgattgcatggggaagggaactaatgatatgaaagagcagcatgtcattgaaacacttaaaagcaaaaaacaacaaataatgcttgccacacagttggtaaaaatgatacttaaaattgatgatgtcagaacacctaatgacattcaattctaa

SEQ ID NO: 1616 - DNA, 342 bp, Piezodorus guildinii
atggcttcagcaatggacgttgacgatgaagagaacgaggttcctacctccagtagtggaaaaggtgaaaagaaaagattcgaagttaaaaaatggaatgctgttgccctgtgggcttgggacatagttgttgataactgtgctatttgtcgaaaccacattatggatttgtgtattgaatgccaagcgaaccaagcttctgctacaagtgaggagtgcacagtggcctggggagtttgtaatcatgcctttcatttccattgtatatcaagatggttgaaaacaagacaagtttgcccattagacaatcgtgaatgggagtttcaaaaatatggacattaa

SEQ ID NO: 1617 - DNA, 1605 bp, Piezodorus guildinii
atggtgtctttaaatcctattagaatacttaaacatgaagcggaggaagaaaagggtgaaatggcaagaatgtcgaatttcatcggagcgattgcagttggcgatttagtgaaaagtactctcgggccgaaaggtatggataaaatccttgtatcttacggcagaaatcgtggaaacattgaagttaccaatgatggagctactattctgaaatccgtaggttttgacaatcccgctgctaaaattctcgttaatatgtctaaagttcaagacgatgaagtcggagatggtacgacttcggttacagttttggccgccgaacttctcagagaagctgaaagattgatcgagaggaaaatccaccctcagacaataatcagcggatatcgaaaggccacgaatgtagccctggctgctttagataaatgtgctgtcgacaatagcagcaatgacaaagagttcgccgatgatttgctcaaaatcgcccgtacttcgttgagttccaaaattttgaatttgcacactgaaaaattcagcaaattggcagttgaggcagtacttcgcctcaaaggatctggaaatttaagtgcgatacagatcatcaaaaaaacaggtggctcattagatgattcatttttggatgatggcttcctcttggacaagaaagtcggtcagttccaacctaaaagagttgaaaatgctagaattctcatcgcaaatactccccttgacaccgataaaatcaaagttttcggttccagaatacgcgttgattctttagctaaagtggccgatttggagctagctgaaaaagaaaaaatgaaggaaaaaattgaaagaattataagccacaaatgcaacgtgtttgtcaatcgccagttgatttataattatcccgaacaactgtttgctgatgctggaatcatggcgattgagcatgctgatttcgatggtattgagcgtctagcccttgtgacaggaggtgagatcgtttctacatttgacacacctgagcttgtcaaattaggagaatgtgatttaattgaagaggtcatgattggtgaagacaaattgttgcgatttagcggagtcaagttgggagaagcttgcagtattgtaatcagaggagcaacacagcagattgttgatgaagctgaaaggtctttacacgatgcgctgtgcgtgcttgttaccactgtcagggataagaagacagtttttggaggtggttgttcggaaatcatcatggccagtgctgtgagtgatgaagctattaatgtaactggcaaagaagctgttgctatggaatcctttgcaaaggctttgcttgagttgccaatgaccatctctgacaacggtggatttgattctgcttatttagttactgctttaagagctgcacacaacaaaggccagataacttacggtttggatatgaagaacggtggagtagcgtgcatgagggagcttggtatcgtagaatcacattctgtaaaacgtcaaatgctgctgtctgcttcagaagccactgaagtcatattgagagttgatgatatcctcaaagccgcacctcgcaaacgaacggaagaccgaggctactgctga

SEQ ID NO: 1618 - DNA, 834 bp, Piezodorus guildinii
atgttccgaaaccagtatgattccgacgttacggtatggagcccccaaggccgattacaccaggttgaatatgctatggaagcggtgaagcttggagcagcaaccgttggtgtaaagaataagcaatatgcagtccttgttgctcttaaaagagcttcatcagaactttcagctcatcaaaagaaaattattcctcttgataatcatataggcatgagcatttctggcctaactgctgatgctcgtatattgagtcggcaaatgagaagtgaatgcctttcatattcgtattcatatggaactgaaattcctattatcaggctcatgaacaaaatatctaatatgatgcagagttcaactcagcgatatgatagaaggccttatggagttggtctcctggtggcaggatatgatgctgatggtcctcatatttttcaaatttgtccttctgcaaatctttatgaatgtcgttcaatggctattggcgctagatcccagagtgcgaggacatatttggaaaaacatctggtagacatcggtaactctccgacgctcacagaccttcttaaacatgcacttcgtgctcttagagattcgtcacccaatgatacagaacttagttctaagaacgtagccatcgcagttgtggggaaagatacgccgctgaaggagctgtcagaggcagatactcagacgtacctggacatgatcctgagcgaggagagaaggagtggggatactgcaggaggcaccgatgatgcgcccccaccaccaccaccctccgatcctccagctcaagatcccactccggtagtggctatggaaacacaataa

SEQ ID NO: 1619 - DNA, 2541 bp, Piezodorus guildinii
atgccagtttaccaagaaagaaaacctaaaatagtaattaatgaagaagatctaccatatgaagaggaaattttacgaaaccctttttcaatcaaacattggttaagatacatcgaatttaagaaggatgctccaagaaatggagtgaacataatttatgaaagagcattaaaagagcttccgggaagttacaaactatggtataactatttaatacttaggaaaagacaaataaaaggacgatgcattactgatccttcctttgaacatctaaataatacatatgaacgctctctggtttttatgaataagatgcctaggatatggatggaatattgtcagtttcttgttgatcaatgtaagataaccaaagcacgacatgtttttgatagatccttaagagcattacccattacccaacatcatcgcatttggcctctgtatataaaattcttaaagaagcacaatattccagaaacagcggttcgtgtatttcgaagatatctgaagctctgcccagaagatacagaagaatatattgattacttaactactattggtcgtctagatgaggctgctgttagattggctgatattgttaatactgatgattttgtttcaaagcatggaaaatcaaaccatcaattatggactgaattatgtgacttaatctctaaaaatcctcaagaagttagatcactgaatgtggatgcaattataagaagtggtttgaaaaaatatactgaccagttaggtcatttatggaattccttagcagattattatatcagaagcggactttttgaaaaggccagagatatttatgaagaagcgatacaaactgttactactgtaagagattttactcaagtttttgatgcttatgctcaatttgaagaactttctttgagtaaaaaaatggaagaagtttctcataaagcatttcccaccgatgatgatgatatagatattgaactccgcttagcaagatttgaagatttgattgaaagaagattattacttctaaattcagttcttttgcgacaaaatcctcataatgtccatgaatggctgaaaagagtccagctttttgaaggaaaaccacatgatattatttatacttatacggaagctgttcaaacagttgatcctaaattagctgttggaaaaccacacatgctgtatgttaattttgcaaagttctatgaagaaaatggtcaagtagaagattctagaatagttctcgaaaaaggaacacaggtgccttatactaaagttgaagatcttgcatctgtatggtgtgaatgggctgagatggaaatcagaaatgagaactgtgatgaagcattaaaaattcttcaaagagctactgtgatgccagctagaaaagttgattatcatgatgactcagaaactgtacaaatgagattgtataaatctttgaaaatttggtcattgtatgctgatttagaagaaagctttggaacattcaaatcttgtaaatcagtgtatgacaggataattgatctgaaaattgccacacctcaaattattatcaactatgggctttttctagaagaacacaattattttgaagaagcttttaggacttatgagaaaggaattgctttgttcaaatggcctaatgtctttgacgtatggaatacatatttaaccaaatttttaaagcgctatgggggaagtaaacttgaaagaacgagagatctatttgaacaatgtttggaaaattgtcctccaaagtatgctaaaggtttctacctattatatgcaaaattagaggaagaacatggattagctaggcatgcaatggcagtgtatgaaagggctacttctgctgttttacctgaagaaatgtttgaggttttcaatatttatatcaaaaaggctgctgaaatttatggtgttccgaaaactcgtcaaatttatgaaaaagctattgaagtgttgggtgaagataattcaagagaaatgtgtcttaggtttgctgagatggaaactaaattaggagaaattgatcgagccagggcaatttatgcgcattgtagtcaaatgtgtgatccacgggttactagtactttctggcaaacatggaaagattttgaagtgcgccatggcaatgaggatactatgagagaaatgctgcgaatcaaaagaagcgtacaagctacatacaacacacaggtcaatatgatgtcagcacaaatgttatctgctgccagtaatgtttctggaacagttgctgatcttgctcctggtgctaaagatggaatgcgcatgttggaagctaaagcagcagaaatgactgttactccaaaatccggagcatcggccatcatgtttgtaagaggtgaaactcaaaatacccctcaagatgtgcaaaaagaaatacataatcctgaagctttgaatattgactcagatgatgaagaaaacatggaggatgatgatctgcctgttgaaaaacagattattcctgatgaagtattttgtggtctgaagaaaggaagtgattctgactga

SEQ ID NO: 1620 - DNA, 990 bp, Piezodorus guildinii
atggccgctggacctattgccgaaagaaatcaagatgccacgatatatgttggcggattggatgataaagtttctgaaactcttatgtgggagctattcgttcaagccggaccagttgtcaatgttcatatgccgaaagatagagtgacacaacaacatcaaggatatgggtttgtcgagtttttgggagaagaagatgctgattatgccataaaaattatgaacatgataaaagttcatggaaaacctattcgtgtgaataaggcttcagcacatcagaaaaatttggatgttggtgctaatgtgttcattggtaatctggatcctgaggttgatgaaaagttattatatgacacattttcagcttttggggtcattctgcagacgcctaagattatgagggatccagatacaggaaattcaaaaggctttgcattcatcaattatgcctcatttgatgcttccgatgctgccattgatgcaatgaatggtcagtttctgtgcaatcgcccagtttcagtttcttatgcttacaaaaaagatgccaaaggtgaacgacatggatcggctgctgaacgcctgttagctgcacaaaatcccttatcacaagctgacaggccccatcatatgtttgcggatgctcctcctgcacccctgccaccccctccagtattgcctcctcctcctgtcttcaatcctccaccccctcctcatatgcctcctcctccattgccaccacaaaggatggtagctcctatgccgccacctccccctggccctccgccaccaatgccacctggaatgatgccgtggcctccaatgcagcctcactttccaccccctccaccacccccacctacaaacaaagcacctcctcttcctcctccaccccctcctcaagcttggcgtcctccaccaccgccttacaatcgaccaccatttcctccaccacctccacctccagtcagacctccaccaccaatgttctaa

SEQ ID NO: 1621 - DNA, 777 bp, Piezodorus guildinii
atgggtcgagttattagagctcagaggaaaggtgctgggagtgtttttagatcccacaccaaacaccgaaagggagcccctaaattgaggtctttggatttcgctgaaaggcatggttacatcaaaggagttgtgaaagatattatccatgaccctggtagaggagctccattagctgttgttcactttagggatccttacaggttcaagactcgcaaagagcttttcattgcccctgaaggaatttatacaggtcaattcctgtactgtggaaagaaagccaacttacatgttggaaatgttatgcccgttggtactatgcctgaaggtaccatcatctgtaatttggaagaaaaaaccggagataggggtcgtctagccagagcttcaggaaattacgctatcgtaattgctcacaatcctgactccaggaggaccagggtcaagcttccatcaggagcaaagaaagtcattccctccaacaacagggctatggttggtattgtcgctggaggtggtcgtatcgacaagccagtgctgaaggccggtcgtgcgtactacaagtacaaggccaagaggaactgctggcctaaggttaggggtgttgccatgaacccagtagagcatccccacggtggtggtaatcaccagcacattggtaaagcttccactgtcaagaggggaacttctgccggtagaaaggttggtctcatcgctgccaggcgtactggtaggattcgtggtggtaagactgaccagaagaagggagaagattaa

SEQ ID NO: 1622 - DNA, 411 bp, Piezodorus guildinii
atggcccgtaccaagcagaccgctaggaaatcgacaggaggcaaagctcccaggaagcagctggccaccaaggccgccaggaagagtgccccggccaccggaggtgtaaagaagcctcacaggtacaggcctggaacagtcgctctcagagaaatcaggaggtaccagaaaagtaccgagctgctcatcaggaaactcccgttccagaggttggtgagggagatcgcccaggacttcaagaccgacctgaggttccagagctcagccgtcatggccctccaggaggccagcgaagcctatctcgtaggtctcttcgaggataccaacttgtgcgcaatccacgccaagagggtcaccatcatgccgaaggatatccagttggctcgccgtatccgcggagaacgtgcctaa

SEQ ID NO: 1623 - DNA, 1596 bp, Piezodorus guildinii
atggcagcaataactttattgaatcccaaggcagaagttgtaagaaaaactgaggcattgtctatgaaccagagtgccgctaaaggattacaggatgtcatgaagactaatctcggtccacgaggtaccatgaaaatgttagtttctggtgctggagacattaaaattacaaaagacggcaatgttctgctgaaagaaatgcaaattcagcatcctaccgcttctctcattgccagaacttctactgctatggatgacattaccggtgatggcactacctcaacagtcctactcattgccgaattattaaagaaagctgacaattatattattgaaggtgtccaccctaggttaattactgaaggttttactgtggcttgtaaacacgctatggaagttctggatagtatcaagaaacctgtaagtctagatgataaggagacacttatttctgttgctagaactgctcttaacaccaaagtagaatccaaagtagcagaggtattaactcatatttgtgttgaagctgtacaagcaattaaactgcctgataaacccttagatttacacatggttgaaataatgacaatgcaaagccgacttgaatctgaaactcggctagttaggggactcgtccttgatcatggatcacgtcatcctaatatgcctaagaagctaactaatgcttatattttgacatgtaatgttagtttagaatttgaaaaaacagagattaatagtgggtttttctataaatcagccgaggaaagggaaaaactggtggcatctgaaagagagtttatcgagttgagggttaagaaaattattgctttgaagaagtctgtatgtgatggaacagacaaaggatttgttgtcatcaatcagaaaggaattgatcccgtctctttggatatgctagcccgagaaggtatcatggcacttaggcgagctaaaagaaggaatatggaaagactcactttagcttgtggtggagtagctatgaatagtcttgatgatctcacagaagattgtctagggcgagcaggtcttgtttatgaacatgttcttggtgaaaccaagtatacatttgtatctgattgtccaaaccctcatagtgtcactgtactagtccatgggccaacttcttatgccattactcaaatccaagatgctcttcgggatggtctgagagctgtcaaaaatgcagttgaagatggaggtatacttcctggtggaggagcagtagaattaaaattacgtcatgaattgaaaaaagttgctgagaacacaaaggaaaagtaccgtgttggaatcgaagctttctgtgatgctcttttaattattcccaaaaccctcgctatgaacagtggattcaatactcaagaagtcatcactcaactagattatgatgctaaggataatgatgtaattggattggatcttcaaactgggaaatcaatggtcccaactgatctaggcattcttgacaattattctgtcaaaaagcagtatatagcatcaagtgtcattgtagcaagcaatcttctccttgttgatgaagttatgagagccggaatgtcatctttaaaaggataa

SEQ ID NO: 1624 - DNA, 3144 bp, Piezodorus guildinii
atgtctagtgctgaagtggccaacaattccatagaacctccagccaagaagcggaaaattgctacaggagagactgctccagcgaactccgtttcaaaggcaatatcagccatggcgaataatggatcttttgattccaatcaagaaattgatgagggactttactctcgccaactttacgttttagggcatgatgccatgcgacggatggcatcctctgatgttcttatttcaggtttaggaggacttggtgtagaaatagctaaaaacgtcatattaggtggtgttaaatctgttacgttacatgatgaaactgtatgcactatatcagatctgtcttctcaattttatttatctgaaaattctattggtttaaatcgtgctgaggcttcttgccagttacttgctgaacttaacaattatgttccaaccagagcctatactggaactcttactgaagacttcatcaaaggttttagtgttgttgttttaactaatgcatcagaagaggagaaattgagaatttctgaaatagctcatgcatctgatgtttcattaatcattgcttcgactagaggtgtatttgcacaagtattctgtgattttggccgagagttcagtgtagttgacacaaatggtgaaaatccagtttctgcaatgattgcaagcatttctagagatgaagaaggagttatcgcttgtttagatgatactagacatggcttagaagatggagattatgttacattttctgaaattcaagggatgaccgaattaaatggttgcgagcctactaaaattaaagttcttggaccatacacatttagcattggtaatacctcaaattatgcagaatacatccgtggtggaatagttcaacaagttaaaatgccaaaagttttgcaattcaaatcatactcagaagctttgaagtctcctgaatttatatttactgattttggtaaattcgatcacccacaacaacttcatgtggcatttaaggctctagaaaattataagaaggaatttggaaagttgcctacaccatgggacaacaaagatgctgcagattttgtcaactgttgtaagtcagtagtatctgatcttggcttagatgtagaattaaatgagaagcttatgcagcaatttgctaaaacttgctctggaaatatgaatcctattgatgcgtttattggtggtgttgtggcccaagaagtgatgaaagcttgcagtgggaagtttcatcctattttccaatggctttattttgattctattgaattattacctactgaagatctcaatcctagtgaatgtgcacctaccaattctcgatatgatggacaagttgccatttttggaacagaattccagaaaatgttaggtgctctgaaatattttgttgttggagctggagctattggttgcgaacttcttaagaatttttcaatgatgggtgtaggagcagatggcggcaaagttattgtaacggacatggatcttattgagaaatctaacctaaacagacaatttttatttagacctcacgatgttcagaaacccaaatcagctactgctgcgaaagcaataaagaaaatgaatccattaatgaatgtgatagcccatgaaaatcgagttggccctgaaactgagaaagtttatgatgatgcctttttcgaagatttagatggtgttgccaacgctctagataacgtagatgctagaatatacatggatcgccgttgtgtttattacagaaaaccgttgttagaatctggaactcttggtactaaaggtaatacacaagttgttgttcctttcctgactgaatcctacagctcctctcaagacccacctgagaaaagcattcctatttgtactttaaagaattttcctaatgctattgagcataccctgcagtgggctagagatgttttcgaaggcctgtttcgccagtcagctgaaaatgctgctctttacttaagtgatcctaattttattgatagaacactgcgtttgccaggagtccagccaatggaagttttagaatctatcaaacaggctcttatcgatgacagaccgaaatctattgaagattgcatcgcttgggctagaaaccactggcaagaacagtattcaaatcagatccgccagcttcttttcaatttcccacccgatcagatgactacgaatggccaacctttctggtctggccccaagaggtgcccagttccacttgagtttgatgtgaataacgacctgcatttggattatattttagctgctgctaacctgaaggctgaagtctatggaatccctcaggttcgtgatagaaacttcattgctaaagtggtccagaacgtagaggttcctgaattcactcccaagtctggtgtgaaaatcgctgtaactgattcacagatggctaatggtgctggtgggcaggttgatcaagatagaattgggcagttgcagaatgaacttccatcgaaggagatgttcaacggcttgaatatcacacctctcgaatttgaaaaggatgacgataacaacctccatatggacttcatcgttgctgcatccaatctgagagctgctaattacaacataccacctgcagacaggcataagagtaagttgatagctggtaagattatacccgcgatagcaaccacaacatctgttgttgctggtttggtatgtattgagctcatgaagttagctaagggttacaaagatatagctttgttcaagaatggctttgtcaacttggctcttccattctttggattctccgagccgatttcagcccctaaattgaagtattatgagaacgaatggacattgtgggaccgatttgaagttactggagagatgactctcaaagagtttatcgactattttaaagacaaacaccagcttgaaataaccatgttatcccaaggtgtttgtatgttgtattctttcttcatggccaagagtaaattagaagacagacttaatcttcccatgtccgaagtggtccgtagagtttctaaaagaaaactggaacctcacgttaaggcgctcgtttttgaactttgctgtaacgatacagatggcaatgatgttgaagtaccctacgtcaggtacacattgccttga

SEQ ID NO: 1625 - DNA, 1278 bp, Piezodorus guildinii
atggctgacaatgatgatttgttggattatgaagatgaagaacagacagagcaacctattgtcgaaggttcaggagatacagctcctcgtaaagatttgaaaggagcttatgtatcaatccatagttcagggtttagagatttccttctaaaacctgaaattttaagagcaattgttgattgtggttttgaacatccttctgaagtacaacatgagtgcattcctcaagcagttcttggtatggatatactttgtcaagccaagtccggaatgggtaaaactgctgtgtttgtattagccacccttcaacaaatggagttgactgaaaaccaagtaacagttttggtcatgtgccatacccgagaattggcatttcaaataagcaaagaatatgagcgattctcaaaatatatgccaaacatcaaggttgctgtattttttggtggtttacctatacagaaggatgaagaagttttaaaaaataactgtcctcacattgtagttggtacaccaggacgtattttagctttagtgaaaaataaaaaactaaatttgaaaaaccttaaacattttgtattagatgagtgtgacaaaatgctcgagcagttagacatgaggcgtgatgttcaggaaatttttaggaatactcctcacagtaagcaagttatgatgttcagtgcaactcttagtaaagacataagaccagtttgtaagaaatttatgcaagatcccatggaagtatatgttgatgatgaagctaagctcaccctgcacgggcttcaacagcattatgttaagctaaaagaaaatgaaaaaaataaaaaattatttgatctactcgacatcttagagtttaatcaggttgtaatattcgtgaaatcagttcaaagatgtatggctttggcacaactattgtgcgatcagaatttcccagctgtagccattcatagagctatgagtcaagaagagaggcttgctaagtaccaagaattcaaagactttcaaaagagaattcttgttgctactaacttatttggaagagggatggatattgaaagagtaaacattgtgtttaactatgacatgcctgaagattctgatacttacctccatagagtagcaagagctggacgttttggaactaagggcttggctataacatttgctagtgacgaggctgacgctaaagttctgaataatgttcaagatagatttgatgttaatattactgagttacctgaagagattgacctttcatcttatattgatggacgataa

SEQ ID NO: 1626 - DNA, 1464 bp, Piezodorus guildinii
atgcctgttgaagctatgcaaacggatgtggagatgaaggtggttgattctccttcctctgaagacccagtggcttcagcagttcaagaaataagggagcatattcgtcagttggaaaaggcagttgctaataaagaacctcgttttatattaagagttttacgtctacttccttctacacgtcataaactttctgcagcagtccttcgtaacgtaatatcttctttttatttaagtagtcctgaaaaagatgccttatttctttatattgaagatgctgatgattcagatacaacacaaaaaacaaaactgatcaaaaattctaatgttcctctcttacccgaaatagatgcttatattcatttgttggtacttgtgagactcattgatgctggaaaggaatctgaggctgtgaagtgttctgatgctcttatggctaagataactgctcagaaccgcaggagtttagatttagtggctgctaaatgttatttttaccactctcgagtttatgaactcactaaccagttggaaaaaatcagaggatttctgcatgctaggctccgaactgccactcttagaaatgattttgaaggtcaagcagttctaattaattgtctcttgagaaattacttacattataagttgtatgaccaagcagacaagttagtatccaaatcagtatacccagaatcagcaagtaataatgaatgggctagatttctttattatttaggaagaattaaagcagctcgtttagaatattccgaatcacacaaacatctagttcaagctttgagaaaagctcctcagcatgctgctgttggatttagacaaacagttcaaaagcttgctgtcactgttgacttacttcttggtgacattccggacagacagatctttcgacaagcaccacttcgtcgttctctcgcaccttatcttcagttaacacaagctgttagaactggcgatttgcaaagatttggtgaggttttggaaatgtttgggccccagtttcgttctgaccatacatttaccttaattcttcgtttaaggcataatgttataaaaactgctataagatgtattggtttatcttattcgcgtatcactcctaccaacatagcttcaaagctcggattagattcacccgaggatgcagaatttattgttgctaaagcaattagggatggtgtcatcgaagcaaccttagatcctgagcatggttatatgcaaagcaatgaagttactgacatctatcggacaagagaaccacaattggcctatcatcaacgtatatcattttgccttgatcttcataatcaaagtgtcaaagctatgagataccctcctaaatcttatgggaaagatttagaatcagctgaagagcgtcgagagcgggagcaacaggacttggagttagcaaaagaaatggcagaagaagatgatgatgttttcccttaa

SEQ ID NO: 1627 - DNA, 1761 bp, Piezodorus guildinii
atggctttaagtactccttcagtgccagtttctgaaatattgaagagcagtgctgattcagatgaacccaagaagaaatcaagggaagattggcgcaaagccaaggaattggaagaagcaagaaaggctggtactgctcctgctgctgttgatgaggaaggaaaagatatcaatccccacattccacagtatatttcatctgctccttggtactatagtgctagagggcctactcttaaacatcagagaatacaagatgaaagtgttaaaaagttctccggtattgatgaatggtacaaacgaggagttgacacaacaaaagtggttactaaatatagaaaaggtgcttgtgagaattgtggagcccttactcatcaaaagaaagactgtatggagagaccacggaagattggtgccaaatttactggagctaaaattgcacctgatgagtttgttcaacctgaactgtcacgagattatgacggaaaaagggacagatgggcaggatatgatccctcacaacacaaaatggttattgagagatatgccagaatagatgaggccaagcggcaactgagagcagaaaaacttaattctgaacagacagaagaggctgaagaagaagagacgaaagacagtgctgctgatgagggaggtgaagatgaagataaatatgtggacgaagtagacatgccgggcacgaaagttgattctaaacagagaatcacagtgagaaatctcagaatcagagaagacacagccaaatatttgagaaacctcgatcctaattctgcctattacgatcctaaaacgaggagtatgagggacaacccttatgctggatctgcagatgctgatgtggactatgctggagaaaactttgtgcgcttcactggtgatacattagagcatgcgaaagtgcaattgtttgcatgggaagcgcataataaaggtgttgatgtccatcctcttggagaacccaccaggctggaagttctcaagaaggaattcgtcggaataaaagaagagttcaaacaaaagggacaagaagacctcattaaaaagtatggtggagaagaacacctgaaagctcctcctaaagaacttttattagcacagacagaatattacgctgagtatactcgttacggcacagtcatcaagggccaagaaaaagaagttgtgagatcaaggtatgaggaagacgtgtttattaataaccatacgactgtatggggatcgttttggcattctggaaagtggggatataaatgctgtcattcttttattaagggatcttattgcaccggggaggctggtagactggcaacggctggagaggtggctgtcaaaggcccagcttttattccaccgcgtcccgctacaccaactgcctcatcctcctcgtcttcatcttctgattcttcatcgtcgtcatcttcatcatctgaggatgaagaagagaaggagaggaagaagaagaagcaggaaaagaagaaagcaaagaagaagaagcaaaaggtaaagaaactcaagaacaagaacaaaaaacctgaagaaaagacagaagaagaacagctgaaggaagccttgaaaaaagaggaagaagcccaaagagaaggtgacaggcttgctaaaatggatgaccgtaagaggccgtataacagtatgttcgaagtgcagaaacctactgacgtcgaaatggaagcttattacatgaagaagaagagggatgaggatccaatggctaacttcttataa

SEQ ID NO: 1628 - DNA, 627 bp, Piezodorus guildinii
atgggtatttcgcgagatcattatcataagagaaggaagactggaggtaagagaaaacccatcaggaagaagaggaagtatgagttaggaagaccagcagccaacacaaagttgggccctaaaagagttcatttagttagaactcgaggtggaaataccaagttcagggctttgaggttggactacggtaacttttcatggggttctgaatgttgtaccaggaaaactcgtctaattgatgtagtctataatgcatcaaacaacgagcttgtacgtaccaaaactcttgtgaaaaatgccatagttgtcatcgacgcaacccctttcagacaatggtatgaagcccactacgctctgccattaggaagaaagaagaatgctaaattgtctgaagctgaggaagctgtcctatataagaagaggtctaggaaaactgaaaacaggtataaggcgaggcagaaactggccaaagttgaacctgccttagaagaacaattccagactggtcgtttgcttgcatgcctcgccagccgacctgggcaatgtggacgagctgatggttacatcctcgagggtaaagagcttgagttctatttgaggaaaataaaagccaagaaaggaaagtag

SEQ ID NO: 1629 - DNA, 936 bp, Piezodorus guildinii
atggatcgtcttttgcgtttagggggtggtatgccaggattaagtcaagctccacctccatcagatgctcctgttgtagacacagcagagcaagtctacatttcttctctagcccttcttaagatgttaaaacatggaagagctggtgtccctatggaagttatgggtcttatgttgggagaatttgttgatgattatacagtgagagtaattgatgtgtttgctatgccacagaccggaacaggtgtgagtgtcgaagctgtagaccctgttttccaagcaaaaatgttagacatgttaaaacaaactggtcgaccagaaatggttgttggatggtatcactcacatccaggatttggttgttggttatcaggtgttgatattaacactcaacaaagctttgaagctctttcagaaagagccgtagctgttgtagttgatccaatccagagtgtcaaaggaaaagttgtcattgatgcttttagattaattaatcccaatatgatggttcttgggcaagaaccacgacaaactacctctaatttggggcatctgcaaaaaccttctgtgcaggcattaatccacggtttaaatcgccattactattccatcagcattaactacaggaaaaatgagttggagcaaaaaatgttgttaaatttacacaaaaagtcttggatggatggattgatgctctctgattattcagaaaattgcaaagttaatgaaactacagttggcgacatgcttgaattagctaagaattataacaaggcattggaagaagaagagaaaatgacgcccgaacaacttgctattaagaacgttggaaagcaagatccgaagaggcatttagaagagaaagttgatgtactaatgtcagccaatattgtgcagtgtcttggtgctatgttagatactgttgtgttcaaataa

SEQ ID NO: 1630 - DNA, 1218 bp, Piezodorus guildinii
atgacatacacaacttttgagcaaatggatgtggatgagaagaagggagaaggttttcgttcttattacatcactaaaattgaagaacttcaattaatagtcgcagagaagagccaaaatcttagaaggcttcaagcacaaagaaatgaactcaatgctaaagttcgtatgctaagagaagaactgcagctgcttcaagaacaaggctcttatgttggcgaagtagtgaaaccaatggacaagaagaaagttcttgtcaaagtgcatccagaaggaaagtttgttgttgatattgataaaaatattgatattaatgatgttactcctaactcccgggtggctttgcgaaatgagagttatactctacataagatcctgcctaataaggttgatcccctggtgtcattgatgatggttgaaaaagttccagattctacttatgaaatggttggaggtcttgacaagcaaattaaggaaatcaaagaagtaattgaactgcctgtaaaacatccagaactgtttgatgcattaggtatagcacaacctaaaggagtgttactatacggacctcctggaacaggcaaaacacttctggcaagagcggtcgctcatcacaccgaatgtacattcattcgtgtgtctggttctgagctggtacagaaattcatcggtgaaggatcaagaatggttagagaattattcgtcatggcaagggagcatgctccgtccataatatttatggatgaaattgattcaattggttcctcacgtattgagtctggtagtggtggagattctgaagtacagagaactatgttagaattattgaaccaattggatggttttgaagctacaaagaatattaaggtgatcatggcgacaaataggatcgatattctagaccctgctctccttcgccctggaaggattgatcgtaaaattgagttcccaccaccaaatgaggaggctcgattagatatccttagaattcattcacgtaaaatgaatcttacacgtggtatcaacttgcgtaaaattgctgagctcatgcctggagcatctggtgccgaagtcaagggtgtatgtactgaagcaggaatgtacgcccttcgtgagaggaggattcatgtcactcaagaagattttgaaatggcagtggccaaggttatgcaaaaggactcagagaagaacatgtctatcaagaaattatggaaataa

SEQ ID NO: 1631 - DNA, 603 bp, Piezodorus guildinii
atggttaagttgtatgctcttcatattttatacaaaaatttaaatagtgcagtatggttgaaaacagcttatgatgtccaaagttttggatattttcaaagaggaactgcccaagacaccatggcttttgctagtaaaacaatagttgaaaggactcagtctgcaaccagacagtctgtcaaagaaggagattatatatgccatgtgtatgtaagagctgacaatttagcaggggttgtgatatcaaaccatgaataccctcatcgagtagctcatacactaataaccaaagtattggatgaatttagcgctaaatatccaccttcaacttgggcatctgcaaatgaatccaatattgattttcctgcattggcagctcaccttcaaaagtttcaaaatcctaaagaagctgatgctcttatgaaaattcaaagtgagcttgatgaaactaaaatcattcttcataacaccattggagccgttttagagcgtggagagaaattagatgatcttatcatgaaatctgaaagtcttagctatcagtccaaagcattctacaaaacagctaggaaaacaaattcatgctgttcatatgtcggttaa

SEQ ID NO: 1632 - DNA, 750 bp, Piezodorus guildinii
atgtttctcacacgttcagagtacgacaggggtgtcaatactttctctcctgagggaaggttgtttcaagtggaatatgctatagaagctatcaagctaggttccacagcaataggtgtttgcaccccagaaggagttgttatgggagctgaaaagagaataaagtcccctttgatggaaccagaagctgtggagaagattctccaagtcgatgatcatattggttgcgctgtaagtggtttgatggctgattccagaaccttagtagagcatgctcgagtccagtgccttaatcattggtttgtttatgatgagaagatgccgatagagtctgctgctcaggccgtctctaacttggcaataagatttggtgatgctgatgaagatgctggcccagcgatgagtaggccttttggtgtggctgtcatgttcggaggatatgattacagaggacctcagctctatcatatggacccatcaggaacatttatctatttcgatgctaaggcaataggttccggtagcgaaggagcgcaacagagacttcaagaattgtatcataaaggaatgagcctcaaagaggccatgcagatgatcttgacaattttaaaagaagtaatggaagaaaaattgactgacaataatgtcgaaatagctgtagtaactgcagaagagaaacagttccgtatgtataccaaggaagaagtttccaaagtcataggtgaaacgcaatcggcacaaacttcgtaa

SEQ ID NO: 1633 - DNA, 1167 bp, Piezodorus guildinii
atgagtgagtactggcttatatcagctcctggcgataaaacatgccaacagacatgggaaaccatgaataatcttactagcaaacagcacaacttgtcagaaaatttcaaattccatattcctgatttaaaggtgggaacattggaccagcttgtcggactttcggatgatttagggaaactcgataatttcgtggatcaggtcactcacaaagtagctcagtatcttggagaagttttggaggaccagaaagataaacttcaggaaaacttgatggctaataatacggatttatctacgtatattacaaaattccagtgggatatggctaaatatcctattaagcaatctcttcgtaacattgctgatatcataagcaagcaagttaatcagattgatgctgacttgaagacaaaatctactgcttacaataatctcaaaagcagcctccaaaatatggaaaagaagcaaagtgctagtttgttgacccggaacttagctgaccttgttaaaaaagaacattttattttagactctgaatatttgacgacattactagttgtggttccgaagtcaaacttcaatgattggaattccagctatgaaaaacttactaatatgattgttccacgttcaagtcagcttgtttatcaggattctgattttggtttgttcacagtctcgttatttaagaaagtggtaaatgatttcaaattaatggctagggaaaaaaaatttgttgttcgtgactttatctataatgaagaggaattagctgcaggaaaaaatgaaattacaaaattagttactgacaaaaagaaacaatttggccctcttgtacgttggctgaaggttaatttcagtgaatgtttttgtgcttggattcatgtaaaagcattgagagtttttgttgaatcagttttgagatatggtttaccagttaacttccaggctatgttgatccatccccacaaaaagtccgttaaacgtttgcgagatttattgaatcaactttatgcaccattggacagtagtgctcagcagcaaggaaatcaaggtggtggtaatgatagcgtggacattcctggtttaggatttggccaatcagattattatccctatgtatactataaaataaatattgatatgttagacactaaggcttaa

SEQ ID NO: 1634 - DNA, 1647 bp, Piezodorus guildinii
atgtcaactttaggcgttccattatcggttgggggcacgagaacctcgggagctccagtcagaactcaaaatgttatggcagcatgctccattgcaaacattgtcaaaagctctttggggcctcttggattggataaaatgctggtcgacgatattggggatgtcactgttactaatgatggagcaacaatcctacgattacttgaagtagatcatcccgctgcaagagttcttgttgatctagctcaacttcaagatgaggagattggcgatggaacaacttctgtagtaattattgcagcagaacttcttaggaatgctgatgaattagtcaaacagaatattcacccaacttctatcatcagtggttacagacttgcctgcaaggaagctcagaaatatattcaagaacacctatgtgtcagtgttgatgaactgggaaaagattccatcatcaatattgcaaagacatccttgtccagtaaagttattggaattgatgatgacttctttgcatcaatggttgttgaagctgcacaggctgtaaaagttaatgacagcaaagggaaagcttcttatcctattaaagctatcaacattttgaaagcccatgggggatcagctaaagaaagtatattggtcaatggatatgccctcaactgcacagtcgcatcaatgggaatgacaaagcgagtagaaaatgctaaaattgcctgccttgatttctctttacaaaagacgaaaatgaaattaggtgttgaagttctggtagaagatcctaatcagttggaagcaatcagagatagagaggctgacataacaaaagacaggattcagaaaattcttagtgttggcaccaatgtagtacttttgagcggaggcattgatgacatttacatgaaatatttcgtcgaagcaaacgcgatggtggtaaggagagttaaaaaatcagacttgaaacgtattgctaaagcaactggtgcctcttttgcaacatctctaactaatatggaaggtgaagaagcatttgatgctagtttattaggcgaggctgccgaggtatcccaagaaaggatatgtgatgatgaacttatccttgttaaaggtccaaaagcacactctgctgcctccataatccttcgtggaccaaacgattatttctgtgatgaaatggagagatctattcacgactcgctgtgtgcagtaaaacgtgttcttgaaagtaaaaccgttgtagcaggtggcggagccgttgaagctgctctttcaatctacttggaaaactttgccacatctttaagttcaagagaacaattggcgatcgccgagtatgctaaatcacttttggtgataccaaaaatacttgctgtcaatgcagctcttgattcgactgatttagttgctaagctcagagcttaccacaacacaagccagacaaagaaggatcatgctcacttgaagtggcatggacttgacttgtatggaggcgcagtgagggacaacaagaaggctggtgtccttgaaccaactatctcaaaaattaagtccttgaaatttgccactgaggccgctatcacaattctccgaatagacgatcttatccgcctggaagccgagaagaaagatcagggccatggagatatgtga

SEQ ID NO: 1635 - DNA, 786 bp, Piezodorus guildinii
atgttgagtttagctgatgcttcaacaaattttgatcacaattctatcagaagcaatgatagacatggtaacacactcgatgataatcaagttaaaattattaaagctccggattttttaaccaggactttatatcccatgacaactacagcatctgtagttggaatcaaatttaataatggtgtagctatcgctgcagatgtcggtggatattatggatcattgaatcgtttcaagtctcttgataggctgtacaaagttaataacaatattgtaatgacaaccactggagattatgctgattttcaatacatcagagaattaatacaacaaaaagttatcagtgaggaaatcctggatgacagtttctctttaaaagccttttctcttcatacttggctcactcgcctgatgtacaacagaaggtcgaagtttgatcccttatggaacaatgttattgttgctggatttgatagcaacggacccttcttgggaatcgtggataaactaggaatgagttatgaagatagctgtgttgcaactggtatgggtgggtatcttgccactccacttttgagggatgtctatgaacgaggcaaaggaaatttgactaaacaagaagcccatgccgcccttcagaaatgcatggaaattttgtactacagggatactcaatcgcttcccaagtttcaaattgcaacagtcaccgaagaaggtgttgaaatatcacctgaattagaagtggaaggaaactgggaaattgtcaaacattctaagggattttga

SEQ ID NO: 1636 - DNA, 2055 bp, Piezodorus guildinii
atgaatgatcatcttaagaaattttctggtgttgatttcaacccagacaaatatgtcaaagaaatatctcaagtttgtgttggtggaatagaactccaaagccatagagctaaaatccaggctcttgctgaagaaacaagtcagaatctaaaaaaaaatgtttataaaaattacatgcaattcattgaaactgccagagaaatctctcatcttgagggtgaaatgtatcagttatctcacttactatcagagcagcgtgcccttcttggttcaatgagcaattcaggttctgaacctgttcttcaagcaggtggaagcaaagcccaagaagaaaaaagaattgcggctttatcgtctatttcggaggtcatagaatcttgcccggatcttcttgatactccaggcagagaaattttgcacgaaggtgaccttgtggaactggaccctctggagaacacagctcttcatcgaactcgggctttactgttttctgatatgtttatgattgcgacttggatgtctgaaaggaaaggacaagcaaagtataagtttgaaagcagttacgatctgggtagcatggctgttgtaaatgtgagggatcttggacaagttaaacatgcttttaaacttttagtttttcctgataccagactttttcaatgcgtaaataatgaagccagggaagaatggctgaaaaagtttgatgaagctaagaaagcacgattgaattcagagcagaccaaaaaaaaaggtgaaaatgacaaagaatcttatacgattcgtgagcaatcgactaaaccccctgagagaactgattctgttgaattcggatctaatccatttgggtttgtgcttgatgatgatgcagacagcgatgctcttccagaatggttgaccgaagcagcggatgattttgatgtttccatagctcagaggcattttgaagaagcctatgcaatcattcagaaaactgaggagtattttgcatctgcgcaagacgatcaagggctggctgatataaaatccaaattggaaaataggaaagatgtattgatctgtgtcctcctatctgagttgaacgtgagtgctgaaaaatcattacaaggaggtcttcgtgcgagccgtcgagctgttaggcttcttaaccaacttaataaatcaactcaggcatgtgagctatatctgaaagtttgtacaaacctcctaaaagcacaaagcaaacgggtaaagcgagagggtgcaactgtggcgtatgtcaaacgattatcagaagtatacttttcgaatcttgcatctattacttccgaatttcaatatcgtgcatttcctcacaatcaagattgtacatcagcttttgtagtatgggtgtcgatggaagtctctaatttcctctcacatatcataaaacaagtattcatccctcagacaccccttggtaccctggctgagtgtatagacattataagaaagcagtcccagcagatgtgcgagcttggcttggatctgagctaccaggttaatggccagaccatggcagcagttacgcgtgcagtagccgaagctggagagaaagctgttgatgctgtcaaggtgagagctgccgaggacccttggagaccttcaaggcagacccagcaatcgatcaataagatccagtcagagttaggtcttcctgtttcagaatatctcgttgattatggagtcttcgagctgactgctaacagcctgtcttttgccaagttgctgtcctctttgacagatgagggccttatgatatcctgccaagatctggagcacgctttgagtaaagcattgaatgaagttcttaaagcgcacttgaaccatctttcagcctcttactctagtaacaaatttcgttctcagagaagtcttatacagcaaaatgcaaaatttattctcgatcaattattggaagcagtgcagagaaaatacagtgaaaaaatgggccatagatgtaagaaattggacatattaaggaaagaatacaattttattttgaaggagagtaaaacaacggttactggttacatttag

SEQ ID NO: 1637 - DNA, 3792 bp, Piezodorus guildinii
atggatgaagtgaagaaacttgagcacctctcattggtgtcgaaaatttgcacagagcttgaaaaccatttgggattaaatgacaaagatttagctgaatttatcattgatttggcctctaagaataatacatttgagagtttcaagaaagccttattagataatgatgcagagttttcggattcttttatttctaatttgctgaggatcattcaacacatgcgacctaagaatgaggtaaccgtgacgaaagacatgaccaagcaagacaaactgagtatgaagtttccaggactagctattccgaatgaggtacaacagacgaagaaccatagcgagaaaaagttcaatctgtctacaatcaaggaagatcctgaggacaatgaagtcgaggatgcgatggcagctctcgaagcattagctccctcgaaagaaatgaaatttgccttgaagactgaaagagcatccaggtctccggaaaaagttatcaaacaagaatcggataagatcagaaaacgaagtcgcagccgcagcagaaacagagacaagaagaggaatagaagtcggagtaggagtagaggaaggggcaggagtaaagagaaatcctccggtaagagcaggcaaaggagcacgagtcgtgggaggagacggagaagcagggacaggagttctagcaggaatagaggtcaggtgaagaactgggacagggagagagagagggagaggagggtgaagaatgaccgaaggagtaggagcaggagcaacggaaggaggagaaacgaaaggagtcgtagcaggagcacaggaagaaggaggaacgatcggagtaggagcaggagttatgacaggaagaaaaatgataaaaaaagagaaaatgaagatgaaaagaataaaactgatgaaccgcttgaacccgaagttggaaaaatatataatggaaaagttacaaatatcgtttctttcggatgtttcgttcaaattgagggtttgaagagacgttgggaaggactagttcatatttcacagctgaggagagaaggaagagtaacaagtgcttctgacgttgtctcccgtggaatgaaagtcatgatcaaagtgttgtcggtcgctgggcagaaggtatctctctctatgaaggacgtcgaccaggaaactggaaaagatctgaaccccaccgttcgccatgccatcaacaaggacagggaagaagaagcctcaatgcgaaatcctgaccgtccaacgacactactagatcttggttccttcgatgatcacgatgactttcagagcagaaagagggttaataggatatcatcgcctgagaaatgggagatcaagcagatgttatctgcgagttgtatcgataaaagtgaacttcctgatttcgatgaagagactgggttgcttcctaaagaggctgccgaagaagaagatatagaaatagaaattgtagaagaggaaccaccttttctacaggggcatggaagaaatttgcatgatcttagtccggtgaggatcgttaagaatcctgacggctcccttgctcaggccgccatgatgcaaagcgcactcgcgaaggagaggcgcgagcagaagatgttgaacagggaacaagagatggaccaaatgccgaccggtttgaataaaaattggatcgatccccttcctgagagtgatggtagaactttagctgcgaatatgcgtggaatcggactaacgaatcaggacctcccggaatggaaaaagcacgttattggcggtaagaagagttcatttggtatgaagacgaacatgacactcttggaacagaggcaaagtcttcctatttataaactgaaggaacagctgattaaggctgttaccgaaaatcaaattttgatcgtcattggtgaaacaggatcaggaaagaccacccagatgactcagtatttggcagaagctggtttcacatcgagaggaaaaattggttgtacgcaaccgaggagagttgcggcgatgtcagtggctaagagagtggccgaggagttcggttgtcgtttaggtcaagaggtcggctacacgattcgtttcgaagattgtaccagcccggaaacagtcatcaagtacatgacagacggtatgttactccgagaatgccttgtggacttggatctgaagagctattcggttataatgttggacgaagcgcacgaaaggacaatacatactgatgtactctttggacttttgaaacaagctgttcagaaaaggtcagaactaaagttaatcgtcacatcggctaccttagatgctgtgaagttctcgcagtatttcttcgaagctcctattttcaccattcctggacgtacgttccctgtcgaagtactctatacaaaggaaccagagacggattacttagacgcatcgcttattactgtgatgcaaatacatttaagagaacctcctggggatattttgctatttcttacaggtcaggaagagatcgataccgcttgtgaaatattgtacgagagaatgaaatcgcttggtcctgatgtcccagagctcattatccttcccgtttattctgcacttccgagcgaaatgcaaactagaatttttgaagcagctccacctggctcgagaaaggttgtaattgctacaaacatagccgaaacatctctcactattcatggaatcttctacgttgtcgatccaggattcgtcaaacagaaagtgtacaattcaaagacaggaatggactctctcgttgttacacctatttcacaggctcaagcaaaacagagagcaggtagagccggtagaacaggacctgggaagtgctatagattgtacacagagcgcgcctaccgggacgagatgctgcccactccagtccctgagatccagagaaccaacctggccaccaccgtcctccagctgaagactatgggcattaacgacctccttcactttgacttcatggatgccccgccggtggagagtttgataatggccctcgagcagcttcacagcctcagcgctctcgatgacgaagggcttcttacgaggctcgggagaaggatggctgaatttcctttggaacctaatctatcaaaaatgttgattatgtcggttcacctccagtgctcggatgagatacttaccgttgtgtcgatgctttctgtccagaatgtattttacaggcctaaagataagcaggcactcgctgatcagaaaaaggctaaattcaatcaagccgagggagatcaccttaccctactcgccgtttataattcgtggaaaaacaataaattcagcaacgcctggtgttacgagaatttcgttcagatcaggacgctcaagagggcacaagatgttaggaaacagctgttaggaataatggacaggcacaaattagatgttgtatcagctggtaaaaacacagttcgtgttcaaaaagcagtgtgctctggtttcttcagaaatgctgcgaagaaagacccccaagaaggttataggactttggtcgacagtcaggtcgtttacattcacccgagcagtgctctttttaaccgacaacctgaatgggttatttatcatgaactcgttcagacaacaaaggagtacatgagggaggttacaacaatcgatccgaaatggctggtcgagttcgcacctgctttcttcaagttttccgatccgaccaaactcagcaaattcaagaagaaccaacggcttgaacctctgtataataagtatgaagagccaaacgcctggaggatatcaagagttcgaaggagaagaaattaa

SEQ ID NO: 1638 - DNA, 1245 bp, Piezodorus guildinii
atggcacctaccagaaaaacagaagggctccttgcccgagtaaattttcccttgtacaccttgcaaatgttgactagtagacatgttcttgttggtggaggtggtggctcagccaaaacaggagttgcaaatggttttgaaatttttgaattgtcttatgatggaacccgtttttctgctgaagaagttattcgtcatgaaactgggtctaaagtggtgatgaattctgcttgttacagtgacaagaaaagtacgtttttagttgctggacaagaaagtcactgtcagttatacagagttggaattactgttgagaaggaggtttctgaagaaccaatgaatggcattctggaacctcctaatctaaggcaccgaaaaccttccagaaatcaccaaaatggtataagtgaagtgaagaatattgtcaaaaagaaattagtttttaaattcaactctggtgatagcatacaatctgactttagtgaaaacgaaccatgccaaagggtagttacaatatctcgttgtggtggctggatggcaactggtggaactgatggaatcgtaagaatctggtcattccctagccttcgattgattagagctcttaaggcccacacgaaagaactagatgatttacattttagccctgattcaaagcagatagccagtgtggcaaaagatggacaagcaattatttgggagctgaagtcaggaaaacaggttcataaacttgattggactcatcctgcaggaatcaaatatctcttcaaaagatgtcgctttggcattgttgaaggcaaaggttgcagattatttactacagttaatcctgtggctggtgggaaggatgcccaaggctggatccatgcctgggatgatggtcgcattttcaagtccgcagctgtatctgaacctacttcagcacttgccgttagggatgatggtattttcattgcaatcggcactatgttcacaggatctgtatccatatacatagcattctctcttcagagagttctgcatgttgatggagcacattcaatgtttgttactggtgttgaattattgccttgttcttcttcatggggtgcaatagaagctgcagctttgagtatttctgttgataacagagtctgtattcacagcttaccattcagaagaacgttaccaccatggttagtgatcatcatcatcatgttgactcttctctttacttttgtattgtgcagctttatcggcctttaa

SEQ ID NO: 1639 - DNA, 1254 bp, Piezodorus guildinii
atggcgggtgcaatgttgtttgagaggactgtctcttctagagatagggataatagtcgaattcttcctacttctagcagaaatgtcgacgatgacaatgacgaagaagacatcagaaataaggaacaagggattttgcagttgggagagcaatacaagaaagagggtaaagctaaagagttagcagaacttatcaaggcaagtagaccctttcttagtcaaataagcaaagctaaagctgcgaaattggtgcgttctttagtggattatttcttggatcttgaagctgggataggaatagaagttcaactttgtaaagagtgtatagaatgggcaaaagatgaacacaggactttcctcaggcagtcactggaagccaggcttattgctctatatttcgacactggaatgttcacagaagcactccagctcggctcaagtctccttaaggaattgaagaagttagatgataaaaatttgcttgttgaagttcttttgttggaatccaaaacttatcatgctttgagtaatctttctaaagcccgggctgctctgacatcggccaggacaactgctaattcaatttattgtccacctaaaatgcaagcagccctcgatttgcagtctggtatattacacgcagctgacgaacaggatttcaaaacagcttactcatacttttatgaagcatttgaaggttatgatagtgttgacagcccgaaggctttggtagctcttaagtacatgcttttgagtaaaatcatgttgaatacgccagaagatgtgcagcaactagttagtggaaaacttgctcttaaacacgctggtaaagatatcgatgcaatgaaatcagttgctcaagctagccataagagatcccttgccgattttcagataactttaaagaattacaagaaagagctggaagaggatccgatcgtaagagctcacttgggtacactttacgacaacatgttggaacagaatttgtgtaggatcattgagccgtattcaagagttcaggtcgattttatttcaaaatcgatcaagcttccccttcctcaagtcgaaaagaagctttctcagatgattcttgacaagaagttcaacggaattctcgaccaaggtgaaggagttctaatagtgtttgaagatgcagtcgttgaaaaaacctacgaaatggctttagaagtcattaacagtatgggtaaggtcgtagacacattatatcaaaaagctaagaagctctcataa

SEQ ID NO: 1640 - DNA, 1800 bp, Piezodorus guildinii
atgtctacgaagtcacccaaaaagacaactccagccggttcttcatcagcaggtccttctagaagttcacccagaaaaagtgaaactcctactcctcaaggtgccaggaaaagtcctttaagtccaacaagatatagtagactccatgaaaaacaagaacttgctaatttaaatgatcgcttggcatgttacattgatagagttagaaatttagaaactgaaaataaccggttaacccgtgaagtcaaaagttctcaagaaaatattaccagagaagtaactagtgttaaatctttgtacgaaagtgagttatcagaagcaagaaaattgcttgatgaattatcccgggaaaagacaaaactccaaatagatacacgaagattatatactgaaaatgaagaacttaaaactgagcttgagaagaagactaaagattgtaatattctccaaacttcactttcagtcagtgagaaccgacttgcagatctcacaacaaaatataatcaactgcaaggagaaaggaagaagcttgcagatgaaaacaaggctttggaaaatgaaagaaataaacttgcagtccagctatcagatacacgaaaacatttggaggaagaaactctccagagagtagatctagaaaatgctgtgcaaacattacgtgaagatttttcatttaaagaacagctacatgaacagcagttattggaaactcgtactaaaaagcaagtggaaattagtgaacttgatggtagattaagccaagagtatgaagaaagattataccagagtcttcaagaaatacgcgatcaatatgaatgcgatttagaaaataacaaggaagaaattaaaaaactgtacgaggaaaaaattcgaagtcttggaagtcaattgacacgaaacagcaatgctgctgcaatggctattgaagaaatgaaaaacatgcaagctaaactcaatgagcttaatagaaaattactagacttggaagcagacaggaatgcagcccagcaaaaggctagagatctggaaaagattttggaacaggctaaagctcaatatatggaagaatatagtcagagggaagctgaaatcactactcttcgtgaagagatggctcatcaagttcaagaatatcaagatttaatggacatcaaagttgcattagatttagaaatagctgcctaccgaaagttgcttgagggagaagaagccaggttaaatataacacctgtcagttccccagcccagacttcttcccgaaaggtattaggcaggaaaaggaaacgtacttttattgaagaatctgatgaaacagacctttctaactactcagttacttcttcttccaagtgtgatgttgccatctcagaagtttgtagtgaaggacaatttataaaactccttaataaatctaataaggaggtttcacttggtggttggcaactaactcgtaaagccggagaatcctccactatttacaagtttcaccgtactattaaaatggaaccaggtgctactattaccatatggtcttcagatgttccggataaatctcatgagcctccagaaaatttgcttatgaaaggtcagcgttggatggttgctgatactatgactacagttttgtccaatcctgctggggaagaaatggctatatcagaacataagaaacagcagctgagtgaccgaacatcatcaaggcaaagagaaggtagtttctatcaaaagagaacatttctttcttcttcaatgcgccctcctagtgaaactccaggtgaagaaagatgtgtgatttggtaa

SEQ ID NO: 1641 - DNA, 2409 bp, Piezodorus guildinii
atggctgatatgaaaagcaatgaagatttgtcaactgcaatcctgaaaaagaaagatagaccaaacagattgattgtggaagatgcagtcaatgatgacaattctgttgttgctctctcacaggccaaaatggatgaacttcagttatttcgtggagatactgtgcagcttaaagggaaaagaaggaaggaaactgtttgtatagttttatctgatgatacatgccctgatgaaaaaattaggatgaacagagttgtacgaaataatttacgagttcgtttgtcagatattgtttcaattcaagcttgtcctgaagtaaaatatggcaaaagaatacatgttttacctatagatgacactgttgagggattgactgggaatttgtttgaagtgttccttaaaccatattttctggaagcataccgtcctattcataaagatgatacttttgttgttagaggtggtatgcgtgctgtagaatttaaggtagtagaaacagatcccgctccttactgtattgtagcacctgatactatcattcattgtgagggtaatcatataaagagagaggaagaagaagaagctttaaatgctgttggatatgatgatattggaggttgtagaaagcaacttgctcagattaaagaaatggttgagctacctttgagacatcctagcttattcaaagcaattggtgttaaacctcctcgtggaatattactttatggaccacctggaactggtaaaacattaatagcacgtgctgtggctaacgaaacaggagcattcttctttttaatcaatggccccgaaattatgagtaaattagctggtgaatctgaaagtaatctgcgtaaagcatttgaacaagctgaaaaacatgctccttccatcatttttatcgatgagttagatgccattgctccaaaacgagacaagactcacggagaagtggaaagaagaatcgtctcacaattacttacattaatggatggtcttaaacaaaattctcatataattgtcatggctgctaccaacaggcctaattcaattgatgctgctcttagacgttttggacgatttgatcgtgaaattgatattggtattccagatacaactggacgtttagaggttcttcgaattcatacaaaaaatatgaaactagctgatgatgtcaatttagaacagattgctgctgaaacacatggtcatgttggagcagatttggcatctctctgttcagaagcagcacttcagcagatccgtgaaaaaatggatctaattgatttagaagaagagcaaattgatgcagaagttctaaactccttggctgttactatggataacttccggtatgctatgggcaaaagtagcccaagtgcccttcgtgaaactgtggttgaagttccaaatattacttgggatgatattggtggtctggataatgttaaaaaggaattgcaagaattggttcagtaccctgttgaacatccagaaaaattcttgaaatttggaatgcaaccttcccgtggtgttttattttatggaccaccaggttgtggtaagacattgttagctaaagctattgctaatgaatgtcaggcaaacttcatttcagtcaaggggccagaattattaactatgtggtttggagaatcagaagctaatgttcgtgatatttttgataaggctagagctgctgcaccatgtgttctattttttgatgaactggattccattgctaaatcaagaggtggaagtgttggagatgctggaggtgcagctgatagagttatcaaccaaatccttactgaaatggatggaatgggagccaagaaaaatgtttttataattggggctactaatagaccagacataattgatcctgctattctgagacctggccgtttagatcaactcatttatataccattacctgatgagaagtcaagagaagccatcttcagagcgaacttaagaaaatcacctgttgccaaggatgttgatttacaatatattgccaaagttacatttggttattctggagctgatcttactgaggtatgtcaaagagcgtgtaaacttgcgatcagacagtccattgaagctgaaatcaaaagggaaaaaagtagattagatggagctacacgaatggatatggatgatgaggatcctgtccctgaaataacacgtgaacattttgaagaggcaatgaggtttgccaggcgttctgtcactgataatgatattcgcaagtatgaaatgtttgctcagacattacaacaatcaagaggttttggaactaattttagattccctgctagctcaaatattcctagtgcaccaggaggtgggggaactgaaactaacaactttccagatgatggagatgatgacctttataattaa

SEQ ID NO: 1642 - DNA, 834 bp, Piezodorus guildinii
atgacggaccagcaaatggactgtgctctcgacttgatgcgaagactaccgcctcaagaaattgaaaaaaatttaagtgatttaattgatttagttccaagtctttgtgaagaactattgtcttcagttgaccaacctttaaaaattgccattgataaaggggttggtaaggattatttattatgtgactacaatcgggatggtgattcatacagatcaccttggagcaatacttatgatccacctctggaggatggttcaatgccctctgaaaggctaagaaaactagaagtagaagcaaacgctgccttcgaccagtatagagaaatgtattttgaaggaggtgtgtcatctgtttacttgtgggatttggatatgactggttttgcaggtgctattttaataaaaaaggctggggatggttcaaaaaaaattaaaggttgttgggattcaatacacgtggttgaagttcaagaaaaaacaactggacgaaatgctcattataaattaacttcaactgttatgctttggttgcaaacaaataaaacaggttcaggaacgatgaacttgggaggtagtttaactagacagatggagcaagatgcagctgtatcagatgcttctccacacattgctaatattggccgaatggttgaagatatggaaaacaaaattaggaacatcctgaatgatatttattttggaaaaactaaagacatagtcaatgggttgcgaagtacacaagctttatcagaacagaaagcccaggctgccctgaggcaggatcttgctgtagctcttcagaaacggcaggcaaaaactgcggacaattga

SEQ ID NO: 1643 - DNA, 3717 bp, Piezodorus guildinii
atgcaacaaatggactccttgcaaccgaacaacgcaacaggactggtgaaaagcgggctagaggcgggggccggtagcggcatgaaggagcccccgccacgagaggagccggtcctagaccctatcaatggtgttgtccagccaccggtcatacctccaccccacaggcctggccgggtcaccaaccagttgcaatatattcagaagaatgtcctcaaagcagtgtggaaacatcaatatgcttggcctctacagcaacctgtcgatgctaacaaactcaatcttcctgattaccataaagttattaaacatccaatggatcttggtaccatcaaaaaacgactggaaaacaattattattggtgtggtgctgaatgtattcaagatttcaatacaatgtttaacaattgttatgtttataacaaaccaggagaagatgttgttgttatggctcaaacgctggaaaaaatttatttgcagaagctggaaacaatgcccaaagaagaaatcgagctggagcctccaccacctaaaggttccaagccagttaagaagcgacctggagtgataggaccaggtagaggaggtgggaccactggtgctgggagggggaggccttccaactcgacaacggcagccactgcagcagtagtcgcgactcctgtaccacctgtcactcctccgtctcacctaccaccaaccatacccggttccactgctaccactactgtagctactactcatcataactctcttccccctcaggttgggcagccagcagctgtaccctccaacttcaatgcgacacctgttgatcctctgctaacacctggattggctcctggtgttggtccaaaaggtggcaaaggggccgtcgttcagaccccaacggcgcccaaaccgaagaaaggggtcaaaagaaaggctgatcaaaacgatagcccggctggcttcgatccaacctacaccccaggtgactccaaagctgccaaggttggcactaggagagaatctggaaggcaaataaaaaagcctcaaagacagtcagacgatggtatgccattttctcaaagcccaatggcaccctatgctcattcgaattcaaatcaggcttctcacgaaaagccaaaagaaaagctttccgaaacattaaaagcgtgcaatgaaatattgaaagaattattttctaaaaaacattttaactatgcgtggccattctataaacctgttgatgccgaatggctcggtttacacgactatcatgatattattaagaaacctatggatctcggaacagttaagcaaaaaatggataatcgagaatacaaaactgcgactgaatttgccgcagatgtcagactaatatttacaaattgttataagtataatcctcctgaccacgatgttgttgccatgggaagaaaattgcaggatgttttcgaagtgagattcgctcaagtacctgaagagtcccctgctgtagcacctcctcctccagaaaaggaagaagaatcctcttctgggtcatcttctggctctgaatctgaaacagacgattcagacgatgaaagggcccgtaaacttagtcaattacaagaacagctgagaatgatgcaggaagagatgacaaaactcctcgaaaaaggcgccttgaaaaagaagaagaaaaagaaagatgggtcgggttctggtggaagctcctctagtaaaaaaaggaaatctgctgataggacacttggtaaaacagctgatggtagtatgttagctggtgctggagcgcctgctgtcgcagaaatgaaggctgccgacggtgtaaaagccgcaccccctccaggcaggaatgctgtcccctcaccccaggtcaaaccaaacaagggcaaagcccctggcagaacaccaggaaaaacaaattctcagggcaagaggccaaagccaaactccaggtccaccaactcaaagaagaagaatcctgtcgtaacttcagagttcaactcagaagatgaagataatgcaaagcctatgtcttatgacgaaaagagacaacttagcttggatatcaacaagctcccaggtgataagcttggaagagtagtccatatcattcaggccagagagccctctttgagggattcgaatcctgatgaaattgaaattgactttgagacattgaagccgtcaaccctgagggagctcgagtcttacgttgcatcatgtctcaggaaaaagccacataagaaagtatctgcaaaatcaaaagatgaagcaatggcagagaagaaacaagaacttgaaaaaagacttcaggatgttactggccagttaggaggatcagcaaaaaagcaggctaagaaacaaggccagggaagactttctgcatcttcatcatcaagctcagattctgatagcagtagttcgagtctctcaagcagttcttccgactcatctgacagtgaagcagggaaagcagggcgtccagcaaagaagaaaaacaagaaaaatcacctgctggcaacaactactgcatccactgtccaacagaatcaaacagtccccagcttgaccatgacaactgctacaggtaccattgtaaataaaactgtcggggcttcacagcccatagtaccattagcaagcaccaataagcctactgtacctcctgtctcttcagttgctcagcctgaacccgtgaaacctgtggtggtggcatctcatatcctccctccccaacctgcaaggccgaccgctacagcagccccgctgactaccgcaaagagggcatcgatccctacaccaggcacaaccttaggtataccacctaccgctccgaccgcccttgagacaggtcctattgagatcaaacaagaattggacgttcctgtgtcattagctcctgtgcctgaccatttggatttcaaaaaccttttggaagtgaagcctgagctgaatgatatcgtaacagggatgccttctgtttttgatccattgcctgactcacctcccatcattaaggaagaaaaacttcccatattacctcatcacactgatggacacttgaataactctcttccccccgtgagtaacgtgcctggcccgccagttatacctagtgctgcacttcctacaacacctcacatcttagatatgaacaaaaattctcagcctccccagcttcctcagacgccagttatgcaacacaacttcaagcctaagagtgttgaacaaaacctgaaaaatgccagttcatggtcttcattggcccaatcgccgacaccagctctaactcctactccacccactgcagcagcactgaaatcatcaatggctgacagttttcaagcatttaagaaacaagctaaagaaaatgccaagaagcaacgcgccctgattgagcagcaggaaatgagacggcatcaaaaagaacaggccgaaagggaaaggttacgtgtcgaaactgagaagaggagagaaagggaagaagaagaagctttggaaaaagccaggaaggctgctgtagtggcttctggtggaagagttgaagaggtcaaaaatgctgcgatcgaggaaggctctagccctggttcagctgataaagctgctgcagagcgcgagcgtctgaggcaacgagagcaagagaggcggcgacgtgaagcgatggctggacaaattgatatgaacaggcaaagtgatttaatggctgcttttgaacagaccttgtaa

SEQ ID NO: 1644 - DNA, 1293 bp, Piezodorus guildinii
atgattcccccgtcttctcggccgcaggtcactgtgtacagtgacaaaaatgaaccaactggtgaattattgactctacctgcagtctttaatgctccaattagaccagatgtcgtcaattttgtacatcaaaacatagcaaaaaatcacaggcaaccttatgctgtcagtgctgaagcaggtcatcagacttcagctgaatcatggggaactgggcgagctgtggctcgtattccccgtgtaaggggtggtggtacccaccgttcaggccagggtgcattcggtaacatgtgtagaggtggacgtatgtttgctcccaccagggtatggcgcagatggcaccgcaaggtgaatgttaatcaaaagaggtatgcaatggtatctgctattgctgctactggagttccagctctcgttatgtccaaagggcacatggttaacgaagttccggaaatccctcttgttgttactgataagatccaagagtatactaaaaccaagcaggccacaatctttttacatcgtatcaaggcctggtctgatattcagaaggtctacaaatctaaaagattccgtgctggtaaaggtaagatgcgtaataggagacgcattcagcgtagaggaccactcatcatctatgggcaagatcaaggtctaactcgtgctttccgtaacattcctggtgttgatcttatcaacgtttcacggttgaacttgcttaagctggcacctggtggtcatgttggaaggtttgtgatctggacccaatcagcttttgatcaacttaacgctctctatggcacatggaagaaaaaatcaactttgaaaaaggactacaacttgcctatgcccaagatggttaatactgacctgtctaggctgttcaagtctgaagaaatcaagagtgtccttaaagcaccaaggaagaccatagttaggagggttaggaaactaaacccattgaggaacactcgagcaatgctcaagctcaatccattcgctgcagttctgaagaggaaagccatacttgctgataggaaacttaagcttgagagggctattgagagatcaaagaaggaaggaattgagcttacccctcatcaaaagaggtatgttgctatgctcgagcgaaggaaagctcagatcaaagctgctaaggctgctaagcctaaaaaggtcaagaaaccaaaagctgaaaaaactgaagctgctgaagcaaagaaagctagtgtaactaaaaaaccagcaaaaaaggcaacaacagctgctgctcccaaacctgccaaaaaatga

SEQ ID NO: 1645 - DNA, 5460 bp, Piezodorus guildinii
atggcagatttcatagattctgaagccgaagaaagtgaggatgaggaagagttggaagttcatgagaaaaagaagttgaaacggttgaaggcgatggaaagtgatgaagacgaggaagaagaagatgatgaggaacgtcttagagaagaattaaaagatttaattgatgacaaccctatagaagaagaaagtgaaagtgatgatggcagtggatctgaagaaggaagtggggaagatcggggaggggaaaaacgtaagaagcatgatgaagattttgatgaccgtcttgaagatgaggattatgatttattggaagaaaatctggggcgaaaggttgaaagaaggaaaaggtttaaaagattgagaagaattgaagatgaagagtcagatggcgagggagctgaagatgagggtgaagtgagggaagctatagccaatgaactttttgaaggatcagatcatgaagaagaccggagctcttctagaggcccggcagcacccgagaggtatgaagatgaggaggaagatggtgaatattcagatgctgatgattttattgtggatgatgaaggtagacctattgctgacaaaaggaaaaagaggaaacctatattcaccgatgctgctttgcaagaagctcaggatatatttggagttgattttgattatgaagattttgaaagacttggggaggatgaatatgaagaagaggaagatgaagatgagtatgttgatgaagaaggcattgaagatagtgaaaggagacgtaaacctacaaagaaggctgctagaaagaagccaacaaggaaatcaatctttgaaatttatgaacctagtgaattgaagagaggtcattttaccgattttgacaacaaagttcggaatacagatattcctgaacgaatgcaacttagagaaatccctgtgacaccagttccagaaggctctgatgagctttctgaagaagctgaatggatttataaacaagccttttgcaaacctacaacatccaaccaggaatggggcaacacgatggagagaggaaaaccgaagaaggaacctcaaacagtggagaagatcaaaaaagctcttgattttatgagaaatcaaaactttgaagttcctttcatagcattttataggaaagaatatgttctcccggaacttaacatcaatgatctctggagggtattcaaatatgatgccaagtggtgccagttaagaagcagaaaaatgactttactttcattaatggaaaaaatgagggactaccaggctgaacagctgatgaaggatatagatgcacccattccagaccatgtcagggtcattaaagatgatgatattgaaaggttaaaagctgtacagaccactgaggaattaaaagatgttcattcccattttttgatgtattatgccgatgaagtgaaaataatgttagaagctacaagagttaaggaacgggaagcagctaaagcaaaagctaggcaagagaagcaggtagatgaaaatggtgatccaatcgaaacagaagtagaggaacaagaggaacctcctcctcctgaaataccagcagtaaaacattctatacgttctggaccgtatgctatatgccgtaaagctggaataggtggtttggctaaacgatttggtttgaaacctgaacagtttgctgaaaaccttagggataattatcagcgccatgatgttgaacaggaaccatctttacctattgaattggccaaagaatttgtttcatcaaaatttcaatcaccagaagatgttttaaaagctgcaaagtttatggttgctacacaactgagtagagaacctcttgttcggcgttgtatgcgggatacattttttgaaaaagcaaaaattgatgttaaacctaccaaaaagggatcaaaggaagttgatgaaaatcatccttgttatgtcatgaaatacatgaaaggaaagcctgtaagagatttaaccgctgaccaatatctgaagctgcatatagctcatcaagataagcttttgaacgttagcatcagtgatcatattggaggtcatacaacgacatcctatattgaggaaattaagcaactctactaccgggatgagtttatgcaacatgtacaagaatggaataatatccgtcaagaatgtgttgatgttgcgattaagaagatgttgattccagaactgataaaggaactccatactcgtcttcttgaagaagctaaagaatttgtcttgagatcatgtgctaggaaagtttacaattggattaaggtggctccattttccgttgaatttggagatgatgatgaagatgattgggacaccagcaagggtattcgtgtcatgggggttgcgtatgtgcctgatttagcgcaggcttcttttgcttgcatggtcgctcctgatggtgaatgtactgattttcttaggctgccccatctgcttaaaagaaaaaatacttggcgagaagatgaaagaatgcaaaaggaatcagatttagcactgatacgaaattttatattgaccaaaaaacctcatgctgttgtcattggaggagaatcaagagatgctcttatggtggcagcagatctaagagaaataatatccaatttggttgaagatgaacagtttcctcaaattcctgttgaaattatggataatgatttggcaaaagtttatgccaactcattgaaaggagagagtgattttcgagattacccaatgttactgagacaagctgtttcactcgctcgaagattgcaggatccattagtggaattttcccagctatgcactccagatgacgaaattctttgtcttagatttcatcctttacaagaacagttatctaaagaagagctccttgatgttgttacattggaatttgttaatcgaactaatgaagttggtgtcgatataaatgaagtagtcgcaaatccgatttgtggaaacttggttcagtttgtttgtggtctcgggccaaggaaagggactacgcttatcaaaattttaaagcaaaccaatcagcggcttgaaaacagaactcagctcgttactacatgccatatgggacctaaagtttttattaattgtgcaggattcattaaaattgataccaatgctctcggcgacagtaccgaagcttacgtagaggtattagatggttctcgtgttcaccctgaaacttatgagtgggctcgtaagatggctgtagatgctcttgaatatgatgatgaggatgccaatcctgccggtgctttggaggagattctagaaaagcctgaaaaacttaaagatctagatctagatgcatttgctgaggagttggagagacagagttttggtaacaagagcattactctttatgacatcaggtcggaactcaaccatagatataaagatcttagagttccttatcaatctcctggacccgagttgatgtttgacatgctcactaaagaaactcctgaaacattctacattggaaaacttgtcaccgcaacagttattggcatttctcatagaaaacctgaaaaagatcagcttgatcaagctaacccggtacggaatgatgaaactggtctgtggcagtgtccgttttgtctgaaaaatgattttcctgaattatcagaggtttggaatcattttgatgccggtggttgtcctggccaagccacaggagttagaatccgattagataacgggattactggttacattcacattaagaatttgtcagataaacatgtcactgatccagctcagagagttactcgtggtcaaatgattcattgcagggtaactaagatagaggtagaaaggttttcaattgaagctacttcaaaatcttctgatctgttggataagaatcatgattggaggccacaaaaggatccttattatgatcatgaaagtgaaaagaaagatttacatacagaagaagaagccaaaaaaaataggcaaaaactgacatatatcaaaagagttatcgttcaccctgcctttcataatatttcttacattgaagctgaaaaaatcatggctacaatggagcagggtgatgtcattgtaagaccttcaagtaagggtgctgaccatctaactgttacttggaaagtagcagatggcatttatcaacatatagatgtcagggaagagggcaaagaaaatgctttttcattgggtcagtcgttgtggatcggcaatgaagagtttgaagatttggatgaaataattgcaaggcatgttaatccgatggcagcttatgttagggatatgttcgcattcaagtatttaaaagatacagaaggaggccttaaggataaagctgaagaatttttgaaagaagaaaagaaaaaaaatccagcaaaaatacattacattgtttctgtatccaagaattatcctggtaagtttttgctctcctatctcccaagagctaggtgtaaacatgagtacatcagcataacacctaatggattcaagtttagaggacagttctttgaatctgtcaattcattgttcaagtggtttaaagaacatttctcggatcctatacctggcacacctagtactccaagatctgcgatgtcagcacgcactccttatacgaatacgcctggacctatgccaataaatatgaatgctgaagcaatacagcgtgttgctcaaaatatgccaaatcatatgctgcatagcctttcgcaagttgccagccatactcctcactaccctcatactcctggagcatattcccttcatcagtatccagccactccatatactccgtccggtcaaactcctttcatgacgccatacacaaccccaagatacggtagtggtatgacacctggccaccagagtattatgtcttcaggatctattacatcacctcaaagttcaactccaggtcagcctgttttcctccatcctggctctatcacaccttcccacaggactcctgtcgctaatttccatagacctggtgggactcatcctgaagattggggtaagaaagcagaagaatgggttgcgaagaaaagagagaatgctagtagaacacctaggtcaactccaaatactggcactccacgccatggaacaccacgagatgatgccaataagaaccgaacacccaggtatgctgacaatgattatacctctccacgaccaggtgcgaatttcacatccccaagatattccaattggaataaagttgctggcactcctaattcacatatatctgcttatgaagacgccaattatgatgccaggagcctcaagtccccacgccctccacctgcccagggcaagtatgatccctacgaacttggccaaggaaagtcccctcggtattcaatgacaccacgttccacccctcgtaccatcaattcgcctcgttctatgtcactaggtgattcaactcccctgtatgacgagagcatttag

SEQ ID NO: 1646 - DNA, 2304 bp, Piezodorus guildinii
atggaagaatctaaagaacgtagtaagagttgtaggaaacatggaagaagtagtgaaaagactgaacataaatcaaaaagtgataaagattattccgagagagaaagtaagaggaggcgaaaccacgattatgataagtatgataaacattcatcaagagatagaaggcgtgattcggatcgtagaaattatgaaaaatatgaaagatactggggaaaagacaaagaagaggatcatcatgacagagatgttaaagctgactatttagtgggttcaaggtattataaagagacccctaaacatgagccacaggtgagaaaatcagagggtgctaataaaagtaaggaaaatgttaatccattggaaagtgctggtaaagaaaagccagtcaccagaaagaagaacgatgatatcattacatccaggactggaggtgcttacataccccctggaaaacttagattaatgcaagccagtatcaccgataaatcaagtgccgaataccaacgtatagcctgggaagcgttgaagaaatcgattcatggtcatattaataaagtgaatacttccaatattggcgttgttgccagattgttattcaaggaaaacataattcgaggcagaggtctactttgcagatcgatcatacaagctcaatctgcgtctattacattcactaacgtttacgcttgtctggtggctatagttaattcaaagtttccaagtataggagaactattactgaagagagtgatcattcggttcaaacgagcatacaaaaggaatgataaagcagtctgtatttcttcggctacttttatagcacatcttatcaatcagggtgtagcccatgaaatccttggactggaattggtcaccttattagtagaaaaccctacagatgattcgatcgaagtcgcagtcgcttttttaaaagaagcaggtcaaaaattaagtgaagtaaccagcaaaggcactaacgcaatattcgatatgttaagaaatattcttcatgaaggcaaattggaaaaaagggtacaatacatgattgaagttatgtttcaagtgaggaaagatgattttgcaacttttccatcggtaccggaagagctagaccttgttgatgaagaagatcagttcactcacttgattggtctcgatgatgccatagatacccaagacatacttaatgtattcaagcttgattcggaatatcaagcgaacgaggaacgttataaagaattgaggagcgaaatcctcgatactgattccgaggagagcggttctgaaggcgatagcagtggagaaggagaagacgatgattctgatgaggaagatgaagaaaagaaagtcacaatcgtcgataacacagaaacgaacttgatatcgctgagaaaaactatttacctgacgattcaatcaagtcttgactttgaagaatgtgctcataagctgttgaaaatggaaatcaagcctgggcaagagaaggaactctgtcacatgtttctagattgctgcgctgagcagaggacttacgaaaagttttttggtctccttgctcaaaggttctgccaagttaataatacttacatagcacccttcgaacagatattcgctgacacatattcgaccgttcatcgtttggacacgaacaggttgcgaaacgtagcaaaattattcgcacaccttctcttcacggatgccatttcttgggctgtactttctaatattcgactcaacgaagaagataccacaagttcgagccgaattttcattaaaattttatttcaagagctatctgaatatatgggcttagcgaacctcaatgccaggctaaaggacccaactcttcaatctgcaatggaaggtctattcccaagagacaatccaaaaaacacaagatttgcgataaactttttcacatctataggtcttggtggtctgactgatgaattgagggagcatttaaaaaatttacctaaatcaatccctgtggcacaactcattcaggaattgtcttctgaatcatcctcttcttctgaatcgtcatcttcttcttcttcctccgaaagtgagtcatcatcgtctagcgattcatcagaggaagaacgaagaaaaacggccaaaaggaaaaagaggccaaatgtttcaaaggaggattcaaataagaaaaaagaaagaaaacgaggaaactcacaggaaaatcatcgatcgaccaaagaaaccaagaacaagactccagagaagaagagaaaacatcagagagaggaaaaacaccattctcgaaaatcgaaaaggaaataa

SEQ ID NO: 1647 - DNA, 1758 bp, Piezodorus guildinii
atggcgcttaaggctctcgttggtcaaaaaattatgaacgatgcgatcaggcaaaagaagaaagggaaagaggtggagtggagggtcctcgtggtggatcagttagcgatgcggatgatctcagcctgctgtaaaatgcatgaaatttctgctgagggattgaccattgtagaagacataaataaaaagagggagccacttccaacgatggaagctgtctatttaataacaccaagtgaaaaatctgtccacgctttgatgaacgatttcgcctcaccaaatcgtatcatgtacaaagcagctcatgtctatttcacagaagcgtgcccaaacgctttatttgacaccctttgtcatgcgagactcgctaaatttataaagacattgaaggagataaatatagcgtttattccgtacgagcaacaggtgttctctctagacgctcctgaaacattccagtgcttctacaatccatcattgagcaacagccgactcgcaaatatggagcgaattgcagaacagatcgcaacgttgtgtgccacgcttggtgaatacccatctgtcagatacaggagtgattttgataaaaacgtagagctagcccagatagtacagcagaagctggatgcctataaagctgacgagcctacgatgggggaagggccagagaagtctcgctcgcagctgctgatcctggaccgaggcttcgacgctgtctccccactcctccacgagctcaccctccaggcgatggcctacgatctccttcctatcgagaacgatgtttacaagtatgaagctacagctggagctccagaaaaagaagtgttgttggatgaaaatgacgaactgtgggtagagctacgccatcaacatattgctgtagtatcacagaatgtcacaaagaatctaaagaagttcacagagtctaagcggatgccacaaggagacaagcagtcgatgagggacctgagccagatgatcaaaaagatgccgcaatatcaaaaagagctcagcaaatattccactcatttgcacctcgcggaagattgcatgaacgcttaccaaggccatgttgataagctctgcaaggttgaacaggacctagcgatgggtaccgatgctgaaggagagcgtatcaaggaccacatgaggaacatcgtcccgatcctcctcgaccagtcggtctccaactacgacaagatgaggatcatcctcctctacaccctctccaagaacggtatttccgaggagaacttgaacaagctcgtccagcatgctcagattcagccgcacgagaagcaggccattgtcaaccttggcaatcttggtctcaatgttgtcgttgatggtactcgtatcaagaagccatacgtgcctcctaggaaagagcgtatcaccgagcagacttaccagatgtcacgttggacgcccgtgatcaaggatcttatggaagattgcattgacgacaagctcgacctcaagcacttccccttccttgccgggagggctgcgtcttcaggataccacgctcctgccagcgtgcgatacggacactggcacaaagacaagggccagcagaccgtcaagaacgtgcctcgcatcatcgtcttcatcatcggtggcatgagcttctcagagatccgatgtgcctacgaagttaccaacgcagttaaaaactgggaggtcataattggttcttcgcacatcctgacccctgaagacttcctcagtaacctcgccaacttgagcaactag

SEQ ID NO: 1648 - DNA, 2208 bp, Piezodorus guildinii
ataacctggttatgttattattttgatttagcagggttaaattctactcttttcataatgatgcaacaatatatgaaagaattggaacaagatccctatagttatgaagatttcgttgaacgtttagcttggagaactgttgatggcttcaaggaagatggaattcatggatttgatccaaatttaatgcacgaaacatttctccaagcaattaaggatttgcaggttctgctagatcgtcagtgtaaaaaatgtgaaaaacttgaactgatttgcaaggaagaagaagccaatcatttccaagatatatcccatttgcaggacaaaaataaggaagctgttgctttatttcaagatttggatgaaagaataaattttgttgctactaaagttatacatttaggggatcagttagaaagtgttaatgttcccagatctagagctgttgaggcacaaaggctgatgacatattttagtgaatttcttagccctggacctgttctcgctagtgttttttcaaataaagaagaggtatttgaagctgctgatattatacagaagcttcatatgatctcacaagaacttccttctgataaatttaaagatgcaagatcaaaaataagtttaaaatatgatgaaattgaaagatcgttaattgaagaattcgtgaagtcacatagggttcatgaaacaagcagaatgaaagaaattgcaaatattcttatgcatttcaagtcttactcacagtgtattgatgcatttattgaagaaagtcaaatgggaacatttgctggaaaagatatttttaaggaaatattacctcttacaaaaaaaaattttaacatcatgaaagaagtttttagcaaccctgaacaagttatggctaaatttgttttgaatatttaccacttaaaactgcagaaacatattgtaagcaacctttctgacaagtctgattctaataaatatctaagaaacttaatggaattatatactaggactactgagctatctgttgaattgagttgttttaaaatggggtctgatgattcatatcttcaaaagctaactcataccatatttcaaaaatatttagaatcatacattagtgtagaagttaagggcttgaaggaaaaatgctcaacattattacaaaaatattatgattctaaagatcaccacaaacgacaaatacagtctggaggattccaagattttagacgtgatcttcaagctgtgattggcacaagggctaacattaatattgctcaaattgaagattacggaggagaaacatttttatctgaagaattagttataagtctgatacaagagtccaagcaggcattttacagatgtaaattgctctctaaacctgcagacttagcaagtaatgcagttcagttgttagaagttctattaaattgtattataattgatcatgttgattatgctgtagaattagctttacaagcagtaccaattcctgaaagtaaaacacaggctcagccaatttatttctttgatgttgtaagacagacaaatacaattgtgcatctggttgaaaaacacttcaacgattctgcacttcctttagtaatgtcaacttctaagcatggagaatgtgtaatgaaaaaaaaattcctactgaaccatttagaacagaaacttgacaatggcatcgatcgggctctgaatgctatagttggatgggtaaaagtttttcttcagtctgagcagaaaaagaccgatttcaaacctgaaactgaattgaatacattatcatcccctgcttgtatagctgtggtggaatactttaatgataatgtcaaacacatcagatcttgtctggatggcagaaatattgaatgtgtaatgacagaattgggttgtcgttttcatagagtaatttatgaccatttgcaacagtttcaatacaattcaacaggtgcactttgtgtgatatgcgacatgaatgaatatagaaaatgtgtgaaagaacttaattctgtcttggttaatactttgtttgatactttacatgctctttgcaatgttctactagtgaaacctgaaaaccttgatcaagtgtgcactggtgatcagttgtctctcttagatcgttctgtcgttttaaattttatccagttgagaaatgattacaagactcagaagttatcaaattttctgaaaggaatgtctgcttga

(The sequence listing continues in the following parts.)

What is claimed is:

1. An interfering ribonucleic acid (RNA) molecule wherein the interfering RNA molecule comprises at least one dsRNA having annealed complementary strands, one strand of which is complementary to a target nucleotide sequence within a pest insect target gene, and comprises SEQ ID NO: 5037, or the complement thereof; wherein the interfering RNA molecule has insecticidal activity on a hemipteran plant pest, wherein said hemipteran plant pest is *Nezara viridula*.

2. The interfering RNA molecule of claim 1, wherein the RNA comprises at least two dsRNAs, wherein each dsRNA comprises a sequence of nucleotides which is complementary to a target nucleotide sequence within the target gene.

3. The interfering RNA molecule of claim 2, wherein each of the dsRNAs comprise a different sequence of nucleotides which is complementary to a different target nucleotide sequence within the target gene.

4. The interfering RNA molecule of claim 1, wherein the dsRNA is a region of double-stranded RNA comprising fully complementary annealed strands.

5. A nucleic acid construct comprising the interfering RNA molecule claim 1.

6. A nucleic acid molecule encoding the interfering RNA molecule of claim 1.

7. A nucleic acid construct comprising a nucleotide sequence that encodes the nucleic acid molecule of claim 6.

8. The nucleic acid construct of claim 5, wherein the nucleic acid construct is an expression vector.

9. A recombinant vector comprising a regulatory sequence operably linked to a nucleotide sequence that encodes the interfering RNA molecule of claim 1.

10. An insecticidal composition for inhibiting the expression of a *Nezara viridula* insect target gene, comprising the interfering RNA of claim 1 and an agriculturally acceptable carrier.

* * * * *